United States Patent 7,314,974 (EXPRESSION OF MICROBIAL PROTEINS IN PLANTS FOR PRODUCTION OF PLANTS WITH IMPROVED PROPERTIES) - sequence listing, part 5

SEQ ID NO: 16326 - protein, 733 aa, Xanthomonas campestris
CPFNHSVVGAGTTNRDWWPKQLRVDLLNQHSARSNPLAASFNYAEAFKRLDLQTLKQELRALMTDSQDWWPADFGHYGPLFVRMAWHSAGTYRTGDGRGGGGRGQQRFAPLNSWPDNVSLDKARRLLWPIKQKYGQAISWADLMILTGNVALESMGFKTFGFAGGREDTWEPDQDLYWGRETKWLGGDDRYAHGSPGVDQAHGVLVKDDDSEVQHTRDLENPLAAVQMGLIYVNPEGPDGNPDPLLAAKDIRDTFGRMAMNDEETVALIAGGHTFGKTHGAADAAHVAAEPEASDLESQGLGWHNSFGSGKGGDTITSGLEVTWTTTPAQWSNDFFDHLFGFEWELSKSPAGAHQWVAKNAQAIIPDAHDASKKRLPTMLTTDLALRIDPAYEAISRRFHANPDQFADAFARAWFKLTHRDMGPRARYLGADVPAEELLWQDPIPALNHALIDAQDAAALKQTVLSSGLSVAQLVATAWASASSFRGSDKRGGANGARIRLAPQKDWASNEPAQLAQVLATLERIQADFNARQSGGKQISLADLIVLGGNAAVEQAAHAAGHAVTVPFAPGRMDASQAQTDVESFAVLEPVADGFRNYAKARYAVSAEALLIDKAQLLTLTAPEMTVLVGGLRVLGANTGQSHNGVFTTRPGVLSNDFFANLLDMRTEWKATSETKETYEGRDRATGEHKWTGTRVHLVFGSNSILRAVAEVYASAHDQQKFVQDFVPAWTKV

SEQ ID NO: 16327 - protein, 492 aa, Xanthomonas campestris; identical to SEQ ID NO: 15966

SEQ ID NO: 16328 - protein, 410 aa, Xanthomonas campestris; identical to SEQ ID NO: 15585

SEQ ID NO: 16329 - protein, 271 aa, Xanthomonas campestris; identical to SEQ ID NO: 15967

SEQ ID NO: 16330 - protein, 588 aa, Xanthomonas campestris; identical to SEQ ID NO: 15968

SEQ ID NO: 16331 - protein, 592 aa, Xanthomonas campestris; identical to SEQ ID NO: 15969

SEQ ID NO: 16332 - protein, 405 aa, Xanthomonas campestris; identical to SEQ ID NO: 15595

SEQ ID NO: 16333 - protein, 849 aa, Xanthomonas campestris; identical to SEQ ID NO: 15976

SEQ ID NO: 16334 - protein, 421 aa, Xanthomonas campestris
WKPETIAVHGGYRPDPTTRAVAVPIYQTVAYAFDDTQHGADLFDLKVQGNIYSRIMNPTNDVLEQRVAALEGGIGALALASGQAAVTYAIQTIAEAGDNIVSSSALYGGTYNLFAHTLPQFGITTRFADYRDPQAFAGLIDERTKAVFVESIGNPRGNITDIEAVAAVAHAHGVPLIVDNTVATPSLLRPIDFGADIVVHSLTKYLGGHGNSIGGAIVDSGRFPWAAHKARFACLNEPDVSYHGVVYTEALGEAAYIGRARVVPLRNTGAALSPFNAFLILQGIETLPLRMERINANTLAIARYLQEHARVAWVNYAALPDHPEHALAQKYLGGHGSGVLTFGLPGGRAAGARFLDALQLFTRLVNIGDAKSLATHPASTTHRQLGPAELEHAGVSEDTVRLSIGIEHIDDLLADLEQALQ

SEQ ID NO: 16335 - protein, 786 aa, Xanthomonas campestris
GGRLVAVGGSWYYVLAGIAVLVAGVLLALGKRAGLWLFGATLAATIVWALWEVGLDGWGLIPRLAWISVLGLVLLPFWGVARRRMQPLSGLGYVVVTGVLPVLGAALILWPLLVPRNVELADASKQPADAATPFSRGSVPSPDGNVAANHDASNWTAYAGSNLSNHYTPGAQITPENVKGLKVAWEFHTGDLKPKDSKLGYAFQNTPLKVGDLLYICTPTQKVIAVEAANGKERWRFDPQTNPKAMAGVAATTCRGVSYYQAPEGTAECPTRIFWPMVDGRLGALDAQTGKLCASFGNNGYVDLNAGTGNTKPGFVGPTSPPVVMRGVVIQPTGQVRDGQERDAPSGVVRGFDALTGQLRWAWDLGNPAITAEPPAGQTYTRSTPNVWSLMAADDELGLVYLPTGNAAGDFFGKGRTPQEEEYTASLVAVDAATGKERWHFRTVNHDLWDYDIGPQPNLVDWPVAGGGTRPAVIQATKSGQVFVLDRATGQPIMPVKQIAVPQGTDHGDWTASTQPVSPGMPNTVGAPSRDYETIVESDAWGMTPFDQLACRIEFKKLRYEGMFTPPSLQGSLSFTGNHGGINWGGVSVDLQRGIMVMNSNRLPYTEHVYPRTVMNELGVVSVFNGSSKTKGYMAQEGLAYGARKEPWMSPLNTPCVAPPWGYISGVDLRTQQVIWRRPLGTGYDQGPMGIPSKTKFEIGTPNNSGSLATAGGVTFIGASLDNFIRGFDTRTGKQVWETRVPAGPQAAPLSYTIDGKQYIVAAVGGHVRMETKSKNSVFAWALPDD

SEQ ID NO: 16336 - protein, 452 aa, Xanthomonas campestris; identical to SEQ ID NO: 15597

SEQ ID NO: 16337 - protein, 486 aa, Xanthomonas campestris
GGFAEPYRWTTYVEQLQRAGVSWQIYQDMRDNFTDNPLAGFDVFRQAYSQTPGHDAQLRARGVSTRGVEQLREDVIGGRLPSVSFIIADAAGSEHPDPSSPAQGAAYTARVLDALTADPQVWSRTALLLMFDENDGFFDHMPPPAPPSPDPRAAGGFAGASSIATDDEYHRHPAPGEQKVDLPEWRGRPYGLGPRVPLYVLSPWSRGGWVDSQVYDHTSVLRLLERRFGVPCTAITPWRRAVCGDLTAAFDFSRTDTRPFVGTLPDISATATRAAALHQHTLPPLPPTLQPPEQAFGLRRSRAVPYRPRVQLDVVQARGEVVLRMANAGAAAVLHVYERYDLAAIPRRYTVGADAPLDGTWTTYDGRYDLWVLGPNGFHRHYRGDVGVAPLIADVAQDPGDAQALRLTLHNPGNVPVAVTLQPAAYANAQPREGVTIAPGQHHQRSWSAAATGGWYDLWIEHDGASQRLAGRVETGADSVSDPAMG

SEQ ID NO: 16338 - protein, 482 aa, Xanthomonas campestris; identical to SEQ ID NO: 15604

SEQ ID NO: 16339 - protein, 259 aa, Xanthomonas campestris; identical to SEQ ID NO: 15986
  unsure (1)..(259): unsure at all Xaa locations

SEQ ID NO: 16340 - protein, 675 aa, Xanthomonas campestris; identical to SEQ ID NO: 15980

SEQ ID NO: 16341 - protein, 570 aa, Xanthomonas campestris; identical to SEQ ID NO: 15608

SEQ ID NO: 16342 - protein, 334 aa, Xanthomonas campestris; identical to SEQ ID NO: 15984

SEQ ID NO: 16343 - protein, 87 aa, Xanthomonas campestris
VIDLSPTADFEKGHIAGSRNVALAKFDPAGKLLANAKSSPVVVVCRSGNASAGAAKTLKKAGFEQVYWLEGGIAAWQMAELPLVKGR

SEQ ID NO: 16344 - protein, 421 aa, Xanthomonas campestris
RPVAILGGVRIPFCRQNTAYADVGNLGMSVRTLGALVERFGLHGQQLGEVAMGAVIKHSSDWNLAREAALSSGLSPLTPGITLQRACGTSLDSVITIANKIALGQIDSGIGGGSDTTSEVPIVYGKKLRARLLAANRAKATSDKLKALLRGFKLGELKPEFPGVAEPRTGKSMGEHCEDMAKEWNISRDSQDEWAVASHHKLAAAYERGFFDSLIAPFRGVSRDNILRADTSLEKLATLRPAFDKTSGRGTLTAANSTPLTDGAAAVLLSSEAWALAHGHTPMAYLRDAQVSAVDFVHGEGLLMAPTVAVPQMLARHGLTLQDFDIYEIHEAFAAQVLCTLRAWESEDYCRNRLGLDAPLGRIDPDKINPLGSSLATGHPFAATGARVVATAAKQLEERGGGRALISICTAGGMGVVAIVE

SEQ ID NO: 16345 - protein, 321 aa, Xanthomonas campestris; identical to SEQ ID NO: 15612

SEQ ID NO: 16346 - protein, 306 aa, Xanthomonas campestris
STLAFVFPGQGSQSLGMLAELAELHPQIRETFVEASDGAGVDLWALSQGGPEEMLNRTEYTQPALLAAGVAVWRLWNAQRGERPAVLAGHSLGEYTALVAAGALSLHDGAHLVRLRGQFMQAAAPAGVGAMAAVLGAEDALVREVCVEASGSQVVVPANFNSPGQIVIGGDAAAVDRALALLAERGVRKAVKLAVSVPSHTPLMREAANQLGEAMAGLTWHTPQIPVVQNVDAQVHAGHEAIRQALVEQLYLPVQWTGCVQALAAQGISRIAECGPGKVLSGLIKRIDKSLDARSLATPADYAGAL

SEQ ID NO: 16347 - protein, 242 aa, Xanthomonas campestris; identical to SEQ ID NO: 15989

SEQ ID NO: 16348 - protein, 75 aa, Xanthomonas campestris; identical to SEQ ID NO: 15990

SEQ ID NO: 16349 - protein, 409 aa, Xanthomonas campestris; identical to SEQ ID NO: 15616

SEQ ID NO: 16350 - protein, 1013 aa, Xanthomonas campestris
LRAAITAAWLKDETEHVRELLEQARLPAAEQAKVQALAADLVTRVRARAQDQGAIEAFMRQYDLGSEEGVLLMCVAEALLRIPDQDTADKLIRDKLGEADWKKHVGGSDSVLVNASTWGLMLTGKLVQLNDLTRADVPGAFKRLIGRVGEPVIRLAVRQAMKIMGHQFVMGRTIGEALARSRKGDNANYRYSFDMLGEGALTMKDAQRYLQAYRDAIHAIGRSGSFVGTDVFAAPSISIKLSALYPRYEHAKRARVMAELVPGVLELAQLAKSYGIGYTVDAEEADRLELSLDIIEATFSDPSLDGWEGYGLAVQAYQKRTPYTIDFLADLARRVGRRIPVRLVKGAYWDAEIKRAQIDGHPGYPVFTRKQNTDVSYLACARRMFAHSDALYPMFATHNAQTIAAVRAISAGKTYEHQKLHGMGDDLYAEVIPADRLGLPCRVYAPVGSHEDLLPYLVRRLLENGANSSFVNRITDEDVAIEDLIRDPVEAVSSFASIPHPKIPLPADLLRSQNQNRKNSMGANLANDNDLRQLADQLTAAIKPWNAAPLVPGAVITTPSEAVLNPADRRETVGHWQPADPATVQKALASAAAAQPAWNRTPAASRATILEHAADLLEARMPEFMAICVKEAAKTLPDAVAEVREALDFLRYYAAQARAQFGAPERLPGPTGESNELQLHGRGVFVCISPWNFPLAIFLGQVAAALAAGNAVIAKPAEQTNLVGFAAVKLLHEAGVPEAAVQFLPGDGATVGAALTNDPRVAGVAFTGSTDTARIINRTLAARDAAIGVLIAETGGQNAFIADSSSLPEAVVKDAISSAFISAGQRCSAARVLFVQEDIADKVMTMLAGAMGELKIGDPALLSTDVGPVIDADALKILEEHASRMDSEARLIGTTTLDSATAYGSFFAPRAYELKSLAQLQREIFGPVLHIIRWKADQLDSVIDQINATGYGLTLGVHSRIDETIDRITSRVAVGNVYVNRNQIGAVVGVQPFGGQGLSGTGPKAGGPHYLLR

SEQ ID NO: 16351 - protein, 204 aa, Xanthomonas campestris; identical to SEQ ID NO: 15617

SEQ ID NO: 16352 - protein, 268 aa, Xanthomonas campestris; identical to SEQ ID NO: 15999

SEQ ID NO: 16353 - protein, 349 aa, Xanthomonas campestris; identical to SEQ ID NO: 15625

SEQ ID NO: 16354 - protein, 423 aa, Xanthomonas campestris; identical to SEQ ID NO: 16001

SEQ ID NO: 16355 - protein, 158 aa, Xanthomonas campestris
APLQIRPATPADAALLHELVTALAVYEREPDAVKATPEDLRASLFGDGATAHALLCEQGGQVLGFAVYFFNYSTWLGRNGLYLEDLFVRPQARGQGAGLALLRHLAQLAVDKGCGRFEWSVLDWNQPAIKFYQAVGARPMECWTVYRLDGERLAAFAA

SEQ ID NO: 16356 - protein, 293 aa, Xanthomonas campestris; identical to SEQ ID NO: 16004

SEQ ID NO: 16357 - protein, 323 aa, Xanthomonas campestris; identical to SEQ ID NO: 15997

SEQ ID NO: 16358 - protein, 615 aa, Xanthomonas campestris
EFLATMSHEIRTPLNGIIPMLELISRGQLSLDQRDMLQTATGSSLQLLRIVDDILDYSKLEANKLELEITTFNLRELLDGVAQLMQRTAEGKQLRLGLDIEPSVRLLVRGDPIRLRQVLGNLIGNAIKFTERGSVDIQLRRLGETRAQHLLRFQVRDTGIGIAADQQARLFRSFAQADASTTRLYGGTGLGLAICKRIIDLMGGRIGVESEPGRGATFWFEIPLLKVIGDLQQTTGADAARVMVISSDARLSQRLKRLLDSWGISHVLMETTQEALERVRRHHRRRRLPLRHRRPRDAALQRARRASRPGTAGRPQRLTAIWLYGDEPVPDELQANATLVPRQSPDETLRALVLPPEPKPSVAPTLASAMIPEPLPPPVAHARDVRILLVEDNPVNLLVAQKLLGVLGFEADTATDGEAALSSMESTRYDMVFMDCQMPVLDGYAATRRWRAMETESGGRPIPIVAMTANAMAGDRERCLAAGMDDYLSKPVAREQLNACLQRWLPRQALLPGPSTGAPSADAESAASAAQARALPILESGVIDELYEVAGADTIRILQLFLEDAPGIIEGLEAAASNRDSMHLRDLAHTLKSSSANVGAQALANAARRIELAAR

SEQ ID NO: 16359 - protein, 202 aa, Xanthomonas campestris; identical to SEQ ID NO: 16005

SEQ ID NO: 16360 - protein, 742 aa, Xanthomonas campestris; identical to SEQ ID NO: 15631

SEQ ID NO: 16361 - protein, 326 aa, Xanthomonas campestris; identical to SEQ ID NO: 16007

SEQ ID NO: 16362 - protein, 271 aa, Xanthomonas campestris; identical to SEQ ID NO: 16008

SEQ ID NO: 16363 - protein, 501 aa, Xanthomonas campestris; identical to SEQ ID NO: 16009

SEQ ID NO: 16364 - protein, 180 aa, Xanthomonas campestris; identical to SEQ ID NO: 15635

SEQ ID NO: 16365 - protein, 299 aa, Xanthomonas campestris; identical to SEQ ID NO: 15637

SEQ ID NO: 16366 - protein, 654 aa, Xanthomonas campestris; identical to SEQ ID NO: 15638

SEQ ID NO: 16367 - protein, 795 aa, Xanthomonas campestris
PSNPNNPGAMTTGKPVVYVLEDYGLSNALILDKACREAGLPSPLVPLPGDPLERKRAYLALSRRSSSNSLIPEQRGGKTHSDSLAKLLQAHRVRADLDVHLVPVSIFVGRAPDKQSGWFAVLFSENWALVGRFRRLLSVLLNGRTTIVRFAPPISLRQTMAEGLPPERTLRKLQRVLRTHFRRIREAVIGPDLSTRRLLVDQVLAADSVREAIATQAKRDNSKPVDAWRKAHAYAWEIAADYSSPVVRSASFLLTHVWNRIYAGVLVHHLDKLKQAAPGHEVVYVPSHRSHMDYLLLSYLLYERGIVPPHIVAGINLNLPVVGTLLRKGGAFFIRRSIRGNALYSAVLSEYVAQLVAGGYSIEYFVEGGRSRTGRLLQPKGGMIAMTLRAYLRQPRKPVLFQPVYIGYEKLMEGNSYLDELTGRPKEKESIWGLLWSIPKVLKQNYGQVVVNFGEPIALNDVLAKHAPEWNDEPLPDDEKPTWLAPAVDTLATQIQTRINCAADVNPINLLALALLSTPKHAMGEADLIAQIELCKKLLAEMPYSDRVTVTPHTPARIITHAEEINVLTRVSHPLGDVLSVSGDTAVLLSYFRNNVLHLFTASSWVACCFQNNRRMSRAGLLRLGRTVYPFLQAELFLPWSEDRFAERIEQTIDMFVREGLLLNVTDDDGGILARNTGQTDEVFRLRAIGHSLQQAFERYYIAISVLVKNGPGVLGAGELESLCQQAAQRLSLLYAPAAPEFFDKTLFRSFIQKLRELRLVWPDENSKLMFDERLDAWAKDAKFILGRELRHTIE

SEQ ID NO: 16368 - protein, 837 aa, Xanthomonas campestris; identical to SEQ ID NO: 15640
  unsure (1)..(837): unsure at all Xaa locations

SEQ ID NO: 16369 - protein, 372 aa, Xanthomonas campestris; identical to SEQ ID NO: 15641

SEQ ID NO: 16370 - protein, 304 aa, Xanthomonas campestris; identical to SEQ ID NO: 15642

SEQ ID NO: 16371 - protein, 295 aa, Xanthomonas campestris
LLVVNLGTPESPTAPAVRRYLAEFLSDRRVVAIPPLFWKPLLYGVILPIRGPKSAEKYAKVWLPDGSPLAVYTRRLTEGLQQVMPDWHVTWAMRYGAPALRKALDGLRARGIKRIVVLPLYPQYSTTTTASIQDVVDAWRPSAPEIAVEVIQDYCEDAGWVAAIADSIRTHWQVHGRSEKLMFSFHGLPQRVANAGDPYPQQCERSAQAIVTALGLGPDAWQMGYQSRFGAERWLQPYAEPTLWALAEGGVRSFDLVCPGFATDCLETLEEVALGFAETLAERGATLSYIPCLND

SEQ ID NO: 16372 - protein, 94 aa, Xanthomonas campestris; identical to SEQ ID NO: 15645

SEQ ID NO: 16373 - protein, 475 aa, Xanthomonas campestris
MHATSRPCPRTFWQRAHQLLLIALTLLLTTASAQADVILHAFNWPYATVEARAKQIADAGYRKVLVAPAYRSEGSAWWARYQPQDIRLIDNPLGDTTAFARMVQALANNGVETYADVVFNHMANEAATRSDLNYPGSAVLAQYAANPGRYDALRLFGTVQSNFLSASDFGPAQCISNYNDAFQVRNYRICGGGSDPGLPDLLGNDWVVQQQRAYLQALKGLGVTGFRVDAAKHMTFDHLNRVFDAGIRSGVYVFGEVITGGGSGNGDYDQFLAPYLQSTPHAAYDFPLFNAVRNAFGVGASMQQLVDPASTGQALPGNRAVTFAVTHDIPNNAGFRYAILDPVDETLAYAYLLGRNGGVPMVYTDNNESGDNRWVNAYLRDDLRRMIGFHNGVQGSDMQVLSSSACHILFRRGSLGIVGINKCGNPVNTTVAMNGSVLFWNADYVDALGSGTVVRISSGSYTFTLPARQARMWRR

SEQ ID NO: 16374 - protein, 426 aa, Xanthomonas campestris
MTLWVLGLNHQTAPVDLRERAAFAGDALPRALESLRALPQVSEAALLSTCNRTELYAMAEEAHSLVTWLETHAPALSGYLYQHQEAEAVRHLFRVATGLDSMVLGEPQILGQVKDAWAVARAHGTLGSGLDRLFQQTFSVAKRARTDTRVGANPVSVASTAVRLAQDSFARLNESTVLLIGAGETIELAAKHLSEGRVRRLLIANRTLAHAQTLASQHGGFALPLTDLERHLAEADVVFSATAAREPLVTRAQVEQALRARKRKPMLLFDLAVPRDIEASVGELSDAYLYTVDDLERAVEDNRRGRREAADQAEAIIDLQVARYVETLQANARQAPLKRLRAFGDSTRDELLAKARQQLHNGKPADEVLEQLAHALTNRLLHPPTAALRDAALNNDLELTTAADRLFPEKPGLPTSPHSYPDREDR

SEQ ID NO: 16375 - protein, 429 aa, Xanthomonas campestris
MNHSRSHALFAQAQTLLPGGVNSPVRAFKSVGGEPFFVARADGPYLFDVDDNRYIDYVGSWGPMIAGHNHPAVREAVEQSIRNGLSFGAPCAAEVTMAQTIARLVPSCEMVRMVNSGTEATLSAVRLARGATGRNRIIKFEGCYHGHGDSFLVKAGSGMLTLGVPTSPGVPAGLSELTATLSFNDFEGATALFDEIGAEVAAVIIEPVVGNANCIPPQAGYLQHLRTLCTRHGALLIFDEVMTGFRVALGGAQAHYGVTPDLTTFGKIIGGGMPVGAYGGRRDLMEQVAPAGPIYQAGTLSGNPVAMAAGLAMLELVQEPGFHTRLSEATSMLCEGLEDAARAAGIAVTTNQVGGMFGLFFTDDVVESYAQATACDITSFNRFFHAMLQRGVYLAPSAYEAGFMSSAHDEAVIEATLAAAREAFADVAR

SEQ ID NO: 16376 - protein, 414 aa, Xanthomonas campestris
GKVVEVVGTMLKVAGVQVSLGEVCELRQRDGTLLQRAEVVGFSRDLALLAPFGELIGLSRETRVIGLGRPLAVPVGPALLGRVLDGLGEPSDGQGAIACDTWVPIQAQAPDPMRRRLIEHPMPTGVRIVDGLMTLGEGQRMGIFAAAGVGKSTLMGMFARGTQCDVNVIVLIGERGREVREFIELILGADGLARSVVVCATSDRSSIERAKAAYVGTAIAEYFRDRGLRVLLMMDSLTRFARAQREIGLAAGEPPTRRGFPPSVFAELPRLLERAGMGESGSITAFYTVLAEDDTGSDPIAEEVRGILDGHLILSREIAAKNQYPAIDVLASLSRVMSQIVPYDHSQAAGRLRRLLAKYNEVETLVQVGEYRQGSDAVADEAIDRIDAIRDFLSQPTDQLSAYENTLELLTSVT

SEQ ID NO: 16377 - protein, 351 aa, Xanthomonas campestris
VATWLVTRGAGFIGANFVLEAVSRGIRVVNLDALTYAGNLNTLASLEGNADHIFVKGDIGDGALVTRLLQEHQPDAVLNFAAESHVDRSIEGPGAFIQTNVVGTLALLEAVRDYWKALPDTRRDAFRFLHVSTDEVYGTLGETGKFTETTPYAPNSPYSASKAASDHLVRAFHHTYGLPVLTTNCSNNYGPYHFPEKLIPLVIAKALAGEPLPVYGDGKQVRDWLFVSDHCEAIRTVLAKGRVGETYNVGGNSERQNIEVVQAICALLDQHRPREDGKPRESQIAYVTDRPGHDRRYAIDASKLKDELGWEPAYTFEQGIALTVDWYLTNQTWVQGVLDGSYRLERIGATV

SEQ ID NO: 16378 - protein, 448 aa, Xanthomonas campestris
MTLPAFKAYDIRGRVPDELNEDLARRIGVALAAQLDQGPVVLGHDVRLASPALQEALSAGLRASGREVIDIGLCGTEEVYFQTDHLKAAGGVMVTASHNPMDYNGMKLVREQARPISSDTGLFAIRDTVAADTAAAGEPTAAEHSRTDKTAYLEHLLSYVDRSTLKPLKLVVNAGNGGAGLIVDLLAPHLPFEFVRVFHEPDGNFPNGIPNPLLQENRDATAKAVKEHGADFGIAWDGDFDRCFFFDHTGRFIEGYYLVGLLAQAILAKQPGGKVVHDPRLTWNTVEMVEDAGGIPVLCKSGHAFIKEKMRSENAVYGGEMSAHHYFREFAYADSGMIPWLLIAELVSQSGRSLADLVEARMQKFPCSGEINFKVDDAKAAVARVMAHYGDQSPELDYTDGISADFGQWRFNLRSSNTEPLLRLNVETRGDAALLETRTQEISNLLRG

SEQ ID NO: 16379 - protein, 493 aa, Xanthomonas campestris
MSIFRTASTLALATALALAAGPAFSYSINNSRQIVDDSGKVVQLKGVNVFGFETGNHVMHGLWARNWKDMIVQMQGLGFNAVRLPFCPATLRSDTMPASIDYSRNADLQGLTSLQILDKVIAEFNARGMYVLLDHHTPDCAGISELWYTGSYTEAQWLADLRFVANRYKNVPYVLGLDLKNEPHGAATWGTGNAATDWNKAAERGSAAVLAVAPKWLIAVEGITDNPVCSTNGGIFWGGNLQPLACTPLNIPANRLLLAPHVYGPDVFVQSYFNDSNFPNNMPAIWERHFGQFAGTHALLLGEFGGKYGEGDARDKTWQDALVKYLRSKGINQGFYWSWNPNSGDTGGILRDDWTSVRQDKMTLLRTLWGTAGNTTPTPTPTPTPTPTPTPTPTPTPTPGTSTFSTKVIASPVVGSAARKLPAASRLACHWPASSTGWRVWVIAAPSVTWKRPHAARAIERRMRVTRLRRATRLNRGPLPAPAHTTQHAPRLR

SEQ ID NO: 16380 - protein, 922 aa, Xanthomonas campestris
MSDSFSTRTSLEVNGQRYDYYSLPKLGERFDVARLPYSMKILLENLLRHEDGGVTVGKDHIEAVAKWDPTAEPDIEIAFMPARVVLQDFTGVPCVVDLAAMRDAVVKLGGNADQINPQIPSELVIDHSVQVDVFGKPEALDLNGKIEFQRNQERYGFLRWGQKAFDNFKVVPPNTGIVHQVNLENLARVVMSADKDGTQIAYPDTVFGTDSHTTMINGIGVLGWGVGGIEAEAAMLGQPSSMLIPQVVGFKLTGKLPEGATATDLVLTVTQMLRKHGVVGKFVEFYGEGLQHLPLADRATIGNMAPEYGATCGIFPVDNESLTYLRLSGRSEEQIALVEAYAKAQGLWHDADTPHAQYSATLELDMGDVKPSLAGPKRPQDRVLLEDMQSNYRESLKPFAEARSKRLADTKQEDRLKNEGGGGTAVGAKASQAESAGDSGAGWQLRDGSVVIAAITSCTNTSNPAVMLGAGLLARNAAAKGLKAQPWVKTSLGPGSRVVTDYLSKAGVLADLEQLGFYVVGYGCTTCIGNSGPLPEDVSAAIAKDDLVVTSVLSGNRNFEGRVHPEVKMNYLASPPLVVAYAIAGTTDIDLNPRPVRHRQDGQPVYLRDIWPSNKEIGDTIAATVGPEMFKQNYADVFKGDTRWNTIASPDGALYEWDAGSTYIKNPPYFEGMTMQVGHVDDVHGARIMGLFGDSITTDHISPAGNIKKDSPAGRFLQERGVQPADFNSYGSRRGNDDVMVRGTFANIRIKNLMFGGEEGGNTLYFGKDGATPEKLAIYDAAMKYKADGVPLVVLAGKEYGTGSSRDWAAKGTNLLGVKAVVAESFERIHRSNLVGMGVLPLQFLEGENAQTLGLDGSEVLDITGLQDGASRRATIDAKKSDGSVKQFQVKVLLLTPKEVEYFKHGGLLQYVLRQLAARKAA

SEQ ID NO: 16381 - protein, 837 aa, Xanthomonas campestris
LSSPSIAPVTPDLVRLRATARDKDDAIAQAAQLLVAAGCVAPGYDASMRRREGLANTFLGHGLAIPHGVGEDRHLVRRDGIAVLQLPEGVEWNPGQTTRLVVGIAAQSDTHITLVRRLTRLIQDPAQLEALFTTDDPAVIVAALTGDRAPDTSAAPATDLAERFEWTIAYPSGLHARPATRWAETARGFSARAQVRAGDQAADAKSLVGLLQLGLRAGDSITVSAKGSDAPALLKRLRAVMDSLTAQEKADAERAAQRRAAPVIGWTPPQAQPAIVGIGASPGVAIGIVHRLRAAQTEVADQPIGLGDGGVLLHDALTRTRQQLAAIQDDTQRRLGASDAAIFKAQAELLNDTDLITRTCQLMVEGHGVAWSWHQAVEQIASGLAALGNPVLAGRAADLRDVGRRVLAQLDAAAAGAGLTDLPEQPCILLAGDLSPSDTANLDTDCVLGLATAQGGPTSHTAILSRTLGLPALVAAGGQLLDIEDGVTAIIDGSSGRLYINPSEQDLDAARTHIAEQQAIREREAAQRALPAETTDGHHIDIGANVNLPEQVAMALTQGANVGLMRTEFLFLERGSTPTEDEQYHTYLAMAQALNGRPLIVRALDIGGDKQVAHLESPHEENPFLGVRGARLSSRRPDLLEPQSRALYRAAKDGARLSIMFPMITSVPELISLREICAAIRAELHAPELPIGIMIEVPAAAAQADVLARHADFFSIGTNDLTQYVLAIDRQNPELAAEASSLHPAVLRMIRSTIDGARKHDRWVGVCGGLAGDPFGASLLAGLGVQELSMTPNDIPAVKARLRGRALSALQQLAEQALHCETAEQVRALEAQREGQA

SEQ ID NO: 16382 - protein, 560 aa, Xanthomonas campestris
MSQARPWLQSYPAGVAAEIDLEQFSTVAEVFATSVARFADRPAYHSFGKTITYREADQLVDQFAAYLLGELQLKKGDRVALMMPNCLQYPIATFGILRAGLTVVNVNPLYTPRELKHQLIDSGSSVLVVIDNFGTTVQQVIADTQVKQVITTGLGDMLGFPKAALVNFVVKYVKKLVPEYRINGAIRFRDALALGRKHRVPTLQIEPDDIAFLQYTGGTTGVAKGAMLTHRNLVANMQQAHQWLAGTGKLEEGHEVVITALPLYHIFALTANGLVFMKIGGCNHLISNPRDMPGFVKELKKTRFTAFTGVNTLFNGLLNTPGFDQIDFSSLKMTLGGGMAVQRSVAERWKQVTGLTLVEAYGLTETSPAACINPMDLVDYNGSIGLPIPSTDACIKDDDGKVLALGEIGELCIKGPQVMKGYWKKADETAKVMDAEGWLHTGDIARMDERGFVYIVDRKKDMILVSGFNVYPNEIEDVIATMPGVLEVAAVGVPDEKSGEIVKVVIVKKDQALTAEDVKAHCRTNLTGYKQPRVIEFRKELPKTNVGKILRRELRDAAKA

SEQ ID NO: 16383 - protein, 414 aa, Xanthomonas campestris; identical to SEQ ID NO: 16376

SEQ ID NO: 16384 - protein, 324 aa, Xanthomonas campestris
MSKRIRKAVFPVAGLGTRFLPATKTVPKEMLPIIDKPLIQYAVDEAIQAGCDTLIFVTNRYKHSIADYFDKAYELEQKLERAGKLEQLELVRHALPEGVRAIFVTQAEALGLGHAVLCAKAVVGDEPFAVLLPDDLMWNRGDAALTQMADVAEASGGSVIAVEDVPHDKTASYGIVSTDAFDGRKGRINAIVEKPKPEVAPSNLAVVGRYVLSPKIFEYLESTGAGAGGEIQLTDAIAELLKQEQVDAFRFEGRRFDCGAHIGLIEATVHFALEHEKHGAPAKEIIRSALAAADARVSVRLAVLQRTAPLAPFWVRALEEWCHA

SEQ ID NO: 16385 - protein, 435 aa, Xanthomonas campestris; identical to SEQ ID NO: 15541

SEQ ID NO: 16386 - protein, 445 aa, Xanthomonas campestris
MRVAIFGTGYVGLVTGTCLAEVGHHVICVDIDQAKVDGLNRGVIPIYEPGLEPMVKGNHASGRLRFTTDAAEAIAHGEITFIAVGTPPDEDGSADLQYVLAVARTVGRHIDGPSVIVNKSTVPVRTADKVRAAIQEELDARGVDHEFDVVSNPEFLKEGDAVADCMRPDRIVIGAKKPAAIARMRRLYAPFNRNRDRIVEMDVRSAELTKYAANAMLATKISFMNEIANIAERVGADVEHVRNGIGSDPRIGWHFIYPVPATARASRRCAGARKTAHEYGMQPTLLNAVESVNNAQKGHLFELVQRHYADGNGSIAGKTFAVWGLAFKPNTDDMRAASSRRLMASCGKPVPRCARTTPKPRTKPSASSASATTWRSATTPSPHWKRRRAGRGHRVEAVPQPGFRQDQAGSEGRRRVRRPQPVRPAGDRSRRSAYYAIGRGRSLHA

SEQ ID NO: 16387 - protein, 598 aa, Xanthomonas campestris
MLRTTLAPLVLALALALPAAAATPESWPTFGTQGTQFVRDGKPYQLLSGAIHFQRIPRAYWKDRLQKARALGLNTVETYVFWNLVEPQQGQFDFSGNNDVAAFVKEAAAQGLNVILRPGPYACAEWEAGGYPAWLFGKGNIRVRSRDPRFLAASQAYLDALAKQVQPLLNHNGGPIIAVQVENEYGSYADDHAYMADNRAMYVKAGFDKALLFTSDGADMLANGTLPDTLAVVNFAPGEAKSAFDKLIKFRPDQPRMVGEYWAGWFDHWGKPHAATDARQQAEEFEWILRQGHSANLYMFIGGTSFGFMNGANFQNNPSDHYAPQTTSYDYDAILDEAGHPTPKFALMRDAIARVTGVQPPALPAPITTTTLPATPLRESASLWDNLPTPIAIDTPQPMEQFGQDYGYILYRTTITGPRKGPLYLGDVRDVARVYVDQRPVGSVERRLQQVSLEVEIPAGQHTLDVLVENSGRINYGTRMADGRAGLVDPVLLDSQQLTGWQAFPLPMRTPDSIRGWTGKAVQGPAFHRGTLRIGTPTDTYLDMRAFGKGFAWANGVNLGRHWNIGPQTALYLRPSSARVTTRWWSSTWTMLHPSVRG

SEQ ID NO: 16388 - protein, 340 aa, Xanthomonas campestris; identical to SEQ ID NO: 15392

SEQ ID NO: 16389 - protein, 560 aa, Xanthomonas campestris
MTTLQISGMTCASCADHVKDALEKIPGVHQADVSYASGKAELTVDKRVNHEQMQAAVEALGYRAAFEDATLQPRPGLLDQAPGWLSGGIGAGKEDVRLHVAVIGSGGAAMAAALKAVEGGARVTLIERGIIGGTCVNVGCVPSKIMIRAAHVAHLRRESPFDGGLSATTPTVLRERLLAQQQGRVDELRHAKYESILESTPAISVLRGTARFQDGHTLSVELAEGGERIVAFDRCLVATGASAAVPSIPGLKDTPYWTSDEALVSDSIPQRLAVIGASVVAVELAQAFARLGSRVTILARSSMFFREDPAIGAAVTEVFRMEGIEVLEQTQASQVSQPNGEFVLSTNHGELRADQLLIATGRLPNTQGMNLDGAGVTLDERGGIQIDRGMRTSARDIYAAGDCTDQPQFVYVAAAAGTRAAINMTGGEATLNLDVMPSVVFTDPQVATVGYSEAEAHNAGLETDSRTLTLDNVPRALANFDTRGSSSWCAEAGSGRLLGVQAVTPEAGELIQSAVIAIRARMTVQELADQLFPYLTMVEGLKLAAQTFTKDVKQLSCCAG

SEQ ID NO: 16390 - protein, 702 aa, Xanthomonas campestris
MAKSPSKSAQVPALAPVSATVDGARGTGDELHQKAGGTHPQLTTNQGIPVGDNQNSLRATPRGPTLLEDFILREKITHFDHERIPERIVHARGSAAHGYFELTKSLSQYTTAKIFTEVGEKTPLFTRFSTVAGGAGSVDTPRDVRGFAVKFYTKEGNWDLVGNNIPVFFIQDAMKFPDLIHAVKMEPDRGFPQAASAHDTFWDFISLTPESMHMVMWAMSDRTIPRSLRMIEGFGIHSFRFLNDKGESTFVKFHWRPKLGLQSTIWDEAVKIAGADQDFHRRDLFEAIQNGDFPEWELGVQLFTEAQAATFPFDHLDSTKVIPEELVPLQIVGRMVLDRWPDNFFAETEQVAYCPANIVPGIDFSNDPLLQGRLFSYLDTQLSRLGGPNFHQIPVNAPKCPFANNQRDGHMQMGVPKGRVAYEPSSLQADAPREALRGFPSHATPAEEGAKGRVRAESFADHYSQARLFFRSQTAPEQAHIASALVFELSKVETAHVREAIVGHLRHIDQELAQRVADGMGMTALPPAPPAAVAPIDMPLSPALQVIGKMKDTLKGRTVGILIHDGSDAAAIKAVRKAAEAAGATVKIVAPKLGGAKLSDGKQLAADGQLAGTPSVVFDAVAVLLSSEAAKLLTRESAALNFVSFAWAHLKAIAFDEGAQVLLKAGNVGKDAGVVPAADTKAFITAAKTRQWAREPKVRMLA

SEQ ID NO: 16391 - protein, 526 aa, Xanthomonas campestris
MSSSCRFRPLSFLLAAALGASAAFAPSVHAADAAPATPRSEGSGVWYEIFVRAWYDTDGDGIGDLNGVTAKLDYLQSLGVSGIWLMPINPSPSYHGYDITDYEGINPQYGTMADFEKLVSEAHKRGIEVILDLVINHTSDQHPWFKAALDPKDAHRSWYTWAGPGTNLKAVSAVGGPAWHANGKQHYLGDFTGAMPDLNYDEPAVRREMIAVGKFWLDKGADGFRLDAARHIYDDLESDNGQPAVIARNAQWWNEFRQGLRQVRPDVYLVGEVSAKQPGELAPYLPALGSVFDFPLAEQLIASAGQEKAGKLPALLTETYAAFRAAAGDDYADAPFLSNHDQERVLSQLGGDLRHMRTAAAMLLTLPGRPYLYYGEEIGMLGRKPDENLREPMRWQRQAGAPGDSRWKPYSVKQGGEVSVQAEQDRPDSLLSFYRTLIHWRVEVPALRDGALRVVDTGAPALVAYERVTADSRALVVHNLSGKPASMKLGADRAKAFAAIRLHSAPGATLTEGRLTVPAYATVVLQ

SEQ ID NO: 16392 - protein, 790 aa, Xanthomonas campestris
MLIALVGLIFLLGGARLASLGGSWYFLLMGLATALAGVLIVLRRPAGALVYGVAFALTLVWALWDAGLEFWPLVSRLMLPAAFAVLVALAWPALRRSRALPTGRTAYGVATVLALAVVAGIGGMFVPHPPVAGNAGPGMTAVPPGSVQQNWSAYGNTDGGSRFAALDQINRSNGRPAAGSPGPTTPGEIANSDGNGAEDQLTPLQVGEKVFLCTPHNNLIALDASTGKQLWRREINATSSVWQRCRGLGYFDADAALPAPSVANPSPIAAVTVAQGANCRRRLFTNTIDGRLIAVDADTGAFCQGFGSNGQVDLKAGLGAAPDPFYQLTSPPLVAGTTVVGGRTRADDNVQTDMPGGVVRGSMWSPVRSAGLDPGNPHDRQAPAAGSSYVRSTPNVWAPMSYDAAMNTVFLPLGGPSTDLYGAERTALDHRYGASVLALDATTGAEKWVYQTVHNDLWDFDLPMQPSLIDFPNQDGSHTPAVVIGTKAGQIYVLDRATGKPLTEVREVPVKGSDIAHEQYAPTQPLSVGMPQIGTKHLTESDMWGATAMDQMLCRIAFKQMRYEGLYTAPGTDVSLSFPGSLGGMNWGGLSTDPVHDVVFANDMRLGLWVQMIPADTRKAEAAGGGEAVNTGMGAVPLKGTPYAVNKNRFLSALGIPCQAPPYGTLSAIDLKTRSIAWQVPVGTVQDTGPFGIKMHLPIPIGMPTLGGTLSTQGGLVFIAGTQDYYLRAFDSATGKELWKGRLPVGSQGGPITYVSHKTGKQYVVISAGGARQSPDRGDYVIAYSLPDAH

SEQ ID NO: 16393 - protein, 406 aa, Xanthomonas campestris
MTRAVREARHANQAKSRFLANMSHEFRTPLNGLSGMTEVLATTRLDAEQKECLNTIQASARSLLSLVEEVLDISAIEAGKIRIDRRDFSLREMIGSVNLILQPQARGRRLEYGTQVADDVPDLLKGDTAHLRQVLLNLVGNAVKFTEHGHVLLRVTRVSGSAEDAVRLRFDVEDTGIGVPMDMRPRLFEAFEQADVGLSRRYEGTGLGTTIAKGLVEAMGGSIGFKENQPSGSVFWFELPMAIGEPLKSSTVRVPTGALVDAPEELESSNIIAFSNPFLRHRARVRSMRMLVADDHEANRMVLQRLLEKAGHKVLCVNGAEQVLDAMAEEDYDAVIVDLHMPGMNGLDMLKQLRVMQASGMRYTPVVVLSADVTPEAIRACEQAGARAFLAKPVLAAKLLDTLADL

SEQ ID NO: 16394 - protein, 298 aa, Bacillus thuringiensis
INVSFGETVGDCTTVGFSPVYGTDAEFKSDISYLKSKGKKIVLSIGGQNGVVLLPDNAAKDRFINSIQSLIDKYGFDGIDIDLESGIYLNGNDTNFKNPTTPQIVNLISAIRTISDHYGPDFLLSMAPETAYVQGGYSAYGSIWGAYLPIIYGVKDKLTYIHVQHYNAGSGIGMDGNNYNQGTADYEVAMADMLLHGFPVGGNANNIFPALRSDQVMIGLPAAPAAAPSGGYISPTEMKKALNYIIKGVPFGGKYKLSNQSGYPAFRGLMSWSINWDAKNTFEFSRNHPTYFDGLSLQ

SEQ ID NO: 16395 - protein, 70 aa, Bacillus thuringiensis
  unsure (1)..(70): unsure at all Xaa locations
EPTVGIDPLLRKTIWEKFYVLKNKGASIIVTTHIMDQDEFCERLGLITEGKLVAVGTTEXLNTRVSSGRI

SEQ ID NO: 16396 - protein, 262 aa, Bacillus thuringiensis
MTQQTFTQYDFKPFLIDAVRELRFTEPTGIQQKIFPVVKKGVSVIGQSQTGSGKTHAYLLPTLNRINASREEVQLVITAPTRELAQQIYEEIVKLTKFCAEDQMITARCLIGGTDKQRSIEKLKKQPHIVVGTPGRIKDLVEEQALFVHKANTIIVDEADLMLDMGFIHDVDKIAARMPKNLQMLVFSATIPQKLKPFLKKYMENPEHIHINPKQVAAGNIEHYLVPSKHRNKIDLVHKMLLQFKPYLAVVFTNTKKMADQV

SEQ ID NO: 16397 - protein, 154 aa, Bacillus thuringiensis
HTKQMIEYGTKIVGGVTPGKGGTDIEGVPVFDTVEDAVKATGANASVVYVPPAFAADAIMEAVDAEIDLVVCITEGIPVLDMVNVKRYMAGKHTRLLGPNCPGVITPDECKIGIMPGYIHKKGHVGIVSRSGTLTYEAVHQLTQEGIGQSTAVG

SEQ ID NO: 16398 - protein, 302 aa, Bacillus thuringiensis
  unsure (1)..(302): unsure at all Xaa locations
SSKRSAVXLVRFKGREIIIKEAKTTSFEGVDIAFFSAGGEVSRQFVTHAVSSGAIVIDNTSEYRMAQGVPLVVPEVNAHTLKQHKGIIAVPNCSALQMVTALQPIRKSFGLERIIVSTYQAVSGSGIHAIHELQEQAKSMLAGEEVKSNILPAKKDKKHYPIAFNVLPQVDIFTDNDFTFEEVKMIQETKKILEDENLKMAATCVRVPVVSGHSESVYIELEKEATVTEIKEVLMDAPGVILQDNPSKQLYPMPLYAEGKIDTFVGRIRKDPDMPNGFHLWIVSDNLLKGAAWNSVQIAETL

SEQ ID NO: 16399 - protein, 275 aa, Bacillus thuringiensis
MKAIVHQYKTGFDGVEYKISPERALNDGEVKVKLKSAGLNHRDLFIVNNRKEMQLPLILGSDGAGIVTEIGNGVSDNILHTEVIINPSIGWEHATEVPELPEVLGGPKDGTFAEYVIVPAENVVERPSYLTWEESGVLSLSALTAYRALFTKGRLKCGEHVLIPGIGGGVATFAMLFAKAIGAKVSVTSRVENKRELAAKYGADISFHSAGNWEEGLQGEKVDLIIDSIGPATFLKYFDVLKPNGRIGNFGAGSGDKIELPLRALFYNQIDIMGT

SEQ ID NO: 16400 - protein, 138 aa, Bacillus thuringiensis
IIMIKLVLIRHGQSLWNLENRFTGWTDVDLSENGLSEAREAGAILKKNGYTFDVAYTSVLKRAIRTLWIVLHEMDLTWVPIHKSWKLNERHYGALQGLNKDETAQKYGEEQVHIWRRSVDVRPPALTEDDPRYEATDP

SEQ ID NO: 16401 - protein, 239 aa, Bacillus thuringiensis
FQLYESLETYTKADFLTNPSKKTPVFVRFSTVQGSKGSNDTVRDVRGFATKFYTDEGNYDLVGNNMPVFFIQDAIKFPDFVHAVKPEPHNDIPQGASAHDTFWDFVAHNPESTHMVMWQMSDRAIPRSLRMMEGFGVHTFRLINAEGKAHFVKFHWKPTLGVHSLVWDEAQKIAGKNPDFHRQDLYEAIEKGDYPEWELGLQLIPEEDEHKFDFDILDPTKLWPEEEVPVKLVGKMTLN

SEQ ID NO: 16402 - protein, 117 aa, Bacillus thuringiensis
HIKDTLPHRYPFLMIDKVTNVKQGESVTGYKLITNNEWFINDSQKHMPHMLIVESLAQLSAFVHTSDSEGLGFLSSLDGVEFHGKAYPGDKLDLHYELTRNRRGFILGKSIATVNDQ

SEQ ID NO: 16403 - protein, 345 aa, Bacillus thuringiensis
FPHDFLFGAASASYQVEGAWNEDGKGVTNWDEFSKIPGKTYNGTNGDVAVDHYHRYKEDVRLMAEMGLESYRFSISWARILPTGDGKVNEKGIEFYNNLIDECLKYGIVPFVTLYHWDLPLPLEKDGGWTNKRTAEAFVKYAETCFKAFGDRVKHWITFNETVMFCGLGYLKGAHPPGIQNDVPKYFQATHYVFYAHAKTVAVYKQLKQYGEIGITHVFLPAYSVDDQKENIQAANHANEYETYWYYDPILKGEYPSYVVQQLKEKGWTPNWTVEELEIIKQNAEENDFIGLNYYQPIRVERYDLDIKSEEHSRENSTLASGNFSFDGFYRTGKMDDKTLYKWGW

SEQ ID NO: 16404 - protein, 356 aa, Bacillus thuringiensis
  unsure (1)..(356): unsure at all Xaa locations
LHELLNGSNAQIQLSVPQLVEKVLMRNEGKLTSTGAVSASTGKYTGRSPKDKFIVKEASVADKIAWGAVNQPISEEHFNKLYTKVLEYLKEKEELFVFKGFAGADRNYRLPIQVINEYAWHNLFVHQLFIRPTEEELTTHESEFTIVSAPNFKADPAVDGTNSEAFIMVSFEKRIVLIGGTEYAGEMKKSIFSIMNFLLPEQDILSMHCSANVGEEGDVALFFGLSGTGKTTLSADPNRKLIGDDEHGWSDNGVFNIEGGCYAKCVNLSHEKEPQIFDAITFGSVLENVIINDQTRIADYNDTTLTENTLAAYPMHAIDNIVLSSGAGHPNTIIFLTADAYGVLASIRXLSKEQAM

SEQ ID NO: 16405 - protein, 334 aa, Bacillus thuringiensis
  unsure (1)..(334): unsure at all Xaa locations
CISGYGQVGREFIKIINEKYSYIYETYGIQLVVSGVLGRNIAIHNEDGLSLHHLLMYGGGTAAIEKYLEYHPKERATTSISGTVLVESTVTNLKDGNPGKQYMKQAIEKQMDIVAISKGALVTNWREINEAARGANVRIRYSGATAAALPTLDIGQFSLAGCSIEKIEGILNGTTNYILTKMYEEDMTFEEALKEAQDKGIAETNPILDISGSDRAXKLVLMTNSLMETEKTLTDIHIKGIEHVTKQQIRNAKEQHKIIKLIASTYKDEGGNVNLNVEPCEIEKDHPLAKVNGTEKGITFFTDTMGQVTTIGGASNPRGAAAAALKDVINLYRK

SEQ ID NO: 16406 - protein, 269 aa, Bacillus thuringiensis
ISEILKDAEDFANGKESKTTEQTFVANLFFENSTRTRFSFEVAEKRLGLDVLNFSADASSVQKGETLYDTIRTLESIGTKAVVIRHEQDRYFDELKDQVNIPILNAGDGCGNHPTQCLLDLLTIKQEFGRFEGLKIAIVGDVRHSRVARSNAEALTKLGATIYFASPEEWKDEDNTFGTYKPLDELVPEVDVMMLLRVQHERHDHYETDIMKEYHEKHGLTVEREKRMKEGSIIMHPAPVNRDVEIASELVECERSRIFKQMGNGVYVR

SEQ ID NO: 16407 - protein, 380 aa, Bacillus thuringiensis
GYFQRKYSMSEHTKLSFLQNSNEKVLVMVRFSLAVSTKGTPDTARNVRGFSTKFYTKEGIFDLLCNHIPVFSVRDPMRFPETIQALLPSPKNNLIDPNRFWSFVAKAPESIHFVVRLYSNNGTAKSLRHIPGHSVNTYVWRNAEGNRKYVKYHWYPFEGVQYITSKEAIKLAAENPDYSGKDLYDAIENGKPVEYGLYVQLMDPKDEAHLSYDPLDDTKVWDEQTYPLIPVGKMVLNKNPENFMEQVEKVAFSPSNLLDGAELSDDKMLQGRANIYSDSQRRRIGPEFRKLTINQQQDWTPANQITTGEERYVEGKLERPSITKQDNFTQASEFYTKLQPIEKEHLAENLASDLKVISDDIRKIVLGYFNRVSTDLKTNI

SEQ ID NO: 16408 - protein, 401 aa, Bacillus thuringiensis
TVQLNRKYAKGFTNDIGGLSSHSAIMARSMEIPTVVGTKVVMEKIQNGDIVIIDGLDGEVIVNPSEETLRSFEEKKAKFEEQKAEWAKLKDQATVTSDGHHVELVANIGTPNDVQGIIDNGGEGVGLYRTEFLYMGRDNLPTEEEQFEAYKAVLEGVKEGQPVVVRTLDIGGDKELPYLHLPKEMNPFLGYRAIRLCLDEQDVFRTQLRALLRASVYGNLKIMFPMIATLDEFRQAKAILLEEKAKLVEAGTTVSDSIEVGMMVEIPASAVLADQFAKEVDFFSIGTNDLIQYTMAADRMNEQVSYLYQPYNPSILRLVKMVIDAAHKEGKWAGMCGEMAGDSLAIPLLLGLGLDEFSMSATSILPARTQLSKLSKAEMETLAEKALKMSTAEENVELVKS

SEQ ID NO: 16409 - protein, 325 aa, Bacillus thuringiensis
VTKSLYLPFHFLNPVAIEYAKKLVDCSLKNGKVFFTNSGTEATETTLKLIDKYRANMNEECEGIVLLKNSVHGRTLGALHFTRHESVYQNFPETSIPVYEVERENIDQLEETIIKENPIAIMLEPVLGSGGIYPLSSEYLHGIQYLCEKYNVLLVVDEVQSGMGRTGKLFAYQNFNITPDIIQIGKGAGGGIPLGGIIVGEKLCDVFSPGDHGTTFAHSSMGTALGLTVLNTLLDEGLMQEAYETSLYLNDKLQDIQKENSYYIQEVRHAGMMFGISLNDTNENVKKLQVELMNKGMLVDVTQGNIIRLLPPYIITKEEIDAFIN

SEQ ID NO: 16410 - protein, 481 aa, Bacillus thuringiensis
SIPNDDVGNFFCFPFIHADDVFKAPSWIKDTIWYQIFPERFANGDSTLNPENTLPWGSANPTPTNFFGGDFSGVIQNLDYLVKLGISGIYFTPIFKAHSNHKYDTIDYMEIDPQFGTKETFKELVEECHKHGIKVMLDAVFNHSGYFFEKFQDVLENGEKSAYKEWFHIHEFPIITEPLPNYDTFAFTPYMPKLNTAHPDVKEYLLEVGRYWVREFNIDGWRLDVANEVDHNFWREFRTEIKTLNPEVYILGEIWHDALPWLQGDQFDAVMSYPVTNALLSYFANDSIKASEFMKQITESVHSYSMNVNEAAFHLLDSHDTPRILTTCNGDKNKLKLLYVFHLSFIGSPCIYYGDEIGMDGGMDPDCRKCMIWDTKEQDHALFTHIQTLILLRKQHKAFGGHGTFQFIEANDEHNYISYTKTYEDETIFFVLNPTNSEVTVSLPLHVTGKKIINIYTYEEFSAEACVLQATLAPYGFSILK

SEQ ID NO: 16411 - protein, 624 aa, Bacillus thuringiensis
MSVSKRLFQYAMKVKGTIFAAMLMLFIFVIAELAGPFVAKTMIDDHIVGIEKPWYETEQSEDAVSYNGAFYKRSDRFEQGEKKGKEVRVMQVGFQYYFVPNKVNAEGSRTVKGDMITVQNGKAVQVYKAKALTKEEVFAFYKPEISRLLLLGGGYFALLVVVSLFAYGKQFFLQKAANKIIQIMREDVFSHIQTLPIRYFDHLPAGKIVSRVTNDTEAIRDLYVTVLATFVSSIIYIIGIFAALFLLDVKLATLCLLIIPILIAWAILYRKYASVYNHKMRSRLSDINGTVNESIQGMPIIQAFRQERETKKEFEELNGDYFKYQNKILNLNAATSHNLVSVLRNIAFTGVIWYFGGASLSATGVISLGILYAFVDYLTRLFSPITNMVNQLANLEQSRVASERVFELLEEKGEAVEEERMPRLQGNVKFDNVSFSYNGKDEVLKNISFEAKQGETVALVGHTGSGKSSIMNVLFQFYEFEKGKLTIDGHDVKEMPKQATREHMGIVLQDPFLFSGTVASNVSLENEKISKERIVKALRDVGAERFANNINEEITEKGSTLSTGERQLISFARALAFDPAILILDEATSSIDTETEAMIQQALEVVKKGRTTYIIAHRLSTIKS

SEQ ID NO: 16412 - protein, 41 aa, Bacillus thuringiensis
SAVQYADWILVMDEGAVIEEGTHAQLIQKGGWYAEQFERQQ

SEQ ID NO: 16413 - protein, 474 aa, Bacillus thuringiensis
MMNVPLTISSMMERAEKLFSKKEIVSRTHDTVTTLTYKQLGERTRRLSSALKKLGIKEGEPVGTLAWNHHRHVEAYFAIPGIASVLHTINIRLSPQHISYIIQHAEDRILLIDEDLVPLVENIQSQLSTVQAYIIMTDKDELPNTMLEPVYHYEKLLEEGDPNFQFVKDIDENTPAGMCYTSATTGNPKGVVYTHRSTVLHCMALGLADTAALSESDAAMAIVPMFHVNAWGLPFAATWFGSKQVLPGPMFTPKILLEMIQSEKVTLAAGVPTIWLGVLQELENNSYDLSSMTRILCGGAAAPKSVIKAFEQKHNVPFIHAYGMTETSPLVTLARLKSYETELSYEEQLEIRSKQGYLVPGVEMKVVGTNGEVKWDGTEMGELCLRAPWIAESYYNDNRTVEGFRDGWLYTGDVVTVDEEGCVKIVDRTKDVIKSGGEWISSVDLENALMAHDAIFEAAVVAIPHHQWQERPIA

SEQ ID NO: 16414 - protein, 214 aa, Bacillus thuringiensis
FQYEKNSPLILRDLSVSIEKGKWVALVGKNGTGKSTLLTILAGLQKARRGKVKWNGKVIHKIDSKERFKSIGYVSQHPYYHFTFDTVWDEVYERARELYGEQGKEIAEDTLKQFWLYSLKERHPHDCSGGEQQLLALCTTLLSKPTLLLLDEPTKGLDPWKKERVGELFRKLQKEGTTIVMATHDIEFAAKYVDQCMMLFDGTVIMNDAPKEFF

SEQ ID NO: 16415 - protein, 391 aa, Bacillus thuringiensis
SKRKLLCIAGLGWLFDAMDVGMLSFVMVALQKDWGLSTQEMGWIGSINSIGMAVGALIFGILSDKIGRKSVFIITLLLFSIGSGLTALTTTLAMFLVLRFLIGMGLGGELPVASTLVSESVEAHERGKIVVLLESFWAGGWLIAALISYFVIPKYGWEVAMVLSAVPALYALYLRWNLPDSPRFQKVEKRPSVIENIKSVWSGEYRKATIMLWILWFCVVFSYYGMFLWLPSVMVLKGFSLIKSFQYVLIMTLAQLPGYFTAAWFIERLGRKFVLVTYLIGTACSAYLFGVADSLTVLIVAGMLLSFFNLGAWGALYAYTPEQYPTVIRGTGAGMAAAFGRIGGILGPLLVGYLVASEASLSLIFTIFCGSILIGVFAVIILGQETKQREL

SEQ ID NO: 16416 - protein, 310 aa, Bacillus thuringiensis
KMLEIRKFEDKVHELFAQGVLPGFVHLYAGEEAVAVGVCAHLTDSDSITSTHRGHGHCIAKGCDLNGMMAELFGKATGLCKGKGGSMHIADLDKGMLGANGIVGGGFPLACGSALTAKYKGTKDVSVCFFGDGANNEGTFHEGVNLAAIWKLPVIFIAENNGYGEATTFEYASSCDSIADRAKAYNIPGVQVDGKDLLAVYKAAAEAVERARNGDGPTIIECMTYRNYGHFEGEAQTYKTSEEKEEHLNEKDAIVNFRKHLIHEGLLTESELVDMEKAVDDAVQRSIEFSENSPYPDDEELLKDVYVSYK

SEQ ID NO: 16417 - protein, 398 aa, Bacillus thuringiensis
LIETIPENGSNPKELLHFLNNNVFNQITHVDHPHFMAFVPGPNNYVGVLADFLASGFNVFSTAWIVGAGAEQIELTTINWLKSMLGFPDSAEGLFVSGGSMANLTALTVARQVKLNNDIENAIVYFSNQTHFSVDRALKVLGFKQHQICRIETDEDLKISVSTLRKQIKEDRLKGKKPFCVIANAGTTNCGAVDSLDELADVCGDEDIWLHVDGAYGAAAILSEKGRELLSGIHRADSLTLDPHKWLFQPYDVGCVLIRNSQYLSETFRMIPEYIKDTETNIEEKVNFGERGIELSRRFRALKVWLSFKAFGVTAFREAIDHGIMLAEQVEEFLRKEKDWEVVTPAQLGIVTFRYIPCELTSTDTIHEINKKLVEEINQRGFAMLSTTKLKEKVVIRL

SEQ ID NO: 16418 - protein, 394 aa, Bacillus thuringiensis
GYGFLSERIQFAKRCEEEGIIFIGPKSKHLDMFGDKVKARTQAQLAQIPVIPGSDGPVNSLEEVEKFAEKYDYPIIIKASLGGGGRGMRIVRTSEELGESYNRAKSEAKAAFGNDEVYVEKFVEKPKHIEVQILADEEGNVVHLYERDCSVQRRHQKVVEIAPSVSLSDDLRQRICDAAVKLTKNVNYLNAGTVEFLVKDDEFYFIEVNPRVQVEHTITEMITGVDIVQSQILIADGHSLHSKMVGVPKQEEVVVHGFAIQSRVTTEDPLNNFMPDTGKIMAYRSGGGFGVRLDTGNSFQGAVITPYYDSLLVKVTTWALTFEQAAAKMERNLKEFRIRGIKTNIPFLENVVKHKNFLSGEYDTSFIDASPELFLFPKRKDRGTKMLNYIGTVT

SEQ ID NO: 16419 - protein, 329 aa, Bacillus thuringiensis
SGKSTLVRMLNQLIKPTAGHIYIDGEDIATMGKEELRRVRRTKMSMVFQKFALFPHRTVIQNVAYGLEIQGVPVEEREKKALESLQLVGLDHHKDNYPSQLSGGMQQRVGIARALTNNPDVLLMDESFSALDPLIRKEMQDELLELQDKMEKTIIFITHDLDEALRIGDRIALMKDGEIVQIGTPEEIMMSPANEFVEKFVADVNLGKVITAESILKRPETLLIDRGPRVALQIMRNAGVSTVYVVNKKYEFLGILTADDASKAVQKQWPIADLLLNDIPHVYLDTLLEETYAKMAEMKYSVPVIDEKKRLRGIIKRESVIQALAGNIE

SEQ ID NO: 16420 - protein, 512 aa, Bacillus thuringiensis
SIMEKQWWKESVVYQIYPRSFMDSNGDGIGDLQGIISKLDYLKELGIDVIWLSPVYESPNDDNGYDISDYCKIMNEFGTMEDWDELLHEMHERNMKLMMDLVVNHTSDEHNWFIESRKSKDNKYRDYYIWRPGKEGKEPNNWGAAFSGSAWQYDEMTDEYYLHLFSKKQPDLNWDNEKVRQDVYEMMKFWLEKGIDGFRMDVINFISKEEGLPAVETEEEGYVSGHKHFMNGPNIHKYLHEMNEEVLSHYDIMTVGEMPGVTTEEAKLYTGEERKELQMVFQFEHMDLDSGEGGKWDVKPCSLLTLKENLTKWQKALEHTGWNSLYWNNHDQPRVVSRFGNDGMYRIESAKMLATVLHMMKGTPYIYQGEEIGMTNVRFQSIDEYRDIETLNMYKEKVIDHGEDIEKVMESIYIKGRDNARTPMQWNDQNHAGFTKGEPWITVNPNYKEINVKQAIQDEGSIFYYYKKLIELRKNNEIVVYGSYDLILDNDPSIFAYVRTYGDEKLLVIANF

SEQ ID NO: 16421 - protein, 319 aa, Bacillus thuringiensis
WHKSVVYQIYPKSFNSYYNRETGDIKGVTEKLDYLKELGVDYIWLTPIYQSPQNDNGYDVSDYYSIDPSYGTMEEFEELLAEAKVRNIEIMLDIVVNHSSTEHKWFKEAKEDKNSPYRNYYIWRDEKNNWQSKFGGSAWKYDEKTEQYYLHLFDETQADLNWENEKLREEVYDMMRFWLDKGVTGFRLDVINLISKDQCFLNDEGSTATSDGRKYYTDGPRVHEYLQEMNRNVFAGKDVITVGEMSSTTIDNCIKYSNPERNELSMTFSFHHLKVDYPNGDKWTKAEFDFIKLKEIMSNWQIEMQKGGGWNAVFWCNHD

SEQ ID NO: 16422 - protein, 282 aa, Bacillus thuringiensis
MSLFSFTKMHGLGNSYIYVNMFEEHIPEEDLALVAEKVSNINTGIGADGMILICPSDVAPVKMRMFNNDGSEGKSCGNGLRCVAKYAYEHKLVEETVFTIETLAGIVTAEVTVEDGVVTLAKIDMGAPRLTRAEIPMLGEGETPFIRENFLYNNHRYAFTAVSMGNPHAVIFVDDVEKAPLTTLGPVLETHEMFPERVNVEFIEILNNDEMNFRVWERGSGVTQACGTGACAAVVAAILNGKMERGKEITVHLAGGDLMIAWTEEGNVLMKGPAEVICRGVY

SEQ ID NO: 16423 - protein, 320 aa, Bacillus thuringiensis
DENVILIGEDVAGGAQVDHLQDDEAWGGVLGVTKGLVQEFGRNRILDTPISEAGYMGAAMAAAATGLRPIAELMFNDFIGSCLDQVLNQGAKFRYMFGGKAKVPVTVRTMHGAGFSAAAQHSQSLYALFTSIPGIKVVVPSTPYDAKGLLLAAIEDDDPVIFFEDKTLYNMKGEVPEGYYTISLGKADIKREGSDVTIVAIGKQVHTALAAAKQLSKKGLEVEVIDPRSLSPLDEDTILSSVEKTNRLIVIDEANPRCSIATDIAAIVADKGFDLLDAPIKRITAPHTPVPFSPPLEKLYLPTPEKVIETVSEMIGDQSL

SEQ ID NO: 16424 - protein, 255 aa, Bacillus thuringiensis
KTFHVAVVGATGAVGEQMLNTLEKREFPIGKLTLLSSKRSAGKKLVFKGEEFTVQEATPESFEGVDIALFSAGGSVSKQLAPEAAKRGAIVVDNTSAFRMTENVPLVVPEVNENDLKEHNGIIANPNCSTIQMVVALEPVRQQYGLKRVIVSTYQAVSGAGAAAIEALHEQSQAILNGEEVKANVLPVSGDKKHFPIAFNAIPQIDKFQDNGFTFEEMKMINETKKIMHMHEFQVAATCVRLPNVSGHSESVYIE

SEQ ID NO: 16425 - protein, 433 aa, Bacillus thuringiensis
MEITIEHVVNELKGILPEDRVVINMTVRELHSKDESYHSSSLPDVVVFPKTTEEVSAIMKIAIQHGTAVVPFGVGSSLEGHVIPYEKGITMDFSLMNKILEIREKDFLVRVQPGVTRSQLNKELKKYGLFFSVDPGADATLGGMAATNASGTTAVKYGVMRDQVRDLEVVLADGGVIHTGNLAAKSSSGYHLNGIFVGSEGTLGCFTELTLKVYGIPEHVMAARASFPTINDAVEAVINILQAGIPIARIELVDELSMKQVNYYNETSYREEPTLFLEFHGNEAGLKQDIEFTKEIVLDHKCIEIAFETETAARNKLWDARHNLAYSYVHSYPGKKLMSTHVCVPISELAGAIQHAKEVLHKVGLIGGILGHVGDGNFHVLLMIDTNDKEEVKKADEINESIVQYALKRGGTCTGEHGVGIGKRKYQEEEHGE

SEQ ID NO: 16426 - protein, 378 aa, Bacillus thuringiensis
DAHYKFVPNRNFYYLTGIDEPNVIFMLKKVGSSVEETLFIEKADPVMEKWVGKTVSNEEAEKISGIKKVIYLDSFEKTMSNILFTENAKHLYLDIERRDWNGTETKTLAFAKHVREKYPHVTIGNVYPNICELRVFKTEEEIEIIKEAIAITKDGIYNVLKHAKAGMMEYELEAQFDFTLKSSGIKYHAFNTILASGKNATVLHYEDNDAQIQNGDLVLLDLGAQKDYYNADISYTFPANGTFSSRQKQIYNIVLKALKETTEIIKPGLKFAALNEHTKKVLAEECKAIGLIQEDEELSKYYYHGVSHFLGLDTHDVGTYKDRVLEEGMVITIEPGLYIEGESIGIRIEDDILVTKDGYENLSKDIIREVEEIEEFMS

SEQ ID NO: 16427 - protein, 237 aa, Bacillus thuringiensis
MKKYALVTGGSGGIGSAISKQLIQDGYTVYVHYNNSEEKVLELQKAWGEVIPVQANLASSDGAERLWGQIEHPIDVIVYAAGKSIFGLVTDVTNDELDYMVELQVKNVYKLLSMALPPMIGRRSGNIVIVSSIWGQIGASCEVLYSMVKGAQNSYVKALAKEVSLSGLRVNAVAPGAIETEMLSVFSEEDKMGIAEDIPLGRIGLPEEVAKTVSFLVSPGASYITGQIIGVNGGWHC

SEQ ID NO: 16428 - protein, 189 aa, Bacillus thuringiensis
MAKVNLEQIEHAVRLILEAIGDDPNREGVLDTPKRVAKMYAEVFSGMHEDPKEHLHKVFGEDHEELVLVKDIPFYSMCEHHLVPFYGVAHVAYIPQGGKVTGLSKLARTVDTIARRPQLQERITSTVANSIMEVLEPHGVMVVVEAEHMCMTMRGVKKPGAKTVTTAVRGVLENDAAARSEILSFIKTK

SEQ ID NO: 16429 - protein, 538 aa, Bacillus thuringiensis
VNKQELDVIVIGGVITGSGIALDGASRGLSTIVFEMQDFAAGTSSRSTKLVHGGLRYLKQLEVKMVAEVGKERAIVYENGPHVTTPEWMLLPFHTGGTFGSFSTSIGLRVYDFLAGVKRSERRKMFNREETLKKEPLVKKEGLKGGGYYVEYRTDDARLTIEVMKEAIERGAKAVNYAKVDGFLYKDGKVCGVRVIDLLDGEVYEVYGKKIVNAAGPWVDTLREKDNSKKGKVLQLSKGVHLVIDQKRFPLGQAIYFDTPDKRMVFAIPRGGKTYVGTTDTFYDKDAAVPQMTTEDRTYIINAINYMFPSVKITEKDIESSWAGVRPLIYEEGKSASEISRKDEIWTSESGLITIAGGKLTGYRKMAEMVVDYVTNLLQKEGHSAYPKSDTKHMPISGGHVDGSHGFPAFVAKKAGEGTKYGLTTAQAEEFAKFYGSNVDVLFDLAKKHKDEAKEYNMPLDVLIPLVYAMDYEMTAKPVDFFVRRRGTVFFNIHWVYEWKEAVINYMAAKLGWSKEEQMKYTAELEKALTDAVIPVDQ

SEQ ID NO: 16430 - protein, 494 aa, Bacillus thuringiensis
MLKTNIELKPKVEAFLNEEIKMFINGEFVSAIGGKTFETYNPATEEVLAVVCEAQEEDIDAAVKAARSAFESGPWAEMATAERAHLIYKLADLIEEHREELAQLEALDNGKPYQVALDDDISATVENYRYYAGWATKIIGQTIPISKDYLNYTRHEPVGVVGQIIPWNFPLVMSSWKMGAALATGCTIVLKPAEQTPLSLLYTAKLFKEAGFPNGVVNFVSGFGPEAGAAIVNHHDIDKVAFTGSTVTGKYIMRQSAEMIKHVTLELGGKSPNIILEDADLEEAINGAFQGIMYNHGQNCSAGSRVFVHRKHYETVVDALVKMANNVKLGAGMEKGTEMGPLVSKKQQERVLNYIEQGKKEGATVAAGGERALEKGYFVKPTIFTDVTDDMTIVKEEIFGPVVVVLPFDSTEEVIERANNSSYGLAAGVWTQNIKTGHQVANKLKAGTVWINDYNLENAATPFGGYKQSGIGRELGSYALDNYTEVKSVWVNIK

SEQ ID NO: 16431 - protein, 294 aa, Bacillus thuringiensis
TQQQREQHFELLNSTQIVISEALEKLGYPNEVYELLKEPIRMMTVKIPVRMDDGTVKIFTGYRAQHNDAVGPTKGGIRFHPNVTENEVKALSIWMSLKCGIVDLPYGGGKGGIICDPREMSFRELERLSRGYVRAISQIVGPTKDIPAPDVFTNSQIMAWMMDEYSRIDEFNSPGFITGKPLVLGGSHGRETATAKGVTICIREAAKKRGIDIKGARVVVQGFGNAGSFLAKFMHDAGAKVIAISDAYGALHDPNGLDIDYLLDRRDSFGTVTKLFNNTISNKELLELDCDILV

SEQ ID NO: 16432 - protein, 293 aa, Bacillus thuringiensis
QPLAHRMRPTNIQEIIGQQHLVGEGKILWRMVQANHFQSMILYGPPGTGKTSIASAIAGSTGTPFRLLNAVTHNKKDMEVVVQEAKMHRHLVLILDEVHRLDKAKQDFLLPHLESGLLTLIGATTSNPFHAINSAIRSRCQIFELHALTEDDILIGLKRALEDKEKGLGEYAVTVTDEALHHFANASGGDMRSAYNALELAVLSSFTTDDQAAEITLEIAEECLQKKSFVHDKGGDAHYDVLSAFQKSVRGSDVNAALHYLARLIEAGDLQSIGRRPFIMAYEDIGLASPQAG

SEQ ID NO: 16433 - protein, 352 aa, Bacillus thuringiensis
FISIGLGAAGLGDPNQLGRIGLKSISFFLVTTAVAISIAVTFALIIKPGAGGNFKTEGLKYEGAKTETSFVDTLLNIVPDNPAKAMADGNMLQIIAFAVLIGLGIAILGKRVQGIHSLLEQGNELMMYLVNLVMKLAPIGTFGLLASSVGKMGLAGVAAMFKYMIVVMLVLIIHGVFVYGGLLKILAKESIVRFFKHFGPVMAIGFSTSSSNASLPFAMKTAQDKLGVPKAISSFVQPLGATINMDGTAIMQGVATVFIAQVYGVELTLPQLAMVVLTAVLASIGTAGVPGVGLVMLTMVLNQVNLPVEGIALIIGIDRILDMSRTAVNISGDAICAMIVAKSEEKYNTDQS

SEQ ID NO: 16434 - protein, 320 aa, Bacillus thuringiensis
IMTRVAINGFGRIGRMVFRQAIKESAFEIVAINASYPSETLAHLIKYDTVHGKFDGTVEAFEDHLLVDGKMIRLLNNRDPKELPWTDLGVEVVIEATGKFNSKEKAILHVEAGAKKVILTAPGKNEDVTIVVGVNEDQLDITKHTVISNASCTTNCLAPVVKVLDEQFGIENGLMTTVHAYTNDQKNIDNPHKDLRRARACGQSIIPTTTGAAKALAKVLPHLNGKLHGMALRVPTPNVSLVDLVVDVKRDVTVEAINDAFKTVANGALKGIVEFSEEPLVSIDFNTNTHSAIIDGLSTMVMGDRKVKVLAWYDNEWGYS

SEQ ID NO: 16435 - protein, 276 aa, Bacillus thuringiensis
EMPLILGNDFSGVIVKVGSQVTRFKVGDAIYARPRKNKIGTFAEYIAIHEDDIALKPKNLSFEEAASIPLVGLTSYQALHDIMHLQKGQKILIHAGSGGVGTFAIQLAKIMGATVTTTASEAGSDLVKSLGADQIINYKTEKFEEILKNYDAVFDTIGGTTLEKSFNIIKSGGNIVSVSGMPNARFGKEFGSGFFKTLLFSLASKKLTALEKKHNAQYSFLFMKPSGDQLRTIANYIEAGKIKPVIDRVFPFEDAQKAMEYSESGRAKGKIIAKIN

SEQ ID NO: 16436 - protein, 193 aa, Bacillus thuringiensis
VLGLLGRNGAGKTTTIKMLLGLLTPNEGSITWDGKAFGNSGVTIGYLPEERGLYTKSRVIDQLRYFGRLEGMSKKEVDHAIDHWLERLAIPEYKFKTAGELSKGNQQKIQLIAALLHNPELLILDEPFSGLDPVNAGMLASIIEEQVQSGKTIILSSHRMEQVEAFCQHVCILKKGEAVVKGQLSDIKKEYGF

SEQ ID NO: 16437 - protein, 266 aa, Bacillus thuringiensis
HTDFKENMTYGEYLQLDSLLSSQKRLSDHHDEMLFIVIHQASELWMKLILHELNAAIESIKQDKLQPAFKMLARVSKIQSQIIQSWDILATLTPSEYIEFRDSLGQASGFQSYQYRMIEYALGYKTPHALKIYEKDPELHARLHKALHAPSLYDVAIQALVKEGFPIHKDVLNRDITQPYEEDATVEAAWLEVYADVKKYWNLYQLAEKLIDIEDWLQQWRFRHMKTVERIIGHKMGTGGSSGVSYLKRVLDQQFFPELWNVRTKL

SEQ ID NO: 16438 - protein, 455 aa, Bacillus thuringiensis
LVVIGGGPAGYVAAITAAQNGKEVTLIDEADLGGTCLNVGCMPTKSLLESAEVHDIVRKANDYGVTLNTGSISIDWDQIQARKSQIVMQLVQGIQYLMKKNKIKVVKGKAKFETDHRVRVVQGNKEEVVDGERFIIAAGSEPTELPFAPFDGKWILNSSHAMSLESVPSSLLIVGGGVIGCEFASIYSRLGTKVTIVEMAPQLLPGEDEDIAHILREKLESDGVEIFTGAALKGLNNYKKQASFEYEGSIQEANPEYVLISVGRKPRVQQLDLEKAGVQFSNKGIAVNEHMQTNVSHIYAAGDVIGGIQLAHVAFHEGTTAALHASGEDVKVNYHAVPRCIYTAPEIASVGLTEKDAREQYGDIQIGEFPFTATEKALIIGELMGKVKVIVEPKYQEIVGICIIGPHATDLIGQGTVMIHTEVTADIMRDYIAAHPTLSEAIHEALMQAVGHAVH

SEQ ID NO: 16439 - protein, 618 aa, Bacillus thuringiensis
MSDFLVIVESPCKAKTIEKYLGKKYKVVASMGHVRDLPKSQMGIEVKNNFTPKYITIRGKGPVLKDLKSAAKKAKKVYLAADPDREGEAIAWHLANTLNVDVESDCRVVFNEITKDAIKESFKHPRAINMDLVDAQQARRILDRLVGYNISPLLWKKVKKGLSAGRVQSVAVRLIIEREREIQNFEPEEFWTIKTEFVKGKRHICSQAFSGVDGEKVQLTNETQVNEIIEQMKDNAFSVENVTRKERKRNPALPFTTSSLQQEAARKLNMRAKKTMMLAQQLYEGIDLGKQGTVGLITYMRTDSTRISETAQTEARTYITEAYGTEYIGTEKKKETKKSNAQDAHEAIRPTSVMRKPEELKSFLGRDQLRLYKLIWERFVASQMASAIMDTVTARLINNNVQFRASGSVVKFPGFMKVYVESKDDGAEEKDKMLPPLEVGETVFSKDLEPKQHFTQPPPRYTEARLVRTLEELGIGRPSTYVPTLETIQKRGYVGLDNKRFVPTELGEIVIELILEFFPEIINIEFTANMEQSLDEVEEGNANWVKIVDDFYVGFEPRLEKAEKEMREVEIKDEPAGEDCELCNHPMVFKMGKYGKFMACSNFPDWRNTKSIVKEIGV

SEQ ID NO: 16440 - protein, 288 aa, Bacillus thuringiensis
SSQNPNLMGWVVADSKKAQGHLDSATDEDLDIAYSLLLAHKQWGSNGTVNYLKEAQDMITKGIKASNVTNNNRLNLGDWDSKSSLDTRPSDWMMSHLRAFYEFTGDKTWLTVINNLYDVYTQFSNTYSPNTGLISDFVVKNPPQPAPKDFLDESEYTNAYYYNASRVPLRIVMDYAMYGEKRSKVISDKVSSWIQNKTNGNPSKIVDGYQLNGSNIGSYSTAVFVSPFIAASITSSNNQKWVNSGWDWMKNKRESYFSDSYNLLTMLFITGNWWKPVPDDTKIQNQIN

SEQ ID NO: 16441 - protein, 448 aa, Bacillus thuringiensis
MIKKVLIANRGEIAVRIIRACKEMDIETVAIYSEADKESLHVQIADEAYCVGPTISKESYLNLTNIISVAKLTGCDAIHPGYGFLAENADFAELCRECNLIFIGPSPEAISKMGTKDVARDTMKEAGVPIVPGSQGIIKNTEEAIELANQIGYPVIIKATAGGGGKGIRVARHEEELIKGIQITQQEASTAFGNPGVYLEKYVEDFRHVEIQIMADTHGNAIHLGERDCTIQRRLQKLLEESPSPALDEDIRKQMGEAAVKAAVAVDYTGAGTVEFIYEYKTKTFYFMEMNTRIQVEHPVTEMVTGMDLIKEQILVASGEKLSLQQEEVQFNGWAIECRINAENPAKKFMPSPGKVEMYLPPGGFGIRVDSAVYPGYSIPPFYDSMVAKLIVHGKTREEAIAKMKRALSEFVIEGVHTTIPFHLQLLDHPDFVKGEFNTKFLEEHELV

SEQ ID NO: 16442 - protein, 316 aa, Bacillus thuringiensis
MSTIIDVYAREVLDSRGNPTVEVEVYTESGAFGRAIVPSGASTGEHEAVELRDGDKSRYLGKGVVNAVNNVNEIIAPEIAGFDVTDQAGIDRAMIELDGTPNKGKLGANAILGVSMAVAHAAADLVGLTLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDD

SEQ ID NO: 16443 - protein, 351 aa, Bacillus thuringiensis
TALIHHGYTSEEHKGSLTPPLFQTSTFTFETAQQGEASFAGVDPSYIYSRLGNPTVKLFEERMAVLEGGEEALAFGSGMAAISATLIGFLKAGDHIICSNGLYGCTYGFLEVLEEKFMITHSFCDMETEVDIENKIRPNTKLIFVETPINPTMKLIDLKQVIRVAKRKGLLVIVDNTFCSPYLQRPLELGCDAVVHSATKYIGGHGDVVAGVTICKTKALAEKIRPMRKDIGGIMAPFDAWLLLRGLKTLAVRMDRHCDNAEKIVSFLRKHDAVEGVWYPEGELASRQMKRGGGVISFSVKGGKEETQAFINDLHFITIAVSLGDTETLIQHPATMTHAAIPAELRKEMGI

SEQ ID NO: 16444 - protein, 159 aa, Bacillus thuringiensis
YAYVPEHPTYYDYLTLWEHIELLMAARGSEMGSWEERAEQLLHTFRMNKHKHEYLSKFSKGMKQKSMLILAFLTEPDFYIIDEPFIGLDPVATKEFLNYLYKEKERGAGILFCTHVLDTAEKICERFLLISQGTLVADGHLESIQILAEMPGSSLLDCF

SEQ ID NO: 16445 - protein, 480 aa, Bacillus thuringiensis
VIGIDIGTTSTKTVVFTEKGKVIASHAIDYPIIQPNVGWAEQDPDVICAAVYKSVSVAIEKGNVLPEDISSIGISTAMHALIAVDENGAPLTRSIIWADNRSTKQSEKLLQQMNGHEIYRRTGTPIHPMSPLSKLLWMKEEEPELYTSAYKFIPFKEYVIYQLFSRYVVDYSIASATGLFNLETLNWDKDVLTMLHMSPEKLSTPVPTTYILSGMKPELAQKMGISAETPIVIGASDGVLANVGVGAISPGAAAITIGTSGAVRTISSNINTDEKGRTFCYALTDEHWVIGGPTNNGGILLRWLRDEFGSPEQEVARKLGIDPYDLLIKYAESVPAGADGLLFLPFLSGERAPYWNANARGTFFGINLQHKREHFIRAVMEGVCMSVYSVALAIRDCTGPLTEIRVSGGFAKSAFWRQMLSDMMGKELLVPESHEASALGAAAVALYAVGKIDSLEEVKDWIDNVHHHVPNKENTAIYYR

SEQ ID NO: 16446 - protein, 322 aa, Bacillus thuringiensis
SIMEMSHRSSYFQSIIEEASNLLRELMSIPDEYDVLFLQGGASLQFSMIPLNLMNTYKKAGYVLTGSWSKKALQEAEKVGEVQVIASSEQEKFTTIPKLDGLLSDEKLDYVHITTNNTIEGTKYVDIPHIERVPLVADMSSNILSEQYDVSKFGLIYAGAQKNLGPAGLTIAIIKRDLIGGADRSCPTMLNYETYSKNNSLYNTPPSFSIYVTKLVLEWLKEQGGVSAIEEQNRMKSSLIYHFLDESKLFTSPVDPAYRSLMNIPFTTPSEELNNEFLQKAKERGLVTLKGHRSVGGMRASIYNAMPAHGVKRLVDYMKEFE

SEQ ID NO: 16447 - protein, 397 aa, Bacillus thuringiensis
EKKKVVLAYSGGLDTSVAIKWLQEKNYDIIALCLDLGEGKDLAFVKEKALSVGAIKSYMIDVQEEFANEYALMAMQAHTLYEGKYPLVSALSRPLIAKKLVEIAEQEGATAVAHGCTGKGNDQVRFEVSIQALNPYLEVIAPVREWKWSREEEIAYAKENDVPIPINLDSPFSIDQNLWGRSNECGILEDPWAAPPEDAYEMTLALEDTPNKPEFVEIGFEAGVPTTLNGTAYSLAELIKTLNALAGKHGVGRIDHVENRLVGIKSREVYECPAAMTLITAHKELEDLTHVKEVAHFKPVIEQKITELIYNGLWFSPLKQALHAFLQETQKNVTGTVRVKLFKGHAIVEGRKSEYSLYDEKLATYTAQDEFNHDAAVGFISLFGLPTKVYSQVNQKK

SEQ ID NO: 16448 - protein, 297 aa, Bacillus thuringiensis
VSKLWGGRFTEEAEAWVEEFGASISFDQQLVNQDINGSIAHVTMLAKQGIVTKEEAEKIKVGLQYLLKEAKENKLQFLVEAEDIHLNIEKMLIEQIGEVGGKLHTGRSRNDQVATDMHLYLKEKVEHIIKATKQLQTVLVHQAENNIETIMPGYTHLQRAQPISFAHHILAYFWMLERDVNRYEDSLKRINISPLGAGALAGTTFPIDREYSAELLGFNGIYENSLDAVSDRDFILEFLSNSSMLMMHLSRFCEELILWSSQEFQFIEMSDQYATGSSIMPHKKNLDMAELIRGKTG

SEQ ID NO: 16449 - protein, 378 aa, Bacillus thuringiensis
MEFTLTREKQMIKEMVRDFAEKEIAPKAVYYDKTAEFPYETFQKMGELGLLGIPFPEEYGGSGGDTVSYALAVEEIGRACGGTGLSYAATISLGASPIYYFGTEEQKQKYLVPMASGKTLGAFGLTEPNAGSDAGGTQTKAVLDGDEYVISGEKCWITNAEYANTIIVTAVNGVEENGRKRISAFIVPTTSEGLTISSPYDKMGVRASNTCEIVLDGVRVPKENILGDVNKGFKQFLYTLDGGRISIAALAVGIAQSAFERALQYAKERQQFGKSISNFQAIQFKLADMATEVELARNLVHKAAWLKDNDKPFGKEAAMAKLFASEAASRIANQAVQIHGGYGYMREYEVERHIRDAKLLEIGEGTSEIQRLVIARHL

SEQ ID NO: 16450 - protein, 179 aa, Bacillus thuringiensis
MKENTKKELFSWAKTIGFTLVLIAIIRGVLFTPSLVQGESMMPTLENNERVLVNKIGYSISGLDRFDIIVFHGKEGYDLVKRVIGLPGDTVEYKNDVLYVNGKAMEEPYLKQFKEKAVGRVLTPDFTLEQITGKTKVPEGQVFVLGDNREVSKDGRMFGFISEDEIVGKGQAVFWPLKQ

SEQ ID NO: 16451 - protein, 481 aa, Bacillus thuringiensis
EIKRVKNHINGEWVESTGTEVEAVPNPATGKIIAYVPLSPKEDVEKAVEAAKAAFETWSKVPVPNRSRNLYKYLQLLQENKDELAKIITLENGKTLTDATGEVQRGIEAVELATSTPNLMMGQALPNIASGIDGSIWRYPIGVVAGITPFNFPMMIPLWMFPLAIACGNTFVLKTSERTPLLAERLVELFYEASFPKGVLNLVQGGKDVVNSILENKDIQAVSFVGSEPVARYVYETGTKHGKRVQALAGAKNHAIVMPDCNLEKTVQGVIGSAFASSGERCMACSVVAVVDEIADEFIDVLVAETKKLKVGDGFNEENYVGPLIRESHKERVLGYINSGVADGATLLVDGRKINEEVGEGYFVGATIFDGVNQEMKIWQDEIFAPVLSIVRVKDLEEGIKLTNQSKFANGAVIYTSNGKHAQTFRDNIDAGMIGVNVNVPAPMAFFAFAGNKASFFGDLGTNGTDGVQFYTRKKVVTERW

SEQ ID NO: 16452 - protein, 504 aa, Bacillus thuringiensis
IQTSNLGYPRIGLQREWKKTLEAFWSNKIDEEQFLTTMKEIRLQHVKVQQEKGIELIPIGDFTYYDHVLDTAYMLGFIPSRFSEFTSYLDVYFAMARGSKDHVASEMTKWFNTNYHYIVPEYEEGLQISLKDNRPLRLYEEAKQELGVDGKPVILGPYTFLKLAKGYTQEQFPNILKQLVAPYVQLLSELHAAGAQAIQVDEPIFASLTKKEVQQAKEIYEAIRKEVPNATLLLQTYFDSVEENYEEIITFPVSGIGLDFIHGKEGNLNAISKYGFPADKTLAVGCIDGRNIWRADLDEVLELFTTLQKQVQTKDIIVQPSCSLLHTPIDKTEETHLSTELFDALAFANQKLEELVLIHSALTQGTESISNELETYRNVHHTIRSSAARNREDVKAARTALKEEDFSRSLPFEKRYELQQVALELPLLPTTTIGSFPQTTEVRQTRKEWRNGVISNDQYEQFIEKETEKWIRYQEEIGLDVLVHGEFERTDMVEYFGERLAGFS

SEQ ID NO: 16453 - protein, 408 aa, Bacillus thuringiensis
LIKKYTCKNGVRIVMENIPTVRSVAIGIWIHAGSRNENEKNNGISHFLEHMFFKGTETRSAREIAESFDSIGGQVNAFTSKEYTCYYAKVLDEHAKYALDVLADMFFNSTFDEEELKKEKNVVCEEIKMYEDAPDDIVHDMLTKATYETHPLGYPILGTEETLDTFTGDTLRQYIKDHYTPENVVVSVAGNIDEAFLQTVEQYFGSYEGTTNREQVHSPIFHFNKVARKKETEQAHLCLGYKGLQMGHEDIYNLIVLNNVLGGSMSSRLFQEVREQRGLAYSVFSYHSSYEDTGMLTLYGGTGSQQLDTLYETMQETLETLKNTGITEKELINSKEQLKGNLMLSLESTNSRMSRNGKNELLLRKHRSLDEIIESVNTVTKENVDGLIRNMFTDEFSAALISPDGKLP

SEQ ID NO: 16454 - protein, 470 aa, Bacillus thuringiensis
MKKHLYINGDWKSVNTYKPLYAPYSEETLAEIAQGTEEDVKEAVTAAKNAMTKMNTLSAYDRATILEKVAQKMDERREEFAEIIAKEAAKPIRAARGEVDRTVQTYKFAAEEAKRIYGETLPLDAAPGADGRIAYTIRKPIGVIGAITPFNFPLNLVAHKVGPAIAAGNTVVLKPADQTPLSSYALVELFEEAGLPNGALNIISGPGSTVGEAIVKNDYVASITFTGSPKVGIGIKQKAGLKRVTLELGSNAAVIIDEDVELTDEIIERVKWGAFVNNGQVCISVQRVFVHETKMHEFLSKLKKAMESVVVGDPLLEETDVSALISKRDVERIDMWVQEAIKEGATVLCGGKKRDARIFEPTVLKNVPNHVSVQCQEVFGPLMTVNTFKEFDEAIEQVNNSRYGLQAGVFTNNLFKAMRAIDELEVGGVMINDIPTFRVDHMPYGGVKESGTGREGIKYAIEEMTEMKLV

SEQ ID NO: 16455 - protein, 263 aa, Bacillus thuringiensis
IKVIIAGPRGRMGHEAVLLMERTEHFNLVAAVDYKHGGEKISDLPGMPALHAPIYADLHTCLDEVEADVLLDLTTPEVGKQHVTLAVERGLRSVIGTTGFTEEELARLTENAKEKAVGTIIAPNFAIGAVLMMKFSQMAAKYFQDVEVIELHHDQKLDAPSGTAVKTVELIRQNRESKQQGHPKEVEQLAGARGANVDGIHIHSVRLPGLIAHQEVMFGGDGQMLTVRHDSFNRASFMSGVKLSIETVMNLDHLVYGLENIID

SEQ ID NO: 16456 - protein, 323 aa, Bacillus thuringiensis
QQSTGDRLAEIKQHKQELDAKLQQQKENVDQTLNELNKVKENVDTKVNELHERKQVADEKINEVKQHKQELDAKLQQDIQIAEDKIAEIKEHKKQVEDKVAEVKEHKQNIDNKVNEIKEHKQTVDEKVNEMKQHKENIDQKVNELKEVKKQVDEKLAELKKAKQTAEDKLAELKENKPNTGNTLEELKKIKGNLDSLSANLELAKQDVKNKLAVLQEARQDLINKINEIKQSKQTVSDDLSKKKQDLDIKINDFKHTEKKIDDKLAELHTTKQNVDNKINEVSQSKQTQADNGTKNNNAKELPNAGSEQSNNMALGMLSVLGG

SEQ ID NO: 16457 - protein, 551 aa, Bacillus thuringiensis
  unsure (1)..(551): unsure at all Xaa locations
MNKTWWKEAVAYQIYPRSFMDSNGDGIGDLQGIIAKLDYLKDLGIDVIWICPMYKSPNDDNGYDISDYQDIMDEFGTMADFDALLDEVHKRDMKLIIDLVINHTSDEHPWFIESRSSKDNPKRDWYIWHDGKDGAEPNNWESIFNGSAWEYDEETEQYYLHLFSRKQPDLNWENKEVREVLYDTVNWWLDKGIDGFRVDAISHIKKEEGLKDMPNPKELKYVPSFXXHMNVKGIQPLLEELKENTFSKYDIMTVGEANGVKIEDAELWVGEEQGKFNMVFQFEHLSLWDAEKKKDLDVVGLKKVLTKWQKGLENKGWNALYIENHDKPRIVSTWGDDKQYWRESATALGAMYFFMHGTPFIYQGQEIGMTNVQLPNIEDYDDVAIKNLYREKIAEGVPHQDMMEIIWASCRDNSRTPMQWNDEMNAGFTTSTPWFSMNPNYKEINVEKQKNEEKSIFNFYKKMIALKKEHDVLNYGTYDLLLEEDPQIYAYTRTLQDEKVIVISNISKEEAVYNEGSFALKRKRLLLNNYEVAEHEEVTTIAKKPYETRVY

SEQ ID NO: 16458 - protein, 383 aa, Bacillus thuringiensis
FRMPKSVLYGRNSLEKLGEQSKKLGKRAFIVTDTIMEKLGYVEKCMQQLNKKGIIVSTYNKVDAEPTNIHVLEALSLCKEEKCDFIIGIGGGSCIDAAKAVAVLYTNGGEVEDYVQKDIEIENNPLPLIAIPTTSGTGSEVTSVAVITNKKTDVKMMMKHPSFIPKVAIIDPVLTSSLPPQITAATGIDALCHAIEAYISKFSQPLTDVLALSAIESIMKYLRIAYEDGHNMEAREAMMIASLQAGIAFSNASVTLVHGMSRPVGALFHVPHGISNAILLPTVLEFTKTSAVKRLAKIGRNLNKDLYSNSDEEVADYTIGEIKKLCYDLRIPNLKEYGIDEIEFENAISKMASDAIESGSPANNPRVPSYDEIKELYRECFNY

SEQ ID NO: 16459 - protein, 490 aa, Bacillus thuringiensis
MITLTGHTLTVEEMKRLLLEGEGVTACPTSMQKVAECREVVEKIVEDGKVVYGITTGFGKFSDVLIQKDDVKALQHNLIQSHACGIGDPFPEEVSRGMLILRANTMLKGVSGVRPLVVNMLLEFVNRKIHPVVPQQGSLGASGDLAPLSHLALVLLGEGEVFYKGKRVHAMVALTEEGLEPIELEAKEGLALINGTQAMTAQGVLSYIEAEATAYQAELIASMTIEGLQGIIDAFDENVHKARGYKEQVEVASRIRDILHDSKLTTKQGELRVQDAYSLRCIPQVHGASWQVLNYVKEKLEIEMNAATDNPLIFDGGEKVISGGNFHGQPIAFAMDFLKVGMAELANISERRIERLVNPQLNDLPPFLSPEPGLQSGAMIMQYAAASLVSENKTLAHPASVDSIPSSANQEDHVSMGTIASRHAHQIIQNARRVLSIEMICAMQAAEYRGIENMSTVTKSFYHQGRQQVPSIKNDRIFSTDIENIAHWLK

SEQ ID NO: 16460 - protein, 307 aa, Bacillus thuringiensis
  unsure (1)..(307): unsure at all Xaa locations
RTLGKTGITVSEIGFGAWAIGGDEWGPVNDKQSITAIKKAIECGVNFIDTADVYGLGHSEKLVATAIKGHRNDIILSTKGGLIGHHYDPNGVPVYDTPEKIIAVFETSLQRLQTDYIDLYFCHIWWHNRRETEAFLRAFDILKRDGKVRAVGVSTHDLQYIHHFNNNNEIDIVQLDYNILNRKPEKDILPFLQEKNLGAVIRGPLKMGILTGKFTNKTIFPDGDLRKDWPNEIWFQEDLQTVEKLRLLSNKNQILGQLALRYVLSHPAVSVVIPGAKTGTQAQENANASVRPILSDEELNYIHSIXK

SEQ ID NO: 16461 - protein, 324 aa, Bacillus thuringiensis
NLAKFPRKKYTESYTPIEKLNNFSEALGGPTIYFKRDDLLGLTAGGNKTRKLEFLVADAQENGADTLITAGGIQSNHCRLTLAAAVKEKMKCILVLEEGLEPEEKRDFNGNYFLYHLLGAENVIVVPNGADLMEEMHKVAKEVSEKGNTPYVIPVGGSNPTGAMGYVACAQEIMAQSFEQGIDFSSVVCVSGSGGMHAGLITGFSGTQSQIPVIGINVSRGKAEQEEKVAKLVDETSAHVGIPNFIPRDAVTCFDEYVGPGYALPTPEMVEAVQLLAKTEGILLDPVYTGKAVAGLIDLIRKGKFNKEDNILFVHSGGSPALYA

SEQ ID NO: 16462 - protein, 274 aa, Bacillus thuringiensis
TVHIPTTTLHNGVKMPMIGLGVYKAKEGDEVKQAVKTALEVGYRSIDTATVYENESGVGEAIRESGIPREDIFITTKVWNDDQGYEETLEAFEKSLKKLQMDYVDLYLIHWPVRGKYVDTYRALEKLYEEGKVRAIGVSNFHKHHLELLLPNCKVKPMVNQVELHPMLTQFELRNYCQDEQIQMEAWSPLMRGGEVFQHPIIQAIANKYEKTPAQVILRWDIQIGIVTIPKSVTPSRIEENFTIFDFALTEEEIRQINTLNRDLHVGTNPDKYD

SEQ ID NO: 16463 - protein, 229 aa, Bacillus thuringiensis
YLEDVLLLAMEKGFYSININTEKLTHIFDPEPHLIENRFNDGKCDPAGRFWAGSTDTYGMNTAGSLYCLHHNLSVEKKVSHVNTSNGIAWSPDHTYFYFIDTPTKKVVRYQYNIRTGDIHNPIDVIIFSENDGLPDGMTIDEDGCLWIAHWGGSKITRWNPSTGEKILSIPIPALYVTSCTFGGPNLTDLYITTARTRMTDDELKEYPHAGGIFRIQTNVKGVPPIHFA

SEQ ID NO: 16464 - protein, 254 aa, Bacillus thuringiensis
VKEKVVIITGGSSGMGKGMATRFAKEGARVVITGRTKEKLEETKLEIEQFPGQVLPVQMDVRNTDDIQKMIEQIDEKFGRIDVLINNAAGNFICPAEDLSVNGWNSVINIVLNGTFYCSHAVGKYWIEKGIKGNIINMVATYAWDAGPGVIHSAAAKAGVLAMTKTLAVEWGRKYGIRVNAIAPGPIERTGGADKLWISEEMAKRTIQSVPLGRLGTPEEIAGLAYYLCSDEAAYINGTCMTMDGGQHLHQYPF

SEQ ID NO: 16465 - protein, 405 aa, Bacillus thuringiensis
RLMYKLADLMEEHKEELAQLETLDNGKPIRETMAADIPLAIEHMRYYAGWATKIVGQTIPVSGDYFNYTRHEAVGVVGQIIPWNFPLLMAMWKMGAALATGCTIVLKPAEQTPLSALYLAELIEEAGFPKGVINIVPGFGESAGQALVNHPLVDKIAFTGSTPVGKQIMRQASESLKRVTLELGGKSPNIILPDADLSRAIPGALSGVMFNQGQVCSAGSRLFVPKKMYDNVMADLVLYSKKLNQGVGLNPETTIGPLVSEEQQKRVMGYIEKGIEEGAEVLCGGSNPFDQGYFVSPTVFADVNDEMTIAKEEIFGPVISAIPFNDIDEVIERANKSQFGLAAGVWTENVKTAHYVASKVRAGTVWVNCYNVFDAASPFGGFKQSGLGREMGSYALNNYTEVKSV

SEQ ID NO: 16466 - protein, 241 aa, Bacillus thuringiensis
LNGKTAVVTGAAQGIGKEIARVYAKLGAKVLISDVNEETLQKTTRELSDEGYEVCSYRCDVSNQNEAKSLIEYAVQKFGTLHILVNNAGITRDAMLHKMEKSAWEQVLQVNLTGVFYCMQPALLYMRQQGYGRIINISSISREGNIGQANYAATKAGVVGLTKTAAKEVGSFGITCNAICPGFMDTDMTKTIPDKVKEKMVGAIPVGRIGTPEDIANAAAFLASEYASYITGEVLNVSGGL

SEQ ID NO: 16467 - protein, 365 aa, Bacillus thuringiensis
MKRQLILEDGTVLIGTGFGGEIEKSGEVVFTTGMTGYQETLSDPSYCGQIVTFTYPLIGNYGINRDDFESIHPSVNGLIVNEICDHPSNFRNEISLNDYLKERNIPGLAGIDTRKLTRKIRQYGTLRGRLCNMDADVEYIVSQLKATVFTDHVKRVSTKDPYPSPGRGHRVVLVDFGMKHGILRELNKRDCDVIVVPYNTTAEEILRLSPDGIMLSNGPGDPKDVSEAIEMLKDIIGKVPLFGICLGHQLFALASGANTSKLKFGHRGLNHPVKNLATGKVAITSQNHGYAVEEESVENTDLEITHVALNDGTVEGLRHKKFPAFTVQYHPEASAGPEDANDLFEDFLNMIENFKKEGEELCQNA

SEQ ID NO: 16468 - protein, 98 aa, Bacillus thuringiensis
GQKQRVSIARALVRKPPILILDDSTSAVDAKSEATIQTALKTKYKGTTTLLIASKISSIMDADKILVLDNGELVGNGTHEQLLERSEVYQEIYLSQGG

SEQ ID NO: 16469 - protein, 567 aa, Bacillus thuringiensis
RIWNYMGYQKAALMFVIFLVVVTTLLGLLGPYFMGVIIDQYIVPKDLSGTARMCMLLIAIYGVTVLLTWLQTFVMINVALKTIQKIRQDIFEKIQTLSLRFFDVRSQGDLMSRVTNDIDNLNQALTQSVVQIISSALTFIGVTIAMFALNWILAIVTLITVPIMFYVTKKLVAYSGKNFAKRQKDLGELNGFIEEAITGADVTTLYGKEKETVQNFNKINEQLRVSATKADTFSAFIFPSMNFINNLGMGLVIGTGSVMVLNGMTTVGVIAAFINYSRQFSRPLSQFATLMNTIQAAVAGGERVFEIMDEVPEIQNKKDAFVVQNLQGHVALENVSFGYAENKTILKEVSLKAQPGETIALVGPTGSGKTTIINLLTRFYDIQQGQIHIDGKDIKDYDINSLRSKIGVVLQDTYLFAGSIMDNIRYGRLDATDEEVITAAKAASAHSFIKHLPNQYETEIASEGSNLSQGQKQLLAIARAILADADILILDEATSNIDTRTELQIQAGLNNLMRGRTSFVIAHRLKTIEKADQILVIKDGRILERGNHESLMEDRGFYFDLYTSQFK

SEQ ID NO: 16470 - protein, 250 aa, Bacillus thuringiensis
KKIAIVTGATRLNGIGAAVCKVLAQKGIDIFFTYWPKYDKAMPWGMSDQEPFLLKKEIESYDVRCEMAEINLSQSYSPNRLFYMVSERLGDPSILVNNAVYSNHTRIEELDVEQLDEHYTVNVRATMLLSSMFIKHYSLKTGGSIINLTSGQSVGPMPDELAYAATKGAIEAFTKSVAPVAMEKGITVNAVDPGPTNTGWITEELKHHLVWKFPQGKVGEPVDAARLISFLVSEEAKWVTGQVIHSNGGY

SEQ ID NO: 16471 - protein, 262 aa, Bacillus thuringiensis
ALRNVNIEVKQGEIFGFLGPSGSGKTTTVKILTSQLLHSVGTVRVLGKDITGPSSIDYKRIGILTDNSGLYERLSIYDNLLLFCDLYDCKKERIDEVLAQVNLLDDKKTPVKKLSKGMKQRVTLARAILHKPDILFLDEPTSALDPVNVQNIHKILKDLNKEGTTIFLTTHNMDEAETLCNRIAFLCGGEIVALDTPENLRLQYAKDQIQVVLKDKKKETVQKDELGAKRISEWMNKGELLSIHSHEPTLGDIFIEVTGRGL

SEQ ID NO: 16472 - protein, 273 aa, Bacillus thuringiensis
LRIENISFQYPGAATYALKDVSFSLYEGEWVSIIGQNGSGKSTLAKLLNGLFLPEAGTITVNDTMVLSEETVWDVRKQIGMVFQNPDNQFVGTTVQDDVVFGLENIGMPREQMIERLEQALRLVRMEDFLNDEPHSLSGGQKQRVAIAGVLALQPSILILDEATSMLDPQGRREVVETVRQLVTQKGITVLSITHDLEEAAQSDRVIILNKGEILEEGTPEKIFKSSHMLQEIGLDVPFSVKIAELLKRNEILLQNTHLTMESLVNELWRLHS

SEQ ID NO: 16473 - protein, 165 aa, Bacillus thuringiensis
EMKSIYITGYMGAGKTTIGKALSKELQMDVVDTDQKIEEKQEKAIRKIFAEEGEMAFREYESEMLRALPVHNVIITTGGGIIERAENRKWMKENGTVVYLYCDPHVIAERLREDTTRPLFQKKDIDAFVKKFESRRAYYEEAHIHIDTTNKSVKQIMNELKEKIN

SEQ ID NO: 16474 - protein, 324 aa, Bacillus thuringiensis
SKSRITAIGTYVPDQILSNNDLEKMVHTNDEWIVQRTGMKERRIASEEEYSSNLAIKAIKNLCTTYKKNLEDVDCIIVATTTADYVFPSVACQIQQYFNIPHTLAFDLNATCAGFTYGLHVGNSLITSGSHEKILVVATETLSKVTDYTDRTTCILFGDGAGAILLERDEDIPSFIAAHMGTNGDGGIHLYSTNLSTTMNGTPLQTNEKIVQNGREVYKWATRTVPKGIKNLLHNANMQGDDIDWFIPHSANLRMIESICEKSQIPIQKTLTSVEYMGNTSSVTIPLALDLAIKEGKLNNGDTLLLYGFGGGLTHLGLIVEWNL

SEQ ID NO: 16475 - protein, 1039 aa, Bacillus thuringiensis
  unsure (1)..(1039): unsure at all Xaa locations
QILTYHXQERRGVFEEAAGVLKYKLRKKKAEGKLAETQENLNRVQDIIHELSSQVEPLERQASIAKDYLENKEELEKVEAALIVHEIEELHEKWEALRNQFGHNKNEEAKMSTNLQKSEEELEELRGQLQAVDESVDSLQEVLLLSSKELEKLEGQRELLKERKQNATTHCAQLEQLIVELTEKAKSYDGEIESSTESLMQFVNEVKELEQKLHDNEQLLATFADNLEEQIENLKGDYIELLNQQASHRNELSMIEEQSKQQTSKNERLDEENAKYVEMRMEITAKKTKLVESYEQAKEKVAGILSNIQKTEAALGKCKTQYSENETKLYQAYQFVQQARSRKEMLEEMQEDYSGFYQGVREVLKARENRLQGIEGAVAELLTVPKEYEVAMEIALGAAMQHIVVQTEEHARNAIAFLKQNKHGRATFLPQAVIKSRSLSFEQLRIANQHPSFVGVAAELVQYNNKYENVVSNLLGTVIVAKDLRGANELAKQLQYRYRIVTIEGDVVNPGGSMTGGAVKQAKSSLLGRQRELEEWTRKLTDMEEKTTKLENFVKAVKQEIQEKEVKIRELRQTVEADRVDEQKLREEINRLELEEHRINDRLSIYDLEIEGFLQDRVKMQGRKEELEGVLTNLQAEITKLDSKIVALTKQKSEQHSSKEKVQKEMTELKVLAAEKQQRLSNQKEKVERLTKEKEETDATLVKTKEDLAFLKQEMTSNSSGEEQITNMIEKKAYDRNQTSELIRSRREQRVSLQERVEHLERNLKETTGKHKYVLEMLKDQEVRINRLDVELENRLQHLRETYTISFEAAKLKYTMTMPAEDARKKVKLIKLSIEELGTVNLGAIDEYERVAERHTFLLEQRDDLEEAKATLHQLITEMDEEMKKRFSTTFEGIRMEFQSVFSELFGGGRADLVMTNPEDLLNTGIDIVAQPPGKKLQNLGLLSGGERALTAIALLFGILKVRPVPFCVLDEVEAALDEANVARFAQYLKKFSDETQFIVITHRKGTMEESDVLYGVTMQESGVSKLVSVRLDAGEELI

SEQ ID NO: 16476 - protein, 339 aa, Bacillus thuringiensis
MGNIHIQTKSKEYDVHVGKEALSNLTTIVQNMQPAVSNVMIISDEAVASLHLQTVIDALQVEQHVFSFVVPSGEKEKSFENFYAAHTSALENKLDRNSLILALGGGMIGDLAGFVAASFMRGIRFVQVPTTLLAHDSAVGGKVAINHPLGKNMIGAFHQPEAVVYHTPFLQSLPEKEWRSGYAEVIKHALIGDVELYHWLKEEVQTLADLHDEKLIHILTKAIPVKANVVSQDETEKGVRAHLNFGHTLGHALEKELGYGNITHGDGVAVGMLFAIFLSEQVYKVDLAYEDMKQWFLKYGYPKMPRDLNVERLVQLMKQDKKANAGAIHMVLMQEYGVV

SEQ ID NO: 16477 - protein, 584 aa, Bacillus thuringiensis
MEVRNEIKKKGSWRQFLRLIQDTNPPKGILVFALLMSLLSTGASLFIPMLTKGLVDNFSLSSISAGQIVGLIAFFVMQTIAAGLSIYLLNYIGQKIVAGLRERLWKKVLILPVSYYDQNRTGDTISRMTNDTGVVKTLISEHLSNLLTGGISIVGSLIVLFVLDWKMTALLLTVIPLSVLILVPLGRKMYKISKALQDETASFTSVLTQVLSEIRLVKSSNTEKREYETGNTGIQKLLQFGLKEGKVQALISPVMSFVLMALLVIIVGYGGMRVSSGALTTGELVAFILYLVQIVMPMSQLSMFFTQFQKAIGATERISTILEYEVEDHETGVKVTNAKQPIVLENVHFEYNEEEQVLKNIDFTIESGKVTAIVGPSGSGKTTLFSLLERFYEPTSGAIKLGEESITSYSLQSWRRQIGYVSQDSPLIDGTIRDNICYGVEGEVTDEEIEKVAAMAYVDAFIHDLPNGYATEVGERGVKLSGGQRQRIAIARALLRNPQILMLDEATSSLDSKSESVVQKALNNLMKGRTTLVIAHRLSTVVDADKIVFIEKGNLTGSGTHDELLQTHDMYREFATQQLKIKEG

SEQ ID NO: 16478 - protein, 312 aa, Bacillus thuringiensis
MKKGINRVVLVGTGAVGCSYAYCMINQAVAEEFVLVDVNEAKAEGEAMDLSHAVPFAPAPTRVWKGSYEDCKDADLVVITAGLPQKPGETRLDLVEKNAKIFKQIVRSIMDSGFDGIFLIATNPVDILTYVTWKESGLPKERVIGSGTTLDSARFRYMLGEYFDIGPHNIHAYIIGEHGDTELPVWSHVSVGIQKLQTLLEKDNTYNQEDLDKIFINVRDAAYHIIERKGATYYGIGMSLLRVTKAILNDENSVLTVSAYLEGQYGQKDVYIGVPAVLNRGGVREILEVELSEDEELKFDHSVQVLKETMAP

SEQ ID NO: 16479 - protein, 398 aa, Bacillus thuringiensis
METIVQKFGGTSVGSVERIQHVANLIIEEYERGHSIVSVVSAMGKSTDELVALANAITENPSKREMDMLLSTGEQVTISLLTMALQAKGYHAISLTGWQAGITTESVHSSARITDIHTDRIQSYLAEGTIVIVAGFQGISVENEITTLGRGGSDTTAVALAAALKAKKCDIYTDVTGVYTTDPRVVKDAYKLDEISYDEMLELANLGAGVLHPRAVEFAKNHNVVLEVRSSMEQENGTIVKGECNMEQQSIVKGIAFEDNITRVTIKGLEQGSLSTVFSTLAAAHINVDIIIQSITNEGTVHLSFSIHSNDLRETLEVLEQNQETLHYESVEHENHLAKVSIVGSGMVSNPGVAANMFTTLKEEDIHIKMVSTSEIKVSVVIDRLHLVTGVEALHQSF

SEQ ID NO: 16480 - protein, 160 aa, Bacillus thuringiensis
MIVSFMVAMDENRVIGKDNNLPWRLPSELQYVKKTTMGHPLIMGRKNYEAIGRPLPGRRNIIVTRNEGYHVEGCEVVHSVEEVFELCKNEEEIFIFGGAQIYDLFLPYVDKLYITKIHYAFEGDTFFPEMDMTNWKEIFVEKGLTDEKNPYTYKNHVYEK

SEQ ID NO: 16481 - protein, 204 aa, Bacillus thuringiensis
KYIVFDFDGTLVDSQNIFVPIYNQLAEKHGYKAVKEDEIEHLRKLTMPERCKQLNVPLYKLPILALEFYKLYQPAIKNLVLFHGMKEVLDELHKKGYGIAVISSNSEEHIRAFLQKNDIENIQEVYCSKNLFGKDKMIKRFLKSKKITEKDMLYVGDEQRDVAACKKAGVNVIWVSWGYDVIETVKKDAPDYMVHKPMEIVQVV

SEQ ID NO: 16482 - protein, 479 aa, Bacillus thuringiensis
MATLTEVKNGVRIEKDFLGEKEVPNYAYYGVQTMRAVENFPITGYKIHEGLIKAFAIVKKAAALANTDVGRLELNKGGAIAEAAQEILDGKWHDHFIVDPIQGGAGTSMNMNANEVIANRALELLGMEKGDYHYISPNSHVNMAQSTNDAFPTAIHIATLNALEGLLQTMGYMHDVFELKAEQFDHVIKMGRTHLQDAVPIRLGQEFKAYSRVLERDMKRIQQSRQHLYEVNMGATAVGTGLNADPEYIEAVVKHLAAISELPLVGAEDLVDATQNTDAYTEVSAALKVCMMNMSKIANDLRLMASGPRVGLAEIMLPARQPGSSIMPGKVNPVMPEVINQIAFQVIGNDHTICLASEAGQLELNVMEPVLVFNLLQSISIMNNGFRAFTDNCLKGIEANEDRLKEYVEKSVGIITAGNPHIGYEAAARVAKEAIATGQSVRELCVKNGVLSQEDLELILDPFEMTHPGIAGATLLKKN

SEQ ID NO: 16483 - protein, 355 aa, Bacillus thuringiensis
KLGKLGGKTILYFEIITTIAILMGLLAANIFQPGTGVDMSNLQQSDISSYKQTADATEKKGFAETIVHIVPKNVFESIAQGDLLPIIFFSVLFGLGVAAIGEKGKPVFNFFEGVLEAMFWVTNQVMKFAPFGVFALIAVTVAKFGVATLLPLGKLVLAVYVTVILFVVIVLGINARMVGVNIFTLIKILKEELILSFTTASSEAVLPNIMRKMEEFGCPKAVASFVIPTGYTFNLTGSAIYQALAALFVAQMYGVHMSLTEQITLLFVLMLTSKGMAGVPGASFVVVLATLGSMGLPLEGIALIAGIDRILDMIRSSVNVLGNALAAIVMSKWEGEFDNEKAKQYVETVKETKAA

SEQ ID NO: 16484 - protein, 266 aa, Bacillus thuringiensis
MDKQIGFIGCGNMGMAMIGGMINKNIVSSNQIICSDLNTANLKNASEKYGLTTTTDNNKVAKNADILILSIKPDLYSSIINEIKEVIKNDAIIVTIAAGKSIESTENAFNKKVKVVRVMPNTPALVGEGMSALCPNEMVTEKDLEDVLNIFNSFGQTEIVSEKLMDVVTSVSGSSPAYVYMIIEAMADAAVLDGMPRNQAYKFAAQAVLGSAKMVLETGIHPGELKDMVCSPGGTTIEAVATLEEKGLRTAIISAMQRCTQKSVEL

SEQ ID NO: 16485 - protein, 415 aa, Bacillus thuringiensis
MNEVLAKGIKAKEVARELVLKTTDQKNEALAAIANQLIVETAYILEENKRDIEEGKEKGFSHSLLDRLLLNEQRIVDMTEGIKQLIELRDPIGECVSAWERPNGLSIQEMRVPLGVVGMIYEARPNVTVDAATICLKTGNAVILRGSSSAIHSNKAIVSVIHRALKQTSLPSESVQLIEDTTRDSAKQLFTLNEYLDVLIPRGGKQLIDTVVREASVPVLETGAGNCHIFIDETADKQMAFNIIINAKTQRPSVCNAIETIVLHENWAEQYGSELFSSLKERGVELRGDNKAVAIDPSILLATEEDWETEFLSLTLAVKVVSTVEEAIHHINTYGSMHSEAIITENEENVSKFFTSVDAAALYHNASTRFTDGSEFGFGAEIGISTQKLHVRGPMGLPALTSTKYVIRGNGQIRK

SEQ ID NO: 16486 - protein, 427 aa, Bacillus thuringiensis
FLELGISETFNHTLRENGITEATPIQEQAIPVIMSGKDIIGQAKTGTGKTLAFVLPILEKIDSESSDVQALIVAPTRELALQITTEIKKMLVQREDINVLAIYGGQDVAQQLRKLKGNTHIVVATPGRLLDHIRRETIDLSNLSTIVLDEADQMLYFGFLYDIEDILDETPGSKQTMLFSATMPKDIKKLAKRYMDEPQMIQVQSEEVTVDTIEQRVIETTDRAKPDALRFVMDRDQPFLAVIFCRTKLRVSKLYDNLKGLGYNCAELHGDIPQAKRERVMKSFREAKIQYLIATDVAARGLDVDGVTHVFNFDIPEDVESYIHRIGRTGRAGGSGLAITFVAAKDEKHLEEIEKTLGAPIQREIIEQPKIKRVDENGKPVPKLAPKKSGQNRQEIAAKVQEVNQDVIQEIAQEVIQEIVREIVLEM

SEQ ID NO: 16487 - protein, 258 aa, Bacillus thuringiensis
FRNLRRTLYRLMIELTNGRFTSYILRKFAQSRLSSIIIPSYAKVFQINQDEMEKGLKEYRTLHELFTRKLKEGKRSIDTDASSIVSPVDGVFADHGPIEDTKTFDIKGKRYSIVDMLGNEERATRYAGGTYMVIYLSPSHYHRIHSPLSGSVTERFVLGRKSYPVNAAGMEYGKEPLSKNYRSVTEVSSDGEHMALVKVGAMFVNSIELLHERDTVQKGEEMAYFTFGSTVVLLFEKDMIEVVQELKSGQELRLGEKI

SEQ ID NO: 16488 - protein, 259 aa, Bacillus thuringiensis
LGGYIMELLQGKTFVVMGVANQKSIAWGIARSLHNAGAKLIFTYAGERLERNVRELADTLEGQESLVLPCDVTNDEELTACFETIKQEVGTIHGVAHCIAFANRDDLKGEFVDTSRDGFLLAQNISAFSLTAVAREAKKVMTEGGNILTLTYLGGERVVKNYNVMGVAKASLEASVKYLANDLGQHGIRVNAISAGPIRTLSAKGVGDFNSILREIEERAPLRRTTTQEEVGDTAVFLFSDLARGVTGENIHVDSGYHI

SEQ ID NO: 16489 - protein, 366 aa, Bacillus thuringiensis
NPKVLILTAHYGNGHVQVAKTLEQTFRQKGIEDVIVCDLFGESHPFITDITKYLYLKSYTIGKELYRLFYYGVEKIYDKKIASWYANFGRKRLKTLLQVEKPDIVINTFPIIAVPELKKQTGISIPVYNVLTDFCVHKIWIHREVDRYFVATDHVKELMVDIGVPAEQIVETGIPIRSSFELKVNPEIIYNKYQLCKNKKILLIVAGAHGVLGNVKELCQSFMSVPNLQVVVVCGKNEALKQDLLSLQKQNSDALKVFGYVENIDELFRVTSCMITKPGGITLSEAAALQVPVILYKPVPGQENENAMYFERKGAAVVIRDDSEVFAKTEALLQDDVKLLQMKEAMKSIYLPEPAGHIVDAILAEN

SEQ ID NO: 16490 - protein, 463 aa, Bacillus thuringiensis
FDFQRNYLLKDMFQVHKAHITMLTEENLMKKEEAKVILHALKKVEGIPEEQLLYTEQHEDLFFLVEHLISQEAKCDFVSNMHIGRSRNDMGVTMYRMSLRRYVLRLIEHHLLLQESVLQLAADHKETIMPAYTHTQPAQPPTFGHYTLAIYDTMQRDLERMKKTYQLLNQSPMGAAALSTTSFPIKRERVAHLLGFTNVIENSYDAVAGADYLLEVSSLLMVMMTNTSRWIHDFLLLATKEYDGITVAKSYVQISSIMPQKRNPVSIEHARAITSSALGEAFTVFQMIHNTPFGDIVDTEDDLQPYLYKGIEKAIRVFCMMNAVIRTMKVEEETLKSRSYKHAITITDFADVLTKNYEIPFRHAHHAASAIANMSLEQKKELHELHFKEVNMYLQEHFKINLLEKEWKEIISPEAFIQKRNVYGGPSKKEMERMIKNRKESFQKEEDVFEKEKQRILQAENAL

SEQ ID NO: 16491 - protein, 351 aa, Bacillus thuringiensis
MANHELDQLRKQVDEINLQLLHLLNKRGEIVQKIGEQKQVQGTKRFDPVREREVLDMIAEHNEGPFETSTVQHIFKTIFKASLELQEDDNRKALLVSRKKKQENTIVDVKGELIGNGTQTFIMGPCAVESLEQVRQVGQAMKDQGLKLMRGGAFKPRTSPYDFQGLGVEGLQILRQVADEFDLAIISEILNPNDVEMALDYVDVIQVGARNMQNFDLLRAVGKVNTPVLLKRGLAATIDEFINAAEYIIAQGNDQIILCERGIRTYERATRNTLDISAVPILKKETHLPVIVDVTHSTGRRDLLLPTAKAALAIGADAVMAEVHPDPAVALSDSAQQMDIPEFHRFMDELK

SEQ ID NO: 16492 - protein, 364 aa, Bacillus thuringiensis
MRYITAGESHGPQLTVILEGVPAGLTLTAEHINKELLRRQKGHGRGRRMQIETDTVEIVSGVRHGMTLGSPITLIVKNDDFKHWTKVMGAEPISEKESKDMKRTITKPRPGHADLNGAIKYGHRDIRNVLERSSARETTVRVAAGAVAKQILSELGVGIAGHVLEIGGVKAKHISNLSIEEIQTITENSPVRCLDKEVEQEMMNAIDNAKSSGDSIGGIVEVIAEGMPIGVGSYVHYDRKLDAKLAGAIMSINAFKGAEIGVGFEAARQPGSKVHDEILWDEKKGYTRKTNNAGGLEGGMTTGMPIIVRGVMKPIPTLYKPLASVDIDTKEAFQASIERSDSCAVPAAGVVAESVVAWELADAL

SEQ ID NO: 16493 - protein, 351 aa, Bacillus thuringiensis
VQVKDQLSSLQPYKPGKSPEQMKEVYGDHSFVKLASNENPFGCSPRVLEELQNSWLEHALYPDGGATTLRQTIADKLHVQMEQVLCGSGLDEIIQIISRAVLRAGDNIVTAGATFPQYRHHAIIEGCEVKEIPLNKGVYDLDEISSAVNNNTKIVWICNPNNPTGTYVNEQKLTRFIEGISENTLIVIDEAYYEYVTAKDFPETLPLLEKHKNILVLRTFSKAYGLASFRVGYAIGQEELIEKLNVVRLPFNVSSLAQKAATIAFGDDEFIKEIVHMNTEGLQQYESFCKENGIPFYSSQTNFIFLPVDNAGEIYEACAHAGFIIRPFPNGVRITVGTREQNEGVISVLKQ

SEQ ID NO: 16494 - protein, 417 aa, Bacillus thuringiensis
LNGNITIPGDKSISHRAVMFGSIAEGKTIIRGFLPGAACLSTISCFKEMGVEITHNGDEVTVVGKGLEGLQEPKAVLDVGNSGTTIRLMSGILANTPFFSCVQGDESIAKRPMKRVTNPLKQMGANIDGREEGTFTPLTIRGGDLKAIEYISPVASAQVKSAILLAGLRAEGVTAVTEPHISRDHTERMLEAFGVKVTREGKTVKLSGGQKLTATDIQVPGDVSSAAFFLVAGAIIPNSKLVLQNVGMNPTRTGIIDVLEKMGATFTVDLINEEASEPAANITIETSSLKGIEIGGDIIPRLIDEIPVIALAATQAEGITVIKDAHELKVKETNRIDTVVAELTKLGARIEATDDGMIIYGKSALKGNTVNSYGDHRIGMMLAIAGCLAEGKTIIEDAEAVGVSYPTFFDELQKLAK

SEQ ID NO: 16495 - protein, 238 aa, Bacillus thuringiensis
MIEITNVSKSYNGSTYAVKDLSLSVPSGEIFGFLGPNGAGKSTTIKMITGIHGVDKGTITINGKNIMEEPMEAKKTFGYVPDSPDMFLRLKGIEYLNFMADMYEVPKEVRQERIESLAKKFDLYNALSDQIQSYSHGMRQKIVIIGVLVHEPDVWILDEPLTGLDPKSAYILKEMMREHADKGKIVFFSTHVLEVAEKICDRVAIINKGNLQFKGNLDEMRDHFKSNESLEKMFLEMT

SEQ ID NO: 16496 - protein, 335 aa, Bacillus thuringiensis
  unsure (1)..(335): unsure at all Xaa locations
RIKIEKRSFXVKVNNMKLQLMYSFLRSDINVIEKELKKTVASEQPLAEEAALQLIEAGGKRIRPVFVLLAGKFGDYKLDAIKHVAVALELIHMACLVHDDVIDAAFLRRGSATVNAKWGDRIAMYTGDYLFAKSLECITNIEIPEAHQALSHTILEVCKGEIEQIKDKYNYNQNLRTYLRRIKRKTALLIAASCQLGAIAAGANRDTVNRLFWYGYFVGMSYQIIDDILDFVSTEEKLGKPAGGDLLQGNITLPALYAMEDPVLRQKITSVHENSTASEIQEIIDAVKNSTAIDQAFAFSERYLHKALEIIKPLPRGKAKYALQNVAKYIGKRKF

SEQ ID NO: 16497 - protein, 148 aa, Bacillus thuringiensis
MEKTFLMVKPDGVQRAFIGEIVARFEKKGFQLVGAKLMQVTPEIAGQHYAEHKEKPFFGELVDFITSGPVFAMVWQGEGVVDTARNMMGKTRPHEAAPGTIRGDFGVTVAKNIIHGSDSLESAEREIAIFFKEEELVDYSKLMNEWIY

SEQ ID NO: 16498 - protein, 212 aa, Bacillus thuringiensis
MRYITAGESHGPQLTTIIEGVPAGLSLVADDINEELARRQKGYGRGRRMQIETDQVQILSGVRHGETLGSPIALVVENRDFAHWTKIMGAEPLTEQEEKEMKRKVTKPRPGHADLNGAIKYGHRDMRNVLERSSARETTVRVAAGAVAKKVLAELGIKVAGHVIEIGGVQAKEITYSSIEELKSITEAYPVRCLDEEAGNQMMKAIDDAKAN

SEQ ID NO: 16499 - protein, 247 aa, Bacillus thuringiensis
MMKLASPKPFTFEGGDRAVLLLHGFTGNSADVRMLGRFLEKKGYTCHAPIYKGHGVPPEELVHTGPEDWWQDVTEAYQLLKDKGFEKIAVVGLSLGGVFSLKLGYTVPVLGVVPMCAPMYIKSEETMYQGILAYAREYKKREQKSPEQIEQEMLEFQKTPMNTLKALQQLIADVRNNVDMIYAPTFVVQARHDEMINTDSANIIYNGVESTLKDIKWYEDSTHVITLDKQRDELHEDVYNFLEQLDW

SEQ ID NO: 16500 - protein, 473 aa, Bacillus thuringiensis
KKVPKYRQIIDYMKEKIENGEWPIGSKIPSQRQLAKLFHVNRSTVITALDELMADGLIQGQIGAGTIVTNNTWSLLATNPPPDWSEYVKAGIHKPSKLMVREINEAEANKTLIHLSKGELAPHLFPLETMQSIIKNVSEELDYFGYEEQKGFYPLREAISKYVKSFGIHASPGSILIVSGALQALQLISIGLLHRKSTVLLEQPSYLYSLHVFQSANINLSGISMDHHGILPNDLLKRIKYSQKNNILYSIPCFQNPTGILMSKERRKEILKICKKEQLPIIEDDIYRELWIDESPPAPLKSIDKHGHVLYIGSLSKTLSPGLRIGWIIGPEPVIDRLSDIKMQTDYGSSSLSQRVAAEWINEGFYEEHVANVRMHLKKRRQIMIRALNKYCADIASWDIPSGGVFIWLKVVHNIPMKKLFSEALSKGILLNPGRIYEEESDQYIRLSYGYASPEQMTNGIKLLSELIRKLTA

SEQ ID NO: 16501 - protein, 219 aa, Bacillus thuringiensis
AAISIKGLKKSFKDKEVLKGVDFEVQRGEIFALLGSNGAGKTTTVNILSTLMKQDSGEVSICGFDVQRQPNHVRQSISLTGQFAALDGMLTGRENLIMIARLRGVSSPAQVADNLLARFSLTDAANQRADQYSGGMKRRLDIAMSFPGRPAVIFLEKPTTGLDPEARIEVWDTVKELADSGTAILRTSQYLKQAEQLADRIAIMHGAIIITAGTLTEKK

SEQ ID NO: 16502 - protein, 177 aa, Bacillus thuringiensis
MSNGIVAKRYAVALFKIAKEKHVLEMFEEELRLVQNVYVKNGELHSFLTQPNISKEQKKTFLANVFGSVSESILNTLYILIDNKRIDILPEIADEYVVLANEERNVADATVYSTRLLSEEEKLNIAEAFAKRTGKDAIRVKNVVDEDLLGGIKVRIGNRIYDGSLQGKLARIQRELM

SEQ ID NO: 16503 - protein, 628 aa, Bacillus thuringiensis
NVFLNEKQLEAVRTTEGPVLTLAGAGSGKTSVLTTRVGYLVNVKQVHPRNILLLTFTQKAAEEIRSRVAKLPGMNHAASSYVVAGTFHSVFLKLLRSQGYNQQILANEKHKQIMIKKILKELRLKDDYDAETMLAMISLEKNKLNRPKDVKAKTPVEQEFKEVYERFEEVKQRYNYIDFDDILLETYYMLENNAPLLTQLQQRFHYIEVDEFQDTSYAQYEIVKLLATPRNNLFIAGDDDQAIYGWRGASHQIILSFPKEFDNTTIIALNTNYRSNPFIVGLGNEVIKLNQERFDKELYSVREEGVQPFYARPATTLDEANQILQLIQEKVESGERNFKDFCLLYRTHSVSRSLLDQLTIHKIPFIKHGASQSFYEHSLIKPVLDHLRLVIEPFRLESLSNILPTMYIGRDDCISFIEREQWKYGEGRFPSLLHFLLLNPSLKPFQVKKVNERIDFIKFIKELEPKKALKEIIHGKGKYLEYLQNNDRSSFTMHKDIQEEMLEELMESATRFTDIPAYLQFIDEAIQGQKEMEALKTMPQKDAVSLMSIHNAKGLEFPCVFLLGASDGILPHTSSLKDANDRVTETSEALEEERRLLYVAITRAKEELYISSPQFFRGKKLDISRFLY

SEQ ID NO: 16504 - protein, 321 aa, Bacillus thuringiensis
MKALCFETFGDADVLQYKEIPDPIINPNEILILTKAIGLNFADIYRRRGDYHLAGNPPYILGYEGAGIVEEVGANVTTINPGDRIAFADVPFANAELVAVPAEKAIPLPDSISFETAASILLQGLTAHYLTKDSYQIKQGDTALVHAAAGGVGQLLIQMIKLLGGKVIGLTSSTEKTKVATLVGADHVFLYTEKWHSKVLEITNGTGVNVVYESVGSTLEKSFNATKIGGTVVFYGMAGGNPAPIDPRMLMDTSKTLTGGDLWNVLTTFEERKQRSTQLFDWIATGKLNIASPTTFSLQDGARAHELLESRKSTGKILLIP

SEQ ID NO: 16505 - protein, 338 aa, Bacillus thuringiensis
LLNQNFNNAFYGKRILITGHTGFKGSWLSLWLNELGATVIGYSLDSKNKNDNFNITNLQNNIIDIRGDIRDFNKLNNVFTDYKPEIVFHLAAQPLVKYSYEYPRETYEVNVVGTMNVLEAIRLHESAKIGIMVTSDKCYENKEWPWGYREIDPMGGHDIYSSSKGCCELLISSYRNSYFSEEKFSQHKKIIASVRAGNVIGGGDWSIDRIIPDCIRALESNKKIIIRNPTAIRPWQHVLEPLSGYLLLTEKIINNGILFSGAWNFGPSLSNIVSVEKLVTSLLDIWGCGDWTAENIGPINFHEANLLNLDISKAKFNLNWQPKWSLQQTLENTIEWYK

SEQ ID NO: 16506 - protein, 244 aa, Bacillus thuringiensis
KYKPNTLTIRSFDKLNLKGYEYMNEPSSHKWAIVVHGYSGRASEMTKYIRNFYEQGYNVIAPDLRGHGNSEGDYVGMGWHDRKDVLIWIQQILKKDPNAEIALFGVSMGGATVMMTSGEDLPSNVKVIIEDCGYSTVIDEFTYQLKDLFHLPKFPVMNAANTVTKLRAGYDLEEASAVKQVAKSKTPMLFIHGDADTFVPFEMLDEVYNAAKVEKEKLIVPGAGHGEAEKVDSNKYWNTVWKFV

SEQ ID NO: 16507 - protein, 359 aa, Bacillus thuringiensis
MRVKEQLLTLRAYVPGKNIEEVKREYGLSKIVKLASNENPFGCSARVTEALTSLASQYALYPDGYAFELRTKVAEHLGVKAEQLLFGSGLDEVIQMISRALLHEGTNVVMANPTFSQYHHHAVIEGAEVREVSLKDGIHDLDAMLEQVDEKTKIVWICNPNNPTGTYVEKQKLLSFLESVPKSALVIMDEAYYEYAEAEDYPQTLPLLEKYENLMVLRTFSKAYGLAAFRIGYAIGDAKLNGQLEVARLPFNTSTVAQSVALAALEDQAFLQDCVQKNAEGLNQYYAFCKEYNVFYYPSQTNFIFLKLGIPGNEAFERLMKKGYIVRSGAAFGIDDGIRITVGLKEENDEIIELLKELV

SEQ ID NO: 16508 - protein, 635 aa, Bacillus thuringiensis
VWFPTEEYKEKTRLYGWMKSLGYEDYETFYNKSIEETAWFWGEAEKAVGYQWMKPYTEVLDLENGTPFAQWYNGGTCNVVESALSRWLADEETRIQPALQYEGENGTSKSFTYEELDNWVSRVANGLKHAGIEKGDRVTIYMPMIPETVVAMLAVMKIGAIISPIFSGFASDAVMTRVQAAGSKMIITADGFSRRGKIVSLKDEVDKACEHCPTVEKVVIVRHAGNDFTPHNYDFSWSTLEKEKPFIHAEEMQSDDPLMLIYTSGTTGKPKGTVHTHAGFPLKAAFDAGFGMNIKQGDRVLWVTDMGWMMGPFLLFGSLINGATMVMYEGVPDFPEADRLWETVDKYEITHLGISPTLIRALMAKGDEYVNKHSLKSLEVFASTGEPWNPDPWMWLFETVGKGNVPICNYSGGTEISGGIFGNVLIKPIAPISFNASLPGMAAVVLDDQGKPIRDEVGELCLEKPWVGMTKSFWEDDERYVNTYWSRFENKWVHGDWVIYDGEQYIITGRSDDTLNIAGKRIGPAEYESILVKHNDVIEAAAIGVPDEVKGEVCHCFVVLRDHVTFTGELKKELMSLVNSHIGKALCPKDIHVVEDLPKTRNSKVMRRVIKAAYLGKELGDLSSLVNPEVVPFIQ

SEQ ID NO: 16509 - protein, 290 aa, Bacillus thuringiensis
LKLPNFAVIKEVGPRDGLQNEKKIVGTKDKVKWIQLLTEAGLSYVEVSSFVHPKWVPALADANDVFSELKRDPNVTYAALVPNQNGLERAFLQNVDEVNVFLSASESHNKSNINKSIKEALVVIEDITKQALFEGKKVRGYVSTVFGCPYEGDISVAAVDELCNQLFSYGIYEVSLGDTIGVANPLQVEQVLEHLLKKYDASQFAMHFHNTYGMALANVVKSLEYGITTFDSSCGGLGGCPYAPGASGNVATDDLVHMLHKLGVQTNIDEEKLLRASQFIQSKLNIQLPS

SEQ ID NO: 16510 - protein, 295 aa, Bacillus thuringiensis
MSLLIKDLTKKFDEHVAVDNLNIEIPKGEIFGFLGGNGAGKTTTFRMILGLLSKSSGTISWNGKPINYGVTDKIGYLPEERGLYAKMTVKEQVNFFAKLKNMKSKDAEKELHYWLERFNITEHLNKKVGELSKGNQQKIQLITAIIHKPELLILDEPFSGLDPVNVEMLKDAVLDMQKQGSSILFSSHRMEHVEELCQHICIMHKGVPVVQGDIAKIKSDFGKKNVVIVGDHDFDHLKEIKGVESMKKRKNAVTLKISYEEVSHVLFKEITKLGYVKKFAVEEPTLNDIFIAKVG

SEQ ID NO: 16511 - protein, 432 aa, Bacillus thuringiensis
MISRYTRPEMGAIWTEENKFKAWLEVEILACEAWAELGDIPKEDVKKIREHASFDIDRIYEIEKETRHDVVAFTRAVSETPALGEERKWVHYGLTSTDVVDTALSYILKQANEIILKDLENFVSILANKAKEHKYTIMMGRTHGVHAEPTTFGLKLGLWYEEMKRNVERFKQAADTVRVGKLSGAVGTYANIDPFVEKYVCENLGLEAAPISTQTLQRDRHAHYMSTLALIATSIEKMAVEIRGLQKSETREVEEAFAKGQKGSSAMPHKRNPIGSENMTGLARVIRGYMMTAYENVPLWHERDISHSSAERVILPDATIALNYMLNRFGNIVKNLTVYPENMKRNMTRTYGLIYSQRVMLTLIDKGMVREEAYDIVQPKAMEAWETQVQFKELVEADERITSKLTQEEINECFNYEHHMQHVDTIFERLGL

SEQ ID NO: 16512 - protein, 453 aa, Bacillus thuringiensis
SISSIVSRQKEYFLKGHTRSIEMRKNNLKKLYEGIQRFEEEIFQALKLDLNKSVHESFTTEVGYVLKEISFQLKHMSSWSKPKRVRTALTHFGSKGKVVPEPYGVTLIIAPWNYPFQLAIAPLVGALAAGNTIVLKPSELTPSVSKVLKRMLDESFPEELVAVVEGGVEESTSLLKEPFDYIFFTGSVGVGKVVMEAAAKQLTPLTLELGGKSPCIVHKDAKIEMTARRIVWGKFLNAGQTCVAPDYMYVHSSVKEKLIEALRHEITEQYSKEPLQNENYVRIVSERHFERLCGFLQDGQVVIGGNYEKDTLHIEPTVLADITWQDAVMEDEIFGPILPIIEYDNIENVIGTIQQHPKPLALYVFSEDKEVQKKVTSNISYGGGCINDVVYHHATPYLPFGGVGSSGLGGYHGKESFRTFSHYKSILAQSTAFDMKIRYSSTKSALKFIRKLL

SEQ ID NO: 16513 - protein, 251 aa, Bacillus thuringiensis
LKGKVALVTGASRGIGRAIAKRLANDGALVAVHYGNRKDDAEETVHEIRSDGGQAFSIGANLESLHGVENLYNALDTELQKRTGETQFDILINNAGIGPGAFIEETTEQFFDRMFSVNAKAPFFIIQQALPRLRDNSRIINISSAATRISLPDFVAYSMTKGAINTMTFTLAKQLGARGITVNAILPGFIKTDMNAELLSDPMMKQYATTISAFNRLGEVEDIADTAAFLASPDSRWVTGQLIDVSGGSCL

SEQ ID NO: 16514 - protein, 310 aa, Bacillus thuringiensis
VNVGILGIGRYVPEKVVTNHDLEKIMDTSDEWIRTRTGIAERRIADDTIDTSYMAVEAAKKALEDAGVSGEDIDLILVATVTPDRAFPAVACVIQEAIGAKHAAAMDVGAACAGFMYGMITAQQFIQTGTYKNVLVVGSDKLSKIVDWNDRNTAVLFGDGAGAIVMGAVSEGRGVLSFELGADGSGGKHLYQDEYVMMNGREVFKFAVRQLGESCLRVLDKAGLTKEDVDFLVPHQANIRIMESARERLNLPQEKMSMTIEKFGNTSASSIPIAMVEELQNGRIQDGDLIILVGFGGGLTWGAVALRWGK

SEQ ID NO: 16515 - protein, 78 aa, Bacillus thuringiensis
KNGGYLIDVREPNELKQGMIKDSINIPLDELRDRLDEVPMDKEIYITCQLGMRGYVAARMLMEKGYKVKNLDGGFKLY

SEQ ID NO: 16516 - protein, 260 aa, Bacillus thuringiensis
VRIIDCRFDLANPNWGREKYEEGHIPHALYFDLNLDLSSPIAEHGGRHPLPNIEEFADKLSKAGIDEHTTVIAYDSQAGANAARLWWLCNYVGHEKVYILDGGFQAWKENGLPTTAEIPVAIRKTFKANIQDHMLVTMETVRENIRAGADVTLIDSREPKRYAGVEELVDHKAGHIPTAVNHFWKDGMLQSGQFKNKAGQQERFQNLSKDKETIVYCGSGVTACPNIVALKLAGFQNVKLYAGSWSDWISYPENQIAKEE

SEQ ID NO: 16517 - protein, 424 aa, Bacillus thuringiensis
ITLTTGEKITVTNGVMNVPNNPIIPFIEGDGIGPDIWAAASRVLEAAVEKAYDGEKKIVWKEVLAGEKAFNQTGEWLPEETLNLIREYLIAIKGPLTTPVGGGIRSLNVALRQELDLYVCLRPVRYFEGVPSPVKRPEDTDMVIFRENTEDIYAGIEYAQGSPEAEKVLAFLKEAMGVNKIRFPETSGIGIKPISEEGTKRLVRAAIQYAINEKRSSVTLVHKGNIMKFTEGAFKNWGYEVAEQEFGDKVFTWAEYDRIVEKDGKDAANKAMADAEVAGKIIVKDSIADIFLQQILTRPREFDVVATMNLNGDYISDALAAQVGGIGIAPGANINYVTGHAIFEATHGTAPKYAGLDKVNPSSVLLSGVLLLEHLGWNEAAKLVTASVEKTIASKVVTYDFARLMEGATEVKCSEFANELIKNM

SEQ ID NO: 16518 - protein, 312 aa, Bacillus thuringiensis
MTIKRKKVSVIGAGFTGATTFFLLAQKELADVVLVDIPQLENPTKGKALDMLEASPVQGFDANIIGTSDYADTADSDVVVITAGIARKPGMSRDDLVATNSKIMKSITRDIAKHSPNAIIVVLTNPVDAMTYSVFKEAGFPKERVIGQSGVLDTARFRTFIAQELNLSVKDITGFVLGGHGDDMVPLVRYSYAGGIPLETLIPKERLEAIVERTRKGGGEIVGLLGNGSAYYAPAASLVEMTEAILKDQRRVLPAIAYLEGEYGYSDLYLGVPVILGGNGIEKIIELELLADEKEALDRSVESVRNVMKVLV

SEQ ID NO: 16519 - protein, 334 aa, Bacillus thuringiensis
MTKITVVGAGSWGTALAMVLADNGHDVRIWGNRPELMDEINTKHENSRYLPGITLPSTIVAYSSLEEALVDVNTVLLVVPTKAYRDVLQEMKEIVTEPITWIHASKGIEPGTSKRISEVIEEEIPEHLIKDVVVLSGPSHAEEVGLRQATTVTSAAKRMEAAEEVQDLFMNSYFRVYTNPDIVGVELGGALKNIIALAAGITDGLGLGDNAKAALMTRGLTEIARLGRKMGGNPLTFAGLTGMGDLIVTCTSVHSRNWRAGNMLGKGHSLEEVLESMGMVVEGVRTTKAAHELAEKMEVEMPITAALYDVLFNGNNVKDAVGSLMGRVRKHEVE

SEQ ID NO: 16520 - protein, 301 aa, Bacillus thuringiensis
AKFIDREVTKWSEMIKDWEEGVEIFGAALIGAPLSKPSISHSGASFAPKTIRAMLDAYSTYAITEEHDMKESVLYDCGDITMHVTDIKESHKRIAKTVGHVTKVNPNVIPIVLGGDHSISFPSITGFANSKGKVGIIQFDAHHDLRNLDDGGPSNGTPFRSLLENDVITGKQLVQIGIRNFSNARAYHEYAIEHGVTVYTMKDVREREIKDIITESIEVLRNQGVTSIYISLDMDVLDQAFAPGCPAIGPGGMDSTTLLDAIEFLGKESLVQGMDIVEIDPTLDFRDMTSRVAAQVIMSFL

SEQ ID NO: 16521 - protein, 362 aa, Bacillus thuringiensis
AQMEDFFPVRDVDHLEFYVGNAKQSSYYLARAFGFKIVAYSGLETGNREKVSYVLVQKNMRFVVSGALSSENRIAEFVKTHGDGVKDVALLVDDVDKAYSEAVKRGAVAIAPPQELTDEDGTLKKAVIGTYGDTIHTLVERKNYKGAFMPGFQKVEFNIPFEESGLIAVDHVVGNVEKMEEWVSYYENVMGFKQMIHFDDDDISTEYSALMSKVMTNGSRIKFPINEPADGKRKSQIQEYLEFYNGAGVQHLALLTSDIVKTVEALRANGVEFLDTPDTYYDELTARVGKIDEEIDKLKELKILVDRDDEGYLLQIFTKPIVDRPTLFIEIIQRKGSRGFGEGNFKALFESIEREQERRGNL

SEQ ID NO: 16522 - protein, 525 aa, Bacillus thuringiensis
WKKIIPAVAVLSTITFSSVFAAPPSQNPAEQNRYIDVQMLGINDFHGQLDTVKKINNKEAGGADYLATYLKERKKQNPNTLLVHAGDIVGASPPVSALLQDEPTIEFLNDLKFDVGTIGNHEFDEGIDEMQRLIYGGYHEKTGNFKGANFPYVAANFYNKSTGRLFLPPFTVKMVDGVPVGFIGVVTTDTPNVVMPTMLNNVQITDEVEAINKSTQQLKRLGVKSIVVLAHVGGTTDESGVTNGDLTRIANETDPEVDVIFGGHSHTYVNGTVNNKLIVQANSYGTAFSDVDVTIDRKTKDIVKKKAEVVTPYHEGVEPDKQVKKKLDQYKEKIAPLVNEVVGKSTAPIDRKQNDAGESTLGNLVADAQRQTMQTQIALMNPGGIRNDLDAGDITWGELYGIQPFGNQLIKVDLTGQDIRDILNQQWQKGTTRMLQISGIQYTWDANKPNGEKVTNIRLTNGEELSPSKMYSVVANAFLASGGDGFVSFKNGKNAETGPNDFEALVDYVKQLKEPIQPVIDGRIQ

SEQ ID NO: 16523 - protein, 191 aa, Bacillus thuringiensis
MKVLQEKILNEGKVLSGDVLKVDAFLNHQIDPVLMQEIGKEFAKRFKEENITKIVTIESSGIAPAVMAALELGVKVIFARKRKSLTLQDNMYVANVYSFTKQETNEISLSRNHIDENDRVLIIDDFLANGQAALGLMSLVEQAGASIAGIGIVIEKAFQDGGKKLREQGVRVESLAEIASLDNGTVTFVQQ

SEQ ID NO: 16524 - protein, 555 aa, Bacillus thuringiensis
KVEKPWLKSYPEEIPSTISYDIQPLHRYVEQMASRYPEKKALHFLGKDITFSDFHDKVKRFANYLQKLGVEKGDRVAIMLPNCPQAVIGYYGTLLAGGIVVQTNPLYTERELEYQLHDSGAKVILCLDLVFPRVTNVQSATKIEHIIVTRIADFLPFPKNLLYPFVQKKQSNLVVKVSESETIHLWNSVEKEVNTDVEEPCDPENDLALLQYTGGTTGFPKGVMLTHKNLVSNTLMGVQWLYNCKEGEEVVLGVLPFFHVYGMTAVMNLSVMQGYKMVLIPKFDMKMVFEAIKKHKVTLFPGAPTIYIALLNSPLLKEYDISSIRACISGSAPLPVEVQEKFETVTGGKLVEGYGLTESSPVTHSNFLWEKRVPGSIGVPWPDTEAIIMSLETGEALPPGEIGEIVVKGPQIMKGYWNKPEETAAVLQDGWLHTGDVGYMDEDGFFYVKDRKKDMIVASGFNVYPREVEEVLYEHEKVQEVVTIGVPDPYRGETVKAFVVLKEGTECSEEELNQFARKYLAAYKVPKVYEFRDELPKTTVGKILRRVLIDEEKRK

SEQ ID NO: 16525 - protein, 434 aa, Bacillus thuringiensis
MNIAIFGTGYVGLVTGVCLSDIGHRVTCIDINENKVAKMKEGISPIYEPGLDELMSKNINDNRLLFTTDCRQGIEEADVIYIAVGTPQQTDGSANLQYIEQVALDIANNLKKDSIVVIKSTVPVGTNDHVKNLIQQNLKADVKINMVSNPEFLREGSAIHDSFYGDRIVIGADDAKTADVMEEVNKPFNVPVFKTTIRSSEMIKYAANAFLATKISFINEIANICEKLGADVEHVANGMGLDKRIGTQFLKAGIGYGGSCFPKDTHALIQIAGNVEHDFDLLKSVITVNNNQQASLVEKIKNVLGDMEGKQVAMLGLAFKPNTDDMREAASIVIANDLVKMGAKVVAYDPIATENAKKVLPNEVQYVPSVAGAVKNADVTLIVTEWDDIKEFPIEQYIKLMKQPIIFDGRNCHGLEYVKKFNVDYYSVGRPAVV

SEQ ID NO: 16526 - protein, 352 aa, Bacillus thuringiensis
MYKGLLKQYASYLPVNENTPDVSLMEGNTPLIPLLNISKQLGIQLYGKYEGANPTGSFKDRGMVMAVAKAKEEGSEAIICASTGNTSASAAAYAARLGMKCIIVIPEGKIAHGKLAQAVAYGAEIISIEGNFDDALKAVRNIAAEEPITLVNSVNPYRIEGQKTAAFEICDQLQNAPDVLAIPVGNAGNITAYWKGFCEYEKEKGYKKPRIHGFEAEGAAAIVKGHVIEEPETIATAIRIGNPASWSYAVEAAEQSRGEIDMVSDEEILHAYRLLAKTEGVFAEPGSNASLAGVIKHVQSGKIKKGETVVAVLTGNGLKDPDIAISSNQLDIASVSNDIEQIKDHIKGVIMS

SEQ ID NO: 16527 - protein, 421 aa, Bacillus thuringiensis
INVGVLGLGTVGSGVVHILKEHYKKIALDTGYEVKVKTVVVRDLEKERDVCIDGIAVTSHADEVLNDSNIDIVVEVMGVIEEANQHIVKALRNKKHVVTANKDLMAVYGAELLQLANDNDCDLCYEASVAGGIPVLRGLTDGLASDQIEKIMGIVNGTTNYMLTKMSQNGWSYEEALQEAQKLGFAESDPTADVDGLDAARKVAILANLGFSMNVSLDDVQVRGIRKVEKEDLQMAEKLGFTMKLIGKAEKQGPAIHLSVEPTLLPSQHPLSNVNNEFNAVYVHGQAVGEVMFYGPGAGKLPTGSAVVSDIISIVKNMNQVPKNKSALKEPVPYELQGDEEVVSKYFLRISLQDEPGMLQKITECFVNYSVSLKEVIQLPLNRELAEVVVVTHRTSKYQFERVLEAIEAVASEINSYYIIE

SEQ ID NO: 16528 - protein, 485 aa, Bacillus thuringiensis
  unsure (1)..(485): unsure at all Xaa locations
MYNTEMDEALKVIDKGLKKTISPKQIIVVGAGMAGLVSASLLKAAGHDVKIFEANNRVGGRIETVRMEDTGLYLDVGAMRIPYSHTLTMAYIRKFGLQVSPFINRNETDIIYVNGRKTTLKQYEKDPSILRYPVEMNEVGKTSEELLLLAVQPIINFIKKNPEKNWDIVVKDFGRYSTGQFLKYHPYQYNTYFSPVTIEMIGVLLDLEGFLERSFVETLRFLYIMQEESGFCEIVGGNDRLPKSFLPQLEENIIYNQKLMKLHQHDNGVTAFYRNEETFEYSSITGDLVIVTIPFSTMRFVEVDPFDSISHEKWKAIRELHYMPATKIGIQFKSRFWEEQGQLGGRIITDLPIRYAYYPNYGIGEKGPAMMLGSYTWSYDALLWDGLSKGDRIYYALHNLATILGGQVYDEFISGISKSWTLDPYALGGFALFQAGQESELQPAIVKPEGRIFFAGDHTTLYHGWIQGAIESGIRVAVEVNEXKV

SEQ ID NO: 16529 - protein, 390 aa, Bacillus thuringiensis
TESNRYIDVQMLGINDFHGQLDTVKKINNKDAGGIEYLGAYLRDREKQNPNTLKVHAGDVVGASTPVSALLQDEPTIEFLNDLKFDVGTIGNHEFDEGVEEMNRLIYGGYHEKTGNFKGAKFPYVAANFYNKSTGRLFLPPFTIKKVQGVPVGFIGVVTTDVPNLVMPTMLKNVEITDEVEAINKSVKQLKKLGVKSIVVLAHNGGITDGNGVTNGDIVRLANETDPEVDVIFGGHSHTYVNGTVNNKLVVQANSYGMAFADVDVKIDRKTQDIVEKKAEIVTTYHEGIEPDKKIKKKMEKYQAKIAPLVNEVVGKSIAPLDRKLNTAGESTLGNLSADAQRTTMQSQIALMNPGGIRNDLDAGDITMGEIYGIQPFGNQLIKVNLTGQD

SEQ ID NO: 16530 - protein, 809 aa, Bacillus thuringiensis
MMFGRFTERAQKVLALSQEEAIRIGHNNIGTEHILLGLVREGEGIAAKALIALGLSPEKVQKEVEALIGRGTEASQTVHYTPRAKKVIELSMDEARKLGHSYVGTEHILLGLIREGEGVAARVLNNLGVSLNKARQQVLQLLGSNEASSGHQGGSSTNANTPTLDSLARDLTVVARENRLDPVIGRSKEIQRVIEVLSRRTKNNPVLIGEPGVGKTAIAEGLAQQIVNNEVPETLRDKRVMTLDMGTVVAGTKYRGEFEDRLKKVMDEIRQAGNIILFIDELHTLIGAGGAEGAIDASNILKPSLARGELQCIGATTLDEYRKYIEKDAALERRFQPIHVDEPSLEESTQILKGLRDRYEAHHRVSITDDAIDAAVKLSDRYITDRFLPDKAIDLIDEAASKVRLRSYTTPPNLKELEVNLEEIRKEKDAAVQSQEFEKAASLRDMEQRLREKLEDTKRQWKEQQGKENSEVTVEDIANVVSTWTRIPVSKLAQTETDKLLNLESILHDRVIGQDEAVVAVAKAVRRARAGLKDPKRPIGSFIFLGPTGVGKTELARALAESMFGDEDAMIRIDMSEYMEKHSTSRLVGSPPGYVGYEEGGQLTEKVRRKPYSVVLLDEVEKAHPDVFNILLQVLEDGRLTDSKGRTVDFRNTIVIMTSNVGAEALKRNKHLGFNVQDESRDYSDMKGKVMDELKKAFRPEFLNRIDEIIVFHMLEKKHIQEIVTLMVNQLVNRLKEQEIELQLTEGAIAAIADKGFDREYGARPLRRAIQKHVEDRLSEELLKGAIEKGQKVIFDVEGETFVIHSAEK

SEQ ID NO: 16531 - protein, 470 aa, Bacillus thuringiensis
MVVGDFPIELDTVVVGAGPGGYVAAIRAAQLGQKVAIIEKANLGGVCLNVGCIPSKALINAGHRYENAMHSDDMGITAENVKVDFTKVQEWKNGVVKKLTGGVEGLLKGNKVEIIRGEAYFVDANTLRVMTEDAAQTYTFKNAVLATGSTPIEIPGFKYSKRVINSTGALSLPEIPKKLVVIGGGYIGMELGTAYANFGTEVTVVEAGDEILAGFEKAMSSVVKRALQKKGNVNIHTKAMAKGVEETETGVKVSFEVKGEIQTVEADYVLVTVGRRPNTQEIGLEQVGVKMTDRGIIEIDEQCRTNVPNIYAIGDIVPGPPLAHKASYEGKVAVEAISGHASAIDYIGIPAVCFTDPELASVGYTKKQAEEAGMTVTVSKFPFAANGRALSLNSTDGFLQLVTRKEDGLLVGAQVAGAGASDIISEIGLAIEAGMTAEDIAQTIHAHPTLGEITMEAAEVALGMPIHIVK

SEQ ID NO: 16532 - protein, 429 aa, Bacillus thuringiensis
  unsure (1)..(429): unsure at all Xaa locations
VAFEFKLPDIGEGIHEGEIVKWFIKPGDEVNEDDVLLEVQNDKAVVEIPSPVKGKVLEVLVEEGTVAIVGDTLIKFDAPGYENLKFKGDDHDEAPKAEEAAVEAPAAEATPAATAEVVNERVIAMPSVRKYAREKGVDIHKVAGTGKNGRIVKADIDAFANGGQTVAATEAPAAVEATPAAAKEEAPKAQPIPAGEYPETREKMSGIRKAIAKAMVNSKHTAPHVTLMDEVDVTELVAHRKKFKAVAADKGIKLTYLPYVVKALTSALREYPMLNTSLDDASXEVVHKHYLNIGIAADTDKGLLVPVVKDTDRKSIFTISNEINDLAGKAREGRLAPAEMKGASCTITNIGSAGGQWFTPVINHPEVAILGIGRIAEKPVVKNGEIVAAPVLALSLSFDHRLIDGATAQKALNQIKRLLNDPQLLVMEA

SEQ ID NO: 16533 - protein, 325 aa, Bacillus thuringiensis
MAQMTMIQAITDALRVEMKNDPNVLVFGEDVGVNGGVFRATEGLQAEFGEDRVMDTPLAESGIGGLAVGLALEGFRPVPEIQFFGFVYEVMDSISGQLARMRYRSGGRWTAPVTVRSPFGGGVHTPELHADSLEGLVAQQPGLKVVIPSTPYDAKGLLISAIRDNDPVIYLEHMKLYRSFRQEVPEGDYTIDLGKADIKREGTDVSVIAYGAMVHAALKAAEELEKEGISLEVVDLRTVQPLDIETIIASVEKTGRVVVVQEAQKQAGIAANVVAEINDRAILNLEAPVVRVAAADTVFPFSQAESVWLPNHKDIVEAVNKVMNF

SEQ ID NO: 16534 - protein, 380 aa, Bacillus thuringiensis
SYSIDTLLLHNQYKHDSQTGAVNVPIYNTSTFHQFDVDTFGKYDYSRSGNPTREALEDIITLLEGGTKGFAFASGIAAISTAFLLLSQGDHVLISEDVYGGTYRVITEVLSRYGVSHTFVDMTNLEEIKQNMKPNTKLFYVETPSNPLLKVTDIREVSKLAKSIGALTFVDNTFLTPLFQKPLELGADVVLHSATKFIAGHSDVTAGLAVVKDAELAQKLGFLQNAFGAILGPQDCSLVLRGLKTLHVRLEHSAKNANKIAHYLQEHAKVQNVYYPGLQTHLGFDIQQSQATSAGAVLSFTLQSEDALRQFLSKVKLPVFAVSLGAVESILSYPAKMSHAALSQEARDERGISNSLLRLSVGLENVNDLISDFENALSYV

SEQ ID NO: 16535 - protein, 364 aa, Bacillus thuringiensis
IETKLAQIGNRSETTTGTVNPPVYFSTAYRHEGIGKSTGFDYSRTGNPTRGLLEQAIADLEYGEQGYACSSGMAAVLLVLSLFRSGDELIVSEDLYGGTYRLFSEHEKKWNVRCRYVNTQSIKQIEQAITTETKAIFIETPTNPLMQVTDIAAVATVAKRHGLLLIVDNTFYTPYIQQPLTEGADIVLHSATKYLGGHNDVLSGLVVAKGKELCEEIAHYHNASGAVLSPFDSWLLIRGMKTLALRMRQHEENAKAVVAYLNDEDGVTDVFYPGRGGMISFRLKDEAWINPFLQSLSLITFAESLGGVESLMTYPATQTHADIPEEIRTANGVCNRLLRFSVGIENSNDLIQDLKQAIKLVKEG

SEQ ID NO: 16536 - protein, 472 aa, Bacillus thuringiensis
YKFYLNGEWRESSSGETIEIPSPYLHEVIGQVQAITRGEVDEAIASAKEAQKSWAEASLQDRAKYLYKWADELVNMQDEIADIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPKGLVNVATGRGSVIGDYLVEHEGINMVSFTGGTNTGKHLAKKASMIPLVLELGGKDPGIVREDADLQDAANHIVSGAFSYSGQRCTAIKRVLVHENVADELVDLLKAQVAELSVGSPEQDSTIVPLIDDKSADFVQGLVDDAVEKGATIVIGNKRERNLIYPTLIDHVTEEMKVAWEEPFGPILPIIRVSSDEQAIEIANKSEFGLQASVFTKDINKAFAIANKIETGSVQINGRTERGPDHFPFIGVKGSGMGAQGIRKSLESMTREKVTVLNL

SEQ ID NO: 16537 - protein, 466 aa, Bacillus thuringiensis
QQKKWGFWVLTAFVVGNMVGAGIFMVPSTLAQTASPLGVTLAWLTTGFGVLMLALVFGNLAIRRPDLTTGPQSHAYALFSTPKKKKMAGFSMVWGYWVANWASNVAIITSFAGYLSLFFPIMKDTRLLFSIGSFNVEVGKLITFTICSILLWGTHIILTNGVSGAGKLNFLATTTKVTGFLLFIVVTLFAFEASKFGQWYTPMIDKSGASHGLLSQVNLAALTTLWAFIGIESAVLLSNRAVSPKTVKRATVAGLLITVAIYLGITILTMGVLHVDKLQASERPLADALNAAMGHGGGKLMALLALTSLFGSILGWILLSSEVPYQAAKEGFFPSFFTKTNKKGSPIYSLRLTNIMSQVFLFSTLSGTIAEAYTFVITVSTLAYLIPYLVSPIFQLKLVATGETYKNEMRARITDGIVAVIALCYALWVIKTGASDIKTFLLGIGLFVIGFAFYPLMNRDQKKNNE

SEQ ID NO: 16538 - protein, 287 aa, Bacillus thuringiensis
MKAVVVNKNSKANIEVIDKELRPLHSGEALVDVEYCGVCHTDLHVANHDFGNTDGRILGHEGVGIVTKIADDVTSLKIGDRVSIAWMFQSCGRCEYCVTGRETFCREVKNAGYSVDGGMAEQCIVTADYAVKVPEGLDPAQASSITCAGVTTYKAIKVSDIKPSQPIVIYGCGGLGNLAIQYAKNVFGAKVIAVDINDDKLALAKEVGADMTINPISQGPADKIVQEEFGGAYAAVVTAVSKVAFNSAVDAVRACGKVVAVGLPVETMDLNIPRLVLDGIEVIGSIV

SEQ ID NO: 16539 - protein, 393 aa, Bacillus thuringiensis
EIVGNLAKRMVIISGLPIEVHLTLDRREALKDADFVTTQLRVGLLEARAKDEAIPLKYDVIGQETNGPGGLFKALRTIPVILDICKDMEELCPNAWLINFANPAGMVTEAVLRYTNIQRVVGLCNVPIGIRMGLARLLEVDASRVHVDFAGLNHMVYGLDVYLDGVSVMDRVLELVTDPEKQITMENIAALNWEPDFIRGLRAIPCPYHRYYYKTREMLEEEKEASVEKGTRAEVVKQLENDLFELYKDPNLDIKPPQLEKRGGAYYSDAACSLITSIYNNKGDIQPVNTRNNGTIASLPHDSAVEVNCIITKEGPKPIAVGDLPVPVRGLVQQIKSFERTTIEAAVTGDYHKALLAMTINPLVPSDKVAKQILDEMLEAHKEYLPQFFKKVE

SEQ ID NO: 16540 - protein, 450 aa, Bacillus thuringiensis
MMKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYAQKGEPHRYKFMSRYRGYHGNTMATMAATGQAQRRYQYEPFASGFLHVTPPDCYRMPEIEGQHIYDVECVKEVDRVMTWELSETIAAFIMEPIITGGGILMPPQDYMKAVHETCQKHGALLISDEVICGFGRTGKAFGFMNYDVKPDIITMAKGITSAYLPLSATAVKKEIYEAFKGKGEYEFFRHINTFGGNPAACALALKNLEIMENENLIERSAQMGSLLLEQLKDEIGEHPLVGDIRGKGLLVGIELVNDKETKEPIDNDKIASVVNACKEKGLIIGRNGMTTAGYNNVLTLAPPLIISSEEIAFVVGTLKTAMERI

SEQ ID NO: 16541 - protein, 289 aa, Bacillus thuringiensis
LKLLVKAPAKINLSLDVLGKRQDGYHEVKMIMTTIDLADRLELTELAEDRIEILSHNRYVPDDQRNLAYQAAKLLKEKFNVKKGVSITIEKTIPVAAGLAGGSSDAAATLRGLNKLWNLELTIDELAELGAEIGSDVSFCVYGGTAIATGRGEKIEHIKTPPSCWVILAKPHIGVSTADVYGNLKLNRVTHPNVDKMVDVINSGDYKGICDTVGNVLEDVTFGMHPEVARIKSQMKRFGADAVLMSGSGPTVFGLVHHDSRMHRIYNGLKGFCEQVYAVRLLGERETLE

SEQ ID NO: 16542 - protein, 244 aa, Bacillus thuringiensis
KLVIITGAGNGIGRGIALHYAEGANVILADIDEKAGAKTVTKMKEQGKEALFVQTDGRLETRLFIRLREVVNQTYGQIDILINNAGKELFKSPYDISLEEWDDVISTNLRSVFLGSREAAKDMAYNKEGGSIVNIASTRAIMSEPNSESYAATKGGIVAITHALAASFSEARITVNAISPGWIETGDYSKLSKIDHEQHLSKRVGTPDDIARACLYLTASENDFVTGINLVVDGGMTRKMMYEE

SEQ ID NO: 16543 - protein, 377 aa, Bacillus thuringiensis
MKAVTYQGPNQVQVKQVDDAKLEKKDDIIVRITSTAICGSDLHLYQGNMPLPQGYIIGHEPMGIVEEVGPDVTKVKKGDRVVIPFNVSCGHCFYCQHEMESQCDNSNPHYDSGGYFGYTEKFGNHPGGQAEYLKVPFGNFTPFVIPESCELEDESLLFLSDVLPTAYWSVINAGVKPGDTVIVLGCGPVGLMTQKFAWMQGAKRVIAVDYLDYRMNYAKKINNVEVFEFTKFPDMGEHLKEITHGGADVVIDCVGMDGKKSPLEFLEQKLKLQGGTLGPIQIATKAVRKYGTVQMTGVYGGNYNAFPLGAFWVRNINLKMGQAPVIHFMPELFEKIINKEFDPKEIITHKIPLEEASYGYQIFNNREDDCIKVILKP

SEQ ID NO: 16544 - protein, 469 aa, Bacillus thuringiensis
KDIRIEKDFLGEKEVPSAAYYGVQTLRAVENFPITGYRIHPSLITAMAIVKKAAALANIDTGYLAKDIGHEIAEAAQEIVDGKFHDQFIVDPIQGGAGTSINMNTNEVIANRALERMGYEKGAYAKISPNTHVNMAQSTNDAFPTGIHIATLMMLEKLLITMEELHSAFLKKAKEFDHVIKMGRTHLQDAVPIRLGQEFEAYSRVLARDIKRIKQSRQHLYEVNMGATAVGTGLNANPTYIEQVVKHLRTFSGFPLVGAEHLVDATQNTDAYTEVSAALKVCMMNMSKIANDLRIMASGPRVGLAEIQLPARQPGSSIMPGKVNPVMAEVINQVAFQVIGNDHTICLASEAGQLELNVMEPVLVFNLIQSISIMNNGFRVFREYCIEGITANEELLKQYVEKSVGIITAVNPHIGYEAASRIAREAIETGKSVRELCLEHGVLTEEELDIILDPFEMTHPEIAGASLLK

SEQ ID NO: 16545 - protein, 363 aa, Bacillus thuringiensis
  unsure (1)..(363): unsure at all Xaa locations
ILHYTSGSLGXAKGVLHAXNAMFQHYQTAKWVLDLKEDDVYWCTADPGWVTGNSYGIFAPWLVGASNVILGGRFSPEAWYEALQDYGVTVWYSAPTAFRMLMGAGQDAIKKYDLSQVRHVLSVGEPLNPEVIRWGMNAFGLRIHDTWWMTETGGQVICNYPCMEIRPGSMGKPIPGVKAAIVDNEGNEVPPYTMGNLAIAKGWPSMMRGIWNNEQKYESYFMPGDWYVSGDSAYMDEDGYFWFQGRIDDVIMTSGERVGPFEVESKLIEHAAVAEAGVIGIPDPVRGEIIKAFIALRAGYEPSDELKEEIRQFVKKGLAAHAAPRQIEFRDKLPKTRSGKIMRRVLKAWELNLPTGDLSTMED

SEQ ID NO: 16546 - protein, 289 aa, Bacillus thuringiensis
IDFGTIATAMVTPFDINGNIDFAKTTKLVNYLIDNGTTAIVVGGTTGESPTLTSEEKVALYRHVVSVVDKRVPVIAGTGSNNTHASIDLTKKATEVGVDAVMLVAPYYNKPSQEGMYQHFKAIAESTPLPVMLYNVPGRSIVQISVDTVVRLSEIENIVAIKDAGGDVLTMTEIIEKTADDFAVYSGDDGLTLPAMAVGAKGIVSVASHVIGNEMQEMITAFQSGEFKKAQKLHQLLVRVTDSLFMAPSPTPVKTALQMVGLDVGSVRLPLLPLTEEERVTLQSVMQSI

SEQ ID NO: 16547 - protein, 404 aa, Bacillus thuringiensis
MKIIVQKFGGTSVRDDNERKHALHHIKKSLAAGYKVVTVVSAMGRKGEPYATDTLLSLVNQEESTISKREQDLLLSCGELISAIVFSNMLNENGIKAAALNGAQAGFVTNDDFTNAKIIEMNCDRIHEELENVDVIVVTGFQGQTKKGDTTTLGRGGSDTSASALGVALHAEYIDIFTDVEGVMTADPRIVKDARHLQTVTYNEICNMAYQGAKVVHPRAVEIAMHAKVPLRVRSTYSESEGTLIAAYDGATKGQDVEERPVTGIAHVSNVTQIKVLAKETAYDIQQHVFKEMANEGISVDLINISPTGVAYTVNDNVSARAVEVLKQLGYEPIVTEHCAKVSIVGAGMAGIPGVTAKIVTALAEKGIQILQSADSHTTIWVLVKEIDLVEAVNALHSAFELSK

SEQ ID NO: 16548 - protein, 631 aa, Bacillus thuringiensis
VDLTQIQNPSFLKDMSISELEGLSEDIRKFLIEELSQTGGHIAPNLGVVELTIALHKLFDSPQDKFLWDVGHQSYVHKILTGRAKEFGTLRQYQGLCGFPKRCESEHDVWETGHSSTSLSAAMGMALARDLKKTKEYVIPIIGDGALTGGMALEALNHIGHEKTDMIVILNDNEMSIAPNVGALHNVLGRLRTAGKYHWVKDELEYILKKIPAVGGKVAATAEKIKDSLKYLLVSGVFFEELGFTYLGPVDGHDYEKLFETLQYAKKTKGPVLVHVITKKGKGYKPAESDVIGTWHGTGPYKIESGDFVKPKEVAPAWSAVVSETVLKLARADERIVAITPAMPVGSKLEKFQKEFPDRMIDVGIAEQHATTMAAGMATQGMKPFLAIYSTFLQRAYDQVVHDICRQNLNVFIGIDRSGLVGADGETHQGVFDISFLRHLPNMVLMMPKDENEGQHLVYTAMQYEDGPIALRYARGNGLGVHMDKELKAIPIGTWETLKEGTQAAILTFGTTIPMAMEAAERLEKAGVSVKVVNARFIKPMDEAYLHDLLGKNIPILTIEEACLIGGFGTGVVEFASENGYHSALVERMGIPDRFIEHGSVTKLLEEIGLTTDAVVDRIHTMIPSKTKKGV

SEQ ID NO: 16549 - protein, 297 aa, Bacillus thuringiensis
IVTIAFDTFLKESKTFVEEKLVSYANELQCPNVLREAMAYSLEAGGKRLRPLLLFATLQAFGKERNLGVGAACALEMIHTYSLVHDDLPCMDDDDLRRGKPTNHKVFGEAMAVLAGDGLLTYAFQVIMAYEQKEISAEKKVRLVLELAKAAGPEGMVGGQVADMEAEGKRLTIDELEYIHKHKTGKLLEFAVLAGAILSDATEEQEEKLLTFAKYIGLAFQIRDDILDVEGTEEEIGKPIGSDLSNEKSTYTTLFTVDRAKDILEETIAEAKGAISSLQLQDEYLLSICDLIAKRNN

SEQ ID NO: 16550 - protein, 280 aa, Bacillus thuringiensis
MVAVIIKGNEVAEKKRAQLTEEVVKLKEQGIVPGLAVILVGEDPASRSYVKGKEKGCEQVGIYSELIELPETITEERLLAEIDRLNGDDRINGILVQLPLPKHIEEKAIIERISPEKDVDGFHPISVGRMMTGQDTFLPCTPHGIVELVKETNLDISGKHVVVIGRSNIVGKPVGQLFLNENATVTYCHSKTQNMKELSKLADILIVAVGRPKMITADYIKEGAVVIDVGVNRLETGKLCGDVDFDNVLDVAGYITPVPKGVGPMTITMLLHNTVESAKR

SEQ ID NO: 16551 - protein, 466 aa, Bacillus thuringiensis
MNKGRVTQIMGPVVDVKFDGGKLPEIYNALTVKQSNENGSINLTFEVALHLGDDTVRTVAMSSTDGLVRGTEVEDTGKPISVPVGDVTLGRVFNVLGDAIDLDGEVPADVHRDPIHRQAPAFEELSTKVEILETGIKVVDLLAPYIKGGKIGLFGGAGVGKTVLIQELINNIAQEHGGISVFAGVGERTRKGNDLYHEMSDSGVIKKTAMVFGQMNEPPGARQRVALTGLTMAEHFRDEQGQDVLLFIDNIFRFTQAGSEVSALLGRMPSAVGYQPTLATEMGQLQERITSTNKGSITSIQAVYVPADDYTDPAPATTFAHLDATTNLERRLTQMGIYPAVDPLASTSRALSPEIVGEEHYEVARQVQQTLQRYKELQDIIAILGMDELSEEDKLVVHRARRIQFFLSQNFHVAEQFTGQKGSYVPVKNTVSGFKEILEGKYDDLPEDAFRLVGGIEEVIENAKKM

SEQ ID NO: 16552 - protein, 286 aa, Bacillus thuringiensis
VASLRDIKAKINSTKKTSQITKAMEMVSASKLNRAEQNAKSFVPYMEKIQEVVASIAQGSKGINHPMLNARPVKRTGYIVITSDRGLAGGYNSNVLRTVSNVIRERHNMDSNQYSIIVLGRLGRDYLKRRGFNIIDEVVGLSDHPSFTDIKDLASRAIAMFADGAYDELYIYYNHYVSKISQEVTENKILPLTDVASDKPTTAYEFEPSEEEILKVLLPQYAESLVYGALLDGKASEHAARMTAMKSATDNAMEVIDSLTLSFNRARQAAITQEITEIVGGAAALE

SEQ ID NO: 16553 - protein, 323 aa, Bacillus thuringiensis
LDTIINQKDEDMICIYVAIGQKESTVRNVVETLRKHGALEYTIVVTASASQPAPLLYLAPYAGVTMGEEFMYNGKHVLVVYDDLSKQAAAYRELSLLLRRPPGREAYPGDVFYLHSRLLERAAKLSDAKGGGSLTALPFIETQAGDVSAYIPTNVISITDGQIFLQSDLFFSGVRPAIDAGTSVSRVGGSAQIKAMSKVSGTLRLDLASYRELEAFAQFGSDLDKATQAKLNRGARTVEVLKQGLHKPLRVEKQVIILYALTRGFLDDIPVVDITRFEEEFHAWLDSNATDLLEEIRTTKKLADDDKFAAAINGFKKVFVASE

SEQ ID NO: 16554 - protein, 286 aa, Bacillus thuringiensis
MLKVTNLKKTIDSQTILDNVSFTLQRGSIIGLLGRNGAGKTTLLRTMVGILDPDEGTVTYEDTNIHQFPEIKQKIVYVPDSTNILNGYTIKEIVKFYKEVYTAFDETHFYELLERFNLPNKRIRSYSKGMKALLAIILAVSTKAEYIILDEPTNGLDPIVKRKILQFLVGEVAEKEITIFISTHHLDEVEQIADTIIILKGHTISSITSLDDAKSRFAKIQVAYERSLPQKLENLSNIKILNQTGKVYTILIEGNVATTLEKFYKEQPILIEELTMSLEDIFITTF

SEQ ID NO: 16555 - protein, 489 aa, Bacillus thuringiensis
  unsure (1)..(489): unsure at all Xaa locations
ETRQQWGTRAGFIFAAVGSAVGLGNIWRFPYTAYENGGGAFFLPYLFALLTTGISLLAFEFALGHRHRGSAPLTFFRISPRAEFIGXWQMCVTFIVSTYYAVIIAWSISYTYFAITGAWGKDTQSFLFKEYLHVADKPGQFGGLVPEVLIPLVLVWIIVLGVAFKGVKKGIEVVNRIFIPLLVVMFLIIVVRAVTMEGAMQGLDAFFKPDWSRIFDGKVWLAAYGQIFFSLSLAFGIMITYSSYLPKNSDTTNNAFITGFANSGFELLAGIGVFAALGFMANNMGVPVDKVASAGVGLAFVVFPQIINELPMSPLFGVLFFLSLTVAGITSLISLAEVCFAAVSEKFSLSREKTIGIMGTLLVLVSLVFATRGGLMFLDVVDYFANNFGLITIALAEVVTIGLILRRLPVYQNHANFVSDIKLGTFWRVSLLVITPLMLGYMLIDGTIQNIKKNYGDYPTEFVVTYGWSIAAAFLIVALIISLKKWNAQ

SEQ ID NO: 16556 - protein, 209 aa, Bacillus thuringiensis
  unsure (1)..(209): unsure at all Xaa locations
IYVTRHGETEWDVAKRMQGRKNSALTENGIVQAKQLGNRMKDLPIHAIYSSPSERTLHTAELIKGERDIPIIADEHFYEINMGIWEGQTIADIEKQFPEEVHLFWNEPHLFQSTSGENFEAVYERVIEGMQLLLEMHKGQNILIVSHAAAAKLLVGHFAGIEIENVWDDPFMHSASLSIIEFEEGIGKVKQFADISHFQXMXKRPQNGL

SEQ ID NO: 16557 - protein, 144 aa, Bacillus thuringiensis
AYYESEVGLLEITANQEGITSVIFVDERQEENKNEMIEQCINELDEYFKGKRIELTVALSAEGTAFQKNVWDALYTIPYGVSASYLDIAEKVGNTKAVRAIGGANSRNPISIVVPCHRVIGKSGKLVGYAGGLWRKEWLLKHEG

SEQ ID NO: 16558 - protein, 507 aa, Bacillus thuringiensis
SKYMIGVDIGTTSTKSVLFSTDGSVIASHGIEYPLYSPTPETAEQDPEEIFHAVINTIKETVRISSVQPNDILCVSFSSAMHSIIAVDEKGKPLTRCITWADNRSASWAEKIKNDMNGHEIYLRTGTPIHPMSPLSKLVWLQNEQAELFAKSYKFISIKEYVFYKLYKEYVIDYSIASATGMFNLKSLKWDEEALHVAGITDEKLSKLVPTTHSLTGLDEEFAKEMNVLVSTPFVVGASDGVLSNLGVNAIDPGVVAVTIGTSGAIRAVTNRPVTDPKGRIFCYALTEDHWVIGGPVNNGGMIFRWARDQLGTSEIELAKRLGKDPYEVLTEIAAKVNPGSDGLLFHPYLAGERAPLWNANARGSFFGLGLHHKKEHLIRAVLEGVIYNLYTVLLALKELIGEPKKIQATGGFARSELWRQMMADIFHQDVYVPESFESSCLGAAILGLYSLGEIDTLSVVSEMVGADFHHEPNMESVEKYKDLTPIYIRLSRQLEEEYESIAAYQK

SEQ ID NO: 16559 - protein, 199 aa, Bacillus thuringiensis
  unsure (1)..(199): unsure at all Xaa locations
ESTRRYEQLKKDGIHLMDAETLGXMEGARNGACYMIGRDQELGDIVEPIFRDTAVENGFLYAGKAGSGHFLKMVHNGIEYGMMAAIGEGFEILEKSEFDYDYEKVSRVWNNGSVIRSWLMELTENAFSKDAKLDEIKGVMHSSGEGKWTVETALDLQTATPVIAMSLLMRYRSLDNDTFTGKVVAALRNEFGGHAVEKK

SEQ ID NO: 16560 - protein, 580 aa, Bacillus thuringiensis
KGKLIVVGGGLAGLMATIKAAEAGVNVELFSLVPVKRSHSVCAQGGINGAVNTKGEGDSPWIHFDDTIYGGDFLANQPPVKAMCEAAPGIIHLMDRMGVMFNRTEEGLLDFRRFGGTQHHRTAFAGATTGQQLLYALDEQVRRHEVAGLVTKYEGWDFLRAVVDDEGVCRGIVAQDLQTMEIRSFGADAVIMATGGPGIIFGKSTNSIINTGTAASAVYQQGAYYANGEFIQIHPTAIPGDDKLRLMSESARGEGGRVWTYKDGKPWYFLEEKYPAYGNLVPRDIATREIFDVCVEQKLGINGENMVYLDLSHKDPKELDIKLGGIIEIYEKFTGDDPRKLPMKIFPAVHYSMGGLWVDYKQMTNIPGLFAAGECDYSMHGGNRLGANSLLSAIYGGMVAGPNAIEYMKGLSKSSDAVSSTVYEQNELIETEKFNNILTMDGNENAYVLHKELGEWMTDNVTVVRENKKLLETDAKIEELMARYKRININDTARWSNQGASFTRQLANMFELARVITIGAYNRNESRGAHYKPEFPNRDDANFLKTTMAKFEGEGNAPAFHYEDVDISLIKPRKRDYSSK

SEQ ID NO: 16561 - protein, 250 aa, Bacillus thuringiensis
MSEKTIRFIITRQDGPDAQAFDQEFEIPYRPNMNIISALMEIRRNPVDSKGNQTTPIAWDMNCLEEVCGACSMVINGKPRQSCTALIDQLEQPIRLKPMKTFPVVRDLQVDRSRMFNALKRVKAWIPIDGTYDLGPGPRMPEKKRQWAYELSKCMTCGVCLESCPNVNSKSDFIGPAPLSQARLFNSHPTGEMHKADRLRAIMGDGGLANCGNSQNCVQSCPKGIPLTTSIAALNRDTTIQSFKDFFGSD

SEQ ID NO: 16562 - protein, 990 aa, Bacillus thuringiensis
  unsure (1)..(990): unsure at all Xaa locations
FTLDIESGIILVVTIPIVIIFMILLGLAAQKMADSQYEIYRVLSNHFVDTLKGLETLKYLGKSEQHEGKIEKVSKRYRKATMRTLRVAFLSSFALDFFTSLSIAFVAVGLGIRLIDGTIILLPALTILILAPEYFLPIKQVGANYHATLDGQIAMEQIEEILQQQKGIQKKDLNEDIVWNASSSLKLQDIKVNNTESEKAILEGINFTWEGNGAIGVIGESGAGKSTLIDVLAGFLSPSSGKMLVNGVEVDGSTREDWQKNIAYIPQQPYIFPLSLKDNIRFYETNATDEEVERVINEVGLRSLVTSLPNGMHERIGEGGRMLSGGQEQRVAMARALLSKKPIILLDEPTAHLDIETEFEIKQAMLRLFNGKLVFLATHRLHWMKQMDHILILNKGEMKESGTYEELLENETLHFHREERGREMSNWVKPYIKQNKGRMTLTIFLGLLGVSSGAMLLFISGYLISKSALRPENVMAVYVPIVATRAFSIGQAVFHYIERLVGHDVVLRILEKMRTRLYRIVEPQALFFRSRFQTGDMLGVLSEDIEHLQNLYLRTIFPSILALVVYSIFVLVIGAFDFVFALIVGCMLAIIVFLLPFVSLLLMKKHHVTLKQGRNRLYQQLTDAVFGLSDWQASGRKDEFINEYVKQNDQLLKIEKRVKRWIIFGTVSFNXXXVLXLFRXSYGLGMKRQVNKLLLQLSQLSYXXLYLXTNALIPIADAIDRIPSYVESTHRLNGVESDSVLHDETDLHGEKDYIEPKHVDIELNHVSYSYPDSNEIVLKDVSLQIKTGKKIAILGRSGTGKSTLLKLLTGALSPVNGQVVLNGERAHTNLLSKYISVLNQKPHLFDTTIGNNVRIGKPEATDEEIWKALEKAQLASHVTSLPDGLQTKMHEMGKRFSGGERQRVAFARTLMQETPIIVLDEPTIGLDPKTELSLIETMFSATEEKTVIWITHHLVGIEHVDEVIFLDRGQIVMQGSHKQLLKENEKYRKL

SEQ ID NO: 16563 - protein, 165 aa, Bacillus thuringiensis
MLLIGTEVKPFKANAYHNGEFIQVTDESLKGKWSVVCFYPADFTFVCPTELEDLQNQYATLKDLGVEVYSVSTDTHFTHKAWHDSSETIGKIEYIMIGDPTRTITTNFNVLMEEEGLAARGTFIIDPDGVIQSMEINADGIGRDACILVNKIKAAQYVRNNPGEV

SEQ ID NO: 16564 - protein, 510 aa, Bacillus thuringiensis
EQARRAYEQFSSQPDDLLKNVYLTALHDRNEVLFYRILTDHLREMLPIVYTPTVGVAIQRYSHEYRKPRGVYLSINDPSGIEEAFTNIGATAENIDLVVVTDGEGILGIGDWGVGGINIAIGKLAVYTAAVGIDPSRVLPVILDVGTNREELLNNPFYIGNRHPRITGKAYDEFIDTFVQAVNKQFPKALLHWEDFSSRNARKILDKYRHDVCTFNDDIQGTGAVSLAAVLSAVKASGVPLSEHRVVVFGAGTAGIGIADQVRDAMVRVGVSEEESYKRFWCIDRNGLVTDNMEDLLDFQIPYARKEVEVSGWKQNDVIGLAEVVKHVKPTILIGTSTVAGAFKEEIIKEMASHVERPIILPMSNPTPLAEAKPADLIEWTEGRALVATGSPFEPVTYNGVTYVIGQSNNALIFPGLGLGTIVVRASVMTDGMFAAAAEAVASMVDTSQPGAPILPEVEELRNISEMVAIEVAKVAVAEGVARVNLSDNDIKMAVKEAMWKPEYRQIKAV

SEQ ID NO: 16565 - protein, 222 aa, Bacillus thuringiensis
MMDQFLWVLFPYIIFAIFIGGHIFRYNYDQFGWTSKSSELLEKKMLRLGSLLFHFGIMFVIGGHVMGILIPEAVYRSVGISEHVYHVVAISFGLPAGVASIIGLIILTYRRVTVKRIIATSTKGDYIALILLLIVMLAGLSSTFLNIDSKGFDYRTTIGPWFRSLFIFQPKVEYMMEVPIWFKIHILAGMGLFAVWPFTRLVHVFSAPIKYVSRSYVIYRRR

SEQ ID NO: 16566 - protein, 176 aa, Bacillus thuringiensis
  unsure (1)..(176): unsure at all Xaa locations
QTAFSCSSFLLSYPELGWREALTELQEEVKTIEQEDVKASLTAFIKQVLDKTNDQLIDSYVYTFDFGKKTNMYLTYMNTGEQRERGIELLELKQHYKKSGFSVTDKELPDYLPLLLEFFANANEQDSEPIMSKYTENIQALHVQLKEAGSMYEPILASVLLAIETWGVQTNXKGAL

SEQ ID NO: 16567 - protein, 484 aa, Bacillus thuringiensis
KAQVGMVMNLDKCIGCHTCSVTCKNTWTNRPGAEYMYFNNVETKPGIGYPKQWEDQEKYKGGWELKNGEIQLKSGSKMKRLMNIFYNPDQPTIDDYFEPWNYDYETLTNSPQRKHQPVARPKSAITGEFIDKIEWGPNWEDDLAGGHITGLQDPNVKKMEEEIKTDFENVFMMYLPRICEHCMNPSCVSSCPSGAMYKREEDGIVLVDQNACRAWRFCVSSCPYKKVYFNWQTNKAEKCTMCFPRIEAGMPTICSETCVGRIRYIGVMLYDADKVKEAASVEDEKDLYESQLTVFLDPNDPEIAAEAKKQGIPEEWIKAAQQSPIYKMIIDWKIALPLHPEYRTMPMVWYIPPLSPIMNMVEGKGSNWQAEEVFPAIDNMRIPIQYLANLLTAGDESHIRLTLKKMAVMRTHMRALQINKEPNEAVLKELGLTKQDVEDMYRLLAIAKYKDRFVIPTSHREQVADLYSEQGSCGLSFTGGPGSC

SEQ ID NO: 16568 - protein, 1188 aa, Bacillus thuringiensis
  unsure (1)..(1188): unsure at all Xaa locations
RKRWXHDKVIRSTHGVNCTGSCSWNIYVKDGIVTWEGQELNYPTTGPDMPDFEPRGCPRGASFSWYIYSPLRVKYPYVRGVLWNMWQEELQNNESPLEAWKSIVENREKARTYKQARGKGGFIRANWDEVLQLVSASLLYTVMKYGPDRNVGFSPIPAMSMLSHAAGSRFMQLMGGPMLSFYDWYADLPPASPQIWGDQTDVPESSDWYNSGYIMTWGSNVPMTRTPDAHFLAEVRYKGTKVVSVSPDFAESTKFADDWISVKQGTDGALAMAMGHVILQEFYVDNQVEYFTKYAKQYTDFPFFVTLKQKGDQFVADRFLNASDIGRETKLGEWKPVLWNENTNDFATPHGTMGSRWDNEKKWNLRLEDEETGEKIDPRLSLLGMEEAIGTVQIPYFSDDGNKVLERTIPVKKVMTEEGEMFVTTVYDLTLANYGVNRGLGGQEPKDFNDDIPFTPAWQEKMTGVKRELIIQIAREFAQNAVDTNGRSMIIVGAGINHWFNSDTIYRAVLNLVLLVGAQGVNGGGWAHYVGQEKLRPAEGWQTIAMAKDWQGPPKLQNGTSFFYFVTDQWRYEDTPVGHLASPVEGNSRYQHHGDYNVLAARLGWLPSYPTFEKNGIELYKEAVAAGATTQEEIGKYVAQKLKEKELKFAIEDPDNTNNFPRNLFVWRANLISSSGKGHEYFLKHLLGTTNGLMNDDSDSLRPEEIKWHEEAPEGKLDLLINLDFRMAGTALYSDIVLPASTWYEKHDLSSTDMHPFVHPFNPAIGSPWEARSDWDIFTSLSKAVSDLAKKIDLEPMKEVVATPLLHDTPQELAQPLGKIKDWSKGECEPIPGKTMPQIHVVERDYKTIYDKMTALGPNAGKQPIGTKGISWSAEKEYEQLKSKLGVVRTDSIAKGCPDIKEAINAAEAVLTLSSTTNGHMAVKAWEALEKQTDLKLRDLAEEREEECFTFEQITAQPKTVITSPAFTGSEKGGRRYSPFTTNVERLIPWRTITGRQSFYLDHDMMKEFGETMATFKPILQHKPFRKSRPEVEGKEITLNYLTPHNKWSIHSMYFDSLPMLTLFRGGPTVWMNKEDAAEAGVADNDWIECFNRNGVVVARAVVTHRIPRGMAFMHHAQDRHINVPGTKLTSNRGGTHNSPTRIHVKPTHMIGGYGQLSYGFNYYGPTGNQRDLNVVIRKLKEVDWLED

SEQ ID NO: 16569 - protein, 199 aa, Bacillus thuringiensis
KNLDGKVALVTGASRGIGRAIAMRLANDGALVAIHYGRNKIVADETISEIESNGGKAFLIEADLNLMDGVKKIVEQLKNELQIRVGTSEIDILVNNAGIGTQGTIENTTEEVFDEIMAVNIKAPFFLIQQTLPLLRVEGRVINISSAEVRLGFTGSIAYGLSKGALNTMTLPLAKHLGERGITVNTIMPGYTKTDINTK

SEQ ID NO: 16570 - protein, 221 aa, Bacillus thuringiensis
INTIIKTTNLTKVYGNQKSVDNLNINVQQGEIYGFIGRNGAGKTTTIRMLLSLIKPTSGTIEIFGENLFQNQKDILSRIGSIVEVPGFYENLTAKENLLINAKIIGVHKKNAIEEALEIVGLQHETKKLVGKYSLGMKQRLGIARALLHYPELLILDEPTNGLDPIGIKEMRKLIHSLAQERNITILISSHILAEIEQLVDRIGIIHEGKLLEEVSLDTLR

SEQ ID NO: 16571 - protein, 516 aa, Bacillus thuringiensis
HLLAFDAGTGSIRAVLFDLHGNQIAVSQKEWIHKSDLRYPGSMNFDVVENWKLVQECTKEVLQKSNTPASSILAISATSMREGFVLYDQDGQEIWACANVDGRASVEVSELKEIRSHLEKDLYTKSGQTFSLGALPRLLWIKKHEPDVYNNIYSFTMLNDWILYKLSGVLQIDPSNGCTSGIFDLQNRVWDNDVAKECGLSLPFSPTVNEAGTVIGNVTKECAALTGLLEGIPAVAGGGDAQMASLGTGIVNPNQTLICGGSFWQQEVNVTEPITDPHAAIRVNCHVVPNLWQYETIAFFPGLVMRWFRDAFCQEEKKHADKLGVDAYELLEEQAKDVPVGSHGIIPTFSNVMNYISWRHAAPSFLNLSLDADKCGKKEMFRAIEENAAFVTLGNLKLIENLTGTFPSEVVFAGGAAKGKLWPQILSDVLGIPVKVPVVKEAAALGTAIAAGVGAGIYSSMEETAEEFVQWEQTFEPVTENHELYKEFYETWKTVYDSQLALADKGLTSHMWIAPG

SEQ ID NO: 16572 - protein, 496 aa, Bacillus thuringiensis
MSKSVVIAEKPSVARDIARVLKCDKKGNGYLEGSKYIVTWALGHLVTLADPESYDVKYKKWNLEDLPMLPERLKLTVIKQTGKQFNAVKSQLLRKDVNEIIVATDAGREGELVARWIIDKVKLNKPIKRLWISSVTDKAIKDGFANLKPGKAYDNLYASAVARSEADWYIGLNATRALTTRFNAQLNCGRVQTPTVAMIASREDEIKNFKAQTYYGIEAQTMEKLKLTWQDANGNSRSFNKEKIDGIVKSLDKQNATVVEIDKKQKKSFSPGLYDLTELQRDANKKFGYSAKETLNIMQKLYEQHKVLTYPRTDSRYISSDIVGTLPERLKACGVGEYRPFAHKVLQKPIKPNKSFVDDSKVSDHHAIIPTEGYVNFAAFTDKERKIYDLVVKRFLAVLFPAFEYEQLTLRTKVGNETFIARGKTILHAGWKEVYENRFEDDDVTDDVKEQILPHIEKGDTLTVKLLMQTSGQTKAPARFNEATLLSAMENPTKYM

SEQ ID NO: 16573 - protein, 178 aa, Bacillus thuringiensis
MMNQDIEKVLISEEQIQEKVRELGAIVAEDYKNTVPLAIGVLKGAMPFMADLLKRTDTYLEMDFMAVSSYGHSTVSTGEVKILKDLDTSVEGRDILIVEDIIDSGLTLSYLVDLFKYRKAKSVKIVTLLDKPTGRKVDLKADYVGFTVPHEFVVGYGLDYKEQYRNLPYVGVLKPSVY

SEQ ID NO: 16574 - protein, 461 aa, Bacillus thuringiensis
RKKVVIVGGGITGLTAMYNLQKNIHEKNLPIDTLLIEASGKLGGKIQTVRKDGFTIERGPDSFLARKESAARLVKELGLGDELVNNQAGQSFILVNNRLHKMPTGSMMGIPTQITPFLFSGLFSPIGKLRAGFDLLMPRSKPVSDQSLGQFFRHRLGNEVVENLIEPLLSGIYAGDIDQMSLMSTFPQMYQIEQKHRSISLGMRTLAPKEEKAEPKKGMFQTVKTGLESIVKSLEVKMHEGTIIKGTRIEKVAKQGDGYTITLSNGKEIEADAIVVATSHKVLPSMFAQYKQFRFFRNIPSTSVANVALAFQKSAIQRDINGTGFVVSRNSDYTITACTWTHKKWPHTTPEGKTLLRCYVGRAGDEAVVEQTEEELVQLVLEDLKKTMDITEDPEFTIVSRWKEAMPQYTVGHNERMKQLTTFMEKELPGIYLAGSSYAGAGLPDCINQGEEAAKRVLSHL

SEQ ID NO: 16575 - protein, 305 aa, Bacillus thuringiensis
KKKIGLLVMAYGTPYKEEDIERYYTHIRRGRKPSPEMLEDLTERYRAIGGISPLATITLEQAKKLEQRLNEVQDEVEYHMYLGLKHIEPFIEDAVKDMHNDGIQDAIALVLAPHYSTFSVKSYVGRAQEEAEKLGNLTIHGIDSWYKEPKFIQYWVDAVKGIYNGMSDAEREKAVLIVSAHSLPEKIIAMGDPYPDQLNETADYIARGAEVANYAVGWQSAGNTPDPWIGPDVQDLTRELNEKHGYTSFVYAPVGFVAEHLEVLYDNDFECKVVTDEIGAKYYRPEMPNASDAFIDCLTDVVLKK

SEQ ID NO: 16576 - protein, 342 aa, Bacillus thuringiensis
TINETFLKACRGERTDYVPAWYMRQAGRSQPEYRKIKEKYSLFEITHNPELCAYVTKLPVDQYNVDAAILYKDIMSPLPAIGVDVEIKSGIGPVIDNPIRSLQDVEKLGEINPEDDVPYILDTIRLLTTEMLDVPLIGFSGAPFTLASYMIEGGPSRNYHNTKAFMYAEPKAWFALMDKLADMVITYLKAQINAGAKAVQIFDSWVGTVNVADYRVFIKPAMERIFAEVRKMGVPMIMHGVGAAHLVNEWHDLPLDVVGLDWRLPIEEARARGVHKAVQGNMDPSFLLAPWSVIEEHVKGILDQGMKQPGYIFNLGHGVFPEVNPDTLKRLTTFIHEYSKGQ

SEQ ID NO: 16577 - protein, 212 aa, Bacillus thuringiensis
MGTEFNGLFDEWAHTYDSFVQGEDIQYKEVFAHYEDILEDVVNKSFGNVLEFGVGTGNLTNKLLLAGRTVYGIEPSREMRMIAKEKLPKEFSITDGDFLSFEVPNSIDTIVSTYAFHHLTDDEKNVAIAKYSQLLNKGGKIVFADTIFADQDAYDKTVETAKQRGFHQLANDLQTEYYTRIPVMQTIFENNGFHVTFTRLNHFVWVMEATKQ

SEQ ID NO: 16578 - protein, 373 aa, Bacillus thuringiensis
KTKLIHGIRIGEPSTGSVNVPIYQTSTYKQEAVGKHQGYEYSRTGNPTRAALEEMIAVLENGHAGFAFGSGMAAITATIMLFSKGDHVILTDDVYGGTYRVITKVLNRFGIEHTFVDTTNLEEVEEAIRPNTKAIYVETPTNPLLKITDIKKISTLAKEKDLLTIIDNTFMTPYWQSPISLGADIVLHSATKYLGGHSDVVAGLVVVNSPQLAEDLHFVQNSTGGILGPQDSFLLLRGLKTLGIRMEEHETNSRAIAEFLNNHPKVNKVYYPGLESHQNHELATEQANGFGAIISFDVDSEETLNKVLEKLQYFTLAESLGAVESLISIPSQMTHASIPADRRKELGITDTLFRISVGIEDGEDLIEDLAQAL

SEQ ID NO: 16579 - protein, 329 aa, Bacillus thuringiensis
TMKAQIIHSFGDSSVFQLEKVSKPKLLPGHVLIDVKATSVNPIDTKMRSGAVSAVAPEFPAILHGDVAGIVIEVGEGVSKFKSGDKVYGCAGGFKETGGALAEFMLADARLIAHKPNNLTMEEAAALPLVAITAWESLFDRANIKPGQNVLIHGATGGVGHVAIQLAKWAGAKVFTTASQQNKMEIAHRLGADIAINYKEESVQEYVQKHTNGNGFEVIFDTVGGKNLDHSFEAAAVNGTVITIAARSTHDLSPLHAKGLSLHVTFMALKILHTDKRNDCGEILTKITQIVEEGKLRPLLDSKSFTFDEVAQAHEYLESNKAIGKIVLK

SEQ ID NO: 16580 - protein, 488 aa, Bacillus thuringiensis
LNLESMTFVLFGATGDLAKRKIYPALYNLYRDQKLPKQISVIGLGRRQVSHVDFQERIKESIETFSRHREEGTPELEGFLDNFRYCPLDVSKPEDYERLLQVVREREEELHIKGNRMFYLSVAPEFFETIALNIKESGLDKTDGWKRLMIEKPFGHDLTSARELNDKLSRTFEEDEIYRIDHYLGKPMIQNLEALEFANPVLQSIWNKEHIANVQITASETVGVEERAGYYDQAGAIRDMVQNHMLQILMMTAMNLPEKVNACEIREEKRKVMETLRKVKKEDVQSHIIRGQYAAGEIKGGQVVAYKEEPGVNPSSNIDTFVAARLWIDNPFWTGVPFYIRTGKRMKEKSTRIVIEFKNTLKQQYQDNNPNAAPNLLIIEISPGENVSLQLNSKNPLKNGEIEPMRINFTCEQADVGVPEAYERLIHDAVSGDATFFAHWREVELSWEWVQPILEAFEENLLPLHEYESGSYGPEASNELLQESGFKW

SEQ ID NO: 16581 - protein, 252 aa, Bacillus thuringiensis
VRHALITAGTKGLGKQVTEKLLAKGYSVTVTYHSDTTAMETMKETYKDVEERLQFVQADVTKKEDLHKIVEEAMSHFGKIDFLINNAGPYVFERKKLVDYEEDEWNEMIQGNLTAVFHLLKLVVPVMRKQNFGRIINYGFQGADSAPGWIYRSAFAAAKVGLVSLTKTVAYEEAEYGITANMVCPGDIIGEMKEATIQEARQLKEHNTPIGRSGTGEDIARTISFLCEDDSDMITGTIIEVTGAVDVIHRHR

SEQ ID NO: 16582 - protein, 349 aa, Bacillus thuringiensis
MKALLWHNQRDVRVEEVPEPTVKPGTVKIKVKWCGICGTDLHEYLAGPIFIPTEEHPLTHVKAPVILGHEFSGEVIEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVIGILGYRHIFPAVIKLISSGQIQAEKLITKKITVDQVVEEGFEALVKDKTQVKILVSP

SEQ ID NO: 16583 - protein, 439 aa, Bacillus thuringiensis
MAVENITMPQLGESVTEGTISKWLVNVGDHVNKYDPLAEVMTDKVNAEVPSSFTGVVKELIAGEGDTLAVGEVVCVIQVEGADEVAATAVEEKTKEESKAEIATSEKAPKVKQPSDGKPRFSPAVLKLAGEHNVDLDLVEGTGANGRITRKDILKLVESGNIPQAGAAKKEEAVAAVVEARPEAPKAAPVAQNVAPAKPVPVPTMPGDIEIPVTGVRKAIAANMLRSKHEAPHAWMMIEVDVTNLVSYRNSIKGDFKKREGFNLTFFAFFVKAVAQALKEYPQINSMWAGDKIVQKKDINLSIAVATEEELFVPVIKQADEKTIKGIAREITELAGKVRTKSLKADEMQGGTFTINNTGSFGSVQSMGIINYPQAAILQVESIVKRPVIMDNGMFGARDMVNLCLSLDHRVLDGLICGKFLGRVKEILENMSENNTSVY

SEQ ID NO: 16584 - protein, 654 aa, Bacillus thuringiensis
  unsure (1)..(654): unsure at all Xaa locations
LGLSDEQVLEMFRTMLLARKIDERMWLLNRAGKIPFVISCQGQEAAQVGAAFALDREKDYALPYYRDMGVVLAFGMTAKELMLSAFAKAGDPNSGGRQMPGHFGQKKNRIVTGSSPVTTQVPHAVGIALAGKMEKKDLVTFVTFGEGSSNQGDFHEGANFAGVHKLPVIFMCENNKYAISIPVEKQLACKNVSDRAIGYGMPGYTIDGNDPLAVYKAVKEAADRGRRGEGPTLIETVSYRLTAHSSDDDDRVYRDKEEVEEAKKKDSIITFAAYLKEAGVLTEESEKQMLDEIMHIVNEATEYAENAPYAAPEDALKHVYAEXGERFMDVMSYIDAITLAMREEMERDEKVFVLGEDVGKKGGVFKATHGLYDQFGEDRALDAPLAESAIAGVAIGAAMYGMRPIAEMQFADFIMPAVNQIVSEAAKIRYRSNNDWTCPVTIRAPFGGGVHGALYHSQSVEAMFANQPGLKIVIPSTPYDAKGLLKAAIRDEDPVLFFEHKRAYRLIKGEVPEDDYVLPIGKADVKREGDDITVITYGLCVHFALQAAEKLAQDGISAHILDLRTVYPLDKEAIIEAASKTGKVLLVTEDNKEGSIMSEVAAIIAENCLFDLDAPIARLAGPDVPAMPYAPTMEKFFMVNPDKVEKAMRELAEF

SEQ ID NO: 16585 - protein, 472 aa, Bacillus thuringiensis
MAKEYDLVIVGGGTGGYVAAIRASQLGLKTALVEKENLGGTCLHKGCIPSKALLRSAEVYATAKKSEEFGVIASNVELNFAKVQERKEKIVTQLHKGVQHLMKQGKIDVFEGIGRILGPSIFSPMPGTISVELASGEENEMLIPKNVLIATGSRPNSLPGLELDGEYVMSSDHALKMETLPSSIIIVGGGVIGIEWASMLADFGVEVTVLEYAKTILPLEDQDVSKEMQRLFKKKGIKVVTGAKVLPETLVKDNGVTIQAEHNGENKEFKAEKMLVSVGRQANTQNIGLENTDIVVEKGYIQTNEFYQTKESHIYAIGDVIGGLQLAHVASHEGIAAVEHIAGKEVTPIDYSMVSKCVYSSPEVASVGLTEQEAKEKGYKLKVGKFSFRAIGKALVYGESDGFVKLVVDEETNDILGVHMIGPHVTDMISEAGLARVLDATPWEVAHTIHPHPSLSEAIGEAALAVDGRALH

SEQ ID NO: 16586 - protein, 351 aa, Bacillus thuringiensis
MASQQLGRLRSEIDQLNLQILELLNERGRLVQEVGNLKEVQGVKRFDPVRERNMLDLIAENNNGPFETSTLQHIFKQIFQAGLELQEDDHRKALLVSRKKKTEDTIVEIKGEKIGDGNQHFIMGPCAVESYEQVRQVAEAMKEQGLKLMRGGAFKPRTSPYDFQGLGLEGLQILRQVADEYDLAVISEILNPNDIEMSLDYVDVIQIGARNMQNFDLLRAAGAVNKPVLLKRGLSATIEEFINAAEYIMAKGNGNIILCERGIRTYERATRNTLDISAVPILKKETHLPVVVDVTHSTGRRDLLLPTAKAAMAIGADAIMAEVHPDPAVALSDAAQQMNIPQFNDFMNELK

SEQ ID NO: 16587 - protein, 288 aa, Bacillus thuringiensis
KVRKAIIPAAGLGTRFLPATKAMPKEMLPIVDKPTIQYIVEEAIESGIEDIIIVTGKGKRAIEDHFDHSFELEQNLLEKGKYEMLEKVQASSKINIHYIRQKEPKGLGHAVWCARKFIGNEPFAVLLGDDIVQAETPCLRQLMDQYEGTQSSVIGVQTVPENETHRYGIIDPVERNDRRYQVRQFVEKPAQGTAPSNLAIMGRYVLTPEIFMLLEDQQTGAGGEIQLTDAIQRLNEIQRVFAYDFEGKRYDVGEKLGFIKTTIEVALQHKELKKQLIKYMNDLVHKEI

SEQ ID NO: 16588 - protein, 258 aa, Bacillus thuringiensis
EEKMKAVILAGGYGTRIGEETHLKPKPMIEIGTKPILWHIMSLYSHYGITEFIICLGYKGYAIKEFFLNYNLHMSDFTIQLNDNTITSHSHRVEPWKVTLIDTGVNTETGGRVKKIQNYVGDEPFCLTYGDGLSNVNIKELITFHKKHGKMATVTAVQPFGRFGSLILDKQSVTSFQEKPLGDGGWVNGGFFVLNPEVFNYISGDKSVFETDSLVQLVNKNELAAYQHSGFWHPMDTLRDKNKLVELWESNNAPWKVW

SEQ ID NO: 16589 - protein, 349 aa, Bacillus thuringiensis
  unsure (1)..(349): unsure at all Xaa locations
LHHFFWNKKKVFITGHTGFKGSWLTLFLRSLGAEVVGFSSHPPSIPNIFEQGNVAKECTTMKGNITDYHSLFHAMKQHKPDIIFHLAAQPIVTASYKNPIDTFKTNVLGTVHVLEAAKSVESVRAIINVTSDKCYENDGSGDRSFVENDRLGGFDPYSASKACAEILATSYQKSFFRTNTQKLASVRAGNVIGGGDWAEDRLFPDIIRAYLHNHTLCIRNKYAVRPWQHVLDPLHGYILLAEKLWNDAKYAEAWNFGPMNEPNRTVHDVIESVIKLWNNPLTIISSSTNTPYESPVLTLDSTKAVNKLSWTPKLSTDDSIAWTVDWYKKYASGENIESFTXQQIDAFKN

SEQ ID NO: 16590 - protein, 308 aa, Bacillus thuringiensis
MNRLQVELPGLSLKNPIIPASGCFGFGREYAQFYDLSVLGSIMIKATTEQPRYGNPTPRVAETPGGMLNAIGLQNPGLDKVMNSELPWLEQFDLPIIANVAGSQAEDYVAVAKEISKAPNVHALELNISCPNVKTGGIAFGTNPEIAADLTKRVKEVSEVPVYVKLSPNVANIVEIAKAIENAGADGLTMINTLLGMRLDLKTAKPILANCTGGLSGPAIKPVAIRMVHEVSQAVNIPIIGMGGIETAEDVIEFFYAGASAVAVGTANFIDPFVCPTIIEELPALLDELGFDHISECQGRSWKQTCHS

SEQ ID NO: 16591 - protein, 1031 aa, Bacillus thuringiensis
KEGTKVIPVNSNPATIMTDTATADKVYIEPLTLEFVSRIIRKERPDAILPTLGGQTGLNMAVELAKSGVLDECGVEILGTKLSAIEQAEDRDLFRTLMQDLNEPTPPSEIIHNLDEAYGFVNEIGYPVIVRPAFTLGGTGGGICHNEEELIEIVTSGLKHSPVTQCLLEKSIAGCKEIEYEVMRDSNDNAIVVCNMENIDPVGVHTGDSIVVAPSQTLSDREYQMLRNTSLRIIRALGIEGGCNVQLALDPYSFQYYVIEVNPRVSRSSALASKATGYPIAKLAAKIAVGLTLDEIVNPVTQKTYACFEPALDYVVSKIPRWPFDKFESANRTLGTQMKATGEVMSIGRNLEESLLKAVRSLELGIYHLELDHLKELDKETMKKRIIKADDERLFIVAEAIRQGVTKEEINEWCEMDFFFLQKVENIVNMECEVKANVGNIEVLQTAKEMGFSDHYIAAAWNKTEREIYDMRKENNMMPVFKMVDTCAAEFESATPYYYSTYADENESIVTDRKSVVVLGSGPIRIGQGVEFDYATVHSVWAIKEAGYEAIIINNNPETVSTDFSISDKLYFEPLTIEDVMHIIDLEKPEGVIVQFGGQTAINLAAKLEEHGVKILGTSLEDLDRAEDRDKFEAALTKLGIPQPVGKTATTVEQAVAIAEEIGYPVLVRPSYVLGGRAMEIVYRQEELLHYMKNAVKVHADHPVLIDRYMVGKEIEVDAISDGENVFIPGIMEHIERAGVHSGDSIGVYPPQSLSEKLKEQIIEHTIALGKGLNIVGLLNIQFVVFKDQVYVIEVNPRASRTVPFLSKITGVPMANVATKVILGQDLVEQGYGTGYHPEEKEVYVKAPVFSFAKLRSVDTTLGPEMKSTGEVMGKDLTLEKALYKGLVASGINIPTHGSVIITVADKDKEEAMEIAKRFHEIGYNLLATAGTAQSLEEQNIPVQVVNKIDSEDYNLLDIIRQGKAQFVINTLTKGKQPARDGFRIRRESVENGVACLTSLDTTRAILRVLESMTFSAHSMKEITQTKRHEV

SEQ ID NO: 16592 - protein, 356 aa, Bacillus thuringiensis
AVIVEAKRTPIGKKDGILKEYEVQQLATPLLTFLSKGIKREIDDVILGNVVGPGGNVARLSALEAGLGYHIPGVTIDRQCGAGLEAIRTACHLIQGGAGNCYIAGGVESTSTSPFQKRARFSPETIGDPDMGVAAEYVAERYNITREMQDEYACLSYKRTLQALEKGYIHDEIFSFNGLLDESIKPEMNYERIIKRTKPAFLQNGTVTAGNSCGVNDGACAVLVMEEGQALKFGYKPVLRFVRSTVVGVDPNLPGTGPIFAVNRLLNEMNVKVEDIDYFEINEAFASKVVACAKELQIPYEKLNVNGGAIALGHPYGASGAMLVTRLFYQAQREFMKYGIATLGIGGGIGIALLFE

SEQ ID NO: 16593 - protein, 551 aa, Bacillus thuringiensis
VMKEYKRILLPLQKEKILVIAAVCSGIIAAILNLSRPIFMGLIVDNLIQRELKGAYVYIALFAGSHFLMWANNLLFDYISSKASQRILQTKRIELLRHYFSLPFEESEKIKQGELETLVVSDIPNWVRLYGSILIEYIHAIAQFIGAFIALQHIDIQFILWVTPFLFLSTIVPILMGEKVRDIASVSQKNHSSVVEMVSQFVKGIQDLRSLQKEKWAIRLFKEVTAQSYKSEVKKTMMQHCIGVVGTVIETGAYIVVLIIGAQKIMRGEIEVGSLIAVLATIEMLFFPVRYVGDLLIMTQVAVASANRAFCFLNKRAADSNVERAMGIRITNVSFQENDEEKCRIHNIDLQIRPGELVMIVGESGAGKTTLLKLITGLYKPSNGSIAYYGNEARMTTVWQEPRFFRTTVTENMYFGEEGLENQLEKNSELINATPIIRGLPEGSQTVLHKSGEEFSGGERKRLALLRAIVSNPTLIILDEPTAGLDPGNQELVWNMIEGIGRDVTRIVATHDVERAMIADCVVVIKNGTIVECGNPRELLNCNSLYKELQT

SEQ ID NO: 16594 - protein, 142 aa, Bacillus thuringiensis
MKKLLLVNGPNLNRLGVREVNVYGKGTLTTLEADMKQEAETMGVELECFQSNHEGAIIDIIHEAEDIYEGIILNPGAFTHYSYAIRDAIASISIPVIEVHISNIHQRESFRHESVTAAVCAGQIVGFGFYGYKLALFALMEK

SEQ ID NO: 16595 - protein, 215 aa, Bacillus thuringiensis
IMKAIIFDFDGLIVDTETIWFHSFRDAVREYGGELPLEEFAKCIGTTDEVLYTYLNDQLKEKFNKNALKEKVATLHKEKMRIPEARDGVKEYLEEAKEMGLKIALASSSSREWVIHFLEELQIREYFEVIKTREDVEKVKPDPALYRVAIEELGIKPSEAVVFEDSLNGLRAAVAAGLTCVVVPNDVTRNLPFENHHLRIESMREKSLKEVLQSI

SEQ ID NO: 16596 - protein, 332 aa, Bacillus thuringiensis
KIGINGFGRIGRNVFRAALNNSEVEVVAINDLTDAKTLAHLLKYDTVHGTLNAEVSANENSIVVNGKEIKVIAERDPAQLPWSDYGVEVVVESTGRFTKKSDAEKHLGGSVKKVIISAPASDEDITVVMGVNHEQYDAANHNVVSNASCTTNCLAPFAKVLNEKFGVKRGMMTTIHSYTNDQQILDLPHKDLRRARAAAENMIPTSTGAAKAVALVLPELKGKLNGGAVRVPTANVSLVDLVVELDKEVTVEEVNAAFKAAAEGELKGILGYSEEPLVSIDYNGCTASSTIDALSTMVMEGNMVKVLSWYDNETGYSNRVVDLAAYMTSKGL

SEQ ID NO: 16597 - protein, 652 aa, Bacillus thuringiensis
  unsure (1)..(652): unsure at all Xaa locations
MNKKSIRDVDLKGKRVFCRVDFNVPMKEGKITDETRIRAALPTIQYLVEQGAKVILASHLGRPKGQVVEEMRLTPVAARLGELLGKDVKKADEAFGPVAQEMVAAMNEGDVLVLENVRFYAGEEKNDAELAKEFAALADIFVNDAFGAAHRAHASTAGIADYLPAVSGLLMEKELDVLGKALSNPERPFTAIIGGAKVKDKIGVIRHLLDKVDNLIIGGGLAYTFVKALGHEIGLSLCEDDKIELAKEFMQLAKEKGVNFYMPVDVVITEEFSETATTKIVGIDSIPSNWEGVDIGPKTREIYADVIKNSKLVVWNGPMGVFEMTPFAEGTKAVGQALADAEDTYSVIGGGDSAAAVEKFGMADKMSHISTGGGASLEFMEGKELPGVVCLNDKXVAAKEKGRCKAMRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEAVSPEAAEAVRIQYGGSVKPENIKEYMAQSDIDGALVGGASLEPASFLGL

SEQ ID NO: 16598 - protein, 978 aa, Bacillus thuringiensis
  unsure (1)..(978): unsure at all Xaa locations
MNDNMVHITIDGKKYTAEPGSTILGVINENGIEHPQICYVPEVDPIQTCDTCIVEVDGKLMRSCSTIATEGMNIERASVRAKEAQTEAMDRLLENHLLYCTVCDNNNGNCKLHNTAELMEIEHQKYPYEPKVDVSEVDMTHPFYRYDPNQCIACGQCVEVCQNLQVNETLSIDWEAERPRVIWDKGVNINDSSCVSCGQCVTICPCNALMEKTMLGEAGFMTGLKPDILEPMVDLIKEVEPGYSGIFAVSEVEAAMRDTRTKKTKTVCTFCGVGCSFEVWTKGRKILKVQPSSDAPVNAISTCVKGKFGWDFVNSKERITKPLIRKNGTFVESTWEEALNVVANKLGAIKEEYGKGSIGFISSSKITNEDNYVIQKLARQVFGTNNIDNCSRYCQSPATDGLFRTIGIGGDAGTIKDIAQSGLVIIVGCNPTEGHPVLATRIKRAHKLHGQKLIVADLRKTEMAERSDVFISPKQGTDQVWLMAVTKYMIDQGWHDQEFINENVNFFEDFKESLEEYTLEYAEEVTGISKETLIQMAEMIRDADGTCILWGMGVTQNTGGSDTSAAISNLLLATGNYRRPGAGAYPLRGHNNVQGACDMGTLPGWLPGYQHVTNEMERAKFETAYGVKIDSEPGLNNIEMLHAIDEGKMKAMYLVGEDMALVDSNANHVHEVLSSLDFFVVQDVFLSKTAQYADVVLPAAPSLEKEGTFTNTERRVQRLYQVLPTLGDAKPDWWIVQEVANKLGANWNYSHPSEIFAEMASLSPLFSQANYEVLEGWNSFHWGSFDGTNTPLLFQDGFNFPDKKARFAIADWVRPAEFPAEFDLHINNGRMLEHFHEGNMTNKSTGIQTKVPGVFVEISPDLAKERGVKTGSLVRLVSPFGALKLRALVTDRVKANELYLPMNSTDNETAINFLTGPAVDVRTNTPAYKQTKVRMEVLEVDGXNPMPKANPRNKKRHPQAGIEVHRKWARPGYVHLTD

SEQ ID NO: 16599 - protein, 534 aa, Bacillus thuringiensis
LYEKVYEEIARRTTALQTMQRQDGTWRFCFEGAPLTDCHMIFLLKLLGRDKEIEPFVKRLASLQTNEGTWKLYEDEVGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLVSDVKKIITYPLSLHHKGYEEVERFMKGRIDENGTLYSYATASFYMIYALLALGHSIQSPIIEKAIMGITSYIWKMERGSHLQNSPSTIWDTALLSYALQEAQVPKVSKVIQNASAYLLRKQQTKKVDWSVHAPDLFPGGWGFSDVNTTIPDIDDTTAVLRALARSRGNENVDNAWKRAVNWVKGLQNNDGGWGAFEKGVTSRILANLPIENASDMITDPSTPDITGRVLEFFGTYTQNELPEKQKQSAINWLMNVQEENGSWYGKWGICYIYGTWAVLTGLRSLGIPSSDSSLKRAVLGLNIYSMKMVAGENLAKVVWKKDL

SEQ ID NO: 16600 - protein, 534 aa, Bacillus thuringiensis
  unsure (1)..(534): unsure at all Xaa locations
MLVGYTEWPKEFADRYREAGCWLGETFGGVLRERAEKYGDRIAVVSGKKHITYSELNKKVDRLAAGLLNLGIKKEDRVVIQLPNIIEFFEICFALFRIGALPVFALPSHRSSEISYFCEFGEASAYVISDKALGFDYRKLAREVKEKVPTLQHVIVVGEEEEFVNINDLYMDPVSLPEVXPSDVAFLQLSGCTSGLSKLIPRTHDDYIYSLRVSAEICNLNAESVYMAVLPVAHNYPMSSPGTFGTFYAGGKVVLATGGSPDEAFALIEKEKVTITALVPPLAMIWLDAASSRNADLSSLEIIQVGGAKFSAEVAKRIRPTFGCTLQQVFGMAEGLVNYTRLDDPEEFIIYTQGRPMSALDEVRVVDENDNDVQPGEVGSLLTRGPYTIRGYYKAEEHNARSFTKDGFYRTGDLVKVNEQGYIIVEGRDKDQINRGGEKVAAEEVENHLLAHDAVHDVAIVSMPDDYLGERTCAFVIARGQVPAVSELKMFLRERGIAAYKIPDRIEFIEAFPQTGVGKVSKKELRKVIAEKLI

SEQ ID NO: 16601 - protein, 244 aa, Bacillus thuringiensis
LNGKVAIVTGGAKGIGKAITVALAQEGAKVVINYNSSKEAAENLVNELGKDGHDVYAVQADVSKVEDANRLVEEAVNHFGKVDILVNNAGITRDRTFKKLNREDWERVIDVNLSSVFNTTSAVLPYITEAEEGRIISISSIIGQAGGFGQTNYSAAKAGMLGFTKSLALELAKTNVTVNAICPGFIDTEMVAEVPEEVRQKIVAKIPKKRFGQADEIAKGVVYLCRDGAYITGQQLNINGGLYM

SEQ ID NO: 16602 - protein, 170 aa, Bacillus thuringiensis
  unsure (1)..(170): unsure at all Xaa locations
TSHTAKYSNAKYNANHGXQPTTEYNANYGXQSNAEYDANYGXQSTTEYDANHGXQSNAEYDANYGXQSNAEYNANYGXXPNAEYDANHGXQSNAEYDANYGXQSNAEYDANHGXQSNAEYNANYGXQSNAEYDAEYGXQSTTKYDALSNAHDAAESVLSTTKSISNAISA

SEQ ID NO: 16603 - protein, 508 aa, Bacillus thuringiensis
MPSADVLIIGSGVAALRVAKEICHEKNVIIITKETKRNNNTHLAQGGIAAAVATYDNPNDHFEDTLVAGCHYNNEEVVRYLVEEGPKEINNLIENGMKFDGDETGPHLGKEGAHRKRRILHAGGDATGKNLLEHLIQEVAPYVTVVEQEMVLDFIIEKDKCVGALTRNNKGELKRYNADCTVLASGGIGGLYAFTSNDETITGDGLAMVYRAGGELVDLEFIQFHPTMLYAGGRCSGLVSEAVRGEGAVLINGKGQRFMMDIHSEQDLAPRDVVARAIHEQLLAGEKVYLNIEMIQNFEQRFPTVSSICKTNGVDINKKLIPVVPGTHFHMGGVKTNCDGETSIPNLYAVGEVACNGVHGANRLASNSLLEGLVFGKRTGRHILSRETKEKVNMLAEKEPKFIVLNHLPTKEEIQKCMMKYVGIVRTEQSLSYAKRWFSKYGVRNMILQHDVLTNEEITLINMLTACELIVVSALQREESIGGHYRSDYPDRNIGKKEIVRVKRKLQL

SEQ ID NO: 16604 - protein, 293 aa, Bacillus thuringiensis
MPNIAVVGSISMDLVAVSKKRPKAGETVIGEAFHTIPGGKGANQAVAAARLGANVAMVGAVGNDDYGTVVRKNLENERIFIDYVVPVTDRTTGIAHIVLAEEDNSIVVVQGANALVNKSVVDRSKELLVKADMVVLQLEIPLETVKYVLAICEEHNIPVMLNPAPAQVLSEDILEKATYITPNEHECRIVLDDFISPIEDLLAKYPNKLLMTEGSNGVRFHNGTEIVHVPSIAVDVVDTTGAGDTFNGALAVALSEGETLQKAIRFANIAGGLSVTKLGAQGGMPTRDKVREV

SEQ ID NO: 16605 - protein, 277 aa, Bacillus thuringiensis
NLQSKTVLNNGVEMPWFGLGVFKVEDGPELVEAVKSAIKAGYRSIDTAAIYGNEKAVGEGIRAGIKEAGISREDLFITSKVWNSDQGYETTLAAYEESLKKLELDYLDLYLVHWPVEGKYKDTWRALETLYNEKRVRAIGVSNFQIHHLQDVMKDAEIKPMINQVEYHPRLTQKELQAFCKEQGIQMEAWSPLMQGQLLDNEKLQEIAEKHGKTTAQVILRWDLQNGVITIPKSTKEHRIIANADIFNFELTKEDMEKIDALNQNHRVGPDPDNFDF

SEQ ID NO: 16606 - protein, 455 aa, Bacillus thuringiensis
VKSLLRKKALSTESPKQLDRTLTALDLTFLGIGAVIGTGIFVLTGIVAAKHSGPGIMLSFLIAAFTCACVAFCYAEFASSIPVSGSVYTYAYMTVGEVVAFIVGWCLMLEYLLAVAAVAVGWSGYLQSLLQGFNIHLPAIIASAPGVGKGGLIDLPAVCILLLITGLLSFGIRESARINNIMVLIKLAVIIAFIVAGAKYVKPENWTPFIPFGYDGIITGAATVFFAFLGFDAIATAAEETKKPQRDLPIGIIGSLLICTILYMIVSFVLTGMVPYTQLDVSDPVAFALHFVGEDAIAGLLAVGAMTGMTTVLLVVMYGQVRVSYAMSRDGLLPKALARVNKKVKIPLLNTWITGVVAALLAGLLDLHLLANLVNIGTLTAFTFVCCAVLILRKTHPDLKRGFRTPFVPVLPVVAILCCLYLMINLSKTTWISFAVWLIVGLCFYFFYSRKHSHL

SEQ ID NO: 16607 - protein, 290 aa, Bacillus thuringiensis
MRFDEAYSGKVFIKSHPSFEESKVVIYGMPMDWTVSYRPGSRFGPARIREVSIGLEEYSPYLDRELEEVKYFDAGDIPLPFGNAQRSLDMIEEYVSKLLDADKFPLGLGGEHLVSCPIFKAMQKKYPDLAIIHMDAHTDLRESYEGEPLSHSTPIRKVCDLIGPENVYSFGIRSGMKEEFEWAKEVGMNLYKFDVLEPLKEVLPKLAGRPVYVTIDIDVLDPAHAPGTGTLEAGGITSKELLDSIVAIANSNINVVGADLVEVAPVYDHSDQTPVAASKFVREMLLGWVK

SEQ ID NO: 16608 - protein, 465 aa, Bacillus thuringiensis
QIEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVIFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGVPYAADIMNFVIITAVLSVANSGLYANSRMLWAMAKQGMASPAFTKLTKKGVPLNALIFSLIFASLSLLTSVFAADTVFLVLTSIAAMAAVVVWMSIAASQFFFRRNFVKNGGNINDLKYRTPLYPLVPIVAFSLNFITFVSLAFIPDQRIALYCGIPFMIICYILYQVKYKKIVTLEQPRTVTQ

SEQ ID NO: 16609 - protein, 871 aa, Bacillus thuringiensis
KWYALSQEDVIKDLQVEKQQGLSAREVQMRQEKYGMNRIEPKQSVPWIVSFMGQFKEFTSLILLGAAGLSVLSGGVFDGLAMGTILVVNAVIGTLQERKAEKVVEALNQFRAPNCIVTREGEEIEVASSELVPGDVVCLQAGDRVPADLRIIDSWNLEVNEAMLTGESLPVEKKVDAVGEECSLAEQNNMLFMGTSVTRGKARAIVVETGMSTEMGYMISLMKGEETEPTPLQQKVTSISKTFIKGAFVAGGIVLVAGLLRGLPITQMITTSVALTASAVPEGLPIMITIALSAGIFRMQKQNALVRKLSSLETLGRTTVICSDKTGTLTKNEMTVKVIATPNRMWSVSGDGYEPVGTISDVTSSKVAAAVEMEVEEATYHESEKTPLEHPDFVRVLQISVLCNNSKLEHEDDQWIVKGDPTEGALLSFASKAGVSYKDMASFERHHEEPFDSETKIMSVVCKENESLYKFSKGSVEAILTRCKWYQHNGEIYPLCDKEKEVILQQNEGFAEQALRVLGFAYSNVENNDLIFVGLVGMIDPPKPEVEESIREAIELGVKPVMITGDHPTTAISIAKQTGIWNRDDRVLTGVEIDNVTDEQLKEIVKNTSVFARVTPAHKLRIVAAYQADCQIVAMTGDGVNDTPAIKKANIGIAMGQTGTEVTKEAADLILKKDHFGSIVEGVKEGRTIIGNIRKAVGCLLTGNLAEVLVTSAAVIAGMPIPLVPIQILLMNLITDALPAMILAVNPGNKTKQTKRQDIVDKELYKKVVTRGILLGAGSLALFGMSLAAGVPLAVAQTSAFAALVAGQLIQTFSWRQEGSDETMRDWSKDRFFVTALGTSWLVLLSAIYVPPFARIFHTAPLTFMQWVPVL

SEQ ID NO: 16610 - protein, 483 aa, Bacillus thuringiensis
MNPNNRLTTNQGAPVGDNQNSRTAGRRGPVLLEDYHLVEKLAHFDRERIPERVVHARGAGAHGVFVTKNSMKQYTKAAFLQNEGTETPVFVRFSTVIHGQGSPETARDPRGFAVKFYTEEGNYDIVGNHLPVFFIRDAIKFPDMVHSLKPAPDTNIQTPDRYWDFMTLSPESTHMMTWVFSDYGTPASYREMEGFGVHSFKWINEEGKIVYIKYHWKPQQGVRNLNAKEVQEVQGKDFNHATRDLFDAIEKGNYPKWDLHVQVMQLDEMDSLDFDPLDPTKVWPEDRFPLMEVGTMTLNRNPKNFFAEVEQVAFSPSATVNGIEPSEDKLLQGRLFSYPDTQRYRLGANYLQIPVNCPYAAVHNQQRDGAMQVNQNPSTINYEPSRHAENPVEDKAYRDSTMKVEGYVSREKIEKPNDFKQAGERYRSFSKEEQDNLIANLTNDLKDVNERTKLLAVCNFFRADQEYGMRLAQALNVDITQYV

SEQ ID NO: 16611 - protein, 306 aa, Bacillus thuringiensis
MTKKRIGLLVMAYGTPESLDDVEAYYTHIRHGRTPSEEALEDLIGRYKAIGGISPLAKITKEQAHKLTDSMNNIFTEYEFTCYLGLKHIAPFIEDAVEEMKRDGIEQAISIVLAPHYSTFSIKAYNDRAIRLSQEIGGPVIEPIEQWYDEPKFISYWADQIKETFTEIDNKEKAVVIFSAHSLPEKIIATGDPYVEQLKHTAYLIAEAANIQNYTTGWQSAGNTPDPWIGPDVQDLTKDLYEEHGYESFVYCPVGFVAEHLEVLYDSDYECKVVTDELNAKYFRPNMPNAQSAFIDCLAEIVSKKV

SEQ ID NO: 16612 - protein, 387 aa, Bacillus thuringiensis
QINERSLLLHKELVGKIEITSKVEVNSADDLSLTYTPGVAESCKAIAADEETVYDYTARGNMVAVVSDGTAVLGLGNIGPKAAMPVMEGKSILFKKFANVDAFPLCLGTTDVDEIVTLVKNLEPTFAGINLEDIAAPRCFEIEKRLKEETNIPVFHDDQHGTAIVVLAAVINALKVVSKQMDNVKIVINGAGSAGIAIGKLLLKAGAKHITLVSLEGIVCEGETWMNEAQIEVSKKTNREHVRGTLKEAINQADIFIGVSAPNVLTKELVQTMNEKAIVFAMANPIPEIFPEDALEAGAAVVGTGRSDYANQVNNVLAFPGIFRGALDVRATDITEEMKLAAAYGIANIITDEERNANYVIPNPLDKRVVPSVAEAVAKAAIDSGVA

SEQ ID NO: 16613 - protein, 379 aa, Bacillus thuringiensis
MHFKLSEEHEMIRKMVRDFAKNEVAPTAAERDEEERFDRELFDQMAELGLTGIPWPEEYGGIGSDYLAYVIAIEELSRVCASTGVTLSAHTSLAGWPIFKFGTEEQKQKFLRPMAEGKKIGAYGLTEPGSGSDAGGMKTIAKRDGDHYILNGSKIFITNGGIADIYVVFALTDPESKQRGTSAFIVESDTPGFSVGKKESKLGIRSSPTTEIMFEDCRIPVENLLGGEGQGFKVAMQTLDGGRNGIAAQAVGIAQGALDASVEYARERHQFGKPIAAQQGIGFKLADMATDVEAARLLTYQAAWLESEGLPYGKESAMSKVFAGDAAMKVTTEAVQVFGGYGYTKDYPVERYMRDAKITQIYEGTQEIQRLVISRMLTK

SEQ ID NO: 16614 - protein, 373 aa, Bacillus thuringiensis
  unsure (1)..(373): unsure at all Xaa locations
EEQQMMRKMVRDFAQKEIAPFVPSMEQGVFPKEILQKMGELGLMGIPAPAKYGGAEMDFISYILAIEEISKVSATVGVILAVHTSVGMNPILYFGTEEQKKKYVSKLATGEYLGAFALTEPNAGSDAGSLKSRAVKKGDHYIINGSKVFITNGGEASTYIVFASTNPEAGKSGISAFIVEKDTPGLIIGKDEHKMGLLGSRTVQLTFEDMKVPAENLLGEEGQGFKVAMANLDVGRIGIGAQALGIAEAALGCAIDYAKEREQFGKPIAAQQGIGFKLADMATSVEAARLLVYRAASLRAQGLPCGKEASIAKLFASKTAVEVAIEAVQVFGGYGYTKDYPVERFFRDAKITQIYEGTSEIQKLVISRALXKG

SEQ ID NO: 16615 - protein, 283 aa, Bacillus thuringiensis
MGVQNIVVIGAGQMGSGIAQVCAMAGYDVKVQDLKQEQLDRGMAIITKNLARQVEKGRMKEEEKEATLNRLTVTLDLDCVKEADLIIEAAVEKMDIKKKIFANLDEIAPEHAILATNTSSLPITEIAAVTKRPEKVIGMHFMNPVPVMKLVEIIRGLATDDAVYEAIEDITKKIGKVPVEVNDFPGFVSNRILLPMINEAIYTLYEGVATKEAIDEVMKLGMNHPMGPLTLADFIGLDTCLYIMEVLHEGLGDSKYRPCPLLRKYVNAGWLGRKTGRGFYVYE

SEQ ID NO: 16616 - protein, 393 aa, Bacillus thuringiensis
MSKTVILSAARTPVGKFGGSLKDVKATELGGIAIKAALERANVAASDVEEVIFGTVIQGGQGQIPSRQAARAAGIPWEVQTETVNKVCASGLRAVTLADQIIRTGDQSLIVAGGMESMSNSPYILRGARWGYRMGNNEVVDLNVADGLTCAFSGTHMGVYGGEVAKEDGISREAQDEWAYRSHQRAVSAHKEGRFEEEIVPVTIPQRKGDPIVVAKDEAPREDTTIEKLAKLKPVFDKTATVTAGNAPGLNDGGAALVLMSEDRAKQEGRKPLATILAHTAIAVESKDFPRTPGYAINALLEKTGKKIEDIDLFEINEAFAAVAIASTEIAGIDPEKLNVNGGAVAMGHPIGASGARIIVTLIHALKQRGGGIGIASICSGGGQGDAVMIEVH

SEQ ID NO: 16617 - protein, 225 aa, Bacillus thuringiensis
  unsure (1)..(225): unsure at all Xaa locations
LKNDWEPLLAPEFEKEYYLTLSSFLTEEYSTHVVYPKVEDIFNALQYTSYENTKVVILGQDPYHGPNQAHGLSFSVQPGVKTPPSLLNMYKELRDEYGYEIPNNGYLVKWAEQGVLLLNTVLTVRQGEANSHKGKGWEHFTDRVIELLNEREKPVIFILWGRHAQAKKKLITNPNHHIIESVHPSPLSARRGFFGSKPYSKVNTILANMGEREIDWEIPNLXIEK

SEQ ID NO: 16618 - protein, 310 aa, Bacillus thuringiensis
IKIRTRRGKMTTILSVRDLKKVIGKKTLVENISFDVKQGEVFGFLGPNGAGKTTTIRMLVGLIKATEGTISIGGYSIKENFREAMRQIGSIVENPELYTYLTGWENLKQFARMLGDISDERIIEIAEMVHLDERIHDKVKTYSLGMKQRLGIAQALLGNPKLLILDEPTNGLDPAGIRELREFIHKLVKEENMSVFISSHLLSEVQMICDRVAIIHKGKMITVAKVEELIKTASDRVEWIVTPISKAKDMLEAAKEVREVSVEGDRLLCRMDIASISSWNKHFVENEIDVHSVKELVFTLEDLFIELTRG

SEQ ID NO: 16619 - protein, 428 aa, Bacillus thuringiensis
KEIQVGLLGLGTVGSGVVRIITDHQERLIHQVGCPVKVTKVLVQNIEKEREVEVPSTLLTQDANEILDNPNIDVVIEVMGGIDDAKSYILQALKSGKHVVTANKDLMALHGAELLATAKDNKADLFYEASVAGGIPILRSIVEGLSSDLITKVMGIVNGTTNFILTKMSDEGRAYNDVLKEAQQLGFAEADPTSDVEGLDAARKMTILATLGFSTNVELGDVKVKGITSITEEDIEYSKSLGYTIKLIGLAKRDGEKLEVTVEPTLLPNTHPLAAVQNEYNAVYVYGEAVGETMFYGPGAGSLPTATAVVSDLVAVMQNIRLGVTGNSAVVPQYQKVLKEPDEIVVKKFLRLHVKDEIGVFAKITSLFSERGVSFEKIIQMPLEEKGKAEIVIVTHRASLADYDYILHTLQGYEEIDCLKANYRIEGD

SEQ ID NO: 16620 - protein, 424 aa, Bacillus thuringiensis
MRDYLIKPLVGQPYPMISHGKGVYLYDQNGNKYFDGSSGAITAGIGHGVKEIADVIKKQAEEIAFVYRSQFTSEPAEKLAKKLSDLSVGDLNWSFFVNSGTEANETAMKIAIQHFQERGIQGKHKILSRWMSYHGITMGALSMSGHPLRRQRFVSILEDYPTIPAPYCFRCPVQKVYPTCQLACATELERSIERIGAEHIAAFIAEPIIGAAGGAVVPPKDYYKVIKEICDHYDILFIADEVMTGLGRTGAWFAMEHWGVEPDIMTLGKGLGAGYTPMAATVVSDRVMEPILRGSRSVMSGHTLSANPLSAATALAVIEYMEKHNLPEKTAEKGEYLIKGLQKVQQQSTIIADVRGKGLLIGVELQPFTKASELISVAAKNGLLLYQAVSGQAGKEDSALLVAPPMTTTYSELDELLSIFSKSV

SEQ ID NO: 16621 - protein, 258 aa, Bacillus thuringiensis
LSIQHIQKQFDAFTALKDISFTVNKNEFVCLLGPSGCGKTTLLRILAGLEEATTGSIAVNGKDITALPPGKRNFGMVFQSYALFPNLTALENIEYGLKTKKYGKAEVKEKALEALKLVDLLNVKDKYPAQMSGGQQQRVALARALALSPDILLLDEPLSALDAKVREKLRREMRDLQEKVGVTTIMVTHDQEEALTMADKIVVMNHAEIMQIGTPEEIYQRPANPFVADFIGSINFFSKNNEEHAIRPEHVTIVQKDG

SEQ ID NO: 16622 - protein, 769 aa, Bacillus thuringiensis
ERIVPLLPLRGVLVYPTMVLHLDVGRDKSIQALEQAAMDENIIFLAMQKEMNIDDPKEDDIYSVGTVAKVKQMLKLPNGTLRVLVEGLHRAEVIEFIEEENVVQVSIKTVTEEVEDDLEEKAFMRTLLEHFEQYIKVSKKVSNETFATVADVEEPGRLADLIASHLPIKTKQKQEILEIVSVKERLQTLISIIQDEQELLSLEKKIGQKVKRSMERTQKEYFLREQMKAIQTELGDKEGKGGEVEELREKIEQSGMPEETMKAALKELDRYEKLPASSAESGVIRNYIDWLLALPWTEATEDIIDLAHSEEILNNDHYGLEKVKERVLEYLAVQKLTNSLKGPILCLVGPPGVGKTSLARSIATSLNRNFVRVSLGGVRDESEIRGHRRTYVGAMPGRIIQGMKKAKTVNPVFLLDEIDKMSNDFRGDPSAALLEVLDPEQNHNFSDHYIEEPYDLSKVMFVATANTLSSIPGPLLDRMEIISIAGYTELEKVHIAREHLLPKQLKEHGLRKGNLQVRDEALLEIIRYYTREAGVRTLERQIAKVCRKVAKIIVTAERKRIVVTEKKIVDLLGKHIFRYGQAEKTDQVGMATGLAYTAAGGDTLAIEVSVAPGKGKLILTGKLGDVMKESAQAAFSYIRSRAEELQIDPNFHEKNDIHIHVPEGAVPKDGPSAGITMATALISALTGIPVSKEVGMTGEITLRGRVLPIGGLKEKTLSAHRAGLTKIILPAENEKDLDDIPESVKENLTFVLASHLDEVLEHALVGVKQ

SEQ ID NO: 16623 - protein, 207 aa, Bacillus thuringiensis
MKGLFVTIEGPEGSGKTTLIKSLLPYFEKKAQKVMATREPGGIAISEDIRTILHKQEYTMMEARTEALLYAAARRQHLVEKVMPALNENYLVLCDRFIDSSLAYQGYARGLGMDKVFEINRFATEDCMPSLTIYLDIEPEVGLARIEKDAGREVNRLDMEDISFHKRVREGYLQVVERFSDRIVLVNADQPMEKLIEEVVQIIEDKL

SEQ ID NO: 16624 - protein, 456 aa, Bacillus thuringiensis
PLYEALIEFKERGPLSFHVPGHKNGLNFPQEAIREFKDILSIDVTELAGLDDLHSPFECIDEAQQLLAEVYNTKRSYFLINGSTVGNLAMILSCCGEHDIVLVQRNCHKSIINALKLAGANPIFLDPWIDEAYNVPVGVRNEIIKKAIEKYPNAKALILTHPNYYGMGMDLEASIAFAHAHKIPVLVDEAHGAHLCLGEPFPKSALTYGADIVVHSAHKTLPAMTMGSYLHINSHLVDEEKVTTYLSMLQSSSPSYPIMASLDIARFTMARIKEEGHSEIVEFLRRFKEQLRSIPQIAILEYPLQDELKVTVQTRCQLSGYELQSVFEKVGIYTEMADPYNVLFILPLQVNEGYMKVIEMIRVALQHYEVKDKRESIRYTYKGEFSLLPYTYKQLDGYETKIVSIEEAVGMIAAEMVIPYPPGIPLIMYGERITSEHKEQIMYLERAGARFQGNTK

SEQ ID NO: 16625 - protein, 483 aa, Bacillus thuringiensis
MEKQVRVRYAPSPTGHLHIGNARTALFNYLFARHLDGKFIIRIEDTDVKRNVAGGEESQLKYLKWLGMDWDEGVDVGGEFGPYRQTERLDIYKKLYEDLLERGLAYKCYMTEEELEAEREGQIARGETPRYAGNHRELTEEQVKEFEAEGRIPSIRFRVPADRDYTFKDIVKDEVAFHSNDFGDFVIVKKDGIPTYNFAVAVDDHLMEITHVLRGDDHISNTPKQMMIYEAFGWDIPQFGHMTLIVNESRKKLSKRDESIIQFIEQYKELGYLPEAIFNFIALLGWSPVGEEEIFSKDEFIKMFDAARLSKSPALFDSQKLKWMNNQYMKKQDLDTVVELSLPHLVKAGRVGETLSEQDQAWIRDVIALYHEQMSFGAEIVELSEMFFKDHVDYEEEGQEVLNGEQVPEVLRAFAGQIEALEAMEPAAIKAAIKAVQKETGHKGKNLFMPIRVATTGQTHGPELPNAIALLGKEKVLNRLQKV

SEQ ID NO: 16626 - protein, 576 aa, Bacillus thuringiensis
IKRYLQFVKPYRWLIAITIIIGLVKFGIPLIMPWLLKYIIDDVIQGAGSLQDKTSQLITAIGIAFFIFAVLRPPIEYYRQYFAQHIANTILYDLRKHIFGHLQKLSLRYYSNTKTGEIISRVIHDVEQTKDFVITGLMNVWLDTATIAIAIIVMFSMNIKLTFVALLILPIYVIAVKYFFGRLRKLTKERSQALATMQGYLHERIQGMQVTRSFALEEYEGKQFEKRNNEFLTKALTHTSWTARTFSAVNTLTDLGPLLVIGFAAYEVIQGQLTLGTMVAFVGYMDSLYSPLRRLVNSSTTLTQSFASMDRVFELLDEKYDIVNVPNAVQTKKLNGEIVFDNVSFRYNADEKEILHNLSLTMQPGEKVALVGASGGGKSSLASLIPRFYDVSEGAVYVDGIDVRKYNMRNLRSHIGIVLQDNLLFSDTIGANILYGNPKATEKEVIAAAKAAQIHDFIIDLPDGYNTVVGERGVKLSGGQRQRVAIARVFLKNPSVLILDEATSALDLENERYIQEALQTLAADRTTIIIAHRLATITHVDTIIYIEDGEIKETGSHEELMRKRGFYYNLYQLQHI

SEQ ID NO: 16627 - protein, 384 aa, Bacillus thuringiensis
SAFIYSDDFRGYSFSPDHPFNQLRVTLTYDLLQKGGFISPSQIISPRMATDEEIAYVHTEEYINAVKRAGEGKLEKSIAMTYGLGTEDTPMFPNMHEASALLVGGTLTAVDAVLSGKVKHALNLGGGLHHGFRGKASGFCIYNDSSIAIKYIQKKYGLRVLYIDTDAHHGDGVQWSFYDDPNVCTISLHETGRYLFPGTGAVNERGQGNGYSYSFNVPLDAFTEDESFLESYRTVVTEVAAYFKPDIILTQNGADAHYYDPLTHLCATMNIYREIPKLAREIANEYCEGRWIAVGGGGYDHWRVVPRAWALIWLEMNNIQNISGYLPPEWIEAWKGQAETELPLTWEDPDNMYKPIPRKPEIEEKNALTVAKSLEIIRNNMTKS

SEQ ID NO: 16628 - protein, 241 aa, Bacillus thuringiensis
ENKIIMISGANSGIGHACIKYFLEKSFHVIALDINNNNLIDYMKTDMPLKVVQIDLSNSEAIHNLFTQLDLEKLSPDILINAAGIREITPVLHLSDDMFKKVIDVNLVAPFILSREVAKRWCESKIKGCIVNIASVSGLMAEPERAAYVASKHALIGLTKQMAMEFGKQNIRVNSISPGVIRTELTEEYFSNTALMSMIKSNQSLDTWGLPQDIVSCIEYLISDQARFITGSNFVIDGGWT

SEQ ID NO: 16629 - protein, 235 aa, Bacillus thuringiensis
MRYVIITGTSQGLGEAIATQLLEESTTVISISRRENKELTKLAEQYNSNCIFHSLDLQDVHNLETNFKEIISSIKEDNVSSIHLINNAGTVAPMKPIEKAESEQFITNVHINLLAPMILTSTFMKHTKEWKVDKRVINISSGAGKNPYFGWGAYCTTKAGVNMFTQCVATEEWEKEYPVKIVAFAPGVVDTNMQAQIRETAKEDFTNLDRFIALKEEGKLLSPEYVAKAIRNLLE

SEQ ID NO: 16630 - protein, 508 aa, Bacillus thuringiensis
  unsure (1)..(508): unsure at all Xaa locations
TIGRIFDLSVGKYPNKEALVEPEKNIRWTYKQWDEQINKTAHALLEDGVRKGDTVSVYLYNCREFVNVYLACAKIGAIFNPINFRLKAKEVSYILQDASSKSLSLKKQLSQLLLXLKEIFQIHLFGLXKTINLPMQVPTMKKXMQHLLRKXISKLMEMDYCSMLYTSGTTGHPKGVLHRHREMTEHSMICTYFLKYNRDSVGLVVAPLYHCGELNAGIIPRIQVGGKNVILHHFDTETVLHTIQEEKITTFFAAPTMWNMLLQKDLAQYDLTSMKIGIYGGAAMAPALVKECKERLYIDLVQIYGMTEMGPVVAFLVEEDQITKAGSAGTPCFSHEVRIVKPNEDAPAEPEDVLPPYEVGEIILRGPTMMAGYHNREEANKKSMYKGWYHSGDLGYFDKDGYLFVADRVDDMVISGGVNIYPREIEDFLHSHPGILDVAVLGEPDELWGERVVAVIVKKDETITEADLETYCKESDELADYKRPRHYLFVDELPRNASGKLQKFVLRE

SEQ ID NO: 16631 - protein, 864 aa, Bacillus thuringiensis
TNEQHGLTDEIVSERLKQYGSNELATKQKRTLWQRIFAQFNDVLVYVLIIAALISAFVGEWADASIIALVVVLNAVIGVVQESKAEQALEALKKMATPKAIVKRHGELKEIPSEHVVPGDIVMLDAGRYIPCDLRLIETANLKVEESALTGESVPVDKDAIYHPSMQSDEQVPLGDQKNMAFMSTLVTYGRGVGVAVETGMNSQIGKIATLLHEADDDMTPLQKSLAQVGKYLGFVAVAICIIMFLIGFLQGRDTLEMFMTAISLAVAAIPEGLPAIVSIVLAIGVQRMIKQNVIIRKLPAVEALGSVTIICSDKTGTLTQNKMTVTHFYSDNTYDRLESLNVNNDAQRLLLENMVLCNDASYNNESQTGDPTEIALLVAGTTFNMQKDYLEKIHERVNEVPFDSDRKMMSTVHTYDESYYSMTKGAIDKLLPRCTHIFKNGKIEILTDSDKNQILESAGAMSQEALRVLSFAFKQYNSNDMDINHLEENLIFIGLVGMIDPPRTEVKDSIKECKKAGIRTVMITGDHKDTAFAIAKELGIAEELGIAEEISEIMIGTELDNISDTELASKINHLNVFARVSPEHKVKIVKALRAKGNIVSMTGDGVNDAPSLKQADVGVAMGITGTDVAKGAADVVLTDDNFSSIVKAVEEGRNIYRNIKKSILFLLSCNFGEIITLFLAILLGWATPLRPIHILWVNLITDTLPALSLGVDPEDPDVMKEKPRHAKESLFSGSVPFLIFNGIVIGLLTLIAFIAGAKFYTGDTHLFPLFPEQIDEDALLHAQTMAFVVLSFSQLVHSFNLRSRTKSIFSIGIFTNKYLVFSLLIGVLMQVCIISIPPLANIFGVHALTMRDWGFVLLLSIIP

SEQ ID NO: 16632 - protein, 288 aa, Bacillus thuringiensis
MPQQKNFITMPAQHQNKQPGIESLMNPLPQFEDPNYKGSEKLKGKNVLITGGDSGIGRAVSIAFAKEGANVAIAYLDEEEDANETKQYVEKEGVKCVLLPGDLSDEQHCKDVVQETVQQLGSLQVLVNNVAQQYPQQGLEYITAEQLEKTFRINIFSYFHVAKAALSHLKKGDVIINTASIVAYEGNETLIDYSATKGAIVAFTRSLSQSLVQKGIRVNGVAPGPIWTPLIPSSFDEKKVSQFGSNVPMQRPGQPYELAPAYVYLASGDSSYVTGQMIHVNGGVIVNG

SEQ ID NO: 16633 - protein, 427 aa, Bacillus thuringiensis
LLMNENEKWNKFIETPLYTKVGKVHSVQEQFFVAKGPKAKIGDVCFVGEHNVLCEVIAIEKENNMLLPFEQTEKVCYGDSVTLVSEDVVVPRGNHLLGKVLSANGEVLNEEAENIPLQKIKLDAPPIHAFEREEITDVFETGIKSIDSMLTIGIGQKIGIFAGSGVGKSTLLGMIAKNAKADINVISLVGERGREVKDFIRKELGEEGMRKSVVVVATSDESHLMQLRAAKLATSIAEYFRDQGNNVLLMMDSVTRFADARRSVDIAVKELPIGGKTLLMESYMKKLLERSGKTQKGSITGIYTVLVDGDDLNGPVPDLARGILDGHIVLKRELATLSHYPAISVLDSVSRIMEEIVSPHHWQLANEMRKILSIYKENELYFKLGTIQENEENAYIFECKNKVEGINTFLKQGRSDSFQFDDIVEAI

SEQ ID NO: 16634 - protein, 387 aa, Bacillus thuringiensis
FICFCLAVVLFVPIHTFADEKREWRDEVIYSIMIDRFNNGEPKNDKQLEVGNLEGYQGGDIRGIIKRLDYIKEMGFTTVMLSPLFESGKYDGLDVQNFKKVNEHFGTDNDVKELVKEAHAKGMKVVFQFPLGENERQVIDAMKWWIKEVDLDGSYVIHSEKKPRSFWDNAQKDMQVIKKDFRIMTKEDGEYNEKIVESFSKADVSVKSLYDVSKKEGEFVTFLDDQETKRYARIAKENMYYPPSRLKLALTYLLTSPGIPNFYYGTEIALDGGSVPDNRRLMDFKSDEKFMQHITKLGELRQARPSLRRGTFELLYDKSGMSILKRKYKDEVTLVAINNTKETQKVSLPASAIGEKQELRGLLQDEIIREGNGKFYLVLKREESNVY

SEQ ID NO: 16635 - protein, 710 aa, Bacillus thuringiensis
MDLNQMTTKTQEAIMSAQSLAVSHHHQEVDTVHLLLALLEEQDGLAVRIFQKMNVDIEALKQGAESLIKKKPSVTGSGAEVGKLYVTSALQQLLVRAGKEAEKLQDDYISVEHVLLAFSEEKGDINQLFTRLHITKDNLLQSLMTVRGNQRVTSQNPEATYEALEKYGRDLVAEVRAGKIDPVIGRDSEIRRVIRILSRKTKNNPVLIGEPGVGKTAIVEGLAQRIVKKDVPEGLKDRTIFALDMSALVAGAKFRGEFEERLQAVLNEIKKSEGRILLFIDELHTIVGAGKTEGAMDAGNMLKPMLARGELHCIGATTLDEYRKYIEKDPALERRFQQVLAEEPTVEDTISILRGLKERFEIYHGVNIHDRAIVAASVLSDRYISDRFLPDKAIDLVDEACATIRTEIDSMPTELDEVTRRIMQLEIEEAALGKETDRGSQERLKTLQRELSDLKEVASGMRAKWEKEKEDIHKVRDLREHLERLRRELEEAEGNYDLNKAAELRHGKIPAIEKELKEAEEMGAHNKQENRLLREEVSEEEIADIVSRWTGIPVAKLVEGEREKLLRLEQILSERVIGQEEAVSLVSDAVLRARAGIKDPNRPIGSFIFLGPTGVGKTELAKTLAQSLFDSEEQMIRIDMSEYMEKHAVSRLIGAPPGYVGYEEGGQLTEAVRRKPYSVVLLDEIEKAHPEVFNILLQKIDDGRITDSQG

SEQ ID NO: 16636 - protein, 422 aa, Bacillus thuringiensis
MGESWGKGTICVQGGYTPKNGEPRVLPLYQSTTYKYDTSDDLAALFNLEAEGYIYTRIGNPTLAAFEQKLSDLEGGVGAVATASGQAAIMLAVLNICSSGDHLLCSSTVYGGTFNLFGVSLRKLGIDVTFFNPNLTADEITALANDKTKLIYAESLGNPAMNVLNFKEFSAAAKELEVPFIVDNTLATPYLCQAFEHGANIIVHSTTKYIDGHASSLGGIVIDGGNFDWTNGKYPELVEPDPSYHGVSYVQNFGAAAYIVKARVQLLRDYGNCMSPFNAYISNIGLETLHLRMERHSENALAVAKWLANHERIEWVNYPGLDSNENYSLAQQYLKKGASGVLTFGIKGGLEAAKEFIANVKLATLVTHVADARTCVIHPASTTHRQLNAEDQRLAGVTSDLIRLSVGIEDVSDIIADLEAAL

SEQ ID NO: 16637 - protein, 349 aa, Bacillus thuringiensis
IELKNVSKVYKNAEETAVKGVSVHIKKGEFFVLVGPSGCGKSTLLRMIAGLEEISSGDLIINERVANDLEPKDRNLSMVFQNYALYPHLSVEENILFGLKVRKVQKEERQKRLMEAIEMVGLKEYVKMKPGQLSGGQRQRVALARAIVSQAPICLMDEPLSNLDAKLRAQMRIEIREIQQRLGITMIYVTHDQIEAMTMGDRIMVLNKGSIQQVGTPLDIYNEPANEFVASFIGSPSMNINDGEVNKEKGVLHIGQLQIPLSIRQLKQLPEGTIRIGMRPEHIALSEEGQEVTLQSVEVLGNESILNFAVNGTTWSAKVIGQLLLNKGDKVKLLFSQEKLCFFNENTNE

SEQ ID NO: 16638 - protein, 200 aa, Bacillus thuringiensis
SINLMDKQLLLSATLGDTETAMKLIQDGANINVEGDNGETPVLAATYQNHVETVKALIGAGANIEIKDEKKSNPLLYASREGYTDIVKVLINAGVNTKETTRSGGTALISASERGHVEVVKELLEHTDIDVNYTNERGGTALLEAIVLGNGSENHKKVIQLLIDHGADVNMANKEHLTPLQYAEKRGFKDIVNMLRVAGA

SEQ ID NO: 16639 - protein, 582 aa, Bacillus thuringiensis
MKKIINKPETLVMEMCNGMVMAHPELELLKKYKVIKKKEMNENKVTLISGGGSGHEPAHAGLVGKGMLDAAVCGDVFASPSQIQVYQAIKETASKKGTLLIIKNYSGDIMNFKNGAHLATEDGIEVDYVKVDDDIAVEDSLYTVGRRGVAGVILVHKIAGAAAEAGMDLGAVKTVAEKAAVNVRTIGLALTSCTVPASGSPTFTLAEDEMEYGVGIHGEPGIKREKMLSADELANRMTNDLIKDLGVKDGEEIALLVNGFGGTPLQELYLFNNAVTRELAARNIKINRVFVGNYMTSIDMAGMSLTVMKLDDELKTLLSKECNTPAFKVDGPVESLEYVNVLEETEEKEVSFELETAEEHAVIKDNVITLNNMIYLVDKMSDIIIKNEVPFCELDTHAGDGDFGMSVAKGFKQLKREWHSIVDQENVTIGSFLDGCSMIIMEHCGGASGPIWGGAFRAASKAAGEKRELTVKEFAEILQAALQGIQSIGERSFGRGAVVGDKTLVDALAPCVDSWLDSASNEVDVKTAFEKGAEAAVKGAEYTKEIVARMGRAGTVGERSLGYPDAGAHALGVIFTEIAGSL

SEQ ID NO: 16640 - protein, 316 aa, Bacillus thuringiensis
MKKIMNDVQHIVQDMLHGFYFEHNDKVNYDETNNIIYVKDIEKLKQNVAIISGGGSGHEPADIGYVGKGMLTAAVNGSIFTPPTVEQIVAATRLMPKDKSILFIIKNFKDDVENFLAAEQIAKEEGRKIDHIIVNDDVSIEDDASFNKRRRGVAGTVFIQKILGASALEGHSLEELTTIGRSVTENLHTLGVALSPANDPVQGKASFTLNDDEVFYGVGIHGEKGYRKEALSSSEILAIELMNKLKSIYRWRKGDNFAILINGLGATPLMEQYIFANDIRRLCELEGLQITFVKVGTLLTSLDMKGVSLSLLKVED

SEQ ID NO: 16641 - protein, 557 aa, Bacillus thuringiensis
EKLATGAQLLLEALEKEGVEVIFGYPGGVDLPVYDALNECEIPHILTRHEQGAIHAAEGYARITGHPGVVIATSGPGATNVITGLADAMIDSLPLVVFTGQVATTLIGSDAFQEADIMGLTMPVTKHNYQVRKASDLPRIIKEAFHIAKTGRPGPVVIDLPKDMVVEKGEQCSNVQMDLPGYNPNYEPNLLQINKLLKVIETAKKPLILAGAGILHAKASKELTNFARKYEIPVVHTLLGLGGFPPDDELFLGMGGMHGSYTANIALYECDLLINIGARFDDRLTGNLAYFAKGATVAHIDIDPAEIGKNVPTEIPIVASAKRALEVLLEPEGGKENHHEWITLLKGRKEQYPFSYKRNSESIKPQYAIDMLYEITKGEAIVTTDVGQHQMWAAQYYPLKNPDKWVTSGGLGTMGFGFPAAIGAQIAKPEELVIAIVGDAGFQMTLQELSVLKEHALPVKVFILNNEALGMVRQWQDEFYNQRYSHSLLPCQPDFVALANAYGIKGVRIDDPLLAKKQIQHAIELQEPVVIDCRVLQSEKVMPMVAPGKGVHQMEGV

SEQ ID NO: 16642 - protein, 345 aa, Bacillus thuringiensis
MEKRIVCLAGDGVGPEVMESAKEVLHMVERLYGHHFHLQDEYFGGVAIDLTGQPLPQRTLAACLASDAVLLGAVGGPRWDSAKERPEKGLLALRKGLGVFANVRPVTVESATAHLSPLKNADEIDFVVVRELTGGIYFSYPKERTEEVATDTLTYHRHEIERIVSYAFQLANKRKKKVTSIDKANVLESSKLWRTVTEEVALRYPNVEVEHILVDAAAMELIRNPGRFDVIVTENLFGDILSDEASVLAGSLGMLPSASHAEKGPSLYEPIHGSAPDIAGKNKANPIAMMRSVAMMLGQSFGLTREGYAIEEAVSAVLKSGKCTADIGGTETTTSFTKAVIQEME

SEQ ID NO: 16643 - protein, 646 aa, Bacillus thuringiensis
MGKRLLDKLWERHVVATNENGLDLLYIDLHLVHEVTSPQAFEGLRLTNRTVRRPDLTFATMDHNIPTKDVWNITDRIAKQQLDTLRENCKQFQVPLADIGDEEQGIVHVIGPELGLTQPGKTIVCGDSHTATHGAFGALAFGIGTSEVEHVLATQTLWQRKPKAMGIELKGKLPQGVYAKDIILHLLSKYGVAVGTGYVMEFYGEAIHAMDMEERMTLCNMAIEGGAKAGIIAPDEKTVAYVKGRKYAPKDYESIKKKWSELYTDLDAVYDLHILVDVTDLAPYVTWGTNPSMGVRIDEKLPEKHDANDERAFSYMGLSPGQSTYDIPVQHVFIGSCTNSRLSDLEIAASVVKGKKVKEGVRALVVPGSQRVREAAMHKGLHRIFEEAGFEWREPGCSMCLGMNPDQVPEGEHCASTSNRNFEGRQGKGARTHLVSPAMAAAAALYGHFVDIRKESYDGAFRIHKGTAAVLMNDNIDTDQIIPKQYLKRIERTGFGKFLFDEWRYDNNRQENPNFPLNAQERKGASILITGDNFGCGSSREHAPWALADYGFRVIIAGGFADIFYMNCMKNGMLPIVMDKDMREQLAKTDAREQITVDLENEIMTTNTHRFHFTIEKMWKEKLLNGLDEISITMQYEQEIKEYERK

SEQ ID NO: 16644 - protein, 428 aa, Bacillus thuringiensis
LKAKYPHLKTIISVGGWTWSNRFSDMAADEKTRKVFAESTVAFLRAYGFDGVDLDWEYPGVETIPGGSYRPEDKQNFTLLLQDVRNALNKAGAEDGKQYLLTIASGASQRYADHTELKKISQILDWINIMTYDFHGGWEATSNHNAALYKDPNDPAANTNFYVDGAINVYTNEGVPVDKLVLGVPFYGRGWKSCGKENNGQYQPCKPGSDGKLASKGTWDDYSTGDTGVYDYGDLAANYVNKNGFVRYWNDTAKVPYLYNATTGTFISYDDNESMKYKTDYIKTKGLSGAMFWELSGDCRTSPKYSCSGPKLLDTLVKELLGGPINQKDTEPPTNVKNIVVTNKNSNSVQLNWTASTDNVGVTEYEITAGEEKWSTTTNSITIKNLKPNTEYKFSIIAKDAAGNKSQPTALTVKTDEANTTPPDGNGT

SEQ ID NO: 16645 - protein, 317 aa, Bacillus thuringiensis
MSTQYLNSNLKVFSLNSNKELAEQIAKHIGVGLGKCSVDRFSDGEVQINIEESIRGCDVFIIQSTSFPVNEHIMELLIMIDALKRASAKTINIVIPYYGYARQDRKARSREPITSKLVANLLETAGATRVITLDLHAPQIQGFFDIPIDHLMGVPILSDYFETKGLKDIVIVSPDHGGVTRARKMADRLKAPIAIIDKRRPRPNVSEVMNIIGNIEGKTAILIDDIIDTAGTITLAANALVENGASEVYACCTHPVLSGPAIERIQNSNIKELVVTNSIVLPEEKKIDKVHELSVAPLIGEAIIRVYEEESVSVLFN

SEQ ID NO: 16646 - protein, 432 aa, Bacillus thuringiensis
MKITIVGTGYVGLITGVGLAKLGHSVTCFDIDDEKIERIKQGDLPIYEARLHELINYAYENNALTFTSNKEEAFDDVEFIFIAVGTPPLLDGTADLTYIQSACNDIGLYATNDIIVVTKSTVPVGTNDVMKGWIEEKLKGRHTVHIVSNPEFLREGSGIYDFFHGDRIVIGADSEEVARRVESLYSELCLETYVTDIKSAEMIKYASNAFLATKISFINEISNICEKVGANVLDVAKGMGMDKRIGASFLNAGIGYGGSCFPKDTKALVQIAGNVAHDFRLLKAVIEVNNKQQLLLIEKAKKVMNMNKKRIAVLGASFKPNTDDIREASSLIIIEALINIGADIVLYDPKAIQYVKNIFGDAIQYSRCIDESIRDASAVFIVTEWGDIQTYPLEKYVQLMREPILFDGRNCYTDEDVKKQKIDYYSVGRKSI

SEQ ID NO: 16647 - protein, 527 aa, Bacillus thuringiensis
YFMKREELLAPPSYNLVSEIEKYTGDKGKLALIWQDDKGNRREVTYAELMQGANKIGNAFIKSGLQKGDKLLIMMPRLIEAYMTYIAAIKAGFVVIPSSEMLRKKDIEYRIGHGEVKAIVSYEPYIRQFDDIEAMESLRKFVLSEQSVDGWINLKTALETESDMLEMAKTDKEDMVFLSYTSGTTGNPKGVVHTHAWAYAHLRTSAPNWLGIEENDIVWATASPGWQKWIWSPFLATLGSGATGFVYHGKFEPETYLNLLDDNKVNVLCCTPTEYRLMAKVEDLSQYNLEALHSAVSAGEPLNREVIGTFQKHFHITVRDGYGQTENTLLVGVMKGMDIRPGSMGKPTPGNHVDIVNEEGTPVKVGEVGDIAVHIETPALFKQYYKDDERTAMQFRGDYYITGDKAKKDEDGYFWFEGRGDDIIISSGYTIGPFEVEDALVKHPYVRECAVVASPDEIRGSVVKAFIVLRENIEKNEETLIPTLQQHVKELTAPYKYPRKIEFVDELPKTISGKIRRIELRKQEMEI

SEQ ID NO: 16648 - protein, 188 aa, Bacillus thuringiensis
FYEGDTLEVAKKLLGQKLVHIVDGIKRSGIIVEVEAYKGPDDKAAHSYGGRRTDRTEVMFGAPGHAYVYLIYGMYHCFNVITAPAGTPQGVLIRALEPVDGIEEIKLARYNKTEITKAQYKNLTNGPGKLCRALGITLEERGVSLQSDTLHIELVPKEEHISSQYKITAGPRINIDYAEEAVHYPWRF

SEQ ID NO: 16649 - protein, 388 aa, Bacillus thuringiensis
FLEENLEDLKSKGLYNVIDPLESSNGPIITIGGKEYINLSSNNYLGLATDSRLQEAAIGAIHKYGVGAGAVRTINGTLDLHIKLEETIAKFKHTEAAIAYQSGFNCNMAAISAVMDKNDAILSDELNHASIIDGSRLSKAKIIVYKHSDMEDLRQKAIAAKESGLYNKLMVITDGVFSMDGDVAKLPEIVEIAEELDLMTYVDDAHGSGVLGKGAGTVKHFGLSDKVDFQIGTLSKAIGVIGGYVAGKQNLIDWLKVRSRPFLFSTALTPADAAACMRSIEILMESTELHDRLWENGRYLKQGLKELGFNIGESETPITPCIIGDEVLTQEFSKRLNEEGVYAKSIVFPTVAKGTGRVRNMPTAAHTKEMLDEAILKYEKVGKEMGII

SEQ ID NO: 16650 - protein, 710 aa, Bacillus thuringiensis
MLKVKRPFDAYLDEMNKITILLPHAYGTSRTFRLQEGSNVKDLPIAHTIALPDATKYECFIEEPLDVGKYYTVRDERNEETDLQIGAVIRTKIFDEKYYYEGTDLGAVYQKQETTFKVWAPTARLAKVRIYKSDKEYTDHEMYRGENGVWIQTLQGDLDGARYTFLVCINLIWNEAVDPYAKSVTVNGKYGIVIDLEKTTVTKREQLPPLQAMTDAILYELHIRDATIHPNSGVSKKGTYKGLMEEGTTGRNGTLTGLSHIKDLGVTHVELLPLYCFGGVDEANPSSAYNWGYNPLYYNAPTGFYATNPSDPYNRIVECKQLIETFHEQGIRVIIDVVYNHVYERELSSFEKLVPGYYFRHGEDGMPSNGTGVGNDVASERKMMRKFIVESILYWLTEYNVDGFRFDLMGILDVDTMNMIEKEVRNIKRDALLLGEGWDLQTPLPLEEKATLNNAKKMPHIAQFNDQFRDGIKGSTFHINKRGFAFGGHVDCNHLQYIAAGSLLSMKETGLFLEPAQSINYVECHDNMTMWDKLVRSNEESETILKKRHLLASAMVILSQGIPFLHAGQEFYRTKKGNENSYNANDEINQLDWDQKEKEIETVNYIKGLIAIRKEHGAFRLQNADLIKKHMTFLQTSTEVLAYHLEHAESFGPWKEIIVLFNSGLEAKTVQLPKEATWHVLVNENEAKIEPISSFRGKELRLAPISTYIL

SEQ ID NO: 16651 - protein, 470 aa, Bacillus thuringiensis
MLEKQIIHSFVSIVGEDNVDTSNMGRLTYSYDATPNFQAMPDAVIAPRNTNEVAEVLKVCNTYKIPVYVRGSGTNLCAGTCPLEGGIVLIFRHMNNILEIDEENLTITVQAGVITLDIIKAVEEKGLFYPPDPSSMKISTIGGNINENSGGLRGLKYGVTRDYVMGLELVLPNGDIIRTGGKLAKDVAGYDLTRLFIGSEGTLGVVTEAILKLVPMPETKKTMLALYEDINEAARAVSSIIANKIIPATLEFLDQPTIEVVEEFAQIGLPTDVKAILLIEQDGPPEVVNRDIEKMANVCHSMNAVDVRVAKDETEADALRTARRSALSALARLKPTTILEDATVPRSQIAPMVEAINTIAKKYNIPICTFGHAGDGNLHPTCMTDVRNAEEMHRAEQAFAEIFAKAIELGGTITGEHGVGAMKAPYLEMKLGKEGIAAMQGIKQAFDPNNIMNPGKMFAKDTRKRVVVER

SEQ ID NO: 16652 - protein, 693 aa, Bacillus thuringiensis
ISNSITKTIKNVIQAIKSISSKEKITERIHVNTRDEIKDLAHTTNHLLDEISKREWLQTELAELILMYQGVSSIEMLGKKILSGIIQKTQTSCGAFYVREEIEDTVYYVKKASFADQGADIGKQSIQMGEGFIGQSALEKKSFILRDIPEEFRYVTSGVLEIRPKNLLIIPILFEDKVIAVMELVSVTEISDLHQDLIQQTVDNLGLTIHSIMGRMRIQTLLHESQAMTEELQVQSEELQTQAEELQMQAEELRTTNEQLESRTEEAEQKTADLQITKSELEEKASELLRSSKYKSEFLANMSHELRTPLNSILLLSEMLRENHNNNLSDDEIELATVIHSSGKDLLTLINDILDLSKVEAGKLDIIFEATNISDMAANMHQNFLHIAAQKNVEFTIEDSDTIPDLFYTDAKRIEQIIKNLLSNAFKFTEKGSVSLHFDSIETSNLSHDMQSISKDWITISVKDTGIGIAKEQHQLIFEAFQQADGATIRKYGGTGLGLSICKEFARLLGGWITLESNVGEGSTFTVYIPNLPNGLPDIQLSNLEVAATIEDVIPAEVVEETIVTPETNNVFQEKTILIVDDDHRNIFALQNALKKQNANIITAQNGLECLEILKSNTNIDLILMDIMMPNMDGYETMENIRMNLGLNEIPIIALTAKAMPNDKEKCLSAGASDYISKPLNLHQLYSVMSVWL

SEQ ID NO: 16653 - protein, 248 aa, Bacillus thuringiensis
MKAVFLSDKGKVRQHNEDSAGVFHNLDGNVLAVVADGMGGHRAGDVASSMAIQLFHDYWKQTHNMNEPKKVEQWLHTSVGIINERIYEYAQQNAECNGMGTTLIIAVCTPSFVTIGHIGDSRCYMVSEGEMTLVTEDHSLVNELVKHGEISKEDAEYHPKKNVLLRALGTEEKVGLDVKTLVIEEDDQLLLCSDGLSNKVSIDDMRQILQLNEQLEGKGQCLIQLANDRGGEDNITLVLIDYAGSTNE

SEQ ID NO: 16654 - protein, 716 aa, Bacillus thuringiensis
  unsure (1)..(716): unsure at all Xaa locations
SSLXIEESALTGKSVPVKKGKSIQGQDVAIGDQKNMAFMGTMITRGSGTEVVVATGMNTAMGQIANMLQNAEQMETPLQRRLEQLGKILIIVALILTALVVLAGVYQGNEVYHMFLAGVSLAVAAIPEGLPAIVTVALSLGVQRMIKKRAIVRKLPAVETLGCASVICSDKTGSMTQNKMMVTHMWSGGELWKVTGQGYEPNGSFMKGEKEVNPAKTKSLYQLLTFGSLCNNANIIQKKKAYVLDGDPTEGALVAAAMKAGITREALKGKFKIIREFPFDSTRKMMSVIVRDREGKKFIVTKGAPDVLLQLSQTILWGDKQQPLSELYRKEVQAAIHSLGSQALRTIAVAFKPLKVTDSIEHERDVEKDFMLVGIQGMIDPPRPEVAQAVKECKEAGIRTVMITGDHKVTAMAIAEQLGVLPPDGRVVEGVELANMDVEELENVVEDTYVFARVSPEHKLKIVKALQNQGHIVAMTGDGVNDAPAIKTADIGIAMGITGTDVAKEASSLVLLDDNFATIKSAIKEGRNIYENIRKFIRYLLASNVGEILVMLFAMLLALPLPMVPIQILWVNLVTDGLPAMALGLDKAEGDVMKRTPRHPKEGVFARGLAWKIISRGFLIGAVTLVAFIIAYNQHPNELKYAQTVAFATLVLAQLIHVFDCRSEHSVFHRNPFGNVYLVGAVIISLLLMLVVIYYPPLQPIFSTMPIQARDWLLIG

SEQ ID NO: 16655 - protein, 308 aa, Bacillus thuringiensis
LEIKNLTKKFGDFIAVDNMSLSIKEGEIFGFLGSNGAGKSTTINMIAGLLRSNEGEISILGKNIKKHNRFAKMNIGIVPQDIAIYEELTAYENVKFFAGLYGLRGVELKARVEEALQFVGLSDKHKSYPKNFSGGMKRRLNIACAIAHRPKLIIMDEPTVGIDPQSRNYILQSVRKLNEMGSTIIYTSHYMEEVEEICTKIAIVDHGKVIAEGTKEQLKAIITDTKDIWIKEKSVENLDAEKLKEINGVKAVQIEEKVIKVNSDAGLNNLNQIMPHFINHDIGIRSLEGVAPNLETVYLSVTGRNLPD

SEQ ID NO: 16656 - protein, 435 aa, Bacillus thuringiensis
VHIIAVSVNYRPAPVEFREKLTFQAAELERAMTTLQNQKSVLENVIVSTCNRTEIYAVVDQLHTGRYYIKKFLADWFQLEIEEVAPYLTIFEQDGAIDHLFRVTCGLDSMVVGETQILGQIKDSFLEAQQVKATGTIFNELFKQVITLAKRAHSETTIGESAMSVSYAAVELGKKIFGELTDCHVLILGAGKMGELALQNLYGSGARKVTVMNRTLSKAEVMAEKYMGHAKSLSELQCALLEADILISSTGASEYVITKEMMTKVEKMRSGRPLFMVDIAVPRDIDPAIDELEGSFLYDIDDLQGVVEANRAERLKEAEKIQFMIEEEIVLFKTWLSTLGVVPLISALRDKALAIQSETMVSLERKIPNLSDREKKVISKHTKSIINQLLKDPILVAKEIAAEEGASEKLALFAKIFDLETEDVESCAEEVEHKK

SEQ ID NO: 16657 - protein, 308 aa, Bacillus thuringiensis
IMRKIIVGSRKSKLALTQTNWFIDQLKALGLPYEFEVKEIVTKGDVILDVTLSKVGGKGLFVKEIEHALLTKEIDMAVHSMKDMPAVLPEGLMIGCTPKRVDPRDAFISKNGASFKELAEGAILGTSSLRRSAQLLAARPDLQVKWIRGNIDTRLRKLKEEDYDAIILATAGLQRMGWDDEVITEHLDEALCVPAVGQGALAIECREDDKDLLQLLAHINDTITERTVAAERVFLHKLEGGCQVPIAGYATLTENDAIELTALVGSMDGSVLLKETVVGTNPEEVGLEAADRLIKQGAKELILAANKE

SEQ ID NO: 16658 - protein, 323 aa, Bacillus thuringiensis
SLQFNRHRRLRQSGGMRALVRETFLHTEDFIYPIFVLEGENVRNEVPSMPGVYQMSLDLLQAEMQEVVDLGIRSVIVFGLPAEKDEVGSSAYCDHGIVQRAIQQIKGDFPELVVVADTCLCQFTSHGHCGVIEDGIILNDESLAVLAKTAVSQAKAGADIIAPSNMMDGFVTAIRHALDENGFGHVPVMSYAVKYSSAFYGPFRDAAHGAPQFGDRKTYQMDPANRMEAFREAESDVMEGADFLIVKPALSYLDIVRDVKNNFNLPVVAYNVSGEYSMIKAAAQNGWINEKEVVLEKLISMKRAGADLIITYHAKDAARWLQE

SEQ ID NO: 16659 - protein, 425 aa, Bacillus thuringiensis
KFDKSIAAFEEAQDLMPGGVNSPVRAFKSVGMNPLFMERGKGSKVYDIDGNEYIDYVLSWGPLIHGHANDRVVEALKSVAERGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEPVINYDAAKSSNLEFFAAYYREMVEQGVFLPPSQFEGLFLSTAHSDADIEATIAAAEIAMSKL

SEQ ID NO: 16660 - protein, 426 aa, Bacillus thuringiensis
YEEAIGWIHSRLKFGIKPGLERMRWMLEELGNPERHIKCVHLAGTNGKGSTLTYMRYMLEGAKYKVGTFTSPYIESFNERISVNGTPIADEEITELVKMVKPVVEKLDETDLGEATEFEIITVMAICYFGKVNFCDVVLFETGLGGRFDSTNVIHPVLTIITNIGHDHMHILGNTLGEIAYEKAGIIKSGVPVITGVQDEEALQVIQNVAKENHANLYELSKHFTALHKQSNEDGEQFDFTCPFSAFEDLQISMKGIHQVGNAALALMAVMYVKTYLSFLIEEEEIRTGLLEAYWIGRFEKLQSNPDIIIDGAHNPEGIESLVKTVEAHYKDKNVIVLFTALGDKQLHNMVGQLETIADEIIFTTFAFDRAISADKLASYSQKESKLVFENWKEAIDTKVEMIAENDVFIITGSLYFISEVRKYIR

SEQ ID NO: 16661 - protein, 476 aa, Bacillus thuringiensis
FRELGLSDSLLQSVESMGFEEATPIQAETIPHALQGKDIIGQAQTGTGKTAAFGLPLLDKVDTHKESVQGIVIAPTRELAIQVGEELYKIGKHKRVRILPIYGGQDINRQIRALKKHPHIIVGTPGRILDHINRKTLRLQNVETVVLDEADEMLNMGFIEDIEAILTDVPETHQTLLFSATMPDPIRRIAERFMTEPQHIKVKAKEVTMPNIQQFYLEVQEKKKFDVLTRLLDIQSPELAIVFGRTKRRVDELSEALNLRGYAAEGIHGDLTQAKRMSVLRKFKEGSIEVLVATDVAARGLDISGVTHVYNFDIPQDPESYVHRIGRTGRAGKKGIAMLFVTPRESGQLKNIERTTKRKMDRMDAPTLDEALEGQQRLIAEKLQSTIENENLAYYKRIAEEMLEENDSVTVVAAALKMMTKEPDTTPIALTSEPPVVSRGGGSKKRGGNGGGYRDGNRNRSRDARGGGDGRNRDRN

SEQ ID NO: 16662 - protein, 201 aa, Bacillus thuringiensis
IIFDIDGTMLDTEKAVLYSLQRTLRDEGMNYSLEKLHFALGIPGMAALQEIGVENMKAVHEKWIRNMADFKNEITVFKGIAEVIEIVSSYKIRTGIVTSKTRQEFINDFKPFGLHSYFEHSICVEDTIKHKPHPEPLVTCLKRLNIDAQEAIYIGDSVYDLQCAKQAGAKFGLALWGAKTRKGFEVADYIFQTPHEILSLV

SEQ ID NO: 16663 - protein, 254 aa, Bacillus thuringiensis
RVVFLTGAASGIGYEMGKAFAKEGAKVVITDRLEERAKEAAEQLQNEGFQAIGLKCDVTSEEEITAAISQTVDHFGSLHILINNAGMQHVSPIEDFPTEKFELLIQIMQIAPFIAIKHAFPIMKQQKYGRIINVASINGLVGFAGKAAYNSAKHGVIGLTKVAALEGATHGITVNALCPGYVDTPLVRNQLQDLATTRNVPLENVLEDVIYPLVPQKRLLQVQEIADYAMFLASEKAKGITGQAVVVDGGYTAQ

SEQ ID NO: 16664 - protein, 473 aa, Bacillus thuringiensis
YNFYVNGEWRESSSGETIEISSPYLHEVIGQVQAITCGEVDEAIASAKEAQKSWAKASLQDRAKYLYKWADELVNMQDEIADIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPKGLVNVATGRGSAIGDYLVGHEGINMVSFTGGTNTGKHLAKTAAMIPLVLELGGKDPGIVREDADLQDAANHIVSGAFSYSGQRCTAIKRVLVHENVADELVDLLKAQVAELSVGSPEKDSTIVRLIDDKSADFVQGLVDDAVEKGATIVIGNKRERNLIYPTLIDHVKEEMKVAWEEPFGPILPIIRVSSDEQAIEIANKSEFGLQASVFTKDINKAFAIANKIETGSVQINGRTERGPDHFPFIGVKGSGMGAQGIRKSLESMTREKVTVLNFK

SEQ ID NO: 16665 - protein, 170 aa, Bacillus thuringiensis
MDFKQHIAIVPDYPKEGIVFKDITPLMNDGKAYKAATDAIVEYAKERDIDVVVGPEARGFIIGCPVSYALEVGFAPVRKLGKLPREVITVDYGKEYGKDVLTIHKDAIKPGQRVLITDDLLATGGTIEATIKLVEELGGVVAGIAFLVELTYLDGRKMLDGYDVLVLEKY

SEQ ID NO: 16666 - protein, 301 aa, Bacillus thuringiensis
LNRNYKIVPAVNDVSFTVKQGEMVGYIGENGAGKSTTIKMLTGILTPTSGQITVNGMNPHKQREEFVRTIGVVFGQRSQLWWDIAVQESFRLLKKVYGVSDAQYKEHMEHVIETLDIGPLLDKPVRKLSLGQRMRCELAAALIHNPPLLFLDEPTIGLDVLVKLKIREFLKEMNERYKTTILLTTHDITDIEALCERVIMLDEGNIMYDGSLSNLRTQWGAEKEIHFQFVAPVSYQALSMVMPDNHVVWSKAKEENAWVAKIPNEEVIISMLISKVVQAFQIKDLKINEVSTEEIIRNIYE

SEQ ID NO: 16667 - protein, 425 aa, Bacillus thuringiensis
TKSEALHKEALEHIVGGVNSPSRSFKAVGGGAPVAMERGKGAYFWDVDGNKYIDYLAAYGPIITGHAHPHITKAITTAAENGVLYGTPTALEVKFAKMLKEAMPALDKVRFVNSGTEAVMTTIRVARAYTGRTKIMKFAGCYHGHSDLVLVAAGSGPSTLGTPDSAGVPQSIAQEVITVPFNNVETLKEALDKWGHEVAAILVEPIVGNFGIVEPKPGFLEKVNELVHEAGALVIYDEVITAFRFMYGGAQDLLGVTPDLTALGKVIGGGLPIGAYGGKKEIMEQVAPLGPAYQAGTMAGNPASMASGIACLEVLQQEGLYEKLDELGAMLEKGILEQAAKHNIDITLNRLKGALTVYFTTNTIEDYDAAQDTDGEMFGKFFKLMLQEGINLAPSKYEAWFLTTEHTKEDIEYTIEAVGRAFAAL

SEQ ID NO: 16668 - protein, 477 aa, Bacillus thuringiensis
MMETMPNWLKQRAFLTPDRTAIEIEEKEVTFMQLHEKVVSVCEHLTHVGVKRGEKVAVLMKNGMEMITVIHALSYVGAVAVLLNTRLSREELLWQMDDAEVICLVTDQEFDAKDVPVYSFAEVMNGPKEEASIQEEFSLEEAMTIIYTSGTTGKPKGVILTYGNHWASAVGSSLNLGLRDDDCWLACMPMFHVGGLSLLMKNIMYGMRILLVPKYDADFIHTALQTRGVTIISVVSKMLTDLLERLGEETYPSSLRCMLLGGGPAPKPLLETCVDKGIPVYQTYGMTETSSQICTLSADYMLTKVGSAGKPLFQCQLRIEKDGVVVPPHAEGEIVVKGPNVTGGYFNREDATRETIQNGWLHTGDLGYLDEEGFLYVLDRRSDLIISGGENIYPAQIEEVLLSHPAIAEAGVVGMTDDKWGQVPAAFVVKSGAVTEEEILHFCEEKLAKYKVPKKACFLEELPRNASKKLLRRELRE

SEQ ID NO: 16669 - protein, 127 aa, Bacillus thuringiensis
VMVSKEFTFDAAHHLHCYEGKCKNLHGHTYKVVFGISGYVNEIGLAIDFGDIKEIWKNEIEIYLDHRYLNETLPAMNTTAENMVVWIYEKMAEALTKENRVNEYKGARVEFVRLFETPTSYAEVRRE

SEQ ID NO: 16670 - protein, 510 aa, Bacillus thuringiensis
  unsure (1)..(510): unsure at all Xaa locations
LVQSLAETAKKKGEKPAYIFMDQSVSYDQLNKMVTRFSSNLAEMGIGKGDNVALVVGNSPHFLVGLYGTMKAGATVIPVNPIYTADEMHYILQNGDVKTIIVLDVLLPVIQSLTTRLPSLENIIICETSSDFNHTETEKMKTFTSFVGTGDTTYEGPELDEEDVAVILYTSGTTGKPKGAMLTHKNLYSNANDVASYLQYTADDRVVAALPMFHVFCLTVAVNAPIVNGATILMLPKFSPKEVFRICRTYEPTIFAGVPTMYNYLYLFEEASAEDVKTLRLCISGGASMPVALLQNFEKRFNVIVSEGYGLSEASPVTCFNPLDRPRKPGSIGTNIWHVENKIVNELGEEVPVGAVGELIVRGPNVMKGYYNAPEDTAATLKDGWLYTGDLAKMDEEGYFYIVDRKKDIVLVGGYNVYPREVEEVLYTHESVAEVVVIGVPDENLGEAVRAYVVLKQANVTEEELMHYCTLHLAKYKVPKSIEFLIELPKNTTGKLLRRALREKAMQVXK

SEQ ID NO: 16671 - protein, 249 aa, Bacillus thuringiensis
ENRFEVALQMVDIFYNEILSLQGVKFIQTKDDINILKQDEIGAILTIEGCETIGKDAMKLRLLYRLGVRSFGLTWNYANLLADGALETRGAGLTTFGKHVVQELNTLHVWTDVSHLNERSFWDVIEIAKNPIASHSNCMKLCEHPRNLNDEQLKALIKRNGMIGVTFVPQFLTNEKQANVADIIKHIEYICLLGGENNIGFGSDFDGIVDTVVNVSAYRDYENVMNELCKHYAASTVERFLYDNFVEHM

SEQ ID NO: 16672 - protein, 887 aa, Bacillus thuringiensis
MTQYTPMIQQYLKVKADYQDAFLFFRLGDFYEMFFEDAVKAAHELEITLTSRDGGSSERIPMCGVPYHAAKNYIEQLVEKGYKVAVCEQVEDPKTAKGVVRREVVQLITPGTMMEGRTIDEKENNFLAALTHFEDGSYALACNDLTTGQNTVTLLTGSVEDILLEVYATGSKEIVVDSSFSKDELNKLTETLKMTISYEDATAIPEGLEHLVKNVSQAKLIKAVGRLFNYVIRTQKRSLDHLQPVEIYYTNQFMKIDVHSKRNLELTETLRTKEKTGSLLWLLDKTKTAMGGRMLKQWMERPLIQKERIEERLEMVETFVNDYFLREDLKEKLKEVYDLERLAGKVAFGNVNARDLLQLRRSLLQVPAILEAISLLDNAYASRLIQGADPCESLTELLGRSIQENPPLSIKDGDIIKDGYNDKLDQYRYVSKNGKTWIAELEKRERDITGIKSLKIGYNRIFGYYIEVTKANLAALPEGRYERKQTLANAERFITDELKEKETLILEAEEKIVQLEYDLFTALREEVKVFIPKLQHLAKVISELDVLQSFATVSEEEQFVKPVLTTKREIFIKDGRHPVVEKVLNGKLYVPNDCIMPENMDVFLITGPNMSGKSTYMRQLALVTVMSQIGCFVPATEAVLPVFDQIFTRIGAADDLISGQSTFMVEMLEAKNAIANASERSLILFDEIGRGTSTYDGMALAQAIIEHIHDQIGAKTLFSTHYHELTVLEESLNQLKNVHVSAIEENGKVVFLHKIQDGAADKSYGIHVAQLAELPDSLIARAKEVLAQLEGQEEIIIPKRVEVKVQEATPEPVVVKEEIAEIQETKVETEEESQLSFFGGEQSSKKQEKPLLDQKETAVLAQIKKIDLLDMTPLEAMNELYRLQKKL

SEQ ID NO: 16673 - protein, 647 aa, Bacillus thuringiensis
MGKIRKLDDQLSNLIAAGEVVERPASVVKELVENSIDANSTSIEIHLEEAGLSKIRIIDNGDGIAEEDCIVAFERHATSKIKDENDLFRIRTLGFRGEALPSIASVSELELITSTGDAPGTHLIIKGGDIIKQEKTASRKGTDITVQNLFFNTPARLKYMKTIHTELGNITDIVYRIAMSHPEVSLKLFHNEKKLLHTSGNGDVRQVLASIYSIQVAKKLVPIEAESLDFTIKGYVTLPEVTRASRNYMSTIVNGRYVRNFVLMKAIQQGYHTLLPVGRYPIGFLSIEMDPMLVDVNVHPAKLEVRFSKEQELLKLIEETLQAAFKKIQLIPDAGVTTKKKEKDESVQEQFQFEHAKPKEPSMPDIVLPTGMDAKQEEPQAVKQPAQLWQPPKQEWQPPQSLVREEQSWQPSTKPIIEEPIQEEKSWDSNEEDFELEELEEEVREIKEIEMNGNDLPPLYPIGQMHGTYIFAQNDKGLYMIDQHAAQERINYEYFRDKVGRVAQEVQELLVPYRIDLSLTEFLRVEEQLEELKKVGLFLEQFGHQSFIVRSHPTWFPKGQETEIIDEMMEQVVKLKKVDIKKLREEAAIMMSCKASIKANQYLTNDQIFALLEELRTTTNPYTCPHGRPILVHHSTYELEKMFKRVM

SEQ ID NO: 16674 - protein, 261 aa, Bacillus thuringiensis
MAGSTLTVKDLHVSIDGKEILKGVNLEVKGGEIHAIMGPNGTGKSTLSSAIMGHPKYEVTEGSIIIDGEDVLEMEVDERAQAGLFLAMQYPSEISGVTNADFLRSAINARREEGDEISLMKFIRTLDKNMEFLEMDPEMAQRYLNEGFSGGEKKRNEILQLMMIEPKIAILDEIDSGLDIDALKVVSKGINEMRGEEFGCLMITHYQRLLNYITPDFVHVMMNGRIVKSGGPELAQRLEAEGYDWIKKELGIEDETTEQEA

SEQ ID NO: 16675 - protein, 795 aa, Bacillus thuringiensis
MFTHVESFKSTFLEKLETMYGKSFKDSTTRDQYNTLGHMVREYMNSQWIATNESYRSGEQKQMYYLSIEFLLGRLLGSNILNLGIRDVCEQGLSELGISLQELEEVEADAGLGNGGLGRLAACFLDSLASLNLPGHGCGIRYKHGLFDQKIVDGYQVEFPEQWLLHENVWEVRRHDQAVEVSYFGNVEPLEIDGRLEFRHTNAEVIMAVPYDVPVVGYETSTVNTLRLWNAEPVPFPQNCKDILKYKRETEAVSEFLYPDDTHDEGKILRLKQQYFLVSASLQNIVRMHRERYGDLRQLHEKIAIHINDTHPVLAIPELMRILLDEEKLAWEEAWHITTQTISYTNHTTLSEALEKWPIHIFKPLLPRIYMIIEEINERFCHELWEQYPYEWDRIEAMAIIAHDLVKMAHLAIVGSHSVNGVAKIHTEILKQREMRLFYEFYPDKFNNKTNGIAHRRWLMKANPQLTNLISEAIGTEWKKEPIKLQELQLVQYDASFQEKFAEVKQERKEILAERIHNTMGITIDPNSIFDVQVKRLHAYKRQLLNVLHILYLYNRLKEDASFTFYPRTFIFGAKASPGYYYAKKIIKLINELARKVNNDPYVSQYMKVIFLENYRVSLAEDIFPAADVSEQISTASKEASGTGNMKFMMNGAITLGTLDGANVEIKDRVGDDNCFIFGLTAEEVLHYYQNGGYRASDYYHHNGHIKKVVDQLTNGFFAQSGAEFEAIYDSLVIQNDEYFVLRDFGPYAERQEAVGRAYENRTKWLEMSILNIAQSGHFASDRTILQYSNEIWGI

SEQ ID NO: 16676 - protein, 476 aa, Bacillus thuringiensis
VNILFAVSECVPFVKSGGLADVAGALPKELKKLGVDVRIILPNYSLIPQKLRDGCTLHKVINVPLGWRNQYCGILKGEQDGITYYLIDNEYYFKRDSLYGHYDDGERFSYFSKAVLECIPHLDFEVDVLHSHDWHTAMVNFLLREKYQDNPLYERIKTVYTIHNLQFQGVFPPEVMYDLLELGDEYFHSEQLEFYGNVNFMKGGIIASDQITAVSPTYKEEIQYEFFGEKLDGLLRKYNDKLSGIVNGIDTSVYNPETDSYIKAQYDAESLYEKSENKRALQRYFGLPEKEDTPIISMVTRLTKQKGLDLVRTVFREIMEEDVQCIILGSGDSEYEQFFEWMAYEYPEKVKVYIGFNEELAHQVYAGSDLFLMPSLFEPCGLGQLIALAYGTIPIVRETGGLNDTVHSYDEETGEGNGFSFTNFNAHDMLHTIHRAIEFYHDKPVWEQLVKQAMTEDYSWEQSALAYKELYKSLME

SEQ ID NO: 16677 - protein, 357 aa, Bacillus thuringiensis
SRLSALTKNLAKPAVPFGGKYRIIDFTLSNCANSGIETVGILTQYQPLELHNYIGIGNAWDLDRVNGGVTVLPPYAESSGVKWYTGTASAIYQNLNYLSQYEPEYVLILSGDHIYKMDYSKMLDYHIQKESDVSISVIEVPWDEASRFGIMNTNEEMEIVEFEEKPQFPRSNLASMGIYIFNWSILKEYLEMDARNPESSNDFGKDVLPLLLDEGKKLMAYPFEGYWKDVGTVKSLWEANMDLLRDETSLNLNDRNWRIYSVNPNEPPQYIAEKAKVEESLINEGCVIEGDVKHSVLFQGVTVEEGSMVIDSVVMPGAKIGKNVVIERAIVGSEMVIEDGTIIRPEKNVDDVVLIAE

SEQ ID NO: 16678 - protein, 648 aa, Bacillus thuringiensis
VNILSVINCEEVKRDEFHTEKYYESYNIFGAHVVTEDEIQGVRFTVWAPHAKAMSVVGDFNEWDYEQHKMLQVTEEGIWSLFIPHIEEGEIYKYAIETLAGDVILKADPYAIYAEVRPNTASVVFDIKGYEWNDKNWNRKKKKKPIYKEAMTVYELHFGSWKKKEDGTLYSYREMAEELIPYVVEHQFTHIEIMPLVEHPYDRSWGYQGTGYYAATSRFGTPHDLMYFVDECHKYGIGVILDWVPGHFCKDAHGLYLFDGTPTYEYKDKDVQENLVWGTVNFDLGKREVRNFLISNALFWMRYFHIDGFRVDAVANMLYWNKEGQEQSNEYAVSFLRELNEAVFAEDEDFLMTAEDSTAWPLVTAPTYEGGLGFNYKWNMGWMNDVLKYMECAPEYRKYIHEKMTFSLLYAYSENFILPLSHDEVVHGKKSLLNKMPGDYWDKFAQLRLLYGYFFTHPGKKLLFMGGEFGQFDEWKDLEDLDWNLHDFEMHRYMHDYFKELIALYKRSKPLWQLDHSPEGFQWIDANNNEQSIFSFIRQGDKQEDALVIVCNFTKATYENYKVGVPDFEYYNEILNSDAQQYGGSGQVNKKRLKTILEPYHNQAAHVEITIPPFGVSILRPVKTRKGSKKQDGSKTKVRSNVTSRGKR

SEQ ID NO: 16679 - protein, 312 aa, Bacillus thuringiensis
MKKGINRVVLVGTGAVGCSYAYSMINQGVAEEFVLVDVNEAKAEGEAMDLSHAVPFSPSPTKVWSGSYADCKDADLVVITAGLPQKPGETRLDLVEKNTKIFKQIVRVIMDSGFDGIFLIATNPVDILTYVTWKESGLPKERVIGSGTTLDSARFRYMLGDYLDVDPRNVHAYIVGEHGDTELPVWSHATIGVQKLETILANNEQYKQEDLDKIFENVRDAAYHIIERKGATYYGIGMSLLRVTKAILNNENSVLTVSAYLEGQYGEKDAYVGVPAVINREGVREIVELELNEEEKVKFAHSVKVLKETMAP

SEQ ID NO: 16680 - protein, 242 aa, Bacillus thuringiensis
LLRVENVTGGYTKRPVLKDVSFSVNKGELVGLIGLNGAGKSTTIKHIIGLMEPKKGTVTINGKTIRDDMTAYRSSFSFIPETPVLYDELTLEEHLKLTAMAYGIDEKQYEERVGQLLQEFRMKNRLKWFPSHFSKGMKQKVMIMSAFLVEPSLYIVDEPFVGLDPLAIQSLLQMMDQMKKSGAGILMSTHILATAERYCDSFIILHQGEVRAKGTLSELQSQFNMPGATLDDIYIALTKEED

SEQ ID NO: 16681 - protein, 460 aa, Bacillus thuringiensis
LQEQIEVNNPATKEIFATVPKGGVTEAKQAVDAAHEAFKTWSKLTAADRATKLKKWFMLIDKNKEEIAAIMTKEQGKPFAEALGEVNYANSFVEWYAEEGKRVYGEMIPASHPNKRILVMKQPVGVMAAITPWNFPAAMITRKVAPALAAGCTAVVKPASQTPLTALKLAELAHEADIPKGVINIVTGSAKAIADTWMEDSRVRKVSFTGSTEIGKELMASAAQTMKKVSLELGGHAPFIVMNDADLDKAVEAVIGSKFRNAGQTCICTNRVFVQEEVYEVFVEKFQKAVGQLKVGDGFGDGTTVGPLIDENAVSKVQEHIEDAIQKGGTVLYGGQKVAELEGHFIQPTVIGVANDTMLCMNEETFGPVAPVAKFKTVDEVIERANNTPYGLAAYIFTKDISQAFQISEALEYGIIGLNDGLPSVAQAPFGGFKESGIGREGGHFGIEEYLEIKYISLGL

SEQ ID NO: 16682 - protein, 426 aa, Bacillus thuringiensis
ASLLERRQNIVPKGVSNGIPTFVQSANGALVTDVDGNQYIDFAGAIGTINVGHCHPAVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRRPEGLTEEQYDDFIIEEFKNFFISEVAPETIAAVVMEPVQGEGGFIVPSKKFVQEVRRICSENGILFVADEIQTGFSRTGKYFAIDHYNVVPDLITVSKSLGAGVPISGVIGRKEIMNESAPGELGGTYAGSPLGCAAALAVLDVIENEKLNDRAIELGKVVMNRFEEMKNKYHCIGDVRGLGAMCAFEVVQDRKTKAPDKTLTANLCAEANKRGLLLLSAGTYGNVIRVLMPLVITDEQLEEGLTIIEESLQA

SEQ ID NO: 16683 - protein, 490 aa, Bacillus thuringiensis
KLNQTEKNKLEKDGLEIFNDIPYYAENGFESIPKEEWDAFKWAGLYLQRPKEAGYFMMRVNIPSGIITNAQAEVLASIAEDYGRDVIDITTRQAIQFHWLEIQQIPDIFKRLARVGLSSAGACGDITRNITGNPLAGIDANELFDTTNIVKEVYDYFQHNEEFSNLPRKFKMSISSNIYNSANAEINCVAFTPATKEIDGEKKVGFHIKVGGGLSARPYLADELDVFVLPEEVKAVAIAIATIFRDFGYREKRHLARLKFLVADWGAEKFKEKLIEYTGSLQSKGESAFKGWNAGYFYGVQDQKQKGLKYVGFNVPVGRLHAEEMFEIARIAKQYGNGQIRTCNSQNFIIPNVPPENVKGLLSEPLFEVISASPKSFIGHAVSCTGIEYCNLALVETKERLRKIAEYLDTQIALDVPVRIHMVGCPNSCGQRQIADIGLQGVKMKTKEKGIVEAFEIYVGGTLLDGGAYNQKLKGKIDGEDLPDVLASFI

SEQ ID NO: 16684 - protein, 196 aa, Bacillus thuringiensis
DTNITWHTASVSKDERRVKNGHHSFVIWFTGLSASGKSTVANAVARKLFEKNIGNYVLDGDNIRHGLNKDLGFSESDRMENIRRIGEVAKLFVDQGAVVLTAFISPFRVDRKQVRDLLAADEFIEIFVKCPIEECEKRDPKGLYKKARKGDIKDFTGIDSPYEEPEQAELIVETHKYSIEECAEQIVKYLQERSFI

SEQ ID NO: 16685 - protein, 369 aa, Bacillus thuringiensis
ELVNRIDETYDVSQIEKEIKLDNIALSDLELLATGGYSPLTGFLGKEDYDSVVETLRLANGSVWSIPITLPVTEKVAESLKVGEEVKLVNNGNIYGVIQIEDIFVPDKEKEALLVYKTTDEAHPGVKKLYERPNVYVGGTIILTKRFENNQFPSYHLDPIETREAFKKRGWKTVVGFQTRNPVHRAHEYIQKSALEIVDGLFLNPLVGETKSDDIPADVRMESYEVLLQKYYPKNRVFLSVFPAAMRYAGPREAIFHALVRKNFGCTHFIVGRDHAGVGDYYGTYEAQEIFTNFTIEELGITPLFFEHSFYCTKCEAMASTKTCPHGKEDHVILSGTKVRELLRNGEIPPSTFSRKEVVEVLIKGLKKE

SEQ ID NO: 16686 - protein, 232 aa, Bacillus thuringiensis
MLTYETWEENVVSFSEEDETKGALSVLKWAYKEYKDEIVYACSFGVEGMVLLHLINQVNPSAKVVFLDTNVHFQETYELIQKVRRRFPSLNIIEKQPELTLDEQEKLHGEKLWESNPNLCCKIRKILPLEKSLAAEKAWISGLRREQSETRKHTKFINQDHRFQSIKVCPLIHWTWKEVWRYVYKHSLPYNPLHDVGYPSIGCEKCTLPVGDGGDSRDGRWAGKVKTECGLH

SEQ ID NO: 16687 - protein, 430 aa, Bacillus thuringiensis
MYLHGTSRINGQGHLEIGGCDTTQLAKQYGTPLYVYDEESIRGKCRAFHRAFKESGFSYQVAYASKAFLCMEMCRVAREENMSLDVVSGGELYTALQAGFPASRIHFHGNNKTEEEIVMALQANIGCFVVDNFFELEVLHDLAMQHGKFVNILIRVTPGVEAHTHEYITTGQDDSKFGFGVSNGQAMQAITFALQKSNYNVLGIHSHIGSQIFETAGFVRAIEVLRQFLVEVREQTNYVVKVLNVGGGFGIRYTESDTPLTLETYVRAVTSAVREQFTVCEYPLPEIWIEPGRSIVGDAGTTIYTVGSVKDIPGIRKYVSVDGGMTDNLRPALYSARYEAMLANRGNDENEELVSIAGKCCESGDMLIWDIHLPKVASSDLLAVSCTGAYGYSMANNYNRIRRPAVVFAKGGTSQVVVERETYENIIGND

SEQ ID NO: 16688 - protein, 215 aa, Bacillus thuringiensis
PNLFTLGNLYSGFLSIGYASLGYYKSAAILVLIGMMLDSLDGRVARLLRVDSQMGKELDSLADVVTFGAAPAVLMYYTSFSNYGIIGLYIAGLFPLFGAYRLARFNVTPSSTSMKYFTGVPITAAGGLVAFLTLFSHTIPKIVLITVFVTFAFLMVSRIRIPSLKDVPIPRYSIIITLFLVGIIITMYQTGFGNFSVFLFIAIPLYILYMLSQFI

SEQ ID NO: 16689 - protein, 193 aa, Bacillus thuringiensis
  unsure (1)..(193): unsure at all Xaa locations
GLIPAIVIEEGTKEVLMLAYMNEEAYEKTLETKRTWFYSRSRQSLWNKGETSGNLQYVQSLYLDCDQDSIVVNVKQVGPACHTGEKTCFHYQIIXGDTYGKCLKLLYKTIEERKESPLPESYTNYLFSKGEDKILKKIGEECAEVIIACKNNDKEEVVKEMVDVFYHCFVLLAEKNITLEDVMREVKERNGKL

SEQ ID NO: 16690 - protein, 251 aa, Bacillus thuringiensis
MLAKRIIPCLDVKEGRVVKGVNFIGLQDVGNPVEIAEAYNEAGADEIVFLDITATHEGRKTIIDVVEKTAAKVFIPLTVGGGISSVKDMYNLLRAGADKVSINSAAVRNPKLIEEGAEHFGSQCIVVAIDARKVAEGKWNVYVNGGRVDTGMDAIEWAKRVVKLGAGEILLTSMDADGTKSGYDLRLTEEISKSVSIPVIASGGCGHTDHIIEVFQKTTVDAALAASIFHYGEATVQSVKRKLRDANVEVR

SEQ ID NO: 16691 - protein, 195 aa, Bacillus thuringiensis
IMRQSSQARETTETKIKLSLQLDESTSVSIQTGVGFFDHMLTLFARHGRFGLQVEAEGDVFVDAHHTVEDVGIVLGNCLKEALQNKEGINRYGSAYVPMDESLGFVAIDISGRSYCVFQGELTNPKLGDFDTELTEEFFRAVAHAANITLHARVLYGSNTHHKIEALFKAFGRALREAVEKNANITGVNSTKGML

SEQ ID NO: 16692 - protein, 585 aa, Bacillus thuringiensis
MRKTKIVCTIGPASESIEKLEQLIEAGMNVARLNFSHGSHEEHGARIKNIREASKKTGKTVGILLDTKGPEIRTHDFVDGQAELVTGAEVVLSTEQVLGTAEKFSVSYAGLYDDVDPGSRILIDDGLIELEVIEKADGNIRTKVLNSGTVKNKKGVNVPNVSIKLPGITEKDVKDIIFGIEQKVDFIAASFVRKASDVLEIRELLKEHNAQYIQIVPKIENQEGIDNIDSILEVSDGLMVARGDMGVEIPPEEVPLVQKRLIKKCNVLGKPVITATQMLDSMQRNPRPTRAEASDVANAIFDGTDAIMLSGETAAGQYPVEAVTMMANIAVRVEKSLQYEDMFKKRIKEFTPTITDAISQSVAHTALALDVAAIVAPTESGYTAKMISKYRPKSPIVAVTSDEQVGRRLALVWGVQAFMAEKRAASTDEMLDTAIQTGMDAGLIGLGDTVVITAGVPVAETGTTNLMKIHVVGEEIAKGQGIGRKAAKGKVVVAKTAAEAVANVNEGDILVTTSTDKDMIPAIEKAAALVVEEGGLTSHAAVVGVSIGIPVIVGVNCVTATLKNGQEVTVDAARGIVYNGHAEVL

SEQ ID NO: 16693 - protein, 319 aa, Bacillus thuringiensis
MKRIGVLTSGGDSPGMNAAIRAVVRKAIFHDIEVYGIYHGYAGLISGHIEKLELGSVGDIIHRGGSKLYTARCPKFKHPVVDLKGIEQLKKHGIEGLVVIGGDGSYQGAKKLTEQGFPCVGVPGTIDNDIPGTDFTIGFDTALNTVIDAIDKIRDTATSHERTYVIEVMGRHAGDIALWAGLADGAETILIPEEEYDMDDVIARLKRGSERGKKHSIIIVAEGVGSAIDIGKHIEEATNFDTRVTVLGHVQRGGSPSAQDRVLASRLGARAVELLIAGKGGRCVGIQDNKLVDHDIIEALAQKHTIDKDMYQLSKELSI

SEQ ID NO: 16694 - protein, 409 aa, Bacillus thuringiensis
TLREEALHMHKVHQGKLETVSKVKVENAKDLSLAYSPGVAEPCKEIYDDKSKVYEYTMKGNMVAVVTDGTAVLGLGNIGPEASLPVMEGKAVLFKSFAGVDAFPIALNTNDVDKIVETVKLMEPTFGGVNLEDIAAPNCFIIEERLKKETNIPIFHDDQHGTAIVTVAGLVNALKLVGKKMSDIKVVANGAGAAGIAIIKLLYRYGVRDIIMCDRKGAIYDGRPTGMNPVKDEVAKYTNKNRIEGSLADVVQGADVFIGVSAEGALTEEMVRTMNDDAIIFAMANPVPEIMPELAKAAGAAVVGTGRSDFPNQVNNVLAFPGIFRGALDVHATQINEEMKMAAVQAIAELVAEDELNADYIIPAPFDARVAPQVAAYVAKAAMETGVARRQVDPNEIAEKTKQLALIGK

SEQ ID NO: 16695 - protein, 326 aa, Bacillus thuringiensis
NLKGRSFLAEKDFTQEELLYFLDLAAELKEKKKNGIPHHYLEGKNVALLFEKTSTRTRCAFTVACTDLGANPEYLGKGDIQLGKKESVEDTAKVLGRMFDGIEFRGFHHETVESLAQNSGVPVWNGLTDMWHPTQTLADLLTIREHLGKLKNVKLVYVGDGRNNVANSLLVGGAIVGMDVCICTPESLWPAQEVIDLAKKYNEQVMITSNVEEAVANADVIYTDVWVSMGEEEKFAERVELLKPYQVNMKMIKATGNENVIFLHCLPAFHDVETMYGEEVYEKYGLKEMEVTDEVFRSKHSKVFDQAENRMHTIKAVMAATLGNME

SEQ ID NO: 16696 - protein, 410 aa, Bacillus thuringiensis
MKHPIHVTSEIGELQTVLLKRPGKEVENLTPDYLQQLLFDDIPYLPIIQKEHDYFAQTLRNRGVEVLYLEKLAAEALVDKKLREEFVDRILKEGQADVNVAHQTLKEYLLSFSNEELIQKIMGGVRKNEIETSKKTHLYELMEDHYPFYLDPMPNLYFTRDPAASVGDGLTINKMREPARRRESLFMEYIIKYHPRFAKHNVPIWLDRDYKFPIEGGDELILNEETIAIGVSARTSAKAIERLAKNLFSRQNKIKKVLAIEIPKCRAFMHLDTVFTMVDYDKFTIHPAIQGPKGNMNIYILEKGSDEETLKITHRTSLMEALKEVLGLSELVLIPCGGGDVIASAREQWNDGSNTLAIAPGVVVTYDRNYVSNTLLREHGIEVIEVLSSELSRGRGGPRCMSMPIVRKDI

SEQ ID NO: 16697 - protein, 294 aa, Bacillus thuringiensis
KEISVIGVPMDLGQMRRGVDMGPSAIRYAGVIERIEEIGYDVKDMGDICIEREKEIDENTKLRNLTQVATVCNELASKVDHIIEEGRFPLVLGGDHSIAIGTLAGVAKHYKNLGVIWYDAHGDLNTEETSPSGNIHGMSLAASLGYGHSSLVDLYGAYPKVKKENVVIIGARALDEGEKDFIRNEGIKVFSMHEIDRMGMTAVMEETIAYLSHTDGVHLSLDLDGLDPHDAPGVGTPVIGGLSYRESHLAMEMLAEADIITSAEFVEVNTILDERNRTATTAVALMGSLFGEKL

SEQ ID NO: 16698 - protein, 448 aa, Bacillus thuringiensis
MGKYFGTDGVRGVANKELTPELAFKIGRFGGYVLTKDTDRPKVIIGRDTRVSGHMLEGALVAGLLSTGAEVMRLGVISTPGVAYLTKALDAQAGVMISASHNPVQDNGIKFFGSDGFKLTDEQEAEIEALLDKEVDELPRPTGTNLGQVSDYFEGGQKYLQYIKQTVEEDFSGLHIALDCAHGATSSLAPYLFADLEADISTMGTSPNGMNINEGVGSTHPEGLAELVKEKGADIGLAFDGDGDRLIAVDEKGNIVDGDQIMFICAKYMKETGQLKHNTVVSTVMSNLGFYKALEANNITSDKTAVGDRYVMEEMKRGGYNLGGEQSGHIILLDYITTGDGMLSALQLVNIMKMTKKPLSELAGEMTKFPQLLVNVRVTDKKLALENEKIKEIIRVVEEEMNGDGRILVRPSGTEPLIRVMAEAPTQEVCDAYVHRIVEVVKAEVGAE

SEQ ID NO: 16699 - protein, 600 aa, Bacillus thuringiensis
MCGIVGFIGEQDAKEILLKGLEKLEYRGYDSAGIAVQAENGVVVYKEKGRIAKLREIVDENVAASVGIGHTRWATHGVPSKVNAHPHQSTSKRFTLVHNGVIENYELVKKEYLQDVTFVSETDTEVIVQLMEQQVSTGLSVEEAFRNTLSLLHGSYAIGLLDAENPNMIYVAKNKSPLLVGVGDNFNVVASDAMAMLQVTDQFIELMDKEIVIVTKESITIKNLQGETIERAPFTAELDASDIEKGTYPHFMLKEIDEQPLVIRNIIQKYQDENGEIELNQDIRNAILDSDRIYIIACGTSYHAGLVGKQFIEKFAKMPVEVHVASEFSYNMPLLTERPFFIYISQSGETADSRAVLVQTNEMGHKALTITNVPGSTLSREADYTLPLYAGPEIAVASTKAYTAQLAVLSILAADIAKAKGEVLDFDLTHELGLVANAMIELCDQKEEMDALAKQFLATTRNCFFIGRSVDFYVGLEGALKLKEISYIQAEGFAGGELKHGTIALIENGTPVIALATQEHVNLGIRGNVKEVVARGANPCIISMKGLEMEGDSFVLPAVHEALAPLVAVIPLQLISYYAALHRECDVDKPRNLAKSVTVE

SEQ ID NO: 16700 - protein, 257 aa, Bacillus thuringiensis
MNQLKNKVAVITGVSRLDGIGAAICKELAESGYDIFFTYWTAYDKEMPWGVDKNEQIQLKEELLKNGVKVSSMELDLTQNDAPKELINKVTEQLGYPHILINNAAYSTNNNFSTLTAEELDKHYMVNVRATTLLSSQFSRGFDKKSGGRIVNITSGQFQGPMAGELAYATTKGAIDALTSTLSAEVAHLGITVNAINPGPTDTGWMTEEIKQGLKPMFPFGRIGEPRDAARLIKFLVSEEAEWITGQVIHSEGGFKR

SEQ ID NO: 16701 - protein, 397 aa, Bacillus thuringiensis
TIMIQTKDIIELTDTYGANNYHPLPIVISKAEGVWVEDPEGNRYMDLLSAYSAVNQGHRHPKIINALIDQANRVTLTSRAFHSDQLGPWYEKVAKLTNKEMVLPMNTGAEAVETAIKTVRRWAYDVKKVEANRAEIIVCEDNFHGRTMGSVSMSSNEEYKRGFGPMLPGIVVIPYGDLEALKAAITPNTAAFILEPIQGEAGINIPPAGYLKEAFEVCKKENVLFVADEIQTGLGRTGKVFACDWDNVTPDMYILGKALGGGVFPISCVAANRDILGVFEPGSHGSTFGGNPLACAVSIAALEVLEEEKLTERSLQLGEKLVGQLKEIDNPMITEVRGKGLFIGIELNEPARPYCEQLKAAGLLCKETHENVIRIAPPLVISEEDLEWAFQKIKAVL

SEQ ID NO: 16702 - protein, 679 aa, Bacillus thuringiensis
GFYQLHKDKEALEVFMEEARENTVPFNSVAERMEYMKEHDYYYNVLDEYSLEEVEEVYNIAYGENFEFQSYMAASKFYKDYALKTNDQKQYLESYEDRVAIVSLYLGRGDVSKARQFASMIVKQNYQPATPTFLNAGRSRRGEMVSCFLLEMDDSLNSIGFNINTAMQLSKIGGGVALNLSKLRARGEQIKGIDNAASGVVPVMKLLEDSFSYANQLGQRKGAGAVYLNIFHWDIIEFLDTKKINADEKSRIQSLSIGIIVPSKFFELAEKNEPFHVFAPYTVYKEYGKHLDDIDIDEMYDELMSNPKVKKKPLDISARDMLIKIAMIQLESGYPYLMFKSNANNQHPLKDIGTVKMSNLCTEIFQLQETSEINDYGTDDIIRRDINCNLGSLNIVNVMENKEIREAVHAGMEALTAVSDMTIIPNAPTVKKANDELHSVGLGAMNLHGYLAKNKIAYESAEAKEFARTFFMMLNYYSIEKSMEIATEKGETFKDFDKSDYANGTYFEKYETTDYSPVTEKVQQLFEGIHIPTKEDWTSLKEQVQKNGLYNSYRLAIAPTQSISYVQNATSSVMPIVSQIESRTYANATTYYPMPYLSKDTFWYYKSSYDMNQFKLIDLIAEIQEHIDQGISTILYVNSDISTRELARYYIYAHKKGLKSLYYTRTRKLSVEECVACTV

SEQ ID NO: 16703 - protein, 312 aa, Bacillus thuringiensis
MKRHTRKIAIIGTGLVGSSCAYSIVNQGICEELLLIDINHERAVGEAMDLSHCINFTNTRTKVYAGSYEDCKDMDIVIITAGPAPKPGQSRLDTLGASAKIMESVVGGVMESGFDGIFLLASNPVDIITYEVWKLSGLPRNRVIGTGTSLDSSRLRTILSEMLHVDPRSIHGYSLGEHGDSQMVAWSHVTVGGKPILQILEEQKERFGEIDLDEIVEKTAKAGWEIYKRKGTTYYGIGNSLAYIASSIFNDDHRVIAVSAILDGEYGEYDICTGVPAIITRDGIREVVELNLTEDEESRFAKSNDILRDYMK

SEQ ID NO: 16704 - protein, 594 aa, Bacillus thuringiensis
MEKTVGNAVKGGSFLVDEITIDQVFTPEDFSSEHKMIAKTTEDFIVNEVLPELEYLEQHEFDRSVRLLKEAGELGLLGADVPEEYGGIGLDKVSSALIAEKFSRAGGFAITHGAHVGIGSLPIVLFGNEEQKKKYLPLLATGEKLAAYALTEPGSGSDALGAKTTARLNAEGTHYVLNGEKQWITNSAFADVFVVYAKIDGEHFSAFIVEKDYAGVSTSPEEKKMGIKCSSTRTLILEDALVPKENLLGEIGKGHIIAFNILNIGRYKLGVGTVGSAKRAVEISAQYANQRQQFKQPIARFPLIQEKLANMAAKTYAAESSVYRTVGLFESRMSTLSEEEVKDGKAVAASIAEYAIECSLNKVFGSEVLDYTVDEGVQIHGGYGFMAEYEIERMYRDSRINRIFEGTNEINRLIVPGTFLRKAMKGELPLLQKAQKLQEELMMMMPEEVGDEPLALQKYLVTNAKKIGLMVAGLAAQKYGKALDKEQEILVNIADIVSNLYAMESAVLRTEKAIKTTGLEKNKQKVLYTEVFCQEAFNEIEADAKETLIAVENGDMLRMMLSSLRKLTRHTPLNVIPKKREIAAKILEDERYTV

SEQ ID NO: 16705 - protein, 389 aa, Bacillus thuringiensis
MREAVIVAGARTPIGKAKRGSLKTVRPDDLGALVVKETLKRANYEGPIDDLIFGCAMPEAEQGLNMARNIGGLAGLSYDVPAITINRYCSSGLQSIAYGAERIMLGHSEAVLSGGAESMSLVPMMGHVVRPNSRLVEAAPEYYMGMGHTAEQVAVKYGISREEQDAFAVRSHQRAAKALAAGNFADETVPVDVTLRSVGSNNKLQEETITFAQDEGVRAETTLDILGKLRPAFNVRGSVTAGNSSQMSDGAASVLLMDREKAVSDGMKPLAKFRSFAVAGVPPEVMGIGPIAAIPKALKLAGLELSDIGLFELNEAFASQSIQVIRELGLDEEKVNVNGGAIALGHPLGCTGAKLTLSLIHEMKRRNEQFGIVTMCIGGGMGAAGVFEL

SEQ ID NO: 16706 - protein, 259 aa, Bacillus thuringiensis
MWNYEAEEAKAVIVIVHGAMEYHGRYEAVAEMWNHIGYHVVMGDLPSHGTTSRNRGHIDSFDEYIEEVKLWVKEARKYRLPIFLFGHSMGGLIVIRMMQETKREDVEGIILSSPCLGVVTGPSAPLQFASRILNVVAPKLQFATNLTVEMSTRNHEVRDAMENDSLFLRKVSVRWYSELIKSIEIAHKKIDDFPDVPLLLMQACEDKLVDKIRVRTWFDNVKISDKAFKEWPNCYHELLNEYERDEILSYIQSFTEMHV

SEQ ID NO: 16707 - protein, 356 aa, Bacillus thuringiensis
VAIETTVTTGLGLLAGERGTSTYVDIPKIVRETIQGIGYTRAKYGFDAETCAVLTSIDEQSADIAMGVDQALEAREGQMTDAEIEAIGAGDQGLMFGFACNETQELMPLPISLAHKLARRLTEVRKDDTLSYLRPDGKTQVTVEYDENGKPVRVDTIVISTQHHPDVTWEEIDRDLKEHVIKAVVPAELMDGETKFFINPTGRFVIGGPQGDAGLTGRKIIVDTYGGYARHGGGAFSGKDATKVDRSAAYAARYVAKNIVAAGLAEKAEVQLAYAIGVAQPVSISVDTFGTGKVSEDVLVELVRNNFDLRPAGIIKMLDLRRPIYKQTAAYGHFGRTDVDLSWERTDKAAALKEQA

SEQ ID NO: 16708 - protein, 458 aa, Bacillus thuringiensis
IVANLFKKKSVTQLLGESKSKTLTKTLGAFDLTMLGIGAIIGTGVLVLTGLVAARDAGPAVIFSFMIAAIVCGFAALCYAEVASTLPVSGSVYTYSYATIGEFVAHLMGWTLLSVYVVTTAAVAGGWTGYFHNLVSGLGLEIPKALLTIPSQGGIVNLPAVIVTLVITWLLSRGTKESKRVNNIMVLIKIGIVVLFIAVGVFYVKPENWIPFAPYGLSGVFAGGAAVFFAFLGFDALATSAEEVKNPQRDLPIGIIASLVICTIIYVVVCLVMTGMVSYKELDVPEAMAYVLEVVGQDKVAGIIAIGAVIGIMAVIFAYIYATTRVFFAMSRDGLLPESFAKINKKTEAPTFTVWLTGIGSALIAGFIDLKELSNLANIGALLTFAMVGVSVIILRKTHPKLQRGFMVPLVPILPIISIACCLFLMVNLPLKTWMYFGAWLAIGVVVYFVYSKKHSHL

SEQ ID NO: 16709 - protein, 978 aa, Bacillus thuringiensis
MAEQTVRVTVDGKEFSASGEKTILQLFNESNLEHPQICHVPEVDPIQTCDTCIVEVNGKLLRACSTKLENGMHIERQSQRAKEAQTEAMDRILENHLLYCTVCDNNNGNCKVHNTVHMMGIEEQKYPYEPKVSACEVDMSHPFYRYDPNQCIACGQCVEVCQNLQVNETISIDWSLDRPRVIWDNGVSINDSSCVSCGQCVTVCPCNALMEKTMLGEAGFMTGLKPDVLDPMIDFVKDVEPGYSSILAVSEVEAAMRKTKVNKTKTVCTFCGVGCSFEVWTKDRHILKVQPVSDAPVNGISTCVKGKFGWDFVNSEDRITKPLIRQGDTFVEASWEEALEVVASNMQHIKSEYGSDAFGFISSSKVTNEENYLMQKLARQIYGTNNVDNCSRYCQSPATDGLFKTVGMGGDAGTVKDIAEAGLVIIVGANPTEGHPVLATRVKRAHKLHDQKLIVADLRKHEMAERADLFIHPRQGTDYVWLAGITKYIIDQDWHDKKFIAENVKNFDEYSKMVEKYTLDYTEEITGISKENLKEMARMVYEADGTCVLWGMGVTQNTGGSTTSAAISNLLLVTGNYRRPGAGAYPLRGHNNVQGACDMATLPNWLPGYQAVSDDALRAKFEKAYGTTIPKAPGLNNIAMLLAADEGKLRGMYVMGEEMALVDSNANHVQHILANLDFLVVQDMFLSKTARFADVILPAAPSLEKEGTFTNTERRIQRLYEVLKPLGDSKPDWWILQKVARALGGDWNYENPSEIMDEIASLAPLYSQATYDRLEGWNSLCWGSHDGSDTPLLYVDGFNFPDKLARLSLDEWVPPVVAPDEYDLLLNNGRMLEHFHEGNMTNKSAGILSKVSEVFVEISPELALERNVKDGGLVELASPFGKIKVQALVTDRVTGKELYLPMHATVNEEAINILTGTATDLYTCTPAYKQTMVKMRVLREKGNRPLPSSNPRDKKRNPQNGVEIQQKWQRKQYVSLVD

SEQ ID NO: 16710 - protein, 391 aa, Bacillus thuringiensis
KMNQTWRAHLQSKLQQLHEQGQYRDLHVTEKAEETWLIRDKKKMLNLASNNYLGLAGDERLKEAAIACTKRYGTGATASRLVVGNHPLYEEVERSICDWKGTERALIVNSGYTANIGAISSLASRHDIVFSDKLNHASIVDGILLSGAEHKRYRHNDLDHLEKLLKMASPEKRKLIVTDTVFSMDGDTVYLRDLVQLKEKYGAIIIVDEAHASGIYGIGGAGLSHIEKNLAQKIDIHMGTFSKALGCYGAYLTGDEIYIEYLQNMMRSFIFTTALPPSTLGAVQKAIEIVKEDNERRENLIANGEYFRTKLRDAGFDIGNSSTHIVPIVVGSNEHALRFSKRLQEAGIAAIAIRPPTVPVHSSRIRFAVTSQHTIADLKWAIDRIIHIAKE

SEQ ID NO: 16711 - protein, 446 aa, Bacillus thuringiensis
ELAEKNKAYVWHPFTQMKDYLEEDPVIIERGEGRKLYDVNGNEYWDGVSSIWLNVHGHQVPELDEAIREQLNKIAHSTMLGLANVPSILLAEKIIEVVPDGLKKVFYSDSGSTAVEIAIKMAFQYWQHKGKPKKQRFVTLKEAYHGDTIGAVSVGAIDLFHQVYSSLLFDAIKMPYPYTYRSPYGNNKEEIVKSHLEEMEELLKEKHEEVAAIIVEPLMQGAGGMITMPKGYLKGLRDLCTKYNVLFITDEVATGFGRTGKMFACEHENVTPDILTAGKGLTGGYLPIAVTVTTDEIYNAFLGEYEEQKTFFHGHSYTGNPLGCAVAIANLELYEKTNLIEEVARKTDYVAAQLEKLFAYKHVGDIRQCGLMVGIELVKNKETKEAFDWTERVGVQVCKRSRELGMILRPLGNTIVFMPPLASTIDEIDDMLRILYKAISDVTEGE

SEQ ID NO: 16712 - protein, 308 aa, Bacillus thuringiensis
VPKLNTKDLLTLEELTKEEIISLIEFAIYLKKNKQEPLLQGKILGLIFDKHSTRTRVSFEAGMVQLGGHGMFLSGKEMQMGRGESVSDTAKVLSQYIDGIMIRTFSHADVEELAKESSIPVINGLTDDHHPCQALADLMTIYEETNTFKGIKLAYVGDGNNVCHSLLLASAKVGMHMTVATPVGYEPNEEIVKKALAIAKETGAEIEVLHDPELAVNEADFIYTDVWMSMGQEGEEEKYTLFQPYQINNELVKHAKQTYRFLHCLPAHREEEVTGEIIDGPQSIVFEQAGNRLHAQKALLVSLFKNVE

SEQ ID NO: 16713 - protein, 376 aa, Bacillus thuringiensis
SHLFQTYGRRTIEFVKGTGTKVIDNNGKEYLDFTSGIGVCNLGHCHPTVLKGVQEQLDDIWHISNLFTNSLQEEVASLLTENRELDYVFFCNSGAEANEAALKLARKHTGKSLVVTCQQSFHGRTFGTMSATGQDKVKEGFGPLLPSFLHIPFNDIKALEEVMNEEVAAVMVEVVQGEGGVILADLSFLKEIETLCNKFGSLFIIDEVQTGIGRTGTLFAYEQVGIEPDIVTVAKALGNGIPVGAMIGRKELGASFTAGSHGSTFGGNYIAMAAAKEVLQVSEKPSFLKEVQEKGEYVLEKLQEELQHVECIQNIRGKGLMIGIECKHEVASFIEQLENEGLLVLQAGPNVIRLLPPLIVTNEELEQAVYIIKKVV

SEQ ID NO: 16714 - protein, 254 aa, Bacillus thuringiensis
MSEYIVVKCGGSMLNQLKAVFFECIKKLQQKYKVVIVHGGGPEIDAKLKDCNINVEKRDGLRVTPKEVMDVVQMVLCGSTNKKLVMNLQKHNLLAVGCSGCDGNLLQVQPVSEEIGYVGEVSYVETALLKGLMNMEYIPVIAPIGVNGNEVYNINADNAAAGIAAALGAKELIFITDVDGILHEGNLVKETDESEIATFIETGVITGGMIPKVQAALASLKMGVQKISIVNGTKDFTEVTGECIGTTVTKGVSI

SEQ ID NO: 16715 - protein, 402 aa, Bacillus thuringiensis
KVASITKLENGSIVTPKGFSAIGTANGLKKDLGAIVCDVPASCAAVYTTNQIQAAPLQVTKDSITAEGKLQAIIVNSGNANACTGMKGLQDAYEMRTLGAEHFGLKENYVAVASTGVIGVPLPMDIIRKGVATLIPTKEESEAYSFSEAILTTDLITKETCYEMIIDGKKVTIAGVAKGSGMIHPNMATMLSFITTDAHIEHDVLQTALSQITNHTFNQITVDGDTSTNDMVIVMASGLSETRPINMEHTDWETFVCALQKVCEDLAKKIAQDGEGATKLIEVNVLGAQTNEEAKKIAKQIVGSSLVKTAIHGEDPNWGRIISSIGQSEVAISPNTIDITLQSILVLKNSEPQTFSEEEMKERLQEDEIVINVYLHLGEETGSAWGCDLSYEYVKINACYRT

SEQ ID NO: 16716 - protein, 344 aa, Bacillus thuringiensis
MKVAIIGATGYGGIELIRLLEQHPYFSIASLHSFSQVGECITNVYPHLRNVLVHTLQEIDVETIGKEAEIVFLATPAGVSAELTPKLLAEGLKVIDLSGDFRMIDPSSYELWYKRPAAKEEILRKAVYGLSEWKRTKIQKANLIANPGCFATATLLAIAPLVRSSRIEEDSIIIDAKSGVSGAGKTPTTMTHFPELYDNLHIYKVNQHQHVPEIEQMLTEWNSELQPITFSTHLIPISRGIMITLYAKVKQKMEIKQLQKLYEETYEQSPFIRICTQGKFPSPKEVRGSNYCDIGIAYDERTEIVTVVSVIDNMMKGAAGQAIQNANIIAGLEETTGLQHMPLY

SEQ ID NO: 16717 - protein, 248 aa, Bacillus thuringiensis
IMSIQNISFLGAGSIAEAIIGGLLHANVVKGEQITVSNRSNETRLQELHKKYGVKGTHNKKELLTDANILFLAMKPKDVAEALTPFKEYINNNVLIISLLAGVSTHSIRKLLQKDVPIIRAMPNTSAAILKSATAISPSKHATAEHIHTATSLFETIGLVSVVEEEDMHAVTALSGSGPAYIYYVVEAMEEAATKIGLKEDIAKSLILQTMIGAAEMLKASDKHPSILRKEITSPGGTTEAGIEVLQE

SEQ ID NO: 16718 - protein, 232 aa, Bacillus thuringiensis
VKGIILAGGTGSRLYPITKVTNKHLLPVGRYPMIYHAVYKLKQCDITDIMIITGKEHMGDVVSFLGSGHEFGVSFTYRVQDKAGGIAQALGLCEDFVGNDRMVVILGDNIFSDDILPYVEEFANQKEGAKVLLQSVEDPERFGVAHIQNRKIVEIEEKPKEPKSSYAVTGIYLYDSKVFSYIKELKPSARGELEITDINNWYLKRGVLTYNEMSGWWTDAGTHASLQKANTL

SEQ ID NO: 16719 - protein, 912 aa, Bacillus thuringiensis
WAKFHGPNLGYVIEQYDLYVTGAGSVDPELQELFEIFGAPSFQDDVVTGDNTATHFSPQNTGNIEKILKVVQLVEQIRSFGHTLAHINPMEDAANGQSLLEKAMNELSDADLKAIPAKTVWQDAPEGIHTALDVIHRLKDVYTKSLAYEFSHIQDSEERAWLHQMVESNSLRQPLSNKKRTALLKRLTAVEGFEQFLHKTFVGQKRFSIEGVDMLVPVLDEIVLEGAKNGVEDVMIGMAHRGRLSVLAHVLEKPYSHMFAEFKHAKIEGAVANSGWTGDVKYHLGREQVVSNEEVSTRVTLANNPSHLEFVNPVVEGFARAAQENRKKSGLPDQDTSKSFVILVHGDAAFPGQGIVSETLNLSRLNAYQTGGTIHVIANNAVGFTTDSYDSRSTKYSSDLAKGFDIPIVHVNADDPEACLAAANLAIQYRMLFKKDFLIDLIGYRRYGHNEMDDPAVTQPQVYKKIKNHPTVRAIYADQLQAAGVLNADEVETITQFIQEQLKSDYALVPPADTSDATIHVKVPDVVAKGIQSIDTGVEIDSLRAINEGLLSWPEGFNVYPKVKKILERRKDALEENGKIEWALAESLAFASILQEGTPIRLTGQDSQRGTFAHRHIVLHDTDTNETYSPLHRLPNINASFSVHNSPLSEAAVVGYEYGYNVFAPETLVMWEAQYGDFSNTAQALFDQYVSAGRAKWGQKSGLVLLLPHGYEGQGPEHSSARPERFLQLAAENNWTVANLTSAAQYFHILRRQASILGTEAVRPLVLMTPKSLLRHPLTLSTASQLSEGRFQPALEQENLGMKPNKVKRLVLSTGKMAIDLAAEIESGKHEYNLDEVHVVRIEQLYPFPAEKVQSIIKRFKNLEEIIWVQEEPRNMGAWHYMAPILFELAGDKVKTGYIGRPDRSSPSGGDP

SEQ ID NO: 16720 - protein, 419 aa, Bacillus thuringiensis
MIEIKVPELAESITEGTISQWLINVGDKVEKGGSVVELETDKVNVEIIAEDSGIVSKLLGEPGDTVEVGATIAILDANGAPVAVSTPAPVAEQPKQETTEAPKAAAPNAEQTATLQGLPNTNRPIASPAARKMARELGIDLNDVRSTDPLGRVRPHDVQAHAAAPKEAPAAPKSPAPAPVAKTEFEKPVERVKMSRRRQTIAKRLVEVQQTSAMLTTFNEVDMSAIMELRKERKDAFEKKHDVRLGFMSFFTKAVVAALKQFPLLNAEIQGDELIIKKFYDIGIAVAAPDGLVVPVVRDANQLNFAEIESEIRELGKKARDNKLSLKELQGGTFTITNGGVFGSLMSTPILNSPQVGILGMHKIQVRPVAIDNERMENRPMMYIALSYDHRIVDGKEAVSFLVAVKDMLEDPKSLLLEG

SEQ ID NO: 16721 - protein, 513 aa, Bacillus thuringiensis
MVVAYKHEPFTDFSVEANKLAFEEGLKKVESYLGQDYPLIIGGEKITTEDKIVSVNPANKEELVGRVSKASRELAEKAMQVADETFQTWRKSKPEMRADILFRAAAIVRRRKHEFSAILVKEAGKPWNEADADTAEAIDFMEYYGRQMLKLKDGIPVESRPIEYNRFSYIPLGVGVIISPWNFPFAIMAGMTTAALVSGNTVLLKPASTTPVVAAKFMEVLEEAGLPAGVVNFVPGNGSEVGDYLVDHPRTRFVSFTGSRDVGIRIYERAAKVNPGQIWLKRVIAEMGGKDTIVVDKEADLELAAKSIVASAFGFSGQKCSACSRAVIHEDVYDHVLNRAVELTKELTVANPAVLGTNMGPVNDQAAFDKVMSYVAIGKEEGRILAGGEGDDSKGWFIQPTIVADVAEDARLMKEEIFGPVVAFCKAKDFDHALAIANNTEYGLTGAVITNNRDHIEKAREDFHVGNLYFNRGCTGAIVGYQPFGGFNMSGTDSKAGGPDYLALHMQAKTTSE

SEQ ID NO: 16722 - protein, 747 aa, Bacillus thuringiensis
MTDKLLNGLNPQQQKAVQTTNGPLLLMAGAGSGKTRVLTHRIAYLLGEKGVAPWNVLAITFTNKAAREMRERIDTLVGPEAEDIWISTFHSMCVRILRRDIDRIGINRNFTILDSGDQLTVVKKIMKERNVDPKKFEPRSILAGISNAKNELLSADKYAKKITMADPYEKLTSDVYTEYQKRLLKNNSLDFDDLIMTTIQLFERVPEVLEFYQRKFQYIHVDEYQDTNKAQYLLVKHLAARFKNLCVVGDSDQSIYRWRGADISNILSFEKDYENAQVILLEQNYRSSQNILNAANAVIEKNTNRKPKKLWTDNQVGSKISYYRAATEKDEAYFVAKKIRDDIQMGKRKYTDFAVLYRTNAQSRMVEEIFLKSNIPYKIVGGTKFYDRKEIKDILAYLRLIGNPDDEISFARIINVPKRGIGATSIDKIINYGVQNGISLTAVFDEIEHVGVSAKITKAVKEFANLLNNWVNMQEYLSVTELVEEVIEKTGYRDMLKNERSLEAEGRLENLDEFLSVTQTFESQSEDKSLVAFLTDLALVADIDRVDEDPTAGEEVILMTMHSAKGLEFPVVFIVGLEEGIFPHTRSLMEEDEMQEERRLAYVGITRAEEELYLSNAQMRTLFGRTSMNAASRFITEIPTELVESLNETAPKRETSFGTKGRTASSGKTTITTATRSRSAFARPAAKTTGGEQIGWAVGDKASHQKWGVGTVVSVKGEGDAKELDIAFPSPIGVKRLLAKFAPVTKQ

SEQ ID NO: 16723 - protein, 448 aa, Bacillus thuringiensis
THVTFDYSKALSFIGEHEITYLRDAVKVTHHAIHEKTGAGNDFLGWVDLPLQYDKEEFARIQKCAEKIKNDSDILLVVGIGGSYLGARAAIEMLNHSFYNTLSKEQRKTPQVLFVGQNISSTYMKDLMDVLEGKDFSINVISKSGTTTEPALAFRIFRKLLEEKYGKEEARKRIYATTDKARGALKTLADNEGYETFVIPDDVGGRFSVLTPVGLLPIAVSGLNIEEMMKGAAAGRDDFGTSELEENPAYQYAVVRNALYNKGKTIEMLVNYEPALQYFAEWWKQLFGESEGKDQKGIFPSSANFSTDLHSLGQYVQEGRRDLFETVLKVGKSTHELTIESEENDLDGLNYLAGETVDFVNTKAYEGTLLAHSDGGVPNLIVNIPELNEYTFGYLVYFFEKACAMSGYLLGVNPFDQPGVEAYKKNMFALLGKPGFEELKAELEERLK

SEQ ID NO: 16724 - protein, 349 aa, Bacillus thuringiensis
LSRSAESLKPSGIRKFFDLAANMKGVISLGVGEPDFVTPWNVRQACIRSLEQGYTSYTANAGLLELRQEIAKYLKKQFAVSYDPSDEIIVTVGASQALDVAMRAIINPDDEVLIIEPSFVSYAPLVTLAGGVPVPVATTLENEFKVLPEQIEAVITAKTKAILLCSPNNPTGAMLNKSELEEIAVIVEKYNLIVLSDEIYAELVYDEVYTSFASIKNMREHTILISGFSKGFAMTGWRLGMIAAPVQFSELMLKIHQYSMMCAPTMSQFAALEALRAGNDEVIRMRDSYKKRRNFMTKSFNEMGLTCHVPGGAFYVFPSISSTGLSSAEFAEQLLLEEKVAVVPWYRIW

SEQ ID NO: 16725 - protein, 380 aa, Bacillus thuringiensis
FHKAINRRGTHSIKWDTYKNEELIHAWIADMDFEVPKPIQTALKQRIEHPIFGYTLPPENIGDIICNWTKQQYNWDIQKEWIVFSAGIVPALSTSIQAFIKENESVLVQPPIYPPFFEMVTTNNRQLCVSPLQKQNDTYVIDFKHLEKQFQQGIKLLLLCSPHNPIGRVWTKEELVQLGSLCTKYDVIVVADEIHSDIIYADHTHTPFASLSEELAERTITCMAPSKTFNIAGLQASIIIIPNEKLRHAFTAIQYRQGFHGLNIFAYTAMQSAYTECNDWLNEIRLYIEDNAQFACEYIKTHIPALSVTKPEGSFLLWIDCSRLKLSQNERTALLEEKGKIIVEPGEKYGLGGEEHIRINIGCPRSVLEEILNRLRHTFS

SEQ ID NO: 16726 - protein, 443 aa, Bacillus thuringiensis
MFKWLKPAPAIERLPADMIDRVYRLLRIRVLIGISVGYAAYYLVRSNFTLSSTYLVQEYGFSTAEIGLLGSVMAIVYGFSKFFMGNLSDKAFAQRFIAVGLFLSGLVNICFGFASSFGMIVTLLVVNGIVQGMGAPPCSIVMTKWFSKKERGTKTGLWNISHNVGGMLVPPLVGIGVGIFGENHWQGGVFIFPAIIAMVIAVLVWINAKDTPESEGLPPIDEYRNDYENLEKADNANKMSPKEILMKYVVKNKFVWFLCIANAFVYLIRFGVINWVPLYLTTVKGFSKAEAHAAYAIFEGMAIPSSLIVGFLSDKLFKGKRMPLCIISMVGVVIGTFIYWQATSVLVVSIAVSIIGCLIYVPQFLIGLSAMELVPKFAVGTTVGMCGLFGYVGGSLVANAAIGVIVDSSGWDGCFILLLTGAVLSTIFLFIVQRGHERKDPKV

SEQ ID NO: 16727 - protein, 274 aa, Bacillus thuringiensis
TSLKDYTTLHNGVKMPWFGLGVFKVEDGSEVIDSVKAAIKNGYRSIDTAAIYQNEEGVGQAIRESGVSREELFITSKVWNSDQGYETTLQAFETTLEKLGLEYLDLYLVHWPVKGKYTESWKALEKLYKDGRVRAIGVSNFHIHHLQDVFEIAEIKPMVNQVEYHPHLAQEELHAFCKEHNIQLEAWSPLMQGQLLDNPTLQEIATKYNKSTAQIILRWDLQNEVVTIPKSIKEHRIIENANIFDFELSADDMKAIQALNEDRRVGPDPDNFNF

SEQ ID NO: 16728 - protein, 259 aa, Bacillus thuringiensis
RILFIGAGRMAEAIFSGLLKTSKEYIEEIIVSNRSNVEKLKQLQHRYNVSTATDWKQHVTSVDTVVLAMPPSAHEELLAELSPLISNQLVVTVAAGIGPSYLEARLPKGTPVAWIMPNTAAEIGKSISLYTMGQSVNEMHQETLQLLLKGIGTSQLCTEEEVHQLTAVTGSAPAFLYYFAESLIETTKSYGVDEETAKHLVIQMISGSASMLEQTQNPANLREQVTTPGGSTAEGLKTLYEYNFSEAIQKAVEATNKKA

SEQ ID NO: 16729 - protein, 299 aa, Bacillus thuringiensis
MEKIIEVNDVSKTFKHKNAVNNVSFHVNKGEIVALLGPNGAGKTTTMSMMLGLKEPTEGKVSIFGKSPKHRDVRNSLGAMLQEVSVIDSITVEEAIELFRSYYTNPIEKETLLQLSNLESERKQRCEKLSGGQKRRLNFALALAGNPDLLFLDEPTVGMDITSRRTFWETIRKLASEGKTIILTTHYLEEADALANRILLFANGKIIADVTPDEMKATISRKTITFYSKESIPTKLLKELPNVTEVKSNEGRFILTTEDTDATLKAIYQRSLPVTDVSVERGSLDEAFEQFVANQKEEI

SEQ ID NO: 16730 - protein, 290 aa, Bacillus thuringiensis
MKKVRKAIIPAAGLGTRFLPATKAMPKEMLPIVDKPTIQYIVEEAVKSGIEDIIIVTGKTKRSIEDHFDNAFELEQNLLEKKKYELLEKVQASSKMVDIHYIRQKEPKGLGHAVWCARKFIGDEPFAVLLGDDIVQAEKPCLRQLMDEYEKTLSSVIGVQTVPESETHRYGIIDPLEQEGRRYQVRNFVEKPAQGTAPSNLAIMGRYILTPEIFMFLEQQHVGAGGEIQLTDAIQSLNEIQRVFAYDFEGKRYDVGEKLGFVQTTIEMALQHPELRDDMVAMMKKILEEQ

SEQ ID NO: 16731 - protein, 583 aa, Bacillus thuringiensis
  unsure (1)..(583): unsure at all Xaa locations
MNWKQEFSRWLSYAQLDAELKEQLENMKQDEKKIEDSFYKNLEFGTGGMRGELGAGTNRLNVYTVRKATKGLASFIEKLGEEAKKRGVVVAYDSRHKSPEFAMEVAATLGARGITTYVFESLRPTPVLSFAVRHLHTVSGIVLTASHNPPEYNGYKVYGEDGGQLPPKEADELISYVNAVEDELTVEVADVEQLKADGLLHIIGQEVDDAYAAELNNVIINKEMVQKVGKDLKIVFTPLHGTSNISVRRGLKEVGFTDVTVVKEQELPDPNFSTVKSPNPEEHAAFEYAIRDGEKVGADVLIATDPDADRLGVAVRNHNGEFQVLTGNQTGALMLDYLLSQKKENGTLPENGVVLKTIVTSEIGRTIAKAYGLDTVDTLTGFKFIGEKIRQYEESGQYEFQFGYEESYGYLIRPFCRDKDAVQSVLFACEVAAYYKSQGKTLYDGLLEVFEKYGFFREDLVSLTLKGKDGAEKIQEMMATFRENPPKEVAGLTVVAVEDYKASIVTSLQDGHKEEIHLPKSNVLKYQLEDGSWFCLRPSGTEPKIKFYFGVKDSSLQNSEQKLLTIKEDIMNRLXYKVILSSK

SEQ ID NO: 16732 - protein, 1367 aa, Bacillus thuringiensis
DSLPSGTSFIPGTVTVDNVPQTNANPAAGISLGTINNGASRTVTFQATVVSLPSQNPISNTANITFQYTPIAGGTTFNGLATSNSAGTQINLADINGTKSVNKLFTDIGETLTYSIALANIGNIAATNVIYTDPIPSGTTFIPGSVTVNGVTQAGANPANGISIGSIAANSTTTISFQVLVPSIPQTNPILNSGTTTYQYIPVPNQPAVSGTDKTNIVSTQVNNATVTMTKAVDKNFADIGDTLTYTVSFTATGNTNANNVIFTDVIPTGTTFVLNSLTIDGTTQVGANPANGVNIGSIPSGTTKNVAFQVVVNTIPASNVVSNGSSASYQYTVNPSQSPVTKNISSNLVSTQINNANVTLTKSTNKQFATIGETISYTILITNSGNAAANSVQLTDPLPNGTILTPGTVTLNGVLQNVDSLVALPIGTIPGGATFTLSFQVTVINITTQNPIINNAFASYLYTVNPNLPPTSKTANSNSVTSTIRLANLHANKSVDKTFAEVGDVLTYTFALTNDGNVAANNVLLSDSIANGTAFVPNSVIVNGVTQPGVTPTSINIGSINANTTITASFQVVITSIPNPNPISNSASISYNFIVDPNASPVSKNTTSTTTFTQVNDANVISAKTVDRAFATVGDILTYTATLTNAGSVSADSPTFVDTNPDGTTFIPNTFLINGVLQNNADPNIGVPLPSIAANGSLTVSYQVTVTSLPIQNPTINSSSTQYSFILNPGDPPTVETSVSNTVSTQINLANVVIVKEVDLTIADVGQPITYTISLANLGNTIANNVIFTDIIPNGTTIVPNSIFIGGALQLGADPSTGLQVGSIPSGGFTTIVFQISANGLPSPNPIQNSASLQYSFIADPNLPALVRNAASNIVTTQINTANIVATKLTSTNFADVGDVILYATILTNNGNIPAANVTFTDIIPAGTLFIPNTVTINNVPVANANPATGISIGTIGANSSRTVAFQVFVPTIPAVNPITNQSGTTFQYTYDPSKPAVMQMVASNTVQTTINNASIAATKSADKQFANVNDIITYTTTLTNNGNTLASNVIFTDVIPNGTSFIANSVTVNGNTLPNVNPASGIAIDPINPNANTLISFQVQVNSIPNPNPLPNQSNTTYQYVVDPNLPPASANTLSNVITTQINNATIVATKSVNTPTAAIGDIVTYTIAVTNTGNTPASATVLTDGLGAGASFIQNSVTINNVPQPGLDPSLGIHLADISPGDTVFITFQAQILAIPPSGTLTNNALVNYEYTVNPNQSPAVNSTITNTTVTPIIDATLSINKTVNSTFATIGDTLTFTSTITNSGNTTANNVIFTDVIPNGTTFIPNSFTVNGTTITNANPQNGINIGNLNSNASATLSFQVNI

SEQ ID NO: 16733 - protein, 1168 aa, Bacillus thuringiensis
INNATVTTVLQANRSIVSIGDVITYTATLTNTGNFPANSILLINGVPEGALFVPNSVTLNGISLPDASPTLGIPVGIIAPGDSATITFQFLASSIPPQGAIINQALTSYTYIVDPSQPPVTATSSSNTVNTAVVDASLSVIKSTDSLVQSTDGTITYTVVVQNNGNTTANTVTLTDLVPEGTAFIPNSVTISGVSVPGADPNVGIPLNSITPSEIVTVTFQVIVQSIPSVTQFSNTARIDYTFIADPTAPIISRTITSNPAFTQISDATILSLKAVNAPQTTTGDILTYTITLENTGNIPATNLIFSDTIPQDTTFVENSFTLNGTAILGANPNVGVTLPTLAANATHLISFQILIKDSFSRESITNQSNTTYTIQPDPGQPPITETSTSNIVITNFVQAQLTITKTSNPTTVDIGGTILYISEVKNIGNVDAINIVFTDSIPAGTTFVPDSVTINGVLQPGVNPENGIPIGTIPANSSKTILFQVQTNNPPTETEIVNQSSATYQYVSIPTAPPVNRSANSNIVTTSLQNANIISVKSADITFASIGQIITYTNTLQNIGTVPANNTVFIDNIPEGTIFIEDSLAINNVIQPGANPENGVTLGTIQPNETVTISFQVQLTNIPVGNVVINISDTSYEYQIDPSSQIIQRRSLSNAVNTEVRTANVSAIKSANRSITRIGQIITYTVAVTNAGTIPITNTLLLDAIASGTTFVPNSILVDGVPRLNENPITGINLDIILPNNTIIVTFQVSVVSIPPQNNINNIAVIHYEYRPDPSTPPISETTSSNATNIQFIDAILITTKSTNTVLANIDETIEYTVFIQNNGSATTNSIFFTDTIADGTVFIPGSVVVNNTVLPAADPNIGFSIPNVAAGQMATITFQVSVTNLPAVNPTPNTANVVYDFIFNPDFAPIQKSTTSNTTFVQINDADIVSLKTVDLTSVTIGDILTYTTTLTNTGNTDATAVVFTDNIPNGTTFIDGSVLVNNIPQLNANPSAGILVGTIAPNISIPVTFSVTVVALPASGHVQNQSTSRYTINVEEQISTSNITFTEVISANVIATKTTPIQYADLQTIIPYTISITNNGNIQVENIIVTDIIPANTSFIENSVIVNGNARPNDNPLNGIQIDNIPPNTTATILFQVRVTSIPQTNPISNTSTIEYEYTVPNRPP

SEQ ID NO: 16734 - protein, 261 aa, Bacillus thuringiensis
MYSDLAGKVVVITGSATGLGRAMGVRFAKEKAKVVINYRSRESEANDVLEEIKKVGGEAIAVKGDVTVESDVVNLIQSAVKEFGTLDVMINNAGIENAVPSHEMPLEDWNRVINTNLTGAFLGSREAIKYFVEHDIKGSVINMSSVHEKIPWPLFVHYAASKGGIKLMTETLALEYAPKGIRVNNIGPGAINTPINAEKFADPKKRADVESMIPMGYIGKPEEIAAVATWLASSEASYVTGITLFADGGMTLYPSFQAGRG

SEQ ID NO: 16735 - protein, 425 aa, Bacillus thuringiensis
  unsure (1)..(425): unsure at all Xaa locations
KKRIQMNSSKVAIIGLGYVGLPLAVHFAERGHTVLGLDKDIRKIDSIIKGESYIPDVSSKELQSLLTKKKLTVNTPDQGIADFQSSDYVIVTVPTPINEQREPDLSALISASHYIQQNLQKGQTFIFESSTYPGTLEEVIIPIISQNSNKVGEDFYIGYSPERIDPANSQYSVQAIPKVISGQTEKCRQKVQDLYSTIFDEVVPVSSPKVAEMCKLFENIQRLVNISLVNELNTLCESLGIDFYEAIEAASTKPFGFTPYWPGPGIGGHCIPVDPLYFQWRIKKNGAISQLIEAAHIINEEMPEKMVRKVKSVVQSPATVLIVGIAYKKDVNDLRESPALPIIQLLRNQGYEIEYHDPYISFAEIGDKVYQSVSLDEEKVKKADCILILTDHSNIDWKLFKGMDRVIDTRGIVKKVSKXVRNVXL

SEQ ID NO: 16736 - protein, 453 aa, Bacillus thuringiensis
DQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVAFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRAYVKQGGDVKDLKFKTPLYPFVPLLALALNITVIVAMAFIPEQRMALYCGIPFMIVCLLFYRATRNK

SEQ ID NO: 16737 - protein, 555 aa, Bacillus thuringiensis
GLFILDFSCAVVAGLLELGFPLIVNQFIDKLLPGQNWTLILWACFGLLAVYMLNAGLQYVVTYWGHMLGVNIETDMRQKLFDHIQKLSFRFFDNNKTGHLISRLTNDLMEIGEIAHHGPEDLFIAVMTLVGAFSFMMMINWKLALLTFFVIPFLLWLALYFNKKMTGTFRRLFSDVADFNACIENNVGGIRVVQAFGNEKFEKEQFAVNNARFRTTKLMAYKIMALNSSISYMLMRLVTLFVLICGTWFVLQGELTYGGFIGFVLLTNIFFRPIEKINAVIESYPKGIAGFKRYVELLETEPDIVDSKDAMEVKHVHGDIQYNNITFGYENKEPILNDISLKIHAGETVAFVGPSGAGKTTLCSLLPRFYEQSSGSIQIDGIDTKDMTLSSLRKQIGIVQQDVFLFSGTIRENIAYGNLKASEPEIWQAVKRAQLEDLIYSQPEGLDTVIGERGVKLSGGQKQRLAIARMFLKNPPILILDEATSALDTETELAIQKSLAELAVGRTTLVIAHRLATIKNADRIVVVNKDGIAEQGSHNELIEQGGGYSRLYEAQ

SEQ ID NO: 16738 - protein, 228 aa, Bacillus thuringiensis
MIKMTNVYKEYPNGMKAIAGLTVNIKQGEFVYVVGPSGAGKSTFIKMMYREEKPSTGSINVNGLTIETLAERDVPYFRRQLGVIFQDFKLLPKLTVYENVSFALEVIEEEPDAIRERVTEVLGLVGLEDRADALPSELSGGEQQRVAIARAIVNRPKVVIADEPTGNLDIETALDIMNIFTRINERGTTIVMATHNADIVNTIRHRVIAIEGGKIVRDEIEGGYGYEG

SEQ ID NO: 16739 - protein, 169 aa, Bacillus thuringiensis
MNIEIKDTLISEEQLQAKVKELALQIERDFEGEEIVVIAVLKGSFVFAADLIRNIKNDVTIDFISASSYGNQTETTGKVKLLKDIDVNITGKNVIVVEDIIDSGLTLHFLKDHFFMHKPKALKFCTLLDKPERRKVDLTAEYVGFQIPDEFIVGYGIDCAEKYRNLPFI

SEQ ID NO: 16740 - protein, 180 aa, Bacillus thuringiensis
IMIPVQDVTKHFLNGKGLFHITFDVKEGEVFGYLGPNGAGKSTTIRNLMGFIKPTAGKATIFGLDCWNEAAKIQREVGYLPGEISFIEGMNGLEFLKLMQGMRGLKDTKRRDELIERLQFDVKTPIRKMSKGMKQKVGIVAAFMHDPEVLILDEPTSGLDPLIAQVFIDLIFEEKHRGKT

SEQ ID NO: 16741 - protein, 125 aa, Bacillus thuringiensis
  unsure (1)..(125): unsure at all Xaa locations
LEGALSLREISYIQPQAFAAGELYPGPIAEIETGTAVIALQPQVHVSLALPGNIKEVVARGANPCIISMRGIEMPGGSVGLPAVREALAPLVAGIPLRHVSQXAALHRERHVDDPRTVADSVTAE

SEQ ID NO: 16742 - protein, 147 aa, Bacillus thuringiensis
MKLSFSLGFNALTLLLQVCIFAQARISNETDMQALLEFKSQVSENNKREVLASWNHSSPFCNWIGVTCGRRRERVISLNLGGFKLTGVISPSIGNLSFLRLLNLADNSFGSTIPQEVGRLFRLQYLNMSYNLLERRIPSSLSNCSRL

SEQ ID NO: 16743 - protein, 194 aa, Bacillus thuringiensis
LYGVIGNPIGHSYPPVMHNDAFEHLNMDAHYHAFLVEEELLGKAVRGLKALGISGFNVTTPHKVAIMEYLDEIDPLARKIGAVNTVVHKDGRLIGYNTDGIGFVRALQSISNEPLQGKRILLLGSGGASRAIYFSLADVGVKEIDVANRTVDKAKELIAARTADVNSVALSLEKATEEQGNYNKIIQTTTIGMH

SEQ ID NO: 16744 - protein, 112 aa, Bacillus thuringiensis
  unsure (1)..(112): unsure at all Xaa locations
DVMAADYGESSHSLILQLPSDYAAEFAXGGSCICHGQNPLVACARAFFTDGDILLLAEGTSKIDTCAELQVHAGLFNLLSGVTCSQMSHRLSTLETADQITVMKAGRILDXG

SEQ ID NO: 16745 - protein, 400 aa, Bacillus thuringiensis
MLRYHFPDVCEGELINIYSYGNFKGKGKYVCLFKNENQSFLFWKNEKGHKIYTNLDSISVEIIDTNNTYNQSQNWLYAQDLVDTYNQSQNGACAQDLMDTYNQSQNGAYAQDLVNTYNQSQNGAYAQDLVDTYNQSQNGACAQDLMDTYNQSQNGAYAQDLVNTYNQSQNGAYAQDLVDTYNQSQNGACAQDLMDTYNQSQNGAYAQDLVNTYNQSQNGAYAQDLVDTYNQSQNGAYAQDLVDTYNQSQNGAYAQDLVNTYNQSQNGAYAQDLVNTYNQSQNGAYAQDLVDTYNQSQNGAYAQDLVDTYNQSQNGAYAQDLVNTYNQSQNGAYAQDLVDTYNQSQNGAYAQNLVDTYNQSQNGACVQDLVNTYNQSQNGACVQDLVDTYNQSQNGNCGCK

SEQ ID NO: 16746 - protein, 635 aa, Bacillus thuringiensis
MAMRSQKFTLLLLSLLLFLPLFLTNFITPNLALADSPKQSQKIVGYFPSWGVYGRNYQVADIDASKLTHLNYAFADICWNGKHGNPFYSSDNQINKLDCKDLVYHCKIKVPNGTLVLGENHGLMLPNRILAQGTTWEDCDKYARGNFGELKRLKAKYPHLKTIISVGGWTWSNRFSDMAADEKTRKVFAESTVAFLPAYGFDGVDLDWEYPGVETIPGGSYRPEDKQNFTLLLQELRNALNKAGAEDCKQYLLTIPSGASQRYADHTELKKISQYSIGLILSHMISTADGKLLLIIMQLYIGSNDPAANTNFYVDGAINVYTNERVSLPTQCPKLLDTLVKELLGGPISQKDTEPPTNVKNIVVTNKNSNSVQLNWTVSTDNVGVTEYEITAGEEKWSTTTNSITIKNLKPNTEYKFSVIAKDAAGIITPTALTVKRSSNATPDGNGTATFSVTSNWGSGYNFSIIIKNNGTTPIKKWKLEFDYSGNLTQVWDSKISSKTNNHYVITNAGWNGEIPPGGSITIGGAGTGNPAELLNAVISENYTLYPLITSIKFEFRFEQYLLNSNFKFYEKSKISQKPIIIIFNFKYEVYMKFIWILHEFPLISIVFYNIILSLHKGIILFISTIYIYKKIVTC

SEQ ID NO: 16747 - protein, 397 aa, Bacillus thuringiensis
  unsure (1)..(397): unsure at all Xaa locations
MKKKVLALAAAITLVAPLQSVAFAHENDGGQRFGVIPRWSAEDKHKEGVNSHLWIVNRAIDIMSRNTTLVKQDRVALLNEWRTELENGIYAADYENPYYDNSTFASHFYDPDNGKTYIPYAKQAKETGAKYFKLAGESYKNKDMKQAFFYLGLSLHYLGDVNQPMHAANFTNLSYPQGFHSKYENFVDTIKDNYKVTDGNGYWNWKGTNPEDWIHGAAVVAKQDYAGIVNDNTKDWFVRAAVSQEYADKWRAEVTPMTGKRLMDAQRVTAGYIQLWFDTYGNRXVFEKGQISEXSIWPFYDYTIHGGMKRERXIAKRCTXLWGWFRSFIXRNFSSSRSSTNQNDTLKVMTHNVYMLSTNLYPNWGQTERADLIGAADYIKNQDVVILNEVFDNSASD

SEQ ID NO: 16748 - protein, 648 aa, Bacillus thuringiensis
VSILNVINCEEVKRDEFHTEKYYESYNIFGAHVVTEDEIQGVRFTVWAPHAKAMSVVGDFNEWDYEQHKMLQVTEEGIWSLFIPHIEEGEIYKYAIETLAGDVILKADPYAVYAEVRPNTASVVFDIKGYEWNDKNWNRKKKKKSIYKEAMTVYELHFGSWKKKEDGTLYSYREMVEELIPYVVEHQFTHIEIMPLVEHPYDRSWGYQGTGYYAATSRFGTPHDLMHFVDECHKYGIGVILDWVPGHFCKDAHGLYLFDGTPTYEYKDKDVQENPVWGTVNFDLGKREVRNFLISNALFWMRYFHIDGFRVDAVANMLYWNKEGQEQSNEHAVSFLRELNEAVFAEDEDFLMTAEDSTAWPLVTTPTYEGGLGFNYKWNMGWMNDVLKYMECAPEYRKHIHEKMTFSLLYAYSENFILPLSHDEVVHGKKSLLNKMPGDYWDKFAQLRLLYGYFFTHPGKKLLFMGGEFGQFDEWKDLEDLDWNLHDFEMHRYMHDYFNELIALYKRSKPLWQLDHSPEGFQWIDANNNEQSIFSFIRQGDKQEDALVVVCNFTKATYENYKVGVPDFEYYNEILNSDAEQYGGSGQVNKKRLKTILEPYHNQAAHVEITIPPFGVSILRPVKTRKGSKKQDGSKTKVRSNVTSRGKR

SEQ ID NO: 16749 - protein, 513 aa, Bacillus thuringiensis
MTSYMLGIDIGTTSTKAVLFSENGDVVQKESIGYPLYTPDISTAEQNPEEIFQAVIHTTARITKQHPEKRISFISFSSAMHSVIAIDENDKPLTPCITWADNRSEGWAHKIKEELNGHEVYKRTGTPIHPMAPLSKIAWITNERKEIASKAKKYIGIKEYIFKQLFNEYVIDYSLASATGMMNLKGLDWDEEALRIAGITPDHLSKLVPTTEIFQHCSPEIAIQMGIDPETPFVIGASDGVLSNLGVNAIKKGEIAVTIGTSGAIRTIIDKPQTDEKGRIFCYALTDKHWVIGGPVNNGGIVLRWIRDEFASSEIETATRLGIDPYDVLTKIAQRVRPGSDGLLFHPYLAGERAPLWNPDVRGSFFGLTMSHKKEHMIRAALEGVIYNLYTVFLALTECMDGPVTRIQATGGFARSEVWRQMMSDIFESEVVVPESYESSCLGACILGLYATGKIDSFDAVSDMIGSTYRHTPIEDSAKEYRTLMPIFINLSRLLENQYTQIADYQRGLITHK

SEQ ID NO: 16750 - protein, 157 aa, Bacillus thuringiensis
VRSSSRTPSDKPVAHVVANPQAEGQLQWLNNTANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 16751 - protein, 648 aa, Bacillus thuringiensis
VSILNVINCEEVKRDEFHTEKYYESYNIFGAHVVTEDEIQGVRFTVWAPHAKAMSVVGDFNEWDYEQHKMLQVTEEGIWSLFIPHIEEGEIYKYAIETLAGDVILKADPYAVYAEVRPNTASVVFDIKGYEWNDKNWNRKKKKKSIYKEAMTVYELHFGSWKKKEDGTLYSYREMVEELIPYVVEHQFTHIEIMPLVEHPYDRSWGYQGTGYYAATSRFGTPHDLMHFVDECHKYGIGVILDWVPGHFCKDAHGLYLFDGTPTYQYKDKDVQENPVWGTVNFDLGKREVRNFLISNALFWMRYFHIDGFRVDAVANMLYWNKEGQEQSNEHAVSFLRELNEAVFAEDEDFLMTAEDSTAWPLVTTPTYEGGLGFNYKWNMGWMNDVLKYMECAPEYRKHIHEKMTFSLLYAYSENFILPLSHDEVVHGKKSLLNKMPGDYWDKFAQLRLLYGYFFTHPGKKLLFMGGEFGQFDEWKDLEDLDWNLHDFEMHRYMHDYFNELIALYKRSKPLWQLDHSPEGFQWIDANNNEQSIFSFIRQGDKQEDALVVVCNFTKATYENYKVGVPDFEYYNEILNSDAEQYGGSGQVNKKRLKTILEPYHNQAAHVEITIPPFGVSILRPVKTRKGSKKQDGSKTKVRSNVTSRGKR

SEQ ID NO: 16752 - protein, 285 aa, Caulobacter crescentus
MTNAITGAAIVGGVCGQPIKHSMSPVIHNAWIAAAGLDAAYVPFAPAADRFETFVDGLRGGAVRGLNVTIPFKERALAVADTASDLARMAGAANLLVFNEDGSVHADNTDGPGLLGAIAIQAPGFDVTAAPVVILGAGGAARGAVAALLLAGAPRIAVVNRTVARAQDLADTFGEKVVAKGEDALPALLPEAGLIINATSLGLGGGAGPSADLTLTPKTAVVMDMVYKPLRTEFLRRAEAAGRRTVDGLEMLLRQAIPTFETIYGQAPSPKIDVRVLALKLLGEV

SEQ ID NO: 16753 - protein, 631 aa, Caulobacter crescentus
MSKIIGIDLGTTNSCVAIMDGKTPKVIENAEGARTTPSVVAFLEDGERLIGQPAKRQAVTNPTNTLFAIKRLIGRTASDPVVEKDKGMVPYEIVKGPTGDAWVKAHGKDYSPQEVSAFILQKMKEAAEAHLGEPVTKAVITVPAYFNDAQRQATKDAGKIAGLEVLRIINEPTAAALAYGLDKNDGKKIAVYDLGGGTFDVSILEIGDGVFEVKSTNGDTFLGGEDFDLRIVDYLADEFKKEQGVDLRKDKLALQRLREEAEKAKKELSSTAQYEVNLPFISMNASGPLHLNIKLSRAKLEALVDDLIARTIGPCEQALKDAGLKKSDIDEVILVGGMSRMPKVQQAVQDFFGREPHKGVNPDEVVALGAAVQAGVLQGDVKDVLLLDVTPLTLGIETLGGVFTPLIERNTTIPTKRSQTFSTADDNQSAVTIRVFQGERPMAQDNKMLGQFDLVGIPPAPRGVPQIEVTFDIDANGIVQVHAKDKATNKEHSIRIQANGGLSDSDIERMVKEAEANKAADEKKKQLVEAKNQGEAILHSTEKALAEHGDKVGAAEKTAIETGITELKTALEGEDVEAIQAKTQALIQASMKLGEAMYAAQQGSAEGGDAKADDGVVDAEFEEVDDNKPAA

SEQ ID NO: 16754 - protein, 385 aa, Caulobacter crescentus
MRDYYEILGVTRTIDEAGLKSAFRKLAMEHHPDRNGGCENAAGRFKEINEAYSVLSDPQKRAAYDRFGHAGVNGPQGGPGGFGGQGFDASDIFNDVFGDVFGEMFGGGRRQSNAPQRGQDLRYDLEITLEQAYAGAEVEITVPAAMTCEVCEGSGAKPGTSPSVCGTCGGAGRVRATQGFFAVERGCPRCGGSGRLVLDPCSNCHGHGQVRRERILSVRIPAGVDDGARIRLAGEGDAGARGGPRGDLYIFLSVTPHELFERDGLDLLCTVPVPMTTAALGGEIDAPCLLGGESCDGECKVKVHVPEGAQTGKTVRLKGKGMPSLRSRQRGDLVVELFVETPTHLSARQKELMRELAGLCGEKQNPKSANFVGKAKRFWEEVTGS

SEQ ID NO: 16755 - protein, 903 aa, Caulobacter crescentus
MNAHATPTPAHEIDPTGATPVMAQFFEMKARQPDALIFFRMGDFYELFFDDAYKAAAALGISQTFRGTHNGQPIPMAGVPQHAAEAYLSKLIRLGFKVAVCEQMEDPAEAKKRGSKAVVRRDIVRVVTPGTLTEDGLLDARGANRLAAVALRAGQAAVASVELSTGEVEVLAVAKEGVAPILAALAPSETLVADRLLSDDSLSQTLRICGGLVQPMPSALSEPQASETRVKRLYGVETLDGFGGLSPAEIGALGLIAAHLEMTQAGRLPALRAPRRAADADVMAIDPATRSSLEIDRTQSGDRNGSLLAAIDRTVTAGGARMLASRLARPLLDVAAIDQRLDAVEWFVEHRQLRQRLREVLKGAGDMARALSRLALGRGGPRDLGCIRDTLKVGERLAGMAGGAPDPLSPPPFELEHAFKALTPALHEGLSQFLTTLEHGLGPDLPALARDGGFVAAGVRPELDQARGLRDDSRKVIAALESQLALESGVPLKIRHNGVLGYFVEATAGKADPLFQPPLNATFIHRQTLANQVRFTTVELADLDARIAQAAERALAMEVAAFEDWREQARLLADAIQIASEALARIDVASSLAEWAEDAGAVRPVVDASYAFDAKAARHPVVEAAVKRAGEPYTPNDCRLDASGETAARLSIVTGPNMAGKSTFLRQNALLAILAQSGCYVPAASFRLGVVDRLFSRVGAGDDLARGRSTFMMEMVETASILTQAGPRSLVILDEIGRGTATYDGLAIAWACAEALHDTNRCRALFATHYHELATLETRMAFVSNLSLRAKEWNGDLVFLHEAAPGPADRSYGVQVAKLAGVPAPVVVRAREVLDRLESKDQSPAKLDDLPLFAVSQAVAVTSAPAKAAPSAVETSLADLDVDGMSPREALEALYRLKGLLTA

SEQ ID NO: 16756 - protein, 407 aa, Caulobacter crescentus
MSRSSYIFTSESVSEGHPDKVADRISDTVVDAFLSVDPEARVACETLVTTNRVVLAGEVRAGKPDGDKKANKQLTKDILGSLEPKVRAAIKDIGYEQKGFHWNKAKYSNFLHGQSAHIAQGVDATDKKEEGAGDQGIMFGYASTETPELMPATLQYSHNILKRLAELRHSGALSELEPDAKSQVTLEYDGNGRPLRVVSIVVSHQHKKKIDGKAATSKRVLELIKPHILPIFPDGLITKKTQWLVNPTGRFEIGGPDGDAGLTGRKIIVDTYGGAAPHGGGAFSGKDPTKVDRSAAYACRYLAKNVVAAGLADRCTIQIAYAIGVAQPVSFHVDLHGTGKVDPAVLEKTLPQLIGGATPRAIREHLQLNRPIYARTAAYGHFGRTPDNEGGFSWEKTDLVGDLKGLA

SEQ ID NO: 16757 - protein, 331 aa, Caulobacter crescentus
MTFEKVGVIGAGAWGTALAQVAARAGLAVTLQAREPEIVAAINDTHENAVFLPGIALEPGIKAVADLADLADCDLILAVAPAQHLRAALTAFAPHRKAGAPVVLCSKGVEQGSLKLMTDVAAEALPGAPIAVLSGPSFAGEVARNLPAAVTLACEDEALGRAIAEAIAIPTFRPYTANDLIGAEAGGAVKNVLAIACGIVEGKGLGRNAHATVITRGFAELTRLAVALGARPETVAGLCGLGDLVLTCSSPQSRNMSVGLALGQGLTLEQALAGKVSVAEGVASAPAVRALARKVGVEAPICEAVAAILAGEVAVDAAIAGLLSRPLKPEA

SEQ ID NO: 16758 - protein, 322 aa, Caulobacter crescentus
MSRQPPIRIGARGSKLSLAQSGLMQARIAHALGVPAGASKDEIEAAAPLIPIVTSGDRIQDRRLMEIGGKGLFTKEIEEALLDGRIDCAVHSLKDMPAELPPGLVLAATPEREDPRDAFISHVCERLEDLPKGARLGTASLRRQAQALHVRPDLEIVMLRGNVDTRLAKLERGEADAILLAQSGLNRLGLGHLTRSWLDPDACPPAPGQGALVIETRAEDIGAPWLEAVRCRQTTIAVAAERGALLALEGSCRTAIGARAILDGARLSMIVEALTPDGAQRFRREGDITLTGADDIAEARAFGLTLGAEVRAAGGDAIILPE

SEQ ID NO: 16759 - protein, 401 aa, Caulobacter crescentus
MADAYIFDAVRTPRGKGKKDGSLHETTALSLATQVLEALRDRNGLDTSKVDDVVLGCVSPVGEQGSDIARTAVLTADYAESVAGVQINRFCASGLEAVNMAAAKVASGEAGLAIGGGVESMSRVPMGSDGGAWPTDPSSAFKTYFAPQGVSADLIATLYGFSRDDVDAYAVESQKRAAAAWADNRFKKSVIPVKDQLGLTLLDHDETVRGSTTMQTLASLNPSFTGMGEMAFDAVVTQRYPQVERVNHVHHAGNSSGIVDGAAGVLIGTKEMGEALGLKARARIKGAASIGSEPSIMLTGPALVSEKLLKKLGMEVKDIDLYELNEAFASVVLRMMQALDIPHDKMNVNGGAIAMGHPLGATGAMILGTVLDELERSDKETALITLCVGAGMGTATVIERV

SEQ ID NO: 16760 - protein, 391 aa, Caulobacter crescentus
MSVLNVEKPAFMAEEDIAIFEDAVGKFFDEHASEATVATWRKNHCVDRDMWTKAGEAGLLGLSTPEQYGGAGGDYRHEVVLMEQLGKKGVDGFGASLHNAIVMPYIVHYGTEEQKQRWLPRMVTGELVSAIAMTEPGAGSDLQGIKTTAKKAGNQYVINGSKTFITNGQTANLICVVAKTDPAGGARGTSLIFVETDGPDGLLEGFERGRNLDKLGQEAQDTSELFFNDVKVPTENLLGTDEGQGFFQLMGQLPQERLNIAVQGMATIERALELTIAYVKDRKAFGKAIIDFQNTQFVLAECKTEATVAKVFVNHCIGQHLEGKLDAATASMAKYWVSDLENKIVDRCLQLFGGYGFMNEYPIARMYKDSRIQRIYGGTNEIMKLLIARTL

SEQ ID NO: 16761 - protein, 545 aa, Caulobacter crescentus
MHDRAGLRALPEDLVDLDALIGAYFEIKPDVSNPAQKVVFGTSGHRGSSLDGAFNEAHILAVTQAIVEYRAAQGVTGPLFVGRDTHGLSEPAWRSVLEVLAANGVEALVDSRDGFTPTPAVSHAILTHNRQGGRQADGLLLTPSHNPPRDGGIKYNPPSGGPAGSDATSAIAARANELLAQGLAGVKRVPFETARKAVGDYDFLGRYVDDLPAVIDIAAIRAAKVRIGADPLGGAAVAYWGAIAERHALDLTVVNDAVDPRWAFMPLDTDGKIRMDCSSSSAMANLIGIMKGGAAYDVATGNDADADRHGIVTPDGGLMNPNHYLAAAISYLFSHRPGWGADTAVGKTLVSSSMIDRVVSGLGRRLLEVPVGFKYFVPGLLDGSVGFGGEESAGAAFLRHDGGVWTTDKDGIQLALLAAEIQAVTGKSASQLYAGLTDQYGAPAYARVDAPASREEKARLSKLSPSDVSAKTLAGEAITDILTAAPGNGEAIGGLKVCTQNAWFAARPSGTEDVYKVYAESFLGADHLKQVQAEAREVVAGALKG

SEQ ID NO: 16762 - protein, 327 aa, Caulobacter crescentus
MQTVLVTGGAGYVGSHCCLALAEAGFRPVVFDDLSNGHREHVQWGPLEVGDIRDAARLDAVFAAYAPVAVLHFAARIEVGESVKNPGAFFDTNVGGTITLIEAARRAGVKVVVFSSTCATFGDPVDLPMKETHPQAPLNPYGRSKLMVEQALADYDRYVGLKSAVMRYFNAAGADPQGRIGEWHEPETHAVPLAIQVALGQRPRFTIFGDDYDTRDGTAVRDYVHVLDLADAHVAALKRLLVGGSSETYNLGTGTGTTVRELVDGVGKVAGAPLPVEIASRRPGDAPVLVGDHAKARAELGWKASRSLDEILSTAWRWHRGRLEQEP

SEQ ID NO: 16763 - protein, 296 aa, Caulobacter crescentus
MVGRLNGKVAVITGGCSGIGLGTVELFVAEGACVVAADLQDEKGRMLEQRFPDQVRFARCDVTADDDLAKTMALAESSFGGLDILFNNAGHGGTPASVPELTAEAWDKTFALLVRGPAMGMTHALPLMQKRGGGSIINTASIAGLQAGFGPLAYSSAKAAVIHMSRCAAAELSPQKIRVNAICPGLIATSIFGASMGLPREVADQMAAQIASIGPKIQPIPKSGLPEDIAAAALYLASDDSRFVTGTHIVVDGGITVGPRSAWDINTPSPILAAMGITPEQAEQMRAQLLAAGGTG

SEQ ID NO: 16764 - protein, 448 aa, Caulobacter crescentus
MSKRAYFGTDGIRGQANKHPMTAEVALRVGLAAGKLFRSQDERRHLVVIGKDTRLSGYMIEPALVAGLTSVGLDVRLFGPLPTPAVAMMTRSMRADLGIMISASHNSFADNGIKLFGPDGYKLSDAQELGIEALMDQGLQEGLAAPRELGRVKRIDDAQARYVEIVKATFPRHLNLSGLRIVIDCANGAAYKVAPTALYELGAEVITLGVSPDGTNINEECGSTHPEAMAKMVREYRADIGIALDGDADRLVICDEKGVVVDGDQIMAIIAAASHKAGTLKGGGVVATVMSNLGLERQLNTMGLSLERTAVGDRYVMQRMREGGFNVGGEQSGHLILSDFSTTGDGLIAALQVLAVMVETDKPMSALGRQFEPVPQLLENVRFVGGKPLEAAAVKEAIADGEAQLNGAGRIVVRASGTEPLIRIMAEGDDPALVKKVVKSIASAVKAA

SEQ ID NO: 16765 - protein, 606 aa, Caulobacter crescentus
MCGIIGIVGKEPVADRLIESLKRLEYRGYDSAGVAGVVGGKVERRRAQGKIKALEAVLADEPLTATTGIGHTRWATHGAPNVRNAHPHTAGRVTLVHNGIIENFAELKAELAGMGRTFESDTDTEVIAQLIDVALAKGLAPLDAFKATLDRLTGAYALAVLIQGEADLLLGARRGSPLVVGEGQGEMFLGSDALAVGPFTNRVIYLEEGDYVALDHDSRRIFDASGARVERPVRVVPTSSVMLEKGNYRHFMEKEIHDQPEGCQRTIAAYVDTLTSKAAVPGDIDFATLDRIQIVACGTSYIAGVIGKYLIEQLADLPVDVEIASEFRYRTPALRPGSLVVAMSQSGETADTLAALRYCKAKGMKSAVVVNAQESTMAREVDVVWPIHCGPEIGVASTKAFTAQVSVMIALAIAAAKARGTIDAAEEQRLVKVLLEAPRLIAEAIGLEDAIKEIAADVAKARDVLYLGRGPMSALALEGALKLKEISYIHAEGYAAGELKHGPIALVDDQTPIVILAPYDSYFEKSASNMSEVMARGGQVIFITDTEGVKHAPAGAKVVVTAPASDPLVSTLVMSAPIQLLAYHVAVVKGADVDQPRNLAKSVTVE

SEQ ID NO: 16766 - protein, 260 aa, Caulobacter crescentus
MKLDNTVAAVVTGGASGLGEATARALAAQGVKVALFDMNEERGLQVAKEIGGVFCKVNVTSDADVDAGFEKARAAHGQERILVNCAGTGNAAKTASRDKATGETKHFPLDAFDRIIQINLVGTFRCIAKSAKGMLDLEPLEDGERGAIVNTASVAAEDGQMGQAAYSASKGGVVGMTLPIARDLMGEGIRVNTILPGIFNTPLMNNAPEAVKAGLAASVPFPKRLGHPEEYAQLALTMITCGYFNGEDVRLDGGIRMAPR

SEQ ID NO: 16767 - protein, 408 aa, Caulobacter crescentus
MADKSVKKVVLAYSGGLDTSIILKWLQTEYGAEVITFTADLGQGEEIEPARAKALAAGVKPENIFIEDVREEFVRDYVFPMFRANTVYEGQYLLGTSIARPLIAKKQIEIARKMGADAVSHGATGKGNDQVRFELGYYGLEPDITVIAPWREWDFKSREALLDFAEKHQIQITKDKRGEAPFSVDANLLHSSSEGKVLEDPAVEAPEFVHMRTIAPEDAPDAPTIITIDFEKGDPVAIDGVAMSPATLLTKLNELGRDNGVGRLDLVENRFVGMKSRGVYETPGGTILLAAHRGIESITLDRGAMHLKDELMPKYASLVYNGFWFSPEREMLQAAIDYSQDKVTGRVRVKLYKGNVTVIGRESPYSLYDQDLVTFEEGKVAYDHRDAGGFIKLNALRLRVLAKRDKRG

SEQ ID NO: 16768 - protein, 514 aa, Caulobacter crescentus
MSDSRSDDRHPSVTPEQLATLSHEFRTPLNGVLGMARLLENTKLTAEQRSYVTALRESGDHLLSLVNDVLHFARLGAAAIELSLAPVDIEGLLRQVAELMSPRAHEKGIEIAWAVSSPLPTILADEGRLRQILLNFAGNAVKFTEAGGVLLTASAIDGGRVRFSVADTGPGVAPDARARIFEAFVQTDVTHATQLGGAGLGLAIVSRLSAAMGGAVGVGGELGQGAEFWFEAPFATAAAPLRAAPLEGRNVAIASPNAIVRAATARQIEAAGGRAYAAVDIASALAGAPADAVLLIDAALSGPRGALKPPAGRRSVVLLTPEQRDRIDRLKAAGFSGYLIKPLRAASLVAQVLQAVTADGVAEDEPAHDDRIAGAVASGARVLLAEDNPINALLARTLLEREGCIVDRVADGEQAIAAASAGVYDLILMDLRMPGLTGIEAARALRAKGVATPIAALTADAFDEDRRTCLAAGMDDFLVKPLTQEALRDALKRWTTGGVSGGWTKPATRAKVAG

SEQ ID NO: 16769 - protein, 334 aa, Caulobacter crescentus
MTFRGPSPPRFGHSMDLPAYAIEAEGLYKTYAGTKTSPEKRALNGIDLKIPRGSIFGLLGPNGAGKSTFINILAGLVRKSSGTVRIWGRDIDQRPRDARAAIGVVPQELAADVFFTPRESLEVQAGFYGVPKSERRTDELLNALGLGDKAGAYVRQLSGGMKRRLMVAKAMVHQPPVLILDEPTAGVDVELRRQLWQYVTSLNELGVTIVLTTHYLEEAQELCDEIAIINRGEVVACEPTAKLLSRMDSRNVVVTPESPVTAAPVLEGFDTKLRSGGAFSVSYRTGQSSVEQVLAAVRASGLHIKDIATEDPDLEDVFVALTYGDPNAADPTKD

SEQ ID NO: 16770 - protein, 539 aa, Caulobacter crescentus
MIPGLMQTTPLMISGILTYAAQAHGAREIVSRLIDEPLHRYDYAGLAGRAAQAAHALRRLGIKAGDRVTSLAWNTHRHLELFYAAPGIGAVLHTANPRLFDEQIVYTINHAESGVLFFERNFQALVERIAPQLTTVKTFVMLSDAERTVPGAVGAISYETLIEGEPDVIAWPSFDENAGAFLCYTSGTTGDPKGVLYSHRAVVLHAMAGGLNSAFGFTPFDVVMPCSSLYHATAWGLPFSAPICGAKLVLPADKMDGASLHQLIEGEGVTFTGGVPTIWTMYLDWLDKNDRRPDSLKKVVIGGSAVPRAMAETFKRRYGVQTLQIWGMTETCPIGVVATPTPALAALGEEAMDEAIWTRQGRLQFGIELKVETEDGQAAPWDGETSGALLVRGPWVVKRYFRKDADAAREDGFFDTGDIATLDANGFMRITDRQKDVIKSGGEWISSIDLENVAVGCPGVKIAAVIGVPHPKWEERPLLVIETHEGAEVTKAAVLDYLTPRIVKWWTPDDVVFATVPLTATGKIDKKVLRQAWKDHLIG

SEQ ID NO: 16771 - protein, 350 aa, Caulobacter crescentus
MATLLLLPGDGIGPEVCAQVRRVAAALTPDLKVDEALYGGASYDTHGTPLTDEVREQALASDAVLMGAVGGPKWADAPRHLRPEAGLLNLRKAMDVFANLRPAYCFEALAGASSLKPELVSGLDIMFVRELVGGVYFGQPRGIEDLADGQKKGFDTQVYTTSEIERVGRVAFELARGRTNKVHSAEKSNVMESGLLWKQVITELHAREYPDVQLEHILADNCAMQLVRAPKQFDVIVTDNLFGDILSDAAAMLTGSLGMLPSAALGAPGKPGLYEPIHGSAPDIAGKGLANPLAAILSFEMALRWSLKQTEAADALLAAVKAALDNGARTRDLGGSLTTTQMGDAVLAAL

SEQ ID NO: 16772 - protein, 311 aa, Caulobacter crescentus
MSTSAIDPVSFSLYAKDFTRFAQELGASFERYGFAVLSDYDLDQARIDAAVDSAKAFFALPVETKKQYAGVKGGARGYIPFGVETAKGADHYDLKEFWHMGRDLPPGHRFRAHMADNVWPAEIPAFKHDVSWLYNSLDGMGGKVLEAIATYLKLERDFFKPTVQDGNSVLRLLHYPPIPKDATGVRAGAHGDINTITLLLGAEEGGLEVLDRDGQWLPINPPPGCLVINIGDMLERLTNNVLPSTVHRVVNPPPERRGVPRYSTPFFLHFASDYEIKTLQNCVTAENPDRYPESITADEFLQQRLREIKLA

SEQ ID NO: 16773 - protein, 539 aa, Caulobacter crescentus
MADLDAAWTRLEAAAKAAGDKRIVEFFDAEPGRLDALTLDVAGLHLDLSKQAWDEAGLEAALDLAHAADVEGARARMFDGEAINSSEGRAVLHTALRAPAGADVKALGQPVMAEVDAVRQRMKAFAQAVRSGAIKGATGKPFKAILHIGIGGSDLGPRLLWDALRPVKPSIDLRFVANVDGAEFALTTADMDPEETLVMVVSKTFTTQETMANAGAARAWLVAALGEQGANQHLAAISTALDKTAAFGVPDDRVFGFWDWVGGRYSLWSSVSLSVAVAAGWDAFQGFLDGGAAMDEHFRTAPLEQNAPVLVALAQIFNRNGLDRRARSVVPYSHRLRRLAAFLQQLEMESNGKSVGPDGQPAKRGTATVVFGDEGTNVQHAYFQCMHQGTDITPMELIGVAKSDEGPAGMHEKLLSNLLAQAEAFMVGRTTDDVVAELTAKGVSDAEIATLAPQRTFAGNRPSTLVLLDRLTPQTFGALIALYEHKTFVEGVIWGINSFDQWGVELGKVMANRILPELESGASGQHDPSTAGLIQRLKR

SEQ ID NO: 16774 - protein, 261 aa, Caulobacter crescentus
MAQSTGRVAGKKAFITGGAQGLGAAAGRMLAKEGAKVALADINLAGAQAVADEINAAHGAGTAFAFELDVTQEDQWIDVLEKATAAMGGLSVLVNNAGIGGDGPIESLDFGLWKKVMSVNVDSVFLGAKHALTHMRAHQPGSIINLSSIAGLIANGNSPAYNASKAAVWLLSKNIALYCAKMKLDIRSNSIHPTFIDTPILDGFSARFGKEEAFAKLARQVPLGRIGEPTDIANAVLYLASDESKFMTGAEIKVDGGISAM

SEQ ID NO: 16775 - protein, 342 aa, Caulobacter crescentus
MGYRVAVVGATGNVGREMFNILEEVKFPVDKMHAIASRKSIGVEVSFGNEILKCEDLEQFDFSKVDLVLMSAGGSISKAWGEKIGAAGPIVIDNSSHFRMDPDVPLVVPEVNPEAVNSIPKNIIANPNCSTAQLVVALKPLHDEAKIKRVVVSTYQSVSGAGKEGMDELWDQTKGVYVLGAPPPKKFTKQIAFNVIPHIDVFMDDGFTKEEWKMAVETQKILDPAIKLTATCVRVPVMVGHSESVNVEFESPLDEDEAREILREADGIVVVDKREDGGYITPKESQGEFPVYISRIRKDPTVENGLAFWCVSDNLRKGAALNAVQIAQLLHDKGLLKRKVLA

SEQ ID NO: 16776 - protein, 463 aa, Caulobacter crescentus
MADYIVKDISLADFGRKEIAIAETEMPGLMATRAEYGPQQILKGARIAGSLHMTIQTAVLIETLTALGAEVRWASCNIFSTQDHAAAAIAAAGVPVFAFKGENLVEYWEYAHKIFEWHDGGYPNLILDDGGDATLLCVLGPKAEKDPSILNNPQNEEEEALYAVMKKYLAEKPGFYSAIRAAIGGVSEETTTGVHRLYQMAQKDELPFPAINVNDSVTKSKFDNLYGCRESLVDAIRRGTDVMLSGKVAVVCGYGDVGKGSAASLRQGGARVIVTEVDPICALQAAMEGYEVQTLNDVADKADIFVTATGNKDVITVDDMRKMKNNAIVCNIGHFDSEIQIAGLRNFKWDEIKPQVHHVEFPDGKKLIVLSEGRLVNLGNATGHPSFVMSASFTNQTLAQIELWTNKAKYENQVYTLPKHLDEKVAFLHLEKLGAKLTTLRKDQADYIGVPEAGPFKPDHYRY

SEQ ID NO: 16777 - protein, 347 aa, Caulobacter crescentus
MSAPSSLILPGLMTPSGGYKPFRYPWAYDFWKKQQQVHWMPEEVPLGEDLKDWAVKLNDKERNLLTQIFRFFTQSDVEVQDNYMERYGRVFKPTEVKMMLASFANMETIHIAAYALLLETIGMPETEFSAFMEYEAMKAKHDYMQTFGVDSNADICRTLAMFGGFTEGLQLFASFAMLMNFPRFNKMKGMGQIVSWSIRDESLHCDGIIKLYHAFNKETGAVTKAVADDIVDCCKTVVGMEDNFIDLAFEAGDIQGMTPDDIKAYIRFVADWRLRQLHLPEVYGVKENPLPWLQSLLSGVEHANFFEARATEYSKAATKGQWHGSDGVWTSFDEMMKKRSAETIPAE

SEQ ID NO: 16778 - protein, 417 aa, Caulobacter crescentus
MNKRFAYLIIASMILGVLVGWTCNQFLDPAGAKSAADNLSIITDIFLRLIKMIIAPLVFTTLVAGVAHMEDAAAVGRIGAKTMTWFIGASAVSLVLGLLMVHLLDPGAGLNMAHVDVAMKTTATTDAFTLKGFITHLVPTSIFDAMAKNEILQIVVFSLFVGTAVAALDDKAPQILELVEQAAQIMLKVTGFVMKLAPLAIFAALASTIATQGLGMLATYGKFVLGFYSAMGVLWALLFIAGLLVLGKRVIPLFGVIRDPVLLAFSTASSEAAYPRILDSLPKVGVRRRIVSFVLPLGYSFNLDGSMLYCTFATMFIVQAHGVELTVQQQIFMLLLLMVTSKGIAGVPRASLVVIMATLTYFGLPEAWIALVLGVDHLLDMGRSATNVVGNSVAAAVVAKWEGELDDIPPEGEAAKA

SEQ ID NO: 16779 - protein, 412 aa, Caulobacter crescentus
MAEAYIIDACRTPRGIGKVGKGALADFHPQHLAATVLKALAERNGLNTAEVDDIIWGTSSQRGSQAGDLGRMAALDAGYDVRASGVTLDRFCGSGITTVNLAAASIMSGMEDLVIAGGTEMMSYTSATANVTSPPMLDSGNLRLRARHPQSHQGVCADAIATLEGITRADVDALALESQRRADLAIQGGHFAKSLIPVLRDDGSVALDHEEFPRPQTTAEGLASLKASFAALAEIPVDEAGNTYGGLIRQVYPDLKIQHMHHAGNSSGVVDGAAAVLLASPAYAQRHGLKPRAKVIAMANVGDSPTLMLNAPVPAARKALAKAGLTVDDIDLWEINEAFAVVAEKFIRDLKLDRDKVNVNGGAMALGHPIGATGSILIGTILDELERRDLKRGLVTMCAAGGMAPAIIIERI

SEQ ID NO: 16780 - protein, 304 aa, Caulobacter crescentus
MTDVAEEAGWATAKTLAEALPYIQIYDRETVVIKYGGHAMGQEDVAKVFAADAVLLKLLGVHPVVVHGGGPQISRMLDKAGVKSTFVDGLRVTDEATMEVAEMVLSGAINKEIANWITLAGAEADVRGVGLSGKDARLITAEKVTRTKKDPDSNIEQAVDLGFVGEPTKVDPQLIEALLTSEHDYIPVVAPIGVSPDGDTFNINADTVAGALAGALKAKRMLMLTDIKGVLDGNGELIREMTIEQARALIDTGVATGGMIPKLENAIHAIESGVEAVVILDGRRPHAMLVELFSEYGAGTLIKR

SEQ ID NO: 16781 - protein, 607 aa, Caulobacter crescentus
MTAQDRPQPSNRALMGRMWREFLQPRWKGFLVSMISAVIVARLTVMLGEYVEPAVDKLIAHPQPGALIWVPLTIAALAVGRGVFQVIQASLINRIGNGVVGDMQTRLFGRLIRADLARLRGAHSGSYVASVLYDAGLIREAATTGVVNYVREALIVAITLWALFNSDPILAAGVLIIVPGVSGVIRHFAKRTTKAAKGAMGETSNLSTAIMESLDGVKIVKMENREAYEEARVAAVVERRQRHLIKGSNARAMAAPATELFSQLVIAAVFAYAGWRAITGALVVGPFTLPPITPGGFLKFVILLGIAAQSLRQVANLQTVFSEGLTAARRLFEALDVAPTIVDPADAKALPPGESMIALADVTFSYGADIPALSSVNLQARKGETVALVGPSGGGKSSILNLIPRFYDVNAGAVTIDGHDVRSVTIASLRDRIALVTQEPFLFDDTIRANIAYARPGASQLEIEAASRQAAAHEFIQALPEGYDTAVGEGGARLSGGQRQRIAIARAFLKDAPILLLDEATSALDTESEAQVQAALERLMAGRTTILIAHRLSTVKNADRIYVIDKGRVVETGSHAELVRAGGLYARLAKAQDLDHPAPDQDGEITA

SEQ ID NO: 16782 - protein, 399 aa, Caulobacter crescentus
MNIHEHQAKAVLAEFGAPVPRGFAAFTPDEAAAAAEKLGGPVFVVKSQIHAGGRGKGKFEGLGPDAKGGVRVVKSVEEVRSNAEEMLGRVLVTHQTGPKGKQVNRLYIEEGAAIAKEFYLSLLVDRASSKVSVVASTEGGMDIEDVAHSTPEKIHTFTIDPATGVWPTHHRALAKALGLTGGLAKEAASLLNQLYTAFMAKDMAMLEINPLIVTADDHLRVLDAKLSFDGNSLFRHPDIKALRDESEEDPKEIEASKYDLAYIALDGEIGCMVNGAGLAMATMDIIKLYGAEPANFLDVGGGASKEKVTAAFKIITADPAVKGILVNIFGGIMRCDIIAEGVIAAVKEVGLQVPLVVRLEGTNVELGKKIISESGLNVIAANDLSDGAEKIVAAVKGAR

SEQ ID NO: 16783 - protein, 294 aa, Caulobacter crescentus
MSVLIGSHTKVICQGITGAQGTFHTEQAIAYGTQMVGGVTPGKGGQTHIGLPVFDTVAEAKDRTGADASVIYVPPPFAADSILEAIEAEIPLIVCITEGIPVLDMVKVKKALQGSKSRLIGPNCPGVLTPKQCKIGIMPGSIFSEGSVGVVSRSGTLTYEAVFQTTNAGLGQTTAVGIGGDPVKGTEFIDVLEMFLADEATKSIVMIGEIGGSAEEEAAQFLKDEAKRGRKKPMVGFIAGRTAPPGRHMGHAGAIVSGGKGGAEDKIAAMEDAGIRVSPSPAKLGETLLEVLKG

SEQ ID NO: 16784 - protein, 976 aa, Caulobacter crescentus
MTETSFLYGANAAFVEDLYAQWAENPGSVEPSWNAFFASLQEQADQVKRAAQDPAWTPKKVATVRPDWLSALDGQWATVAPAVEAKVSKAIEAKAPAASAEAVRAATLDSLRAIMMIRAYRMRGHLAANLDPLGLDPPKDASELDPASYGFSEADYDRPIFLDFVLGLETATIREILSIVRRTYCGNVGVQYMHISDPAEKAWLQERIEGRDKEITFSKEGKVAILKKLIEAEGFERFLHKRFPGTKRFGLDGGEAMVPALEQIIKRGGALGVKDIVLGMPHRGRLNVLAAVMGKPYHVIFHEFQGGSSVPSDVEGSGDVKYHMGASSDREFDDNKVHLSLTANPSHLEIVNPVVIGKARAKQAFTLREQPDAGRGHVLPLLLHGDAAFAGQGVVAECFTLSGLKGYRTGGTIHFIVNNQIGFTTSPRYSRSSPYPSDMALMVEAPIFHVNGDDPEAVVFAAKVSTEYRQKFGKDVVIDMVCYRRFGHNEGDDPTMTSPLMYAKIKGHPSTRELYSNRLIGEGVITQADCDSWVSEFEKFLDAEFDAGKIYKPNKADWLDGKWAGLTLPGDEDRRGKTAFPKTRLLELGRLITAIPERIDAHKTVRRAIENRRDAFEKGEGIDWGAAEHLAFATLLDEGIPVRLSGQDSVRGTFTQRHSDIIDQKTEEHYTPLNNIRAGQAHYEVIDSALSEEAVLGFEYGFSLAEPNTLTLWEGQFGDFVNGAQVVIDQFISSGERKWLRMSGLVMLLPHGYEGQGPEHSSARLERFLQSCAEDNMQVVNCTTPANYFHALRRQMHREFRKPLIVMAPKSLLRHKRAVSNLSDFAEGSAFHRVMVDGAEAGCDVGGITLKSDDKIKRVIVCSGKVYFDLVDQRAKLGRDDVYLLRLEQFYPWPMKSLMNVLSRFKNADLIWCQEEPRNMGGWTFVDPWLELTLDKLDIKAKRAKYVGRPASASTAAGLMSRHLKELETFLNEAFA

SEQ ID NO: 16785 - protein, 402 aa, Caulobacter crescentus
MADINTPALGESVTEATVARWTKKVGEAVKKDEILVELETDKVSLEVASPADGVLSAIGAAEGATVVPGTVLGVVAEGATASAAPAAAPAPKAEAPKPAPAAPAPAAAPAAAPVSPAPARIAAESGLDLSKVAGTGKDGRVTKGDALAALEARASAPAPAAAAAAPRALHEREERVKMTRLRQTIARRLKEAQNSAAMLTTFNEVDMSAVMALRAQYKDVFEKQHGVKLGFMSFFVKAVVAALKAIPDVNAEIDGQDVIYKNHYDIGVAVGTDKGLVVPVVRDADALNLAGIEKTIGDLGKRARNGQLAIEDMQGGTFTITNGGIYGSLMSTPILNAPQSGILGMHAIKERPMVINGKIEIRPMMYLALSYDHRIVDGAGAVTFLVKVKEAIEDPQRLLLEL

SEQ ID NO: 16786 - protein, 475 aa, Caulobacter crescentus
MARPEGDRPMAQYDVVIIGGGPGGYNAAIRAGQLGLKVAIVEGRGKLGGTCLNVGCMPSKALLHASELYAAATGPEFAKLGIEVKPKLNLSQMMAQKAESVEALTKGVEFLMKKNKVEYVKGWGRIDGVGKVVVKAEDGSETTLETKNIVIATGSEPTPLPGVSVDNKRIIDSTGALSLPEVPKRLVVVGAGVIGLELGSVWKRLGAEVTVVEYLDRILPGTDTEVANAFQKILVKQGFKFQLGAKVTGAEAGAKGVKLSFEPVAGGEAQTIEADYVLVAIGRRPYTQGLGLETVGVTPDKRGMIANDHFKTGVAGVWVIGDVTSGPMLAHKAEDEGVACIEMIAGKAGHVNYGIIPGVVYTSPEVATVGKTEDELKAEGVAYKVGKFPFLANSRAKINHETDGFVKILADAKTDRILGAHMIGPNVGDMIAEYCVAMEFGGASEDVARTCHPHPTRSEALRQAAMGVEGWTMQA

SEQ ID NO: 16787 - protein, 419 aa, Caulobacter crescentus
MRTYHSPLDLVRERSPERPVALVRPDAVAVAARWFQSEFKGDVFYAVKANPSPWVIRELAKAGVRSFDVASLNEVELVANEAPGSRMAFMHPVKSRAAISAAYFDHGVKTFSFDTHEELAKILDATGQAKDLNLIVRMGVQAEGAAYSLSGKFGVEMHNAPDLLLAARRATQDLMGVSFHVGSQCMRPTAFQAAMAQASRALVRAGVLADVVDVGGGFPSIYPGMVPPDLSEYLAAIDRGFAEMMVHETTELWCEPGRALVAEASSLLVKVELKKGDALYLNDGSYGSLFDAAHMKWPFPVKLYRKSGEVVEEGLKPFRFYGPTCDSVDHMPGPFYLPESVDEGDYIEIGMLGAYGVAMNTRFNGFGETDTAQVQDAPMASMYGLAKRSIPVVRQETEERKIVRFSRPKGAAGKRKRRR

SEQ ID NO: 16788 - protein, 1147 aa, Caulobacter crescentus
MQFQRLRLSGFKSFVEPTEFRIEPGLTGIVGPNGCGKSNLLEALRWVMGANSAKAMRAGGMDDVIFAGSGARPARNHADVTLTIDNADRTAPAQFNDDPILEVVRRIDRGEGSTYRINGREVRARDVQLLFADASTGANSPALVRQGQISELIGAKPQNRRRILEEAAGVSGLHTRRHEAELRLRAAETNLSRLEDVARELETALNRLRREARQAEKYKRLSSEIRAVQGAVLYARWTEARDHLERTTSEATAAARLVEETARASAAAQVAITEAEAAMPPLREEATIAQAILGQLAIQKDRAEREAEAAAAEFERLSNDLSRIDADRAREAQAKDDAAAALARIAPELEEVRALVAAAPERGPELAAVAKAAEEARAAAEAAVEQLAARVAAEEAQGRAAAARLSEAEARANRTNRALEQARAERAAVGPEVDPAAADARQRFANAEAALAAARAALEEAETARVKAAEQEAQARQLARSVEDQLGRLRTEARGLAQLTAPRSKSGHAPALDSVSPDKGYGAALAAALGDDLDAALDPKAPSYWGGAEAPAPVWPEGAEPLAPLVKAPPALAARLSHVAVVTRANGDRLQKELKPGMRLVSKDGDLWRWDGFVARADAPRPAAVRLEQRTRLAEVEAEIDVMAPRAEATTIALKAAADRLRAAEDLLRDKRRGPPDAERLLTQAREQVAKFEREQALRAARAQSLDDTIGRFEAEKVEADAALGEAREAHAAAQTSGDLQPQLAEARQAAAQAREAAGAARTALDVETRERAGRQRRLESLERDRADWSKRAEAAAKRAESLEGDRVKAAAALEAAREAPAALQEKLVALLDEFAAAEARRAKASDALETAETTRLNADRAARAAEQAAGEAREKRAALVAHLDGARQRFAEVASAIREQARMEPEELGRHVAGEAVAVPKDAAGVEAHLFALERERDAIGPVNLRAEEEAQEYAGRLETMRSERADLSGAVTKLRAGIEELNAEGRERLLAAFDVINANFQTLFQALFGGGQAELKLIESDDPLEAGLEIFACPPGKRMASMSLMSGGEQALTASALIFGVFLANPAPICVLDEVDAPLDDANVDRYCNMLDEMRRRTQTRFIAITHNPVTMSRMDRLFGVTMAERGVSQLVSVDLSTAEKLVAA

SEQ ID NO: 16789 - protein, 512 aa, Caulobacter crescentus
MNGADALITTLADNGVTACFANPGTSEMQFVSALDREPRMRSVLCLFEGVATGAADGYGRMAGKPACTLLHLGPGYANGAANLHNARRAFTPVVNVIGDHATYHRDFDAPLNSDIAALAAPNSVWVKSAETADSVGPLAAEAIIAAYGTPGGNACLVLPADAAWNEATVKGPMVTPPAFAAPDAASVEAVAKALGGATKPVLLLGSGACGEAALAAAGRLAAHGVRVLTDTFTARQARGEGRFRPDKLPYFGELALKDLDGVDLIVLVATQTPVAFFAYPDRPSVLVPEGCSVETLCGREVDAAAALNALADALGAPAAGPVETYAAPDAPAGRLDAWAIGAAIARHMPTDTIISDDAVTAGLPIFTQTKAARAHDWLSLTGGAIGQGIPLAIGAAVACPDRKVLALTGDGAGMYTVQGLWTVVREKLDVTVVVFANHAYRILGIELGRTGAGNPGPAAAKLLDLGDPRIDWVKLAEGLGMAAERVATAEAFEEAFARAMATPGPRLIEAAM

SEQ ID NO: 16790 - protein, 323 aa, Caulobacter crescentus
MSGRITSAFGAKSTAREVVAGHDLSGRVAIVTGAATGIGVETARALALAGAEVIIAARKPELGEEVANAINEEAGSKRVSFGMLDLSSLEAIRHFVNVWGDRRIDILINNAAVMASPLMRTADGFEMQFGTNHLGHFLLSVLLAPNLIAGAKASGKPSRLVSLSSIGHRRSGIHFDDPNYTTRPYEKWEAYGQAKTANSLFAVGFDKRFKDQGVHANAVMPGGILTPLQRHLPIEEQRALGWLDENDQPREGFKTTEQGAATSVWAAVGSELEGVGGLYLEDCNQALPWSKENPWTGVMPHALDPEAADRLWDLSVDIVGAGA

SEQ ID NO: 16791 - protein, 159 aa, Caulobacter crescentus
MTVTVRPATPADAGLIHQFILDLAEYEKLLDTVQATPADTAAALFGEKARAFADIAEIDGQPMGFALWFYNYSTFVGRHGIYLEDLFVRPSARGSGAGKALLANLAKRCLDEGLGRLEWTVLDWNAPSIAFYDSLDAAAMDEWIIRRMTGEALRKLAGV

SEQ ID NO: 16792 - protein, 250 aa, Caulobacter crescentus
MTSRGAALVTGAGRRIGQVLALEAARAGYDVAIHYRASADEAEETARAVRDLDRRALLVRADLSDEDETRSLVAQAAPLGPLTLLINNASAFEDDRVGGLSRASWDRHLETNLRAPIVLAEAMAAALPADRQGLVVNLIDQRVWRPNPQFFSYTLSKAGLWWATQTLAQALAPRIRVNAIGPGPTLPSVHQAPGEFEAEAAGVLLQRRASPEEVAAALRYLIDASSVTGQMIAVDGGQHLGWKTPDIVAP

SEQ ID NO: 16793 - protein, 479 aa, Caulobacter crescentus
MREYTKFYIDGAWVDPAAPNTLDVINPATEEVCGVISMGSEADVDKAVRAARKAFASFSQTSREERIDILERIIAEYQKRFEDMAKAITEEMGAPAWLAQRAQAAMGIGHVQTAAAVLKGYKFEEDRGTTRIVKEPIGVCAFITPWNWPVNQIACKVGPAIATGCTMVLKPSEIAPFSGYIWTEIMHAAGVPAGVFNLVNGDGPTVGAALSRHPEVDMVSFTGSTRAGIEVAKNAAPTVKRVHQELGGKSPNIILDDADFSRAVAGGVASVMMNSGQSCNAPTRMLVPGARMDEVIAIAKAAAESHTVGDPNGNHKMGPVVSETQWNKIQGLIQKGIDEGATLVTGGVGRPEGLDKGYYVKPTVFANVTNEMTIAKEEIFGPVVSILGYDTVDEAVTVGNDTEYGLAAYVSGGDQDEVRKVASRLRAGQVTLNGAGPDLMAPFGGYKMSGNGREWGDHAFGEFLETKAILGYSAKVAAE

SEQ ID NO: 16794 - protein, 500 aa, Caulobacter crescentus
MQSMADAETADTFGCHALVGGTPKVSFWTRRKAIDTITAGHADSHQLKKTLSWPHLVALGVGAIVGTGIYTLTGVGAGLAGPGVILSFLIAGAVCACAALCYAELSTMIPASGSAYTYSYAAMGEPVAWFVGWSLILEYTLVCAAVAVGWSAHAHGLFKMIGFPDALLAGPHQGGLINMPAVFISMAVAGLLALGTRESATVNMVLVFVKIIALIVFVVLCLPAFNLAHFTPFMPNGFQAHVPEGAAADAAKVGVMAAASLIFFAFYGFDAVSTAAEETKNPKRDLTIGIVGSMAVCTAIYMIVAAVSIGASRTEVFSKSEAPLVFILESLNHGKIAQLVALAAVIALPTVILAFMYGQSRIFFVMARDGLLPRALSKVNAKTGTPVMMTLLTGVLAAVISGLLSLKDIAELANAGTLWAFIAVGASVILLRLREPNRPRVFSTPLWPIVAPAGILGCLYLFLSLPGKTQLYFLYAHLIGAVVYLAYGMRKSVLAQQERA

SEQ ID NO: 16795 - protein, 382 aa, Caulobacter crescentus
MALDLETREQLIDTVARFVAERLRPIEAQVAENDAVPDDVIEEMKGLGLFGLTIPEEFGGLGLTMEEEALVAIELGRASPAFRSVFGTNVGIGSQGLVMFGNDEQKAKWLPGIASGAVITSFALTEPEAGSDSAAVQTRATRDGDDYILNGSKRYITNAGKASLFTVMARTNPDAKGGAGVSAFLVPRDLPGLTVGKPEKKMGQQGAHIHDVTFDNVRVPAWNRLGAEGEGFKVAMQVLDRGRLHIAAVCVGVAERLIADCVAYASERKQFGQPIASFQLIQAMIADSKTEALAAKALVLETARKRDAGVNVTLEAASSKLFASEMVGRVADRAVQVFGGAGYVADYGIERLYRDVRIFRIYEGTSQVQQLIIARETLKRGG

SEQ ID NO: 16796 - protein, 363 aa, Caulobacter crescentus
MEATVLTRHETPAPTGASPPSLAPASTHMFREAGEAARVAAVQLTANAPKIQALAQRLRANPPRVVVTCARGSSDHAATFARYLIETKAGVLTSSAGPSVSSVYDASPNLEGALYLAISQSGKSPDLLAAVKAAKAAGAHAVALVNVVDSPLAALADEVIPLHAGPELSVAATKSYIAALVAVTQLIAAWTEDAELTAALQDLPTALAAAWTLDWSLAVERLKTASNLYVLGRGVGFGVALEAALKFKETCGLHAEAFSAAEVLHGPMALVKDGFPALVFAQNDESRASVDEMAAGLRARGASVLIAGGGGDAPDALPTLASHPVLEPILMIQSFYRMANALSVARGYDPDSPPHLNKVTETI

SEQ ID NO: 16797 - protein, 757 aa, Caulobacter crescentus
MTLTPLRIVAVSTFALTAALATGAFADSLTITPAPAKVVRAEGTFTLSASTRIHVARGDIEAKGVALQLADLIQRSRGFRPKVVEGPPAADAIVLTREGPAGEAYKLDINAKGATIAAAKRAGLFYGAMSLWQLATPDEAKGPVALLAASIEDAPRFAWRGLMVDSARHYQSLDTLKAVIDAMAAHKLNTFHWHLVDDQGWRLEIKKYPKLTQVAAWRRNPGAAVNYPKYGGFYTQDQARELVAYAAARNITVVPEIETPGHALAPIVAYPQLGTAPPDASKMGDWGIFPWLYNTDDATFAFLDDVLNEVMDIFPSTFIHVGGDEAIKDQWKASPKVQAKIKELGLKDEHELQSWFIQRVGKSLEKRGRRLIGWDEILEGGLAPNATVMSWRGIDGAIAAAKQGHDTVLSPHPVLYLDHRQSASAEEPTGRGHISSLKDVYAFDPAPVQLTPDERKHILGVQANVWTEHMQTDQRMQLMAFPRAVALAERAWSPEASADWDGFAKRLPAEMARLKVLGVAANPVPFEPQPALSEAEGGKTRVALSTGLGVGQIRYTTDGKAPTATSSTYAGPIELPTGAVLKAQTFVEGQPLGRERSWTMSADLLQTRTSGQLKLCTQQVPLTMIDDAPAALDQRPMMMVDIFNPCWIWEGARLDKGAMLSARVTQIPFNFQVGKDRDKIPLHPPATPGGELEVRLGCSGERIAAIPLGDAARNPGLSTITGRLPARAEKADLCLTFTSRSLDPFWVVERMTLKPAN

SEQ ID NO: 16798 - protein, 852 aa, Caulobacter crescentus
MIVSNLVLTAPLQGWVSALEEAPDAVFAERMLGDGLAIDPLGSTLHAPCDGSVVSVHRARHAVTLRATNGAEILMHVGLETVALNGEGFEVFVEEGQTVKAGDRLIGLDLDLLAQRARSLITPVVITNGEAFQIVRRDQDRQIGVGQFLMELSPIAGASRAAASGAADQITRQIIVPLAHGIHARPAARIAQMAKTFASDLTLATGPRRANARSPVGLMSLAIRHGDTIQLLASGPDAQAAVTALAELIEGGMGEGAPVAAKTSSTKTAPTKTEPSEPPPPAPLPRDGVLKGVPAAPGLAIGKAVRLSTAEIVVREAGEGVAHEEAALAVALETVRARIGKAAETGDKARKAILAAHQAFLDDPELYAGAHRLIAEGKSAGFAWRRAVGGYVQALQALGDRRMAERVDDLIDLERQVLRALSGEEETGAALAPGSILLADELLPSQLMGADPAALAGFATARGGPTSHVAILAAAMGVPALVAVGGALSKVKDGATLILDADAGTLRVAPDAKALEAAQTALAQRQQRKAAAKAAAHEPAVTRDGVRIEVFANTGSVADAQAAVANGAEGSGLLRTEFLFLDRETPPDEDEQARQYQAIAEALDGRPLIIRTLDVGGDKAAPYLPIPAEENPALGLRGVRVSLWRPHLLKAQLRAILRVEPRGQCKIMVPMVASLDELRAVRAVLEEAKRELGITDRVQLGVMIETPAAAVTADLLAAEADFLSIGTNDLTQYVLAMDRGNPELAAGIDALHPAVLRMIDQTCQGAARHHRWVGVCGGLASDLDATPILLGLGVAELSTTASIAPDVKARVRALSLEACRALAAQALEQTSPQAVRALVQGQTNTPLGGLNP

SEQ ID NO: 16799 - protein, 212 aa, Caulobacter crescentus
MDALTRERTLIGSDDTTGLDLEPVQRPSKDEAMAAVRTLLAWAGDNPEREGLIDTPKRVVEAFDEWFAGYHGDPAKELSRTFEDVQGYDDMVMLRGIDVQSHCEHHMAPFLGKAWIAYMPTGKVVGLSKLARLVEIFAKRLQTQETMTMQIADAIEDHLSAAGVAVLIDAEHQCMSTRGVHHHDVSTITTQFRGVFKTDKVLQQRFMDLVKK

SEQ ID NO: 16800 - protein, 299 aa, Caulobacter crescentus
MSRFIQIVEVGPRDGLQNEKTVLSVEEKLDLIAKLEAAGARRTEVVSFVNPSRVPQMAGAEEIMAALPADLVHSRIGLVLNMRGWERCVSTGCDEANVVVCASDGFATRNQGSTTQQQVETLAAIVERQAAEGGPPITATISVAFGCPFDGEVSQDQVVAIVREAAALGVPEIAIADTIGVADPWTVRRRIEAVRAAAPDTRLRMHFHDTRNTGLANAFASVEAGVDVLDASVGGLGGCPFAPNATGNIGTEDLVYMLERAGFETGYDLAALIQIGRDISQRLGKAPASSLARAGGFPA

SEQ ID NO: 16801 - protein, 777 aa, Caulobacter crescentus
MTVTIATLGFPRIGPKRELKFALEAYWAGKTDADALLDTARDLRAKTWTRQAALGVAHVPSNDFSLYDHVLDTAVMVGAIPAAYGWSGGTVDLATYFAMARGDQGRPAAEACGPGCGHAPGADGVPALEMTKWFDTNYHYLAPELSPGQAFALTSSKPVDEFLEAKALGVHTRPVLLGPVTFLKLAKTKAEGFSPLSLLSALLPVYGQVLRGLAAAGADWVQIDEPCLALDLTDFERAELRRAYGALTHAAPGVRLMLTSYFGGYGENLATAVNLPVEGLHLDLVRAPDELEAALAASRESLVLSLGVIDGRNVWRADLPALLDRLEPVVARRGSDRVVLAPSCSLLHTPIDLDLETALDPEIRQWLAFAVQKVEALAVLAQALNGGRASVAAALEASAQAARARATSPRIHDPKVAERLAAVTPDMTRRRSPYDQRREAQRARLNLPPLPTTTIGSFPQTTEVRQARAAFAKGQISDATYEAFLRQETARAVAWQETVGLDVLVHGEFERNDMVQYFGEQLAGFAFTQSGWVQSYGSRCVRPPILFGDVSRPAPMTVDWWRYAQGLTRRPMKGMLTGPVTILNWSFVRDDLPRETACRQIALAIRDEVVDLEATGAAIIQIDEAALREGLPLRRGDWDAYLDWAVESFRLAASGVADATQIHTHMCYSEFNDIIAAIGAMDADVISIETARSKMELLDAFVGYAYPAQIGPGVYDIHSPRVPAVEEMTTLLAAARQRLAGEQLWVNPDCGLKTRKWPETQAAIVNMVEAARRARAS

SEQ ID NO: 16802 - protein, 312 aa, Caulobacter crescentus
MKLLSGNSNRPLSQAIAEYLDMPLTRAQVRRFADLEVFVTIDENVRGEDVFVIQSTSYPANDNLMELLICIDALKRASGKRITAVIPYFGYARQDRKTGGRTPISAKLVANLITRSGADRVLTMDLHAGQIQGFFDIPTDNLLPSRLMAEDIRRHYPMGDDLMVVSPDVGGVVRARALAKRLDDADLAIVDKRRSGPGQSEVMNIIGDVKDRRCILFDDIADSAGTLCNAAQALMAHGAKSVSAYITHGVLSGAAADRVANSVLTELVVTDSIEASDPAKACPKIRYVSCAPLIGEAIRRIANEESVSKLFD

SEQ ID NO: 16803 - protein, 260 aa, Caulobacter crescentus
MTPILLLGAGRMGGALIQGWQAAGAFDAADLIIRDPHVDAAAFAGAVVNPPLETLGAAKTVLLAVKPQIWREAIADVVPHLAPDAVIVSIAAGVRAADISQAFGGRRVARVMPTTAVAIGQGAASLYADDAEALARARALFAPLAAVAELASEDLMHAATAVSGSAPAYLYAFIEALEAAGAAQGLDPAQSARLARATIIGAAALMAQSGEEPAELRKQVTSPGGTTAAALSVLMGAGGFGDLLPKALDAAVARSKELGG

SEQ ID NO: 16804 - protein, 1356 aa, Caulobacter crescentus
MAQSFTGKKRIRKSFGRIPEAVQMPNLIEVQRSSYEQFLQRETRPGLRRDEGVEAVFKSVFPIKDFNERAVLEYVSYEFEEPKYDVEECIQRDMTFAAPLKVKLRLIVFETEEETGARSVKDIKEQDVYMGDIPLMTDKGTFIVNGTERVIVSQMHRSPGVFFDHDKGKTHASGKLLFAARVIPYRGSWLDFEFDAKDIVYVRIDRRRKLPATTFLYALGMDGEEILTTFYDVVPFEKRSGGWATPYKPERWRGVKPEFPLVDADTGEEVAPAGTKITARQAKKFADGGLKTLLLAPEALTGRYLARDAVNMATGEIYAEAGDELDVTSIQALADQGFSTIDVLDIDHVTVGAYMRNTLRVDKNAIREDALFDIYRVMRPGEPPTVEAAEAMFKSLFFDAERYDLSSVGRVKMNMRLEQDVSDEVRILRKEDVLAVLKVLVGLRDGRGEIDDIDNLGNRRVRSVGELLENQYRVGLLRMERAIKERMSSVDIDTVMPHDLINAKPAAAAVREFFGSSQLSQFMDQTNPLSEITHKRRLSALGPGGLTRERAGFEVRDVHPTHYGRICPIETPEGPNIGLINSLATHARVNKYGFIESPYRRVKDGKPQDEVVYMSAMEESKHVIAQSNIKVAEGEIVEDLVPGRINGEPTLLQKETVDLMDVSPRQVVSVAAALIPFLENDDANRALMGSNMQRQAVPLVQSDAPLVGTGMEAVVARDSGAVVIAKRTGVVEQIDGTRIVIRATEETDPARSGVDIYRMSKFQRSNQSTCINQRPLVKVGDRIVAGDIIADGPSTELGELALGRNALVAFMPWNGYNFEDSILISERIVRDDVFTSIHIEEFEVMARDTKLGPEEITRDIPNVGEEALRNLDEAGIVAIGAEVQPGDILVGKVTPKGESPMTPEEKLLRAIFGEKASDVRDTSLRLPPGVAGTIVDVRVFNRHGVDKDERALAIERAEIDRLGKDRDDEFAILNRNISGRLKELLIGKVALSGPKGLSRGEITAEGLAQVASGLWWQIALEDEKAMGELESLRRLFDENRKRLDRRFEDKVDKLQRGDELPPGVMKMVKVFVAVKRKLQPGDKMAGRHGNKGVISRILPIEDMPFLADGTHVDVVLNPLGVPSRMNVGQIFETHLGWACANLGKQITNLLEDWQQGGQKQALVERLTEIYGPDEELPDTEEGLVELARNLGKGVPIATPVFDGARMDDIEGHLEMAGVNKSGQSILFDGLTGEQFKRPVTVGYIYMLKLHHLVDDKIHARSIGPYSLVTQQPLGGKAQFGGQRFGEMEVWALEAYGAAYTLQEMLTVKSDDVAGRTKVYESIVRGDDTFEAGIPESFNVLVKEMRSLGLNVELENS

SEQ ID NO: 16805 - protein, 1396 aa, Caulobacter crescentus
MNQEVLNIFNPVQAAPTFDQIRISLASPEKIRSWSFGEIKKPETINYRTFKPERDGLFCARIFGPTKDYECLCGKYKRMKYKGIICEKCGVEVTLARVRRERMGHIELASPVAHIWFLKSLPSRIAMMLDMPLKDIERVLYFEYYIVTEPGLTPLKQHQLLSEDDYMRAQEEYGDDSFTAEIGAEAIQNLLKAIDLEKEAERLREELSGTVSDMKQKKFSKRLKILEAFQESGNRPEWMVLTVVPVIPPELRPLVPLDGGRFATSDLNDLYRRVINRNNRLKRLIELRAPDIIIRNEKRMLQESVDALFDNGRRGRVITGANKRPLKSLADMLKGKQGRFRQNLLGKRVDYSGRSVIVVGPELKLHECGLPKKMALELFKPFIYARLDAKGLSGTVKQSKRMVEREQPQVWDILEEVIREHPVLLNRAPTLHRLGIQAFEPKLIEGKAIQLHPLVCAAFNADFDGDQMAVHVPLSLEAQLEARVLMMSTNNILSPANGRPIIVPSQDIVLGLYYLSVARDGEPGEGKIFADLGEIEAAMDAGVVSLHAKIKARHTEMTPEGVLLRKVIDTTPGRMKIAALLPHHPQIGHRLIEKALTKKEIGNLIDIVYRHCGQKATVIFADKVMGLGFKEAAKAGISFGKDDIIIPVRKTAIVEETRKLAEEYEQQYADGLITKGEKYNKVVDAWAKATDRVADEMMAELQMKHKDENGREKEINAIYMMAHSGARGSQAQMKQLGGMRGLMAKPSGEIIETPIVSNFKEGLTVQEYFNSTHGARKGLADTALKTANSGYLTRRLVDVAQDCIIVEEDCGTTKGITLRAVVEGGDVLVSLGSRVLGRFTAEDVKDPGTGELVVPADTYIDENIADAIEAAVVQSVKVRSVLTCEAKIGVCGACYGRDLARGTPVNIGEAVGVIAAQSIGEPGTQLTMRTFHIGGTAQVAEQSFFEASNEGTVRVIGPTVVGSDGALVIMSRNTSVSVLVDGKERETYKPPYGARLRVKDGDLVKRGQRLGDWDPYTTPIITEVAGKIRAEDLVDGLSIREEVDEATGIAQRVVADWRTSARGSDLRPAMGVLSEDGSYKRLSNGGEARYLLSAGAILSVADGDEVKPGEVIARIPTEGAKTRDITGGLPRVAELFEARRPKDCAVIAEMDGRVEFGKDYKNKRRIKITPDVDADGNQPEAVEFLIPKGKHIAVHDGDYITKGEYIIDGNPDPHDILRILGVEALANFLVDEIQEVYRLQGVPINDKHIETIVRQMLQKVEILEPGDTGLIKGDHLDKPEFDKEQEKAIARGGRPAVTQPVLLGITKASLQTKSFISAASFQETTRVLTEASVHGKTDTLEGLKENVIVGRLIPAGTGSYLRSLQRVAAKRDEQLAQQREDAMEPLPAEIALSDAE

SEQ ID NO: 16806 - protein, 290 aa, Caulobacter crescentus
MSTDQDLDTKKAAARAWFESLRDQICAAFEQLEDEAPADLYPGAPGRFAKKAWDRPAGGGGVMGMMHGRLFEKVGVHVSTVFGTFTPEMAKTMPGAAEDPRFFATGISLIAHMTNPRVPAVHMNTRFIATTKSWFGGGGDLTPLLGYQRQQDFPDAIDFHAAYKRACDKYDPEWHPKYKAWCDEYFFLPHRNEPRGIGGIFYDHHDSGDWARDFAFTQDVGRAFLEIYPTLVRRRMGEAWTADEREQQLIQRGRYVEFNLLYDRGTMFGLKTGGNVESILSSMPPAVKWP

SEQ ID NO: 16807 - protein, 391 aa, Caulobacter crescentus
MSEIVIVSAARTPVGSFNGALASLPASELGKAVIEAAVSRAGIAPSDVDEVILGQVLQAAAGQGPARQASVKAGIPVEAPAWSLNQLCGSGLRAVALAAQQIADGSAKVVVAGGQESMSQAPHAQNLRGGQKMGDLQFVDTMIKDGLWDAFHGYHMGQTAENIASRWQITREDQDKFAVTSQNRAEAAQKAGKFDDEIVPITIKGRKGDTIVDKDEFIRHGATIESVQGLKPVFNKEGSVTAANASGLNDGAAALVLMSAEEAAKRGLKPLARIASWANAGVEPEIMGTGPIPASKKALEKAGWSVSDLDLVESNEAFAAQALCVVRELGLDPAKVNVNGGAIAIGHPIGASGARILTTLVHEMKRSGAKKGLATLCVGGGMGVAMCVEAV

SEQ ID NO: 16808 - protein, 240 aa, Caulobacter crescentus
MTRVAFVTGGTRGIGRAICERLIADGHKVAAGYSGNEAAAEACAKELGVMVVKGNVGVFEDCQAAVKKVEAELGPIDILVNNAGITRDGMLHKMTYEQWSEVIRVNMDSAFNMTRPVIEGMRDRSWGRIINISSINGQKGQMGQTNYSAAKAGLIGFTKALALENAKKGVTVNVICPGYIDTEMVAAVPENVLAQIVAGIPVGRLGRGEEIADMVSFLAGERAGFVTGATLTLNGGQYMA

SEQ ID NO: 16809 - protein, 352 aa, Caulobacter crescentus
MSLHDIAARALHAFDPEDAHGWAIRGLKWGLGPRDAQPDDPILAVKIAGLELPNCVGLAAGFDKNAEVPDAMLAAGFGFVEAGTVTPLAQAGNPRPRLFRLTEDQAVINRMGFNNGGLEPFAQRLAARQGRGGVVGANIGANKDATDRIQDYVTGLTRLWGLSDYFTANISSPNTPGLRALQTKAALEELLGRLAETRAALKVASGADYPIFLKVAPDLEDGEVEAIVETVVGAGLDAIIVSNTTIARPETLKSRFAGESGGLSGAPLLEASTAVLARFHAAAAGRVALIGAGGVADGAGAYAKIRAGARAVQLYSALVYGGPGLVTRIKRDLAARLRADGFAAVEDAIGAA

SEQ ID NO: 16810 - protein, 878 aa, Caulobacter crescentus
MQKWPCQMVLKWNVVRSAGWTLAERGIQMSALVLTAPLQGWVSALEEAPDAVFAERMLGDGLAIDPLGSTLHAPCDGSVVSVHRARHAVTLRATNGAEILMHVGLETVALNGEGFEVFVEEGQTVKAGDRLIGLDLDLLAQRARSLITPVVITNGEAFQIVRRDQDRQIGVGQFLMELSPIAGASRAAASGAADQITRQIIVPLAHGIHARPAARIAQMAKTFASDLTLATGPRRANARSPVGLMSLAIRHGDTIQLLASGPDAQAAVTALAELIEGGMGEGAPVAAKTSSTKTAPTKTEPSEPPPPAPLPRDGVLKGVPAAPGLAIGKAVRLSTAEIVVREAGEGVAHEEAALAVALETVRARIGKAAETGDKARKAILAAHQAFLDDPELYAGAHRLIAEGKSAGFAWRRAVGGYVQALQALGDRRMAERVDDLIDLERQVLRALSGEEETGAALAPGSILLADELLPSQLMGADPAALAGFATARGGPTSHVAILAAAMGVPALVAVGGALSKVKDGATLILDADAGTLRVAPDAKALEAAQTALAQRQQRKAAAKAAAHEPAVTRDGVRIEVFANTGSVADAQAAVANGAEGSGLLRTEFLFLDRETPPDEDEQARQYQAIAEALDGRPLIIRTLDVGGDKAAPYLPIPAEENPALGLRGVRVSLWRPHLLKAQLRAILRVEPRGQCKIMVPMVASLDELRAVRAVLEEAKRELGITDRVQLGVMIETPAAAVTADLLAAEADFLSIGTNDLTQYVLAMDRGNPELAAGIDALHPAVLRMIDQTCQGAARHHRWVGVCGGLASDLDATPILLGLGVAELSTTASIAPDVKARVRALSLEACRALAAQALEQTSPQAVRALVQGQTNTPLGGLNP

SEQ ID NO: 16811 - protein, 527 aa, Caulobacter crescentus
MLHLPPHRRQLLGGLLALGVGASASRTHAAPTEAVANVRDFGAKGDGVTIDSPAIDRAIAYAAERGGGTVLVPAGTYACYTIHLKSRIRLYLDQGATILAASTPIEGMESGGYDHAEPMDPAYSSYQDFGHSHWRNSLIHGEGLNDIVIEGPGLIWGKGLGRGHDYDKDMPISGKPGVGDKSIALKNCRNVLLRDFKVLQGGWFALLATGVDNLTIDNLLIDTNRDGLDIDCCRNVRITRCTINSPWDDAICPKSSYALGYPRVTENLTISDCYVAGRYRIGSVLDGTWQVFMPAPKGTHGRIKLGTESNGGFKNFTITNCVFDKCRGIALETVDGGALEDITITNITMHGGTTAPIFMRLGKRMRGPEGRPIGTLKRILISNITSSAGDRMPSIIAGLNGHPVEDIKISQCFLEQVGGGDAAMAALRPPENEAGYPEPNMFGDLPATGFFVRHARNVELDGIEVRTLTPDARPAVWMQNVDGARLSRLQLPPSKSSFHLEGVRDFELRTSSPVRDKRVPHTKLMTF

SEQ ID NO: 16812 - protein, 472 aa, Caulobacter crescentus
MSASRLISRDPYTGEAIADFAVNDARSIDAACHSARAAFAEWAMTPLAERRAIALRFAETVRARREEIATLIARETGKPMWEALTEADSVAAKVAISIRAQDERAGERSEPMADATARLAHRPHGVLAVIGPFNFPMHLANGHIVPALLAGNAVVFKPSEKTPACGQLMGELWRAAGLPDHVLTIVIGGGEAGEALVRHEALDGVLFTGGVQAGRAIHRALADAPHKILALELGGNAPLVVWDVADIEAAAHLIVQSAYVTAGQRCTCARRLILPEGARGDALLEALTMLMDRLVIGGPFQSPAPFMGPVIDAHAAAQVLAAQDRMTADGGRPLRLAAVREARSALLSPGLIELTDAPLRDEEIFGPLLQVRRAADFDAALALANATRFGLAAGLISDDEALYRRFWTSVRAGIVNWNRPTTGASSAAPFGGVGGSGNHRPSAYYAADYSAYPVAGLESPSPVYRLPIGLNP

SEQ ID NO: 16813 - protein, 392 aa, Caulobacter crescentus
MSALMNTYARANIDIVRGEGCWLYDQDGRDYLDLAAGVAVNTLGHGDPRLVQALKTQADILWHASNLYRLPAQEALATKLTDATFADRVFFANSGAEAVEAAIKTARRWQGAKGRPERYRVLTFGNAFHGRTLATISATDQMKVREGFTPLYDAFDTTPFNDIEGAARAITPQTAAILVEPIQGEGGLTPATPGFLAGLRALCDQHDLLLILDEVQTGIGRTGHLFAHELYGVRPDIIAVAKGLGGGFPIGACLATEDAASGMTPGSHGSTYGGNPLACAVASAVLDAVLAPGFLETVRERAALVDALLERLLRRHSDLFVRAQGHGLMRGLQVRASARDVVAHLRDFGVMTVAAGADVVRLLPPLTISELEIAEAEARLLRAAEAWLPIAA

SEQ ID NO: 16814 - protein, 892 aa, Caulobacter crescentus
MADGSAALTATRTACPYCGVGCGVIGATAAGARAVAISGDEAHPANHGRLCSKGTALGATVSLAGRLLEPTIQGRSASWDEATALVARRFRETIARHGPDSVAFYVSGQLLTEDYYVANKLMKGFIGSGNIDTNSRLCMASAVVAHKQAFGADLVPGCYEDLDLANLVVFSGHNAAWTHPVLFRRMEAAKARGQKHVVIDPRRTDTAEGADLHLALAPQSDVRLWNGLLADLIRRGAVDMDFLRDHVDGYAAVITSLAEDDQSPAAVAADCGLALADLQTFFDLFAAHPRTVSLFSMGANQSAQGVAKGLAIINAHLATGRIGKPGACPFSITGQPNAMGGRETGGMANTLAGHMDFSPEERDRVARFWGAPNTARAPGLKAIDMFEAVRDGRIKALWVMATNPAVSLPASGAVREALERCPFVVVSDCVETDTTAFADVKLPALAWGEKDGTVTNSERRISRQRTLFPPPGQARADWRIIAEVARAMGFDGFGWPHAASVFREWARLTAYENKGRLLNLEGLTRLDPQAYDALEPVQWPVDTEGRGRARLFEDGRFQTANGRARLVPVRPRGPAEATSDKFPMALNTGRIRDQWHTMTRTGLAPDLCRHAPEPYVEVHPDDARAVGLTEGALARVMTTRAEAVAVAKLSDRQRRGSLFMPMHWTDAFAPAGRANALVAPMTDPSSGQPEFKHTPARIGAYRETWRGFFLAREPALIVDPGLVWRRIPRDACHQHEFAGRGDRAQRATLRKRLVRALTGEIVAYEDAATGALREAWIRDDRLVAVLYMTEAGRLPPRDWLADLFAAPLTPETRATLLHGFPPGAPVDKGPMVCACLKVGGKAIEAAIIGGASTADAVGAATGAGTNCGSCRPEISRMIRAFTDAKQETADVL

SEQ ID NO: 16815 - protein, 420 aa, Caulobacter crescentus
MRHLKSIYVQVLIAIVLGVLVGAIWPQIGVALKPLGDGFIKLIKLVIAPVIFCTVAGGIARMGDMKAFGRVGVKALIYFEVVSTLALVIGLVVGRLIQPGAGFNIDPATLDASIAAGYVEKAQHGEGMVAYLLHLIPDTFIGAFADGNLLQVLVIAILTGFACVRMGDFGEKVAHVLDETSKLFFGIIHIVVRLAPIGAFGAMGFTIGKYGVEALVQLGALVATFYVTSLLFVLVVLGGIAWVSGFSIFRFLAYIREELLIVLGTSSSESVLPQMMEKLENAGARRSVVGLVIPTGYSFNLDGTNIYMTLATLFLAQATNTPLSLGQELALLGVAMLTSKGASGVTGAGFITLAATLAVVPDIPIAALAILVGVDRFMSECRALTNLVGNGVATLVVARWEGALDRQRLDRVLRGAPATE

SEQ ID NO: 16816 - protein, 245 aa, Caulobacter crescentus
MAASKGACLVVGVGDGVGSAIAKAFAAQGYTVCMTRRPRHLDQLEALAAEIRSTGQDARAFGVDARQEADMIALVDRIEAEIGPLEIVVFNIGANVRFDLTETTAQVFSKVWEMACFAGFLAAREAARVMVPRGRGTILFTGASASLRGKEGFSAFASAKAGLRAVAQSAARELGPKGIHVANVVVDGAIDGVFIRSMRGEVGDLLEQDLILKPADIALNYVHLHNQPRSAWTHELDLRPWSESW

SEQ ID NO: 16817 - protein, 726 aa, Caulobacter crescentus
MVARSPLRGRTPLMDIPAELNFARRRRLPVIVGAEAAECGLACMAMVARYHGHDVDLNGLRQRFTLSMSGATLRSIMGFADHLGFAPRALKVELSALDKVRLPAILHWDLNHFVVLKSVQGGRAVVHDPALGARTYSLDELSKHFTGVALELTPSGRFEKITARAPIKLTSLWSRMIGFWPAFFQILGLSLALQVAVFAMPFQMQLVVDEAIFRADRDLLTVLALGFGALVIIQSAIEALRAWALQVFGQMLSFQIVGNLVRHMMRLPSDWYEKRHVGDILSRIGSASAIQDVLTRGVIAAIIDGLMAVVAIIILLLYAPTLAAVVVGAVALNLGLALALFPAMRARTEEQILESAREQSHVMETVRAATTIKLMGREAERESSWRNLYANAINAAVSVGKFQISLSFTQALITGLQTVIVIYLGARTILAGDGFSVGMLFAFLSFRQTFTDRANALINQFIQFKFLNLHLERLADIVTAETEAADTAAPRLEVAGALQLKDVSFRYGAADRPVLQGVDLEVAPGEFLAITGASGGGKTTLLKLMLGLRAPTEGTITLDGQPASPQLWRAWREQVGVVAQDDRLLSGTIADNIAFFDPDLDMERVQHAAMAAQVHDDIARMPMQYLSLVGDMGSTLSGGQKQRVLLARALYRRPRILVLDEGTANLDVQTEELIADLIAQLPITRIVVAHRPALLKRASRILVVEGGVLSTTCSELSRAEPKRAVF

SEQ ID NO: 16818 - protein, 96 aa, Caulobacter crescentus
MKFRPLGDRVLVKRVEEETKTKGGIIIPDTAKEKPQEGEVVAVGPGARNDKGDVVALDVKAGDRILFGKWSGTEVKVDGQDLLIMKESDVLGVVEA

SEQ ID NO: 16819 - protein, 435 aa, Caulobacter crescentus
MDFDISPKQRAFLDRVTAFMDEHVYPAIPAYEAEMNVLGAERWKVVQVVEDLKKKAKAAGLWNFFMPPHSGQTHVDDTFQFEGVQLTNLEYSLIAEQLGKVGFASEVFNCSAPDTGNMEVLMRYGTLAQKEKWLRPLMNGEIRSAFLMTEPAVASSDATNIETRIERDGDHYVINGRKWWSSGVGDPRCKVAIVMGKTDPDNASRHAQQSQVLVPLDSPGIEIVRMLPVFGYDDAPHGHAEVILKNVRVPIEDALLLGEGRGFEIAQGRLGPGRIHHCMRTIGTAEVALEKMCQRLMSRKAFGKYVSDHSVWEERVADARIDIEMCRLLCLKAADMMDKAGNKSARLEIAMIKVAAPRLALKIIDDAIQAHGGGGVTTDFGLAKAYAGIRTLRLADGPDEVHQRTIARMEYGKYGDLMYKQKAEKEAALHVPGIR

SEQ ID NO: 16820 - protein, 637 aa, Caulobacter crescentus
MPIRRLPPETVNRIAAGEVVERPASAIKELVDNAIDAGATRIEVEAHGGGLTRILVADDGCGLSPEELPVAIERHATSKLAPDADGLWDLLRIHTMGFRGEALPSIGSVARLQISSRAKGAKDAFSILVEGGQVGEVAPAAFPGPHGARIEVRDLFYATPARLKFMKSERAEALAITEEIKRQAMANESVGFSLDIDGRRVLRLPPEHPGPQGRLARLAAVLGREFQENALEIDQTRDGVRLSGFAGLPTYNRGNAAHQYLFVNGRPVRDRLLQGALRAAYADFLARDRHPTAALYVTLETTEVDVNVHPAKAEVRFRDPALVRGLIVGALRHALAGAGHRASTTVAAQALDSIRAQQSPFPGYQPQYQPGPSPAGFSAWREGGWTPPTQRPMDLPGLNEVSARVEPSYGGDLAGVVREAYAAAAFEDRPPTDYPGATAPFDPVDYPLGAARAQVHETYIVAQTRDGMVIVDQHAAHERLVYERMKGEMASGGVTRQTLLLPEVVDLDPAEAERVVARAEELAGLGLVLESFGPGAVLVRETPALLGKTDAAALVRDIADDLAENGQALALKERLEEVCSTMACHGSVRAGRRLNGAEMNALLREMEATPHSGQCNHGRPTYVELKLADIEKLFGRR

SEQ ID NO: 16821 - protein, 292 aa, Caulobacter crescentus
MSEIKTVGVIGAGQMGSGIAHVVALGGYDVRLHDVSRERIDAGIAVIEKNMARQVGRGIIDDAAMKAALARIQPAEGLEAIGATDLAIEAATENEEVKKSIFRSLQPYLKPETLLASNTSSISITRLASATDRPERFIGLHFMNPVPLMKLVEIIRGIATDVPTYERAVTFAQSLGKITSNAEDFPAFIVNRVLVPMINEAIYTLYEGVGTVDAIDTAMKLGANHPMGPLELGDFIGLDTVLSIMNVLHEGLADSKYRPCPLLVKYVEAGWLGKKTGRGFYDYRGETPVPTR

SEQ ID NO: 16822 - protein, 591 aa, Caulobacter crescentus
MRPFATCKGAARTRSLVSFPRTSAALPRFAEWLDQDVTSVTARSLPTLGVRLAICAATALIYALAVDLQGGLLWGLAVASAEAAVFICSSPQRADRKISHAQRLSYVAAVAWMNIVWWSLAIMLWRQDHPALRMAALCVVCAFLVHAQAFTARSKTLLLIVGGGSATLLLVLCGVLNDFPPSERLALCAAAIILIIYTAKAAQTNGQQGRALELAKSQAEAASQAKSEFLALMSHELRTPLNGMLGLSQALKLEPLEPGEREQVELLEESGRTLLALLNDVLDMAKIEAGKLDIAPTQEDLSRLAERVVRINQAQAREKGTEITLEIDPATPRALLFDPLRVRQCLGNLVSNAVKFTPAGQIRVRVTCEAGDQPDRMLAKIIVSDTGVGMGPAVLARIFTPFEQADPTIARRTGGTGLGLNITRRLAQMMGGSVSVRSTEGKGSTFTLTFGCRLPSAGAAETGGPLSGEHPLRLLVVDDYAVNRKVIAMMLAPLGCEIVEADNGQRALDLLAEREVDAVLLDFNMPVMGGLETTRRLRADPRWRKLPIVCLTAGVMDDERAAAATAGMDGFIEKPIEMSTLVSTLARVARR

SEQ ID NO: 16823 - protein, 390 aa, Caulobacter crescentus
MGEAYIVAAARTAGGRKGGRVSGWHPADLAGEVLNALVDRSGADPALIEDVIMGCVGQVGEQAINIARNAVLASKLPESVPATSVDRQCGSSQQSIHFAAATVMSGAMDIVIAAGVESMSRVPMGLSSALPYKNGFGTYKSPRMEERYPGIQFSQFAGAEMLAKKYDLSREQLDAFALASHQRAMAATKGGKFAAEIVPIKVTLPDGSVETHDADEGIRWDATMESIGGVKLLSEDGRLTAATSSQICDGAAGVMIVNERGLKALGVAPLARIHHMTVIGHDPVIMLEAPIPATQKALERAGMKIDDIDLYEVNEAFASVPTAWLQVTGGDPDKLNVNGGAIALGHPLGGSGAKLMTTLVHALKDRGARYGLQTMCEGGGLANVTIVERL

SEQ ID NO: 16824 - protein, 983 aa, Caulobacter crescentus
MGLRPPVERRPDRLRPQLHRRLADPAGQARHLLTGTAMRILALSAFGLALLASTSALALDGGFEKTADGVVITPANGPAKKVRLQVMSDRAIRVTASPTDTISVPPSLQVIAAPKTSGFTVEQVGGKVVLKAGKATAEVTLATGAVSFKDAAGKTVLTEQSRANFKPLTLDGKGFYAVSQRFNPNTDEGFYGLGQHQNGQMNYNGQDVELAQYNRAIALPFVLSTRNYGLLWDNNGITRFGDPTPYALASRDLKIFDASGKPGGFTAKYYINGELKLTRVEQDIDYQYLEDLPKWPAELTGPDKKPLRGAKVVWEGSVEGQVGGQQKFQLYSSSYAKLWIDGQLKIDRWRQNWNPWFHNFTAPMKAGSRHKVKVEWEPNDGYIALLHNNPIPAAEQKSLTLTSDVAHAVDYYFVAGENLDQVISGYRDLTGKAQAMPRWAYGFWQSRQRYETQDQLVGVVKEYRKRNVPLDNIVLDWRYWKDDSWGTHKFDETRFPDPKKMLQDVHGMNARFMISIWPKFYPTTDNFKELDAKGFMYKRNIEQGALDWVGPGYLNSFYDPYAKEARDIYWRQVKDNLKGLGVDAWWMDADEPDLHSNVDVAERTLRMGPTAMGPGAEFFNSYPLVHTTGVFEGERELDPNKRSFILSRSGFGGIQRNGVALWSGDVVARWDDFRDQISAGVNLSMSGVPNWTTDIGGFSVEDRYLRKEAQHWPEWQELNLRWFQFGAFSPLFRSHGEEPFREIWNLADEGTPVYESLVWYNKLRYRLMPYTLTLAGETYHRDGSMMRGLVMDFPNDLKVRNIDDQYLYGPAFLVAPVTQFKARSRAVYLPAGTTWYDFETGKAHAGGQTIQAAAPLNRMPLFVKAGAIVPTTEVQQYVGEKPNLPITLVIYAGQDGKYELYEDDGLSTAYQRGAYSRIPISYDDATGRVVIGARSGKFDGMQDKRIFKIRFIGGGAKPTDFDAAGDATVAYEGQPVVVVARKH

SEQ ID NO: 16825 - protein, 515 aa, Caulobacter crescentus
MGFTAEARSPVVATTNGKVRGYLDGEVSVFKGLRYGADTGGARRFMPPVKPEPWTEVKDALAYGPASMQTGKGEEGETLSEDCLFLNVWTPARASRKTGLADGAKRPVMFYIHGGAYNGGSGASPWYEGTKLAKRGDVVVVTVNHRLNAFGYLYLARLFNAPSVADSGNVGQLDLVLALQWVRDNIARFGGDPDCVMLFGQSGGGAKIATLMAMPSAKGLFHRAATMSGQQVTVGGPFNATRRAKAFLDKLGVKDLAALRALPAAEMLAGLKAVDPIAGSGGVYVGPVLDQRSLLRHPFFPDAAPQSLSIPMMVGNTHDETKGFIGWDAKAFPQTWDEVIARLPGQFAARIDIDPETVVAFYRQTYPNYSPADVFFAASTAGRSWKAAIIQDEERAKAGAPAFAYQVNWRSPIQGGIFGAPHTIDIGLVFGTLDAKGSIVGTGPDSVAMSNTMSDAFIAFARTGDPNGGALPKWEPYTLPRRQTMVFDTVSRLEDDPRGVEREFFNRVPFTQFGT

SEQ ID NO: 16826 - protein, 1029 aa, Caulobacter crescentus
MTDWDSLDAGKYRDEAAVIADLLAAKPLSSEDRAAVRAEAEALVRGARRSVRKQGVVESFLQEFSLGTREGLALMCLAEALLRTPDDDTRDKLIAEKIGSADWASHLGGSDSLFVNASTWGLMLTGKIVEPDETARNDMPGFIKKLAGRLGEPVIRAAVGQAIRIMGEQFVLGRTIEAAIKRAAAEGDMCSFDMLGEGARTAADAARYEKAYADAIETVGKLSNGAGPEAGHGVSVKLSALCPRYEATHEDRVWEELYPRTLRLAKIAARHNLNFTIDAEEADRLALSLKLLDKLCREPELGDWTGLGLAVQAYQKRCGEVIARLKALSEETGRRLMVRLVKGAYWDSEIKRAQVAGRPDYPVFTTKPATDLSYLVNAKALIEAAPHLYAQFATHNAHTLAAVVRMAKNTGVKIEHQRLHGMGEALYKAADDLYDGITLRAYAPVGGHEDLLPYLVRRLLENGANTSFVHALLDERVPVEKVVTDPIDTVEAHPDRHAKIPTPINVYGERRVNSAGLDLSVKADRERLSAAVAAQDGVTLSAGPLVGGKVVAGGAPLPLIAPANDQKTVGVVSEAQSAQIDEAFKLARAAQPAWDRAGGVARAQVLRAMGDALEANIERLIALLSREAGKTLSDGIAEVREAVDFCRYYAMLAEDQFGEAEILKGPVGETNSLRLAGRGVFVCISPWNFPLAIFTGQIAAALAAGNAVLAKPAEQTPLIAFEAVKLYHAAGLDPRLLALLPGRGETVGAALTSHEDLDGVAFTGGTDTAWRINQTLAARQGPIVPFIAETGGLNGMFVDTTAQREQVIDDVIVSAFGSAGQRCSALRLLFLPHDTADHIIEGLKGAMDALVLGDPALAVTDVGPVIDAEAKDALDKHLVRLKSDAKVLHALAAPAGGTFFAPVLAEIPTADFLEREVFGPVLHVVRYKPENLEKVAGALAARRYGLTLGIHSRIESFAADVQRLVPAGNAYVNRSMTGAVVGVQPFGGEGLSGTGPKAGGPHALLRFAVERALSVNITAQGGDPALLNL

SEQ ID NO: 16827 - protein, 519 aa, Caulobacter crescentus
MVVRTTACALIPVTLMSPATKGPTRTSRASTGRYGPMGRTPVASVSNAGPSAGMSADGGKVNMTFVAAIVAVATIGGFMFGYDSGVINGTQEGLESAFNLSKLGTGLNVGAILIGCAIGAFAAGRLADVWGRRTVMIISALLFVISAIGTGAAESSIVFIIFRLIGGLGVGAASVLCPVYISEVTPANIRGRLSSVQQIMIITGLTGAFVANYALAHTAGSSTAEFWLGLPAWRWMFWMQIIPAGVFFLCLLGIPESPRYLVAKGKDAQAEAILSRLFGAGQGAKKVEEIRASLSADHKPTFSDLLDPTTKKLRVILWAGLVLAVFQQLVGINIVFYYGSVLWQSVGFTEDDSLKINILSGTLSILACLLAIGLIDKIGRKPLLLIGSAGMAVTLGVLTWCFSTATTVNGALTLGDQIGLTALIAANLYVIFFNLSWGPVMWVMLGEMFPNQMRGSALAVCGFAQWIANFAISVSFPALAAASLPMTYGFYALSAVVSFFLVQKLVHETRGKELEAMQG

SEQ ID NO: 16828 - protein, 289 aa, Caulobacter crescentus
MTAQVTCVWDLKATLGEGPIWHGDTLWFVDIKQRKIHNYHPATGERFSFDAPDQVTFLAPIVGATGFVVGLKTGIHRFHPATGFSLLLEVEDAALNNRPNDATVDAQGRLWFGTMHDGEENNSGSLYRMDLTGVARMDRDICITNGPCVSPDGKTFYHTDTLEKTIYAFDLAEDGLLSNKRVFVQFALGDDVYPDGSVVDSEGYLWTALWGGFGAVRFSPQGDAVTRIELPAPNVTKPCFGGPDLKTLYFTTARKGLSDETLAQYPLAGGVFAVPVDVAGQPQHEVRLV

SEQ ID NO: 16829 - protein, 248 aa, Caulobacter crescentus
MSSAIYPSLKGKRVVITGGGSGIGAGLTAGFARQGAEVIFLDIADEDSRALEAELAGSPIPPVYKRCDLMNLEAIKAVFAEIGDVDVLVNNAGNDDRHKLADVTGAYWDERINVNLRHMLFCTQAVAPGMKKRGGGAVINFGSISWHLGLEDLVLYETAKAGIEGMTRALARELGPDDIRVTCVVPGNVKTKRQEKWYTPEGEAQIVAAQCLKGRIVPENVAALVLFLASDDASLCTGHEYWIDAGWR

SEQ ID NO: 16830 - protein, 478 aa, Caulobacter crescentus
MTDTLRHYIGGERVAADAPAESLNPSNTNDVVAKVPMGGQAEVDAAVDAARKAFPAWADASPEVRSDLLDKVGSTIIARSADIGRLLAREEGKTLAEGIGETVRAGRIFKYFAGEALRRHGQNLESTRPGVEIQTYRQAVGVYGLITPWNFPIAIPAWKAAPALAFGNTVVIKPAGPTPATANVLADIMAECGAPAGVFNMLFGRGSMGDALIKHKDVDGVSFTGSQGVGAQVAAAAVARQARVQLEMGGKNPLIVLDDADLERAVAIALDGSFFATGQRCTASSRLIVQDGIHDKFVALLAEKVAALRVGDALDPNTQIGPAVSEDQMETSYRYIDIAASEGGRVVTGGDRIKLDNPGWYVRPTLIADTQAGMRINNEEVFGPVASTIRVKSYEEALEIANGVEFGLSAGIATTSLKHARHFQRYARAGMTMVNLATAGVDYHVPFGGTKSSSYGAREQGFAAVEFFTQTKTSYSWS

SEQ ID NO: 16831 - protein, 476 aa, Caulobacter crescentus
MTQFSDLGLAKPLLKALAEKGYKEPTPIQAQAIPVVLQGKDLLGIAQTGTGKTAAFALPILQRLAEDRKPAPRRGCRCLVLSPTRELATQIAENFKAYAVHMGLSVHTIYGGVKYGPQMKALAGGIDVLVATPGRLMDHMAEKSAIVSGTEIFVLDEADQMLDLGFVVPIRKIAAQLTKNRQNLFFSATMPSEIGKLAGELLNNPVQVSVAPQATTVERIDQRVLFIEAQRKRPLLAELFADTSFSRTIVFTRTKRGADRVAKYLNAAGIEAASIHGDKTQGQRERALAAFKAGEMRALVATDIAARGIDVNDVSHVINYELPNVPEAYVHRIGRTARKGKDGIAISFCADDERNLLKDIQKATRQTIPSFDRRNDKQLAAAAAVADKLVPAEKYVDPRKADPRNNVPSELRRKRNRNGGGGGGGRAEGAQKAQGRGPGQGKAGAKPGQKAGPGQNEFRGPKRQSATAEKRWSPID

SEQ ID NO: 16832 - protein, 415 aa, Caulobacter crescentus
MSRLVMKFGGTSVADLERIRRVARLVAAEVATGKQVAVVVSAMSGKTNELVAWTDGAGRAAAGLPESDDEYDAVVASGEQVTAGLLAMTLRNMGHKARSFLGWQVPILTDEAHGRARIEEIPPENLEECFANGEIAVIAGFQGVTPNRRITTLGRGGSDTSAVAIAAAVKGDCDIYTDVDGVYTTDPRIESKARRLAKISYEEMLEMASLGAKVLQTRSVEMAMAHRVPVRVLSSFVEPGEAPGQGTIVCDEEEIMEKRIVSGVAYSRDEAKITLLGLPDHPGVSSQIFGRLAEANVNVDMIVQSRARSADTANMEFTVGKRDATRAVEIVQAAQKEIGFEAVAVNEDVAKVSVIGVGMRSHAGVAQSMFQALAEKNINIQVISTSEIKISVLIDAAYTELAVRALHAVYGLDQL

SEQ ID NO: 16833 - protein, 754 aa, Caulobacter crescentus
MAASGIAVRGPRSLLRQIREAMAGAGPAQGKLDVVVRTIAISMVAEVCSIYLRRASGDLELFATEGLAREAVHVTRLKPGEGLVGETMRLGRPLNLSDAASHPSFSYRPETGEDPYHAFLAVPLLRGGRAIGVLVVQNRTERNYDEEEVEDLQIIAMVLAEMVSSSELLGADELKDVELAPHKPERLKGSRFAEGLAYGVAVLHEQPVAPETLLSDDALAEEARLTYAIEALQTQIDQMLEGQHGLVGASYEVLETYRLFAHDRGWNRSLQEAVRSGLTAEAAVERVRSEHRARLGQARDPYLRERLHDLEDLNDRLLRHLSGDVHHVRQLPEDAILIARNLGPADLLEYDRTKLKGILLEEGSAASHAGIVARALDIPCVGRLVGLRDRVNEGDPVVVDAETQEAWLRPRPDVVKALKARMEVRAQRKAEFARLRDTPPITKDGSKVTLLMNAGLAVDLDILGETGAEGIGLFRTEFQFMVAEELPRLEAQTALYEKVLDAANGMPVTFRTLDLGGDKLLPYMELEREDNPALGWRAVRMGLDRPALLRMQIRALIKAANGRPLRIMFPLVANVDEFRAARSFVDQEVAWALKRGRPAPARLDVGAMIEAPSLLWHLDALLPMTDFVSVGTNDLMQYMFAADRGNPRVSDRYDPLSPAALRALKTIQQACADTGTQVSVCGEMAGRPLEAFALVALGFDRLSMPPAGIGPVKQMVLSLDREAARRNVEALLKGSGGSLRGEIETLARKLYVAV

SEQ ID NO: 16834 - protein, 859 aa, Caulobacter crescentus
MNIDLYSDRAKQAVQSAQSLALARGHQQFAPEHILKVLLEEKDGLSRALIQSAGGRPDQLDGGVETLLAKTPRVDGAGGQLYMKPDTARVFAEAEKSAKAAGDAFVTTERLLIAIAKEGGEAAKLFKEAGVSAQSLETAANAMRKGRTADSANAEEGYEALKRYARDLTAAARDGKLDPVIGRDEEIRRTIQVLSRRTKNNPVLIGEPGVGKTAIVEGLALRIVNGDVPESLKDKKLLSLDMGSLIAGAKYRGEFEERLKAVLGEVTAAEGSIILFIDEMHTLVGAGKGDGAMDASNLLKPALARGELHCVGATTLDEYRKHVEKDAALARRFQPVFVSEPTVEDTVSILRGLKEKYEVHHGVRISDSAIVAAATLSNRYIADRFLPDKAIDLVDEASSRVRMQIDSKPEELDEIDRRLVQLKIEREALSKETDAASKQRLENLEVEIDDLQFRSDEMTARWKAEKEKVGGAAQAREALDRLRADLANAQRAGDFARAGQIQYGEIPALERRLAEAEAGDTQALTPEVVDAEQIAAVVSRWTGVPVEKMLEGEREKLLKMEDELRGRVVGQDEALEAVSDAVRRARAGLQDPSKPIGSFLFLGPTGVGKTELTKSLAEFLFADEAAITRMDMSEYMEKHSVSRLIGAPPGYVGYDEGGALTEAIRRRPYQVVLFDEIEKAHPDVFNVLLQVLDDGRLTDGQGRTVDFRNTLIIMTSNLGAEYLASQEDGEDVEAVRPMVMNTVRGHFRPEFLNRIDEIILFKRLSRHNMGDIVRIQLQRVEKLLADRRMALALDAEALNWLADKGYDPVYGARPLKRVIQKELVDPIAKKLLAGEIEDGGVIAVGVTDGQLSFGKAVLQ

SEQ ID NO: 16835 - protein, 395 aa, Caulobacter crescentus
MSAADPVVIVAYARTPMGGFQGALGGVKATDLGATAVKAAIERAGVAGDKVEQIIMGCVLPAGLGQAPARQAALGAGLPLSVEATTVNKMCGSGMQAAIMAHDALAAGSVDVVVAGGMESMTGAPYLMSKHRAGARIGHDQMWDSMYLDGLEDAYTPGKLMGAFAEDSAQTYQFTREAMDDYATRGLMKAKAAVESGAFKAEITPVSVVTRKGTEVVDTDEQPGKADPAKIPTLRPAFSRDGGVTAANSSSISDGAAALVMTRESVAKALGLPILAKVVSHAAHAHEPGLFTTAPVPAMQKALKKAGWSVADVDLFEVNEAFAVVAMIAQKELGIPDDKLNVNGGACALGHPIGASGARILCTLINALQSRGGKKGLASLCIGGGEATAMAIELV

SEQ ID NO: 16836 - protein, 586 aa, Caulobacter crescentus
MGWLAKAWSDERLDEVAADTYRLTLSRLISAALVAVIMVFALGPAIATGWLLSLYIGEGLALLVTRRFKDGRTGTPRERAWFAWASIPINISWTTLAILLWLHGEDLMKIAAVAIWCGQVIYTQNFRHQSAALLLLNGLTPMASLLIFPFFFMPDASAAAQTARWGLVLLVGTTLNVMIQNRAAARRMDELTRGLREEREKALEAARAKSTFIAVTSHELRTPMNGLLGMAHALQRSTLDPVQREQIALMIKSGDSLMQLLNDVLDLSRVETGKVELAPIDMSLQDLVGEVVDAWRDAAVFKNLSLSVDYAPDLPPGVHADPLRIRQVVTNLVSNAIKFTVDGGVRLEVAARPANGGDQRVSITVADTGPGVPADAMERVFDSFTQADQTISREHGGAGLGLSIARALARQMGGDLVLVPSGRGACFVFTFAAPACAAPVAAPEEVGANGDALGPLQVLMAEDNAINQLVVRTMLEPLGVALTVVENGQEALEAMAERRFHCVLMDINMPVMDGITALEAIRDGRTGNPAMPVIALTASAMTGDRERFLGLGFDDHLGKPVKPVDLITAIAKAVNPEPPNAGRRAA

SEQ ID NO: 16837 - protein, 512 aa, Caulobacter crescentus
MHPYLHAQSQGDKAAYIMAGSGEVVTYAQLDARSNQGAHLFRSLGLVPGDVIAILMENNARFFEVAWAAQRSGLYFVCISTKLTASEAEYILQDCGAKVFITSTAMGPMIDEIAALVPGLSLFTVGGAHGPYADFVAAREGRPTTPIADESAGTDMLYSSGTTGRPKGVKPALSGGPIDAPNALQMMAQGLFGFSGDSIYLSPAPLYHAAPLRWCMTVHKLGGTVIVMEKFEPETALALIEQHRVNCGQFVPTHFVRMLKLPEAVRAKYDVSSMKSAVHAAAPCPIPVKEQMIAWWGPVIFEYYAGTEGNGFCWINSQNWLTHKGSVGQAVLGELRICDEAGDPVPPRTEGTVYFANGPAVNYHNAPDKTAESYNKHGWTTLGDVGWADEDGFLYLTDRKSFMIISGGVNIYPQEIENLLITHPKVADAAVVGAPHEEMGEQVVAVIQPMDLGDDQVALAEELMAFARANLSHVKSPRRIDFMAELPRHPTGKLYKRLIRDAYWGKGESKIV

SEQ ID NO: 16838 - protein, 555 aa, Caulobacter crescentus
MTGIIEADYVIVGAGSAGCVLAARLSENGRYKVVLLEAGGDDRPTKNLSQFASNMMIHIPVGYSSTLKDPKVNWLFTTEPDPGTGGRSHVWPRGKVLGGSSSINAMLYVRGQAADYDGWRQLGCEGWAWDDVLPYFRKAQNQERGACDLHATGGPLNVADMRDAHPISEALIEACDQAGIPRYPDLNGADQEGATWYQVTQKNGARCSSAVAYLHPAMKRPNLRVETNALAGRVLFEGKRAVGVEFMQNGERRAAMARGEVILAGGAINSPQLLQLSGVGAGGLLREHGIEVVADLPGVGENLQDHYIVAARYRLKSGTVSVNEQSKGGRLAAEAMKYLLFRKGLLTLSAAHVAAFCKSRPDLAGPDIQFHILPATMDLDKLFNEQKMELEGAPGMTIAPCQLRPESRGYIRIKSADPSVYPAIFANYLADPLDQEVIVAGLKWARKIGQQPAIAQYVESEMNPGLEVQTDEQLLDFARQTGSTLYHPVGSCQMGTGPMAVVDAQLRVRGVEGLRVVDASIMPRLISGNTNAPSIMIGEKGADMILAAARQPVAA

SEQ ID NO: 16839 - protein, 303 aa, Caulobacter crescentus
MTVFVLGSINLDAVARVDDLPRPGETVAGLSLELFLGGKGANQAVAAARMGVATRLMGAVGGDDSGAGLKAKLAGYGVQVGDVVELPGVPTGQAHVWVANSAENMIVVTAGANAMVTPQQVAATTIEGQRVLLCQLETPATAIETLFRAGSAKGALRILNAAPALPQGAALFPLTDILIVNQTELATYAKLDREPVKLEEVSVAARKLMSRPDQTIIVTLGAAGAAVVRRDEAFLVEGKKVKAVDTVGAGDCFCGALAATLAAGMDLAEAVETANAAAALSVQKAGAAPSMPNRREVEAFLEG

SEQ ID NO: 16840 - protein, 509 aa, Caulobacter crescentus
MTELVLNPGAVPLAEWKAIYRGASARLAESAWPVIAESAAAVQRILAKGEPVYGINTGFGKLASVRIGDADLETLQRNIVLSHAAGVGEPSPVPVIRLMMALKLASLAQGASGVRVETVRMLEEMLVEGLTPVVPCQGSVGASGDLAPLSHMAATMIGVGEIFVGGQRLPAAQALAQAGLEPLTLGPKEGLALLNGTQFSTANALAGLFEAERLFQSALVTGALSTEAAKGSDTPFDPRIHTLRRHVGQIETAAALRALMSASEIRASHLKEDERVQDPYCLRCQPQVMGAALDILRQAATTLATEANCVSDNPLIFPEADEALSGGNFHAEPVAFAADMIALAVCEIGSIAERRIAMLVDPALSGLPAFLTPKPGLNSGFMIPQVTAAALVSENKQRAYPASVDSIPTSANQEDHVSMAAHGARRLLAMVENADAVLGIELLAAAQGCDFHAPLRSSAALEAVRALTRSKVPHLSDDRHFHPDMEAANTLVRSGAVIAAVGALPGVTA

SEQ ID NO: 16841 - protein, 530 aa, Caulobacter crescentus
MSDAIDFDRMNTLGDVPRYHAEARPDAVAFSFEGRETTFAQLDRHTNQVANALLAAGLSTGDRIAYVGKNSDHYFELLLGAAKAGVVTTPIGWRLAAPEIAYIVGDSEAKLVFVGRELIGHVDAVAAELTHRPVVIAMEAEGAGDYQTFEGWRDAASDVDPHKPIQISDIAIQLYTSGTTGRPKGAMLTHHNLLGMRREAAKNPLEWNQWGPSDVSLVAMPVAHIGGTGWGLVGLINGAKGVVAREFDPTKVLDFIEKDRISKMFMVPAALQIVVRLPRAREVDYSRLTHILYGAAPIPLDLLRECMEVFGCGFVQQYGMTETTGTVVYLPPEDHDPAGNKRMRAAGLPMPGVELKIIDEAGKSLPPNTVGEVAVRSSANMAGYWKLDEATAKTMDADGWLRTGDAGYLDEDGYLFIHDRVKDMIISGGENIYPAEVESAVYGHPHVAEVAVIGVPDDKWGEAVKAVVAPKPGVTPDADDIIAFARTRIAHFKAPKSVDFIPALPRNASGKILRRELRAPYWEGRERQVN

SEQ ID NO: 16842 - protein, 217 aa, Caulobacter crescentus
MLSLHKTLEMPSADTALPGRAAPIPTAQTHFVNGHALKGPYPEGLETAIVAMGCFWGVERVFWKVPGVYVTAAGYAAGITPNPTYEEVCTGRTGHTEVVLVVFDPKVVTYEALLKTFWENHDPTQGMRQGNDIGTQYRSGLYVTSDAQAAAAAESKAAYQQALSARGLGTITTEIAPAGPFYFAEDYHQQYLAKNPNGYCGIGGTGVVCPIGLGVEG

SEQ ID NO: 16843 - protein, 578 aa, Caulobacter crescentus
MFKRSGAKPTILDQAVLVARPAVITAMVFSFFINILALVSPLYMLQVYDRVLTSRNVSTLIVLTVICVFLFLVYGLLEALRTQVLVRGGLKFDGVARDPIFKSVLDSTLSRKGIGGQAFRDMDQVREFMTGGLIAFCDAPWTPVFVIVSWMLHPFFGILAIIACIIIFGLAVMNDNATKNPIQMATMASIAAQNDAGSTLRNAEVMKAMGMWGGLQARWRARRDEQVAWQAAASDAGGAVMSGIKVFRNIVQTLILGGGAYLAIDGKISAGAMIAGSILVGRALAPIEGAVGQWKNYIGARGAWDRLQTMLREEKSADDHMPLPEPRGVLSAEAASILPPGAQQPTMRQASFRIDAGAAVALVGPSAAGKSSLLRGIVGVWPCAAGVIRLDGYDIKQWDPEKLGRHVGYLPQDIELFSGTVAQNIARFTEFESQEVIEAATLAGVHEMIQSLPMGYDTAIGEGGASLSGGQRQRLALARAVFRMPALLVLDEPNASLDQVGEVALMEAMKRLKAAKRTVIFATHKVNLLAQADYIMVINQGVISDFGERDPMLAKLTGAAPPQTPPPTPPPAPLQRVQ

SEQ ID NO: 16844 - protein, 325 aa, Caulobacter crescentus
MAKTALITGVTGQDGAYLAKLLLEKGYTVHGMLRRSASADVIGDRLRWIGVYDDIQFELGDLLDEGGLARLMRRLQPDEVYNLAAQSFVGASWDQPHLTGSVTGLGTTNMLEAVRLECPQARFYQASSSEMYGLVQHPIQSETTPFYPRSPYAVAKLYAHWMTVNYRESFGLHASAGILFNHESPLRGIEFVTRKVTDAVAAIKLGQQKTVDLGNLDAKRDWGHAKDYVEAMWLMLQQETPDDYVVATGKTWTVRQMCEVAFAHVGLNYQDHVTINPKFLRPAEVDLLLGDPAKAKAKLGWEPKTTMQQMIAEMVDADIARRSRN

SEQ ID NO: 16845 - protein, 357 aa, Caulobacter crescentus
MTDLNTLEADVLAQVAAASDLQALDAVRVAAVGKTGSISGLLKTLGAMSPEERKTQGAAINALRDKVQDAITQKKAALEAAELDARLASETLDLSLPAPYRRKGSVHPTMQTMDEVVAIFAEMGFAVAEGPDIEDDFHNFTALNFPEKHPAREMHDTFFFNPKEDGERMLLRTHTSPVQVRTMVSQKPPIRIIAPGRTYRCDNDATHTPVFHQVEGLVIDKGIHMGHLKWTLETFLARFFETDAVTTQFRPHHFPFTEPSAEMDVQCDRSGGEIKIGQGTSWLEILGCGMVHPNVLRACGIDPDEYQGFAFGMGVDRLGMLKYGMPDLRDMWSSDVRWLSHYGFSAFAAPNPASGLS

SEQ ID NO: 16846 - protein, 308 aa, Caulobacter crescentus
MVRITVLGECMVELSPEAGDGGAPLYRMGFAGDTFNTAIYMARLGDQVAYCTALGQGDPFSEGVLAAMRREGMDTQLVRQVENRLPGLYAIVLDEHGERKFHYWRERAPIRDLFSAHTADQLIEAAKASDLVYLSGVTLAVIGDIGRARLRDILAYVHSHGVAVALDFNYRPALWPSAEAARAALDGVVPACRYISLSSEDSRPLYGREAEDLAAEWAAAGAEVVARDESHAVNVHTPEGRTATPAPARVKAVDTTGAGDSFNAAYLSSRLAGAAIPDAVARAHALAGIVVSHRGAIVPPEIGLAPLG

SEQ ID NO: 16847 - protein, 409 aa, Caulobacter crescentus
MATETSDKPALARRSFLRSAAFLATAAPIMTEASLAYAAQTPAPPSGMALHGQSANAPPSGMVLINANENPLGPSKAACDAIARVAPLGGRYDLTGETELLTKTIAAQSGLKPEFIAVYAGSSEPLHYSVLAFTSPTKSFVTADPSYEAGMFAARTSQAKIIKTPLTSAFAHDVKAMVAADAQAGVIYICNPNNPTGTLTTKKDIVWALENKPAGSILLVDEAYIHLTDEPDTLDLVAQGKDLIVLRTFSKIYGMAGIRCGFAAGRPDLLAKLKPFGQNAMPITGSAAARASLEDPKLVPERRKMIGDTRRDTIAWLKTNGYKVIGDPQTNCFMIDTGRNGRAVMAAMKARNVMIGRTWPIWPNAVRVSVGTPEEMAAFKVAFKAVMDGPPLAEADHVQLAQLDGYVAL

SEQ ID NO: 16848 - protein, 534 aa, Caulobacter crescentus
MSGSDASPAASVLTRRRFFESLAAVGGMSLVLSGMEALGFSQASATELPPTLTGGAKNTKVIILGAGLAGMTAAYEMSKAGYQVQILEARDYAGGRCQTARKGFKHTDLLGNTQVCEFDDGHYINHGAWRIPYHHRSTLHYTKSFGVLLESFVNDNDASYVYFEKGKGPLNGKPVRKGEIAADVRGYTAELVAKAASAGALDAPLSGVDRERFVAYLVNEGRLSKSDLTYKGTEGRGFSVHPGAGVNPGPGKELEPFAFKDVLDSNAWRVLSSVTGYEQQRTMLQPIGGMDQIAKAFEKRVAPMIRYSTVVQKIKQSPTGVTVSFKGPDGKLGEVTADYCVCTIPLSVLKQIDLDASAPFKAAMEGVAYAPVNKIGLQMKSRFWEDRHHIYGGHIYTDLAGIGSISLPSYGWQAQKGVLLGYYAFGGEAARISAKSPADRAAFAVAGGQKVFPEYAENFENAFSFSWHLAEHNLGGWAEWGENGRKEAYPILCEPDGRLYLAGEHLSYLGGWQAGAIESAWQQIAKIHARVQQA

SEQ ID NO: 16849 - protein, 2479 aa, Caulobacter crescentus
MGASTSKDGRMAISNLSAAQISTLSVTAIQGLTTTDIQALNGTQIAAISATGIGALATTQVAALSTTQVKALTATQIPKFATSVVFDVTQLTQLSTQQVSALTSTQLAALDTSHIAVLSATQLGALSATNFSGFDTTQVGQLNETQVKGLTASQIRGLTTTDIGELAGTQVAALAADRVAALSVTNLSALDATQVGALSTTQVAALSTTQMKGLSTTDIGELATTQVAALSAAQVGALTATNFSALSATQVGALSVTQVRGVTVDQIKALTTTDIGELADTQVGALNTSQIGALVTTQAQQLSTTQLAVLASTQVAALGATNFSALNATQVGSLSETQLKGLTTSQLAALTTTDIGELADTQIAALSATQIGSITATAISALNATQVAALSTTQVKGLTTTQLKGLSTTDIGELADTQIGALATSQLAGVTATNVSALSATQAAALSVTQVKGLTADQLKGLSTTDIGELADTQVAALSADQIKNLSATNVSALSQTQVSALTNTQVAGLTTTQLKGLSVTDVEELSATQVGALTTAQIGSLASTQVQELSTTQIGGLSSTQVGALTATNLSLLDATQLGALTTTQLKGLTNAQMAGLTTTNVSNLADTQVGALSSTQLGALTATGFSTLNGTQVAALSETQVKGLTATQLKGLTTTDIGELATTQLAALSTAQLGALTATNVSALNATQTAALTTTQVKGLTADQLKGLSTTDIGELADTQIAALTADQIKNLSATNVSALSQTQVAALNATQIKGLTATQLQGLTTTDVSELADTQIAALATSQITALSLTNVKSLSTTQVGALSASQVGALSATNFSAFDATQVGALNETQIKGLTTAQLGGLTTTDIGELATTQLAALASTQIGALTPTAFSALDATQTAALTTNQIKGLTATQLKGLSTTDIGELGDTQVGALSATQLGALTATGFSALNGTQVAALTTTQVKGLTADQVKGLTTTDIGELADTQVAALSADQIKNLSATNVSALSQTQIAALSNTQVQALSTTQLKGLTTTDIDELSSTQVGALSAAQITALASTQVQELSTTQIGGLSSTQIGALTPTNFSLMDATQFGALTSTQLKGVTNGQLAALTTTNVGNLADTQVAALSASQLGALNATNFSTLNATQVGALTETQIKGVTATQLKGLTTTDVAELSTTQVAALSAVQIGALSATNVSSLNGTQVAALTTTQVKGLTADQLKGLSTTDVSELANTQIGALTADQIKNLSPTNLSALDATQTAALTVTQLKGLTNTQLAGLSTTDISDLADTQIAALSSAQITALNVQDLTTTQISGLSSTVIGAIGPTKFSAWNATQVAALNATQLKGLTTSQLTSLTTTDIGELADTQVAALTATQLGALSPTGFSALDATQVAALSSTQIKGLTATQLKGLTTTDISQLADTQVAALAATQIGALTATGLSALDATQTAALSATQIKGLSADQLKGLTTTDIGEFSTTQIQALTADQLKNLSATNISALANTQIAALSNTQIQALSTTQLKGLSVTDIDELSATQIGALSAAQIGALATTQVQELSTTQIGGLAATQVAAISTTNLTQLNATQLGALSTTQLKGLTADQLKNLTTTNIGDLADTQVGALSATQLGALTATGFSTLNATQVGALSETQVKGLTATQLKGLTTTDIGELATTQVGALTAVQIGALTTTGFSALNATQVGALTTTQVKGLTADQLKNLTTTDIGELADTQVAALTADQIKNLSTTNISALSATQSAALTSTQIRGLTNTQIQGLSTTDVGDLADTQIAALQTSQLAALATTQAQTLSTTQLGALNATQVGALTTQAFSALDATQVGALTTTQVKGLTNSQLSALTTTDVGQLADTQVGALSATQLGALTATAFSALDATQTAALTTTQVKGLTATQLKGLTTTDIGDLADTQVGALSATQLGALTATGFSSLNATQVAVLSATQIKGLTADQLKGLSTTDIGELSTTQITALTADQLKNLSATNISAMADTQVAALSNTQIQALSTTQLKGLSVTDIDELSATQVGALSAAQIAALASTQIQELSTTQIGGLSATQIGAVSATNVSLLNATQVGALTTTQVKGLTVAQLAGLSTTNIGDLADTQVGALSSTQLGALTATGFSTLNGTQVAALNSTQLKGLTTTQLKGLTTTDISELADTQVAALTAAQIAALSATNVSALNATQVTALTTTQVKGLTVDQLKGLTTTDIGELANTQIGALATSQLVALSTTNLSALNATQMAALTVTQVKGLSVDQVKGLSTTDIGELADTQVGALTNSQIGALATTQAQQLTTTQLSALTGAQLGALTVTAFSTLDATQVGALTSTQVKGLGTTQLAALSTTDIGQFADTQIAALTTQQLGALSATNLSALDATQTAALSTTQLRGLSTTQLKGLSSTDVSDLSATQIGALASTQLGALTTTVINSLTTTQIGQLQTTQISGLTTTQLDFLSTTNIEAMTSTQANALTATQVQSLSDAQVSSYLTVT

SEQ ID NO: 16850 - protein, 387 aa, Caulobacter crescentus
MSLADPELIEALRHTVRSLCRDFPPPYWRGLDREKAYPTDFVAAMTKAGLLGVLIPEEYGGGGLGLTAAAAILEEVHASGGNAAALHAQMYTMGTVLRHGSTAQKETWLPRIADGSIRLQAFGVTEPTAGTDTTSISTFARREGDTYVINGQKVWTSRAEHSDLMVLLARTTPKDQVTRKADGLSVFLVDMRAALGQGLTIKPIATMLNHATTEVFFDNLVIPADSLIGEEGKGFRYILDGMNAERILIGAECLGDAAWLIGKARDYANSRVVFGRPIGQNQGVQFPIARAYAQTHAARLTIYDAAARYDAGQPCGEQANIGKMLASEASWAAADMCLQTHGGFGFAEEYDIERKFRETRLYQVAPISTNLILAYVAEHVLGLPRSY

SEQ ID NO: 16851 - protein, 399 aa, Caulobacter crescentus
MTAAYICDGIRTPIGRYGGSLSKVRADDLAAIPLKALVARNPSLDLAAIDEIVLGSANQAGEDNRNVARMALLLAGYPVSVPGVTVNRLCASGLEAVGYAARAIASGHNDLVIAGGVESMSRAPFVMGKADSAFSRSAEIFDTTIGWRFVNPAMRKLYGVDSMPETAENVATDYGVNREDQDAFALRSQARAAAAQANGFLAGEITPVEIPGKAGPTIVDRDEHPRETTMEALAKLKPIVREGGTVTAGNASGVNDGAVALIIASEDAVKRHGLTPRARITGYASAGVEPRVMGIGPVPAVRKLMAKTGLAIGDFDVVELNEAFAAQGLAVLRQLGLPDDGAHVNANGGAIALGHPLGASGARLVLTALRQLEAIGGQRGLATLCIGVGQGAALAFERV

SEQ ID NO: 16852 - protein, 552 aa, Caulobacter crescentus
MYQYDLIDKEFLADRSAEFRGQVARRLSGELTEDQFKPLRLMNGLYLQLHAYMLRVAIPYGSLNSTQARRLAQIARDFDKGYGHFTTRQNIQFNWIKLKDAPEILDKLAEVDLHAIQTSGNCIRNTTSDPYAGATAEEVDDPRVWSEVIRQWSTLHPEFSFLPRKFKIAITASAKDRTAAKVHDIGLMLRKGRDGTLGFEVIVGGGQGRTPYVGPTINEFLPTDRLLSYLEAVLRVYNRHGRRDNIYKARIKILVAALGAEEFARQVDEEWAKIDAARADLPTAELARIRAAFAKTPFETLPARSDAFETAKANDAAFARFVRNNVKPHKQPGYAIVEVSLKAQEQTPGDASAQQLEVVADLAERFSLNDLRVTHAQNLVLPHVKLDDLPTVFATLQASNLATPNIDLVSDIIACPGLDYCALANARAIPVAQDIARQFADLDRAEKVGELKIKISGCINACGHHHVAHIGILGVDKKGEEFYQLSLGGSGAEDASIGKILGPALPADKVATAVDQLVGAYLNVRNDGERFLDTYRRVGLEPFKEAVYAQAD

SEQ ID NO: 16853 - protein, 244 aa, Caulobacter crescentus
MAYDQTSATAPGLAARLDAELRDAHPSEILRTAHEHFGDKLALVSSFGAESAVLLHLASRVSPGLPVLFLDTGMLFGQTLDYRKNIAAQFGLTDVRDLRPAFADLATQDPNSDLWRTSVDGCCHIRKVLPLDRALGGFDAWITGRKRFHGGDRLSLPVVEEADGKIKFNPLANWSKAELDAYVAEHDLPAHPLVAQGYASVGCWPCTQPSDDGRSGRWAGQEKTECGIHVARAPGVAPNVGGDI

SEQ ID NO: 16854 - protein, 195 aa, Caulobacter crescentus
MALRIYGDSISGNCLKVKWTADRLGIAYDWIETNVLTAETRTSAFMALNPAGQVPLAVFPDGRPLAQSNAIIFHLAEGSDLIPGNAFDRAKMLEWMFWEQYSHEPYIAVARFQVLYLGKPVESLEPRLIERGADALARLETQLQRSTFLVGDKLTLADVALVAYTRVAHEGGFDLSLYPAVEAWVGRVEADLGIR

SEQ ID NO: 16855 - protein, 584 aa, Caulobacter crescentus
MESRFAKLYGADARGPAVLERLKTNLLKAAHARPEPLRALDAARAADPAWLHAPGQTAYTFYVDRFAGDLNGVRGKLDYLTELGVRWLHPLPLLEPRPGDSDGGFAVADYRKVDPRLGTIDDLEALAGDLRQRDMGLILDVVCNHTAREHAWAAKARAGDPAYRDYYIVLPDAQSAAARDRELIDVFPDTAPGSFTYDAAMGGYVWTTFYPFQWDLNYANPAVFAEMLEVLIFLAAKGAQGFRLDSAPFLWKQAGTTCRNLPQTYEIVEAWRAALSIVAPGVVLLAEAIESVEDVLPFFGGEESGCNLAYNNVVMTALWAALADGDAVIARRCLAVAARKPAQGAWLNYVRCHDDLIWNALAAYAPASDLRRWSNAYGNGEGFSRGRAFQTAEGGVPSTNGMAAALAGLTADADGDCLGARRLRLLYGIIHALDGWPLIYMGDEIGLDNDEAYQDDPLRAGDGRWLHRPQMDWSLAERRGEAGALQADLFATFARLGQRARRLATLGVAGPARPVEVSSPAVLAFLRDEGARPFLCVANVSDAPQDFELPPAFAQGAEDVLDGAPSPAGAVSLPPYGITWLVAR

SEQ ID NO: 16856 - protein, 289 aa, Caulobacter crescentus
MKGIILAGGSGTRLHPMTLVTSKQLMPVYDKPMIYYPLSTLMLAGIREILIISTPRDTPNFQALLGDGSQWGLDIQYAVQPSPDGLAQAYVIGADFVGRDPSALILGDNIYFGHGITNLFTRAMARPKGATVFAYHVNDPERYGVVEFDKQMTALSIEEKPKVPKSNWAVTGLYFYDGDVVDIARDLKPSARGELEITDVNRAYLERGDLSVELMGRGYAWLDTGTPDSLLEAAEFVRVLEKRQGFKIACPEEVAYQKGFIDAAQVERLADALGKSAYGSYLRTVIGVR

SEQ ID NO: 16857 - protein, 328 aa, Caulobacter crescentus
MAGLAPSDLGSIETEPTMSSQSTAPPIAILSKVLKRRGPTLALNGLDLDIRPGQCVALLGPNGAGKSTSVALLTGRLRPDAGEAFLFGGDPRTLASRGRMGVMLQSAGLPGALSVREQIDLFRGYYRKPRSLDEVVRLAGLEGLEKRRCGALSGGQQRRVQFALAIAGRPDFLVMDEPTTGMDIDARRALWSAVRSEIARGCAVLLTTHHLDEAEALADRIVVIDHGQVIADGTPEAIKSRVSGVAIRCRTRLSDPELASLARVTGVSRDGGKVTLLTTSAPATLRELLARDETVDDLTVSGASLEDAVDRLVQAGQAAALQRQTKVA

SEQ ID NO: 16858 - protein, 404 aa, Caulobacter crescentus
MGLFDKHLAYRDAYKAIQDVGANPFKVRFDAVHSPTEGVVDGRPTILLGTNNYLGLTFDEQAIAASVKAVQERGTGTTGSRIANGSFESHVELEQELAKFYGRKHAMVFTTGYQANLGVLSTLVGRGDHLILDADSHASIYDGSRLGHAEVIRFRHNDPEDLAKRLRRLGDAPGERLIVVEGIYSMIGDVAPLKEIAAVKREMGGYLLVDEAHSMGVLGATGRGLAEAAGVEEDVDFIVGTFSKSLGAIGGFCVSDHDDFDVMRVICRPYMFTASLPPAVAASTVTALRRMIEQPELRDRLNRNAKRLYDGLTAMGFLTGPSASPIVAATMPDQERAIAMWNGLLQAGVYLNLALPPATPDSRPLLRASVSAAHTDEQIDAVLKTYGEIGAALGVIEPLKRARA

SEQ ID NO: 16859 - protein, 521 aa, Caulobacter crescentus
MLAKARQPKIEANMPVTWAKGPQAPPADGQRPPNIVFILADDLGYNDITLNGGGVAGGTVPTPAIDSIAKEGVTFANGYSGNATCAPSRAAIMTGRYATRFGFEFTPTPVAFSRVVGGHAGDPLHPSRFNQAEVKNMPKDENVLAVPAAEVTIAEALKTKGYHTIHLGKWHLGGVKGSRPEDQGFDESLGFMAGAALFAPVGDPGVVESRQDWDPIDKFLWGAAPFAVQFNGGKLFNPSHYMTDYLTDEAVKAIDANKNRPFFMYLAYNAVHTPLQAPKADYDALSHIKDHRMRVYAAMVRNLDRNVGKVLQALKDRGLDDNTLVIFTSDNGGANYIGLPDINKPYRGWKATFFEGGIKVPFLLRWPEQLPAGAVYRSPVGHVDIFATAAGAAGAPTPKDRVLDGVDLVPFVKGQSSGDPHKAIFWRSGGYKTVLAGGWKLQVAKEPNKTWLFDLSTDPTERQELSKARPEKLREMQAIMAQLDGQMMKPTWPSLISGAFYIDHPGGQKAKPSDEYIYWEN

SEQ ID NO: 16860 - protein, 546 aa, Caulobacter crescentus
MPDRRRFAGRWGNAHMAGNRLFLKKSIASIQKEAAHSQLKRTLGPINLMSLGVGAIIGAGIFVLTGQVASANAGPAIMLSFIVAGIACALAGLCYAELASTMPVSGSAYTYAYGTLGEVFAWIMGWLLVLEYGVAASTVAVGWSGYVVSTLHALGINFPMIQVAGADAPMWATPLIQAVAAPGGGTMFAMTGTLNLVAAIGIAMVSALLVVGVSESANVNNAIVVIKVIVLVTFIAVGAQYINPANWHPFIPEPTGQPGEFGIGGIFRGAAIIFFAYVGFEAVSTAAAEAKNPSRDVPIGILGALIICTLIYMAVAAVMTGVVPFRELASPAPIAVAIDRMGLEWADIPYAAAEGGKLNLLSFAIKIGAITGLSSVMLVLCYGQTRIFYTMARDGLLPKVFAEIHPKFRTPWLGTILLGVVIAIAASFLPISLLGDLVSLGTAVAFSIVCLSVIYLRIKHPDLPRPFKVPGGIFTAAAGIAACLFLPYQNFQPMIVHAMNDNPLPLMILGGYAAVGAIIYIAYGYWHSKLAKGIDITEETDPNSPA

SEQ ID NO: 16861 - protein, 813 aa, Caulobacter crescentus
MLPIENVLPALKAALLANNATVLVAPPGAGKTTAVPLALLDAPWVEGRKIIVLEPRRLAARAAAARMASNLGESVGDTVGFRVRLQSKVSARTRIEVVTEGVFTRMILDDPGLDGVAAVLFDEFHERSLDADLGLAFARDVQSVLREDLRLLIMSATLDGARISSLLNDAPVVESQGRMFPVDTRYLGRDERQRLEERVGRAVERALAEESGSILVFLPGQGEIRRAESWLNERLRRSDVDIAPLYGALEPAAQDRAISPAPAGRRKVVLATSIAETSLTIEGVRVVIDAGQARVPRFDPASGITRLETVRVSRAAADQRRGRAGRTEPGVCYRLWDEPETRSLPAFARPEILEADLSRLALDLARWGTKDPSDLTFLDPPPAAAFAEARTLLMRVQALDAQGDLTAHGKALADLPLPPRLAHMVARGAASGQAREAAEIAAVLTEQGLGGRDVDLRRRLEGLHRDRSPRGRDAMALVERWSRAAGRSSGAKPLEIGLLLAEAYPERVAKARGKPGEFQLAGGRGVYLEPTDPLAREAWLAVGELGGGDSRDRILLAAAVDEAQLRETFADRLVAEDRLETTGGKVRAKRLLRLGKLVLEERLIENPDPAMIAGALLDQVRADGLSALRLGERGRALLDRVAFLRDVDGEAWPDLSESALIERLDEWLEPLLAGRSSLSSLDEGTLYDALKTLVPWDLQRKMDALLPARFEAPTGNSFAIDYSAEGGPRVEVRVGELYGLSEHPSVAGGKVPLTLSLLSPAHRPIQITKDLPGFWKGSWREVKVEMKGRYPRHVWPDDPAAAAPVTRAKPRGT

SEQ ID NO: 16862 - protein, 294 aa, Caulobacter crescentus
MVQSHFKGVIPALVTPFRDGEVDEKAFVALVERQIAGGVHGLVPVGTTGETSTLSHEEHRRVVELCVKTTAGRVPVIAGAGSNSTDEAIELARHAKTVGADACLVVTPYYNRPSQEGMYQHYKAINDAVELPIFVYNVPGRTGVDISNDTLERLAKLPNIVGIKDATGDLTRISFQRLMCGPEWVMLSGDDPTALGYMAHGGHGVISVTSNVAPDACSAFMNACMQGEWEKGLYWQDRLVRLHKALFLDSSPAPTKFAMAQLGLCTEDVRLPITACAEGVRPAILEAMREAGLR

SEQ ID NO: 16863 - protein, 507 aa, Caulobacter crescentus
MTQVFPTPAAHAREILAKLGAPPLPADAGEPVRGPIDGAILGHVVYDDARQIEAKVAAACRAFADWRVVPAPRRGELVRLFGEELRAAKADLAALVTLEAGKIASEAAGEVQEMIDICDFAVGLSRQLHGLTIASERPGHAMRETWHPLGPVAVISAFNFPVAVWAWNACLALVCGDPVIWKPSEKTPLTALATQAILERALARFRDAPQGLSSVVLGARDAGERLARDPRIPLVSATGSTRMGRAVAPMVAERFGRSILELGGNNAMIVTPSADLSLALRAIVFSAAGTAGQRCTSLRRLIVHESLVDKVSDAVEAAFQRLSVGDPRDPKTLLGPLIDKAAYDAFIAAMNQVRAEGGSVAGGERVLIDEHPDAYYVRPALARLPAPAPCMQRETFAPLLHVVPYNSFDMAIAIQNDVPQGLSSCVMTNDVREAERFLAAAGSDCGIANVNIGPSGAEIGGAFGGEKETGGGRESGSDSWKQYMRRQTATVNYSGALPLAQGVRFDL

SEQ ID NO: 16864 - protein, 344 aa, Caulobacter crescentus
MGGGSREDLCHGARTRRGGEAVKSPGGRAPLRVSRPEARDGQRRRTPMAQAKLIDGKAFAADLRAKIAEEVAALKAEHGVTPGLAVVLVGEDPASQVYVRNKGEQTTAAGMYSETHRLPETTTQDELLAVVAKLNADPKIHGVLVQFPVPPHISQMDVVAALSPDKDVDGLTVTNAGRLASGLPALAPCTPTGCMMLIRDAIGDLKGKTAVVIGRSNLMGKPMAQMLLAADCTVTIAHSRSQDLPSIVRQADIVVAAVGRAEMVKADWVKPGAVVIDVGITRFPARDPEAAAAGKTRLVGDVAFDEVREVAGAITPVPGGVGPMTIACLLANTLTAAKRLSGIA

SEQ ID NO: 16865 - protein, 496 aa, Caulobacter crescentus
MAQDLILALDQGTTSTRAILFDRAGTALGDASRPLRQSYPADGWVEHDAEEIYAAAVAVLREVTEASGRMADIAAIGVTNQRETVVVWDRATGRPIHPAIVWQDRRTADVCARLKAEGHEPRVTEVTGLLLDPYFSATKIAWILDKTPGARARAEAGELLCGTMDCWVIWRLTGGAVHATDATNASRTLLFDIGAQAWSSEMLALFNVPSTILPKVLDCVDDYGATQADILGREVPIRGVAGDQQAALMGQGCVAPGQMKATYGTGCFMLINTGTDRAVSRARLLTTVAARVGGKTTYALEGSIFVAGAAIQWLGEGLGITGGPRAAEALARAAKPDHAVVVVPAFTGLGAPWWDAEARGGIFGLTRDAGLPEIAAATFDACALQSRDLIEAMRADAPTAFGEAAQLRIDGGMAKSAWFSQRLADLTGLSVRRASYQETTALGAALFAAVGAGLYGSIEEAAEASPAAETLAPAMDDHVREAAYARWLDAVPRVRL

SEQ ID NO: 16866 - protein, 347 aa, Caulobacter crescentus
MTTRRAMLGAGVALIAGAQGFAAQARGAGSPKIGRIRRLSPELDAVVDANAPIEQLTDGITWAEGPAWVANGSYLLFSDVPGNVMHRWDAKGGKTDFLRPSGYDGPPTKIFREAGTNGAIISTAGELLVCDCGNRAVARIDLSTRKKTLLATTFNGKKFNSPNDLVEVRHGPLKGSLYFTDPPYGLEGGDASPAKEQAFNGVYLLRPNGEVALVDGSLSFPNGVGLSPDGRRLYVAISDPKRPVIMAYDLGADGLPTASRVFFDASDLLKAGGPGLPDGMKVDAQGRLFASGPGCIMILTPDAKLLGVIETGFPAANCVFGEDGGTLFITSNHLVARVRTKTKGLGR

SEQ ID NO: 16867 - protein, 279 aa, Caulobacter crescentus
MALKQFNPTSPGQRGLVLIDRSELHKGRPEKKLVEGLTKSGGRGGNGRIAVRFRGGGAKRLYRLVDFKRRKQGVATVVRLEYDPNRTAFIALIKYQADGELAYILAPQRLKAGDEVVTAEKVDVKPGNASPLRTLPIGTIIHNIELKPAKGGQIARSAGAYAQLVGRDAGYAQIRLNSGELRMVLDTCMATVGAVSNPDHMNQNLGKAGRSRHMGRRPHVRGVAMNPVDHPHGGGEGRTSGGRHPVTPAGKPTKGAKTRVNKATDKFIIRSRHKAKKGR

SEQ ID NO: 16868 - protein, 540 aa, Caulobacter crescentus
MGDEAIHLGDYDYIVVGAGSAGCLLANRLSADPRRRVLLLEAGGDDNWIWFHVPVGYLFAIGNPRADWMLETTPQAGLDGRVLAYPRGKVIGGSSAINAMIYMRGQARDYDGWRQRGLAGWGWPDVLPYFLKHEDHIDPRGEHHRAGGEYRVEHPRVRWDVLDAIRRAGEQAGIAQVDDFNGGDNAGSSYFQVNQRAGRRWSTATAFLKPVLSRPNLRLVKGVEVERLIIDGKRVRGLRGRRGGAAVTASVSGELILAAGAIGSPVILQRSGIGRGETLSRAGVAMVHDLPGVGANLQDHLQIRPVFKVSGVRTLNTDYANLFRRAGMGLDYLLRRSGPLTMAPSQLGMFCRSGPEYESANLEFHFQPLSLDRWGEGLHRFGAVTASVCNLRPSSRGAVSLSGPGLEHSPRIDPNYLATEEDRRVAVESLKWARRIMGQAALAAYAPEAFRPGPEVDGDAALLAAAKALATTIFHPVGTAAMGADGDPLAVLDARLRVRGVEGLRVIDASAMPTITSGNTNAPTVMIAEKGAAMILEDSR

SEQ ID NO: 16869 - protein, 260 aa, Caulobacter crescentus
MSSPLHKLFDLTGRVAIVTGGSRGLGLQIARALAEYGAAVALVARKQGELDAAVAALTAEGRTAVGLVADLGQAGSAQDLTARVLERFGRIDILVNNAGAAWGAPAEDYPLEGWNKVMDLNVTGLFLLTQAVAREAFLKQGKGAVVNVASIEGLQGHHHSQLGTIAYNTAKGAVINMTRALAAEWGPRNIRVNAVAPGYFPSKMTMTTLGQHGDDMLRQTPLGKLGGDTDLMGPALLLASDAGGHITGQIIVVDGGMTII

SEQ ID NO: 16870 - protein, 499 aa, Caulobacter crescentus
MRDIPHFIGGQKVDGASGRFGEVFDPNTGKVQARVALASAGELNTAIANAKVAQAAWAATNPQRRARVMFEFKRLLEVHMDELAALLSSEHGKVIADSKGDIQRGLEVIEFACGVPHLLKGEYTQGAGPGIDVYSMRQPLGVVAGITPFNFPAMIPMWMFGPAIATGNAFILKPSERDPSVPVRLAELMIEAGLPPGVLNVVHGDKDCVEAILDHPDIKAVSFVGSSDIAQSVFQRAGAAGKRVQAMGGAKNHGLVMPDADLDQAVADIIGAAYGSAGERCMALPVVVPVGEKTATALREKLVAAIGGLRVGVSTDPDAHYGPVVSAAHKARIESYIQMGVDEGAELVVDGRGFSLQGHEEGFFVGPTLFDHVKPTSRSYHDEIFGPVLQMVRAESLEEGIALASRHQYGNGVAIFTRNGDAAREFADQVEVGMVGINVPIPVPVAYHSFGGWKRSGFGDLNQYGMDGVRFYTRTKTVTQRWPKGGAVLDQSFVIPTMR

SEQ ID NO: 16871 - protein, 404 aa, Caulobacter crescentus
MNLDFSPEDLAFRDEVRAFIAENYPAGLRDKQEEGEEMAKEDFLSWHRVLANKGWVAPAWPTQYGGPGWTSVQRYIWSEETARADCVPILPFGINMVGPVIYTFGTPEQKERFLPGTLSGDIWWSQGYSEPGAGSDLASLKTKAERFTGDDGKEYYLVNGQKTWTTMAQHGDWIFCLVRTDPNAKIQEGISFLLIDMKSPGVTVRPIITLGGEHEVNEVWFENVKVPVENRIYDENKGWTCAKFLLAHERSGIAGVARSKRGIERIRQIASTELSDDGDALIKDPMFKRKVAELEIDLTALEYTELRTLAGEAAGRGPGPESSVLKIKGTEIQQRLTELALEAAGHYGAPYFRGFPKDGDNAHPIGPEFAHRAAPTYFNVRKTSIYGGSNEIQRNIIAKMVLGL

SEQ ID NO: 16872 - protein, 643 aa, Caulobacter crescentus
MAHRLGDARRWRTDHLADPKGWAMRGLGGPPSPGREAVAGAVAKADQPIRFWKAMSDLLQLVLRSQAPGLRWRLTVALLLTLTGKVLGVLAPLMLGQAVNQLSVGQGVAVTVTLAFASLAIGWALVRFISAAAPQARDTIFTPVAQAAQTRAAVETFAHALSLSIDFHQSKRTGSLSRVIDRGARSMDFLLRGLVFNLAPTGIELILAAVVLAKAYDWRFAAVALVTVAIYGYVTFAISDWRIGHRRALNEADAEAAGRAVDALLNYETVKSFGGEARAVASYERALDTYGRANIKATQSLNLLNLVQSGVMSVGLGVMAVLAGSEAAHGRMGPGDVTAAVLILINLYAPLNILGFAYREIRQSLIDMEAMLDLRRQAADVADAPDAQDLPPCADQRGGAVAFEAVSFRHGARSEGLSEVSLTVAPGSTVAIVGPSGAGKTTLVRLALRMIDPQSGRVTLDGYDLKALKQSSLRRAVALVPQDVALFNDTLAANIAFARPEVGETEVWAAAEAAELGDFIRSLPEGMATKVGERGLKLSGGERQRVGIARALLAEPRVLILDEATSALDSRTEAAIQATLRKARAGRTTLVVAHRLSTIADADEIVVLRRGKIVERGRHEALLAAGGEYAALWRRQTRDRETV

SEQ ID NO: 16873 - protein, 583 aa, Caulobacter crescentus
MTQAAPASVPWPAMSVQQAYALITQPGTPGEMEEVEIRGVKTRTWKNAPPTLRETLLMGRSHGDKIFLVHEDERVNFEAFYRAVTHMAAELESFGVQKGDRVAIVMRNLPEWPVAFYGALSLGAIVTPLNAWWTGPELEYGLVDSGAKVAIVDVERYERMGEHLHNCPDLKRVYVSRAKEEITHPYVIPLESKIGGANDWAKLDEKPLPTVAITADDDATIFYTSGTTGKPKGAIATHRNINSNIFAAAAAGARAFLRRGEAPPQPDPSAPQKGALLSVPFFHATGCFAVLNPSLFAGAKLAMMRKWDPERAMQVIQDEKLTQMGGVPTIAWQIIEHPNRANYDLSSIEAVAYGGAPSAPELVRKIKEIWPKSSPGNGWGMTETSATATSNSAEDYENRPDSCGPAVPVTDLKIMTVEAPYRELPIGEVGELWCKGPQVVRGYWNKPEATAQTFVDGWVRTGDLARLDAEGFCFIIDRAKDMLIRGGENIYCIEVENCLYDHPAVMDAALVGVPHKTLGEEPAAVVTLKPGAEATEAELRAFVADRLAAFKVPVKVVFWPETLPRNANGKIMKNELKKVFVEG

SEQ ID NO: 16874 - protein, 295 aa, Caulobacter crescentus
MSHEIMRLSAFAPAKVNLFLHVGGPDGEGYHPISSLMVFADVGDRVNLQPADAPAFETSGPFGDQIPAGGDNLVVRAGQAFHRRLGGPVPPYRLILEKHLPIAAGLGGGSSDAGAALKLLRDALAPALSDDDLEALAASLGADGAACLRARALIAEGRGERLSPAPRLPELNAVLVNPGAPSPTGAVYRAYDAGVHPDGAAMPPMPDHLESAEEAAAWLAFATRNDLEAPAVRLEPHIGEVLDVLRGEPESLLVRMSGSGATCFALCASDIEAEGLAERLETMRPDWWVRRCRLS

SEQ ID NO: 16875 - protein, 334 aa, Caulobacter crescentus
MTTPPLAPYPHTRLRRVRQSDWVRRLVRETEVRPSDLIWSMVVHEGEGTIPVASMPGVERLSVKEAAKAAVRARDLGIPAIAIFPHIDGSRKDAAGSIAADPDGVIPRAVKAMKDAAPEVGIMCDVALDPFTDHGHDGVVEGGKILNDATIERLIEQGLMQADAGADILAPSDMMDGRIGKLRAALEGANYQDVMIMSYAAKYASAFYGPYRDAIGSAKLSAGQGDKKTYQMDPANTEEAIREVALDIAEGADMVMVKPGMPYLDILRRLVEEFRMPTYAFQVSGEYAMIMAAAQNGWIDKDRAILESLTAFKRAGAAGIITYFAPWAAEKLGA

SEQ ID NO: 16876 - protein, 379 aa, Caulobacter crescentus
MDFALNEDQVAIQDAARAFAEGQLAPHSADWDENKHFPVDVLRQAAELGFAGIYVNEDVGGSGLSRLDASIIFEALSYGDVPVAAYLTIHNMASWMIDRFGSDDLRQRYLPRLTTMELIASYCLTEPGSGSDAAAMRTTAKLDGDHYVLNGGKAFISGGGVSDIYVVMARTGGEGAKGVSAFVVEKGMEGLSFGANERKMGWNAQPTAQVNFDNCRVPVANRIGQEGEGFRFAMMGLDGGRLNIASCSLGGAQFALDTAKAYLETRNQFGRPLKDFQALQFKLADMATELEAARLMVRRAAHALDSKHPEATKLCAMAKRFATDAGFQVANDALQLHGGYGYLQDYPLERLVRDLRVHQILEGTNEIMRVIIAREMFRQ

SEQ ID NO: 16877 - protein, 408 aa, Caulobacter crescentus
MDYKAAFRSAVEQIREEGRYRVFADLKRQRGQFPRATWTRQDGSEHEVVVWCSNDYLGQGQNPVVLEAMKAAVDEHGSGSGGTRNISGTNHDHVLLEQELADLHGKEAGLLFTSGYVSNEATLSVVQKILPGLIIFSDELNHASMIAGIRNGGGPRKIFKHNDLAHLEQLLAEAPADAPKLIAFESVYSMDGDIADLAGTVALAKKYGAMTYLDEVHAVGMYGPRGGGVAERDGLMGEIDIIEGTLGKAFGVMGGYITGDAEVIDAIRLMASGFIFTTSLPPALTAGALASVRWLKQHPEVREIHQERAATLKAMFKAAGLPVMDSVSHIVPVLVGDPVHCKMISDMLLADFGVYVQPINYPTVPRGTERLRFTPTPFHTDDMMRKLVAAMEKLWAHCNVARMGGYAA

SEQ ID NO: 16878 - protein, 322 aa, Caulobacter crescentus
MRSVVTGVGAYLPSKVVTNDDLAKFVDTSDEWIVERTGIRQRHQAADDQPVSDLAFEAAKEALAAAGKTAADVDLIIVATTTGDLTFPATATIVQRKLGAPVGVAFDVQAVCSGFVYAMSVADGFVARGHSKCALVIGAEAMTRLMDWSDRGTCVLFGDGAGAIVLEPGEGEGTTDDRGMLGFALRADGTKQDLLYVDGGPSTTGTVGKLRMLGNQVFKHAVVNISEAIHAAAGKAGVAVADVDWFIPHQANQRILQGVAHRCGIDEEKVISTVAIHANTSAASIPLAFAHGIKDGRIKKGDLLLLEAMGGGLTWGACVVRL

SEQ ID NO: 16879 - protein, 317 aa, Caulobacter crescentus
MANAPKVFIDGEAGTTGLQIRERLVGRTDLQLISIDPDKRKDADARAEMLNSADAVILCLPDDAAKEAVSLVSNPNTVIIDASTAYRTAEGWAYGFAELDSEQRGKIAASKRISNPGCYPTGAIALTRPLVSAGILPAELPVSYNAVSGYTGGGKAMIAQFEDESAADHTRAPYFIYGLSLSHKHVPEMQKHGGLLTRPIFTPAVGRYAQGMIVEMPLHLSTLNGAPSLADIHAALVKHYKGEAFVEVASLDEAKALTTLDPEGLNGTNRLKLFVFGSDAGGQARLVALLDNLGKGASGAAVQNLNIALGLDEAAGL

SEQ ID NO: 16880 - protein, 406 aa, Caulobacter crescentus
MSTDFHRIRRLPPYVFEEVNKIKARLRAEGTDIIDFGMGNPDMPTPQHIVDKLIETARDPKAGRYSASKGVPGLRKAMANYYGRRFGVKLNPDTEVIATLGSKEGFANLAQALTGPGDVIICPNPAYPIHAFGFIMAGGIIRHVPALSPEEYLSNISRAVKHSVPPPSVLILSYPSNPTAQWVDLDFYKDAVALAKKHDLLVISDVAYGEIYFDNNPPPSILQVDGAKDIAVEVNSLSKTYAMAGWRVGMVVGNARICAALARVKSYLDYGAYTPVQVAAATALNGPQDCVDEIRGIYKSRRDTLIKSMKAAGWDIPNPPASMFAWAKIPEAYREAGSMLFSRLLIEEAGVAVAPGIGFGEYGEGYVRIGLVENEHRIRQAARNVKKFIANADSILAKAHNKMEQA

SEQ ID NO: 16881 - protein, 429 aa, Caulobacter crescentus
MTNKTWRVGVAGLGTVGGGLLQFLAERPGFAPAGDLAVVTAVSARSKSRPRTVDISNLVWFDDPVALAASPEIDIFVELVGGSDGPAKAAVETALKAGKPVVTANKALIAEHGAELAALAEATNTPLLFEAAVMGGVPAVKMMREALVGDDIISVAGILNGTCNFILSEMEKTGRSFADVLREAQGLGYAEADPTMDVGGFDAGHKVSILAALAFGCAPNFAAAEIEGISEVDLLDIKLAKDLGYRIKLIAGAAKSEDGVAVKVHPSLVPLDHPLAQAGGALNALFIEGKRIGRIFLQGPGAGAGPTAAAVAADIADVMTKAVRPVFQAPAGDLKPFVSIDPSKAVGKAYLRVMVQDQPGVIAAISETLAECGVSIDSFLQKPVEGAGGVPIVLVTHATPESNLLDAISRIEKLQTVLERPRLLRVARI

SEQ ID NO: 16882 - protein, 336 aa, Caulobacter crescentus
MGRSAFGSRTRMTAFVDLAARLAAEPADAALKDVVLTIAETCAQISRVVASGALSGSLGAAGSTNVQDEEQKKLDVITNDMLSDALKACGPVAGLASEELEEVEPTGRVGGYLVTFDPLDGSSNIDVNVSVGTIFSVLPAPAGHAPTEGDFLQPGRNQVAAGYAVYGPQTMLVVTLSGGVNGFTLSADGRWLLTHPDLAIKPDTAEFAINMSNQRHWAPAVRRYIDGCLQGKDGARGKNFNMRWVASMVADVHRIMMRGGVFMYPWDAREPDKPGKLRLMYEANPMSLLAERAGGKSIEGLNEILDINPAKLHQRVPVVLGSANEVEVIRAEMRAG

SEQ ID NO: 16883 - protein, 369 aa, Caulobacter crescentus
MPSTSTAHLVTLPVPTDDLRIEKLQTLSPPAQVIGEAPATSSVAEIVGGARQAVHQILHGQDDRLVVVIGPCSIHDPKAAIDYARRLAAERERHAGELEVIMRVYFEKPRTTVGWKGLINDPGLDGGFRINDGLRLARRVLLDVSAQGLPAACEFLDVTTPQYIADLVSWGAIGARTTESQIHRELASGLSCPVGFKNGTNGDVKIAVDAVMAASQPHHFLAVTKEGRAAIATTTGNGDCHLVLRGGKTPNYDAASVAAAAEVLSKAGLPQRLMVDVSHANSGKNHENQPAVIADVCAQVATGASPVMGVMIESNLVAGRQDIVQGQGLTYGQSVTDACVDWETSVRLLDDLAGAVRAGRLARGSKSST

SEQ ID NO: 16884 - protein, 724 aa, Caulobacter crescentus
MSHSLALHRDLEAFVRRDDAGRGRFELLVRGARCAGCISKIEKAVRALPGVEAARLNLTTGKLSVELAGKISDPGRVLETVEDLGYRACLFDPAEAEAAQDKEGKELALALGVAGFGAGNVMMFTVPAWAGLFGQELTPATLTLMYWMAAIVATPCALFAGRPFFRSAWASLRRGKANMDVPISIGVILTLIVSFSETLLGGKHAYFDAAVTLLFLLLIGRYLDHRLRAGARSAARDLLALQAPVARRLTDGVEQGVPVADIRVGDLLAVAPGERIPVDGLVEQGASELDNALITGETALAPVAAGARLHAGALNLSGRLVMRASARSEDSTLAAIARLMEAGAQARSTYVRLADKAAALYVPVVHTAAALTFVGGWALGLGPREALLRAAAVLIVTCPCALGLAVPAVQIAASSRLFRRGVLVKSGAALERLAEADHVVFDKTGVLTQGRPALIDAPAHLVAQAAPLARASRHPLARALAAEAGAGPVAQDCVETAGQGVEGVIDGRRARLGRAAFVGVQAGDVRETELWFGFENNVKIRFAFEDRPRADARDTITKLRALGLSVEILSGDVEGPVRDVAREVGVSDWRAGLTPVEKAAAIDALKAQGRKVLMVGDGLNDAAALSKAHASMAPGAAVDAAQNAADLVFTGDELAAVVESIETAREARRRALENFGFSALYNLVATPAAMFGLVNPFVAALAMSGSSIVVLLNAARPRLRSFNR

SEQ ID NO: 16885 - protein, 516 aa, Caulobacter crescentus
MGGKWLGAAIALLAVATSARAGEISATATLRADQSGPAISRYIYGQFSEHLGAGVYDGIWVGPDSKIPNVRGVRSDVVGALKAIKTPVIRWPGGCFADEYHWRDGIGPRDKRPSRKNNWWGGSPETNAFGTHEFMDFAEQVGADPYVAVNVGSSNPTVMREWIEYMTSPGEDTLAQERRANGRDKPWKVPFIGIGNESWGCGGEMTPEYYANEYRRFSSFFHKNSDNPAVRVASGANSFDVNWTDVVTKAAAKRMDAISLHYYTIQTGDWNKKGAATGFDKAAWGKSFAQTLRMDDLLRQHIAVLDRNDPQKRIGLYVDEWGTWYDTEPGTNPGHLYQLNTLRDGVLAAVNFNIFHKHAERVRMANIAQTINVLQAVILTKGDQMVLTPTYYAHQMYMPFQDSTAIPLEITAPEIDVAGSKIPAFNASAAKGKDGKIYVAVANMALDDSVKLNVSLAGLKAKMVSGQVLTADKMDAMNDFGAKPAVVPVPFKGGKLSGDRLTLDIPSKSVVVVRLD

SEQ ID NO: 16886 - protein, 386 aa, Caulobacter crescentus
MDEETRLIHTGSEPARLGRTVNPPIQRGSTVLLPDAASLYDDDQLTYGITGLSTPVALQNALAELEGATNVTLYPSGLAAITGAMLAVLKAGDEVLVVDSAYKPTRRFCDRVLGRFGVTTRYYDPKLSPEALMGLVTSSTRLIVLEAPGSLTFEMQDIPAIAAAANARGVLTLIDNTWAAGLLFKPLAHGVTMSVQALTKYVGGHSDCFMGSVATCDDAVAKLLGDAMWDIGWSVSSDDAYTMLRGLRTLATRLPRHAENGLAIARWLQERPEVARVLHPALPGDAGHAIWKRDFTGACGLFGVVLKPCSQKAVHAFLDSLKLFGLGFSWGGYESLALNCDPQLGARSIPVDLEGPLLRFHIGLEGIEDLKADLRRGFEALNAAKA

SEQ ID NO: 16887 - protein, 285 aa, Caulobacter crescentus
MSTPSDPLVTTAWLAQHLEAPDVRVVDASWHMPAAQRDPHKEFLAAHIPGAVFFDIDEIADESTDLPHMIPSPTKFASRVRKLGLGDGSRIVVYDSTGILPAARVWWHFRAMGHEDVVVLDGGLPKWISEGRPIEDGPAFPQERHFTPRYQADVYRSLDQMRDIVATGREQIVDARAAGRFEGVDPEPRAGLRGGHMPGARNIPLSALIAPDGTMLSAEKLKSVFEAAGVDINKPVVSTCGSGITASVVALALARMGKPRSAVYDGSWTEWGGLADTPVVTGPAQ

SEQ ID NO: 16888 - protein, 400 aa, Caulobacter crescentus
MPQGIRDKVAILGMGCSKFGERWDAGPDDLMVEAYLEAMQDAGIEPTQLDAAWFSTHIDEIGSGKGGTPLSIALRLPNIAVTRVENFCASGSEAFRGAVYAVAAGAADIALAVGVEKLKDTGYGGLPVANPGTLSPQVMPNGSAPGNFAQLASAYRAKHGVSKEDLKRAIAHVSVKSHANGAKNPKAHLRKPITEEQALSAPLIAEPLGLFDCCGVSDGAAAAIVTTPEIARALGKHDLVTVKALQLSVSNGYESQYNGWDGSHFHTARIAAGKAYREAGIERPREQISMMEVHDCFSVTELVTMEDLFISPEGQGWRDVLDGFYDADGGVPCQIDGGLKCFGHPIGASGLRMLYEMYLQLQGRAGERQLANPVFGMTHNLGGAPASNVCSVAIIGQEGA

SEQ ID NO: 16889 - protein, 392 aa, Caulobacter crescentus
MSERGPVSSAARSARIIGTVVLPQAVIAATGLYTPPHSISNAELVEAFNTFVERFNAANAEAIAAGEVVALPPSSPEFIEKASGIKSRFVMDKSGIIDPEIMRPILPERPNEEISILAEMAVEAAKQAIARWGKPVSEIGAVICAASNMQRAYPAMAIEVQQALGIEGFAFDMNVACSSATFGIKTAADFITTGSAKAVLMVNPEICSGHLNFQDRDSHFIFGDVATAVIIEDADQAKGGWEIVGTRLKTQFSNNIRNNFGFLNRAAPEGVGAKDKLFVQEGRKVFREVVPMVSEMIVEHAKDLGVDPTGLKRLWLHQANINMNEMIGRKVLGRDPAPGENVIILDEYANTSSAGSIIAFHSANDDFAPGETGLICSFGAGYSAGTVFVRKR

SEQ ID NO: 16890 - protein, 900 aa, Caulobacter crescentus
MNSKMPVETLTKAQWVYAFGGGGADGDASMKNLLGGKGANLAEMSSLGLPVPPGFTITTEACVHYYANGKQYPAELAEQVQAGLAKIEEITGKQFGDVTNPLLVSVRSGARASMPGMMDTVLNLGLNDETVEGLAKLSGDRRFAYDSYRRFIQMYSNVVLNLEHHMFEEILDDHKDRLDVNVDTGLTADDWAAVIKDYKAAVREQLGKPFPQDAQEQLWGAVGAVFASWMNDRAKFYRRMHDIPESWGTAVNIQSMVFGNMGETSATGVAFTRNPSNGDNRLYGEFLINAQGEDVVAGIRTPQSLTKAAREEMGDTAPSMEEAMPEVFGQFKTVVETLERHYRDMQDIEFTVEQGKLYMLQTRNGKRTAKAALKIAVDMAAEGVISTSEAVGRVEPASLDQLLHPTIDPSAHRDVIAKGLPASPGAATGKIVFNSDAAEKAAANGESVILVREETSPEDIHGMHAARGIITARGGMTSHAAVVARGMGRPCVSGAGDVAIFEKEGLFRVRGRDFRAGEIITIDGSTGDILAGAPKMIEPELTGDFATLMGWADQVRRLKVRANAETPLDAKTARQFGAEGIGLCRTEHMFFDDTRIAAVREMILADDEKGRRAALAKIAPFQKADFVELFTIMEGLPVTIRLLDPPLHEFLPHTEEDVQAVAVATGLDAAKLMRRAKELHETNPMLGHRGCRLGVSYPEIYEMQVRAILEAACEVKKAGKQPPAPEIMHPLVAKGEEMKYLRDLTDRVAKAVLEEQGVALEYTVGTMIELPRAALRAGDLAANAEFFSFGTNDLTQTTFGISRDDAGKFLNAYIEKGIFEKDPFVSLDQDGVGDLIRIAAERGRAVRPNVKLGICGEHGGDPASIGFCEKVGLDYVSCSPYRVPIARLAAAQAAMANKVE

SEQ ID NO: 16891 - protein, 756 aa, Caulobacter crescentus
MPISYLSAAQIAALATTTVQTLSTTKMEGLTRTQVGALSDSAIGVLNATQVSALTSTQVKGLTATQIPAFAQNLLFDVDQLQAFSGAQLNALTSTQLAKLDADRLQALSAIQIGAMDATRFTALDATQIAALSTTQLAQLTTTQIAAFSATDLEELSAEKIASLTGTQISALPADLVPSLQGARLSALSTTQLQRMTATQVAALSTTQIKSLGDTLTALGDTQIGALSSAQTGVLSDAVVAGLTGAQLGALSTQGLSGLSATQVAGLTGTQLAGLKPTQLRALSENNLAEFTAAQMRQFSTAQLSALSTTGLNSLAADRVQVFDATQLTALTTTQIAGLTGDDLAEFTPTQVEVLATTQLAALSPTVLNGLGRDQVHALTATQLKSLSRTQIGGLSETSMAAFTPDQVQVFSTTQLNALSPRAINSLSASQVQALTATQLAGLTTTQIAGLSTTGFDKFSSTQLKAFAPSQLAALEATNFNRLGASTIHALSASQLSAISTTQLNALSETDFARFTTTQVASFSGEQIGALSTTSFNGLSPSQIAALSSTQLAGVSATQMAGLTDTDLAELSTTQFAALTGTQIGGLSTRHLTSLDQTAFQALTAGQVSGLSASQLSTLSMTDMGEFTTTQMAALTPSQMMAISVTNLAALSADQYAALTPSALRGLSSFQLRNISPGAFSQLSQTQVQALNASQLGSLSTAVIASLTTTQVGYLTPTQIPGLTINQLDWLSTTNIAAMTPLQVGAFTPAQVESLG

SEQ ID NO: 16892 - protein, 255 aa, Caulobacter crescentus
MANPFSLEGKVALITGANTGIGQGIAIALAAAGADIAAAGRSAPTETQAAVEALGRKFLSIKADFSSIEPVQRVVDETVAAFGKVDILVNNAGIIRRADSIEFSEADWDAVMDTNLKVVFFLTQAFAKQALKQGFEGGQAKVINIASLLSFQGGIRVPSYTASKSGLAGLTKILANEWATKGINVNAIAPGYFDTNNTEALRADQDRNAAILARIPAGRWGRPEDIGGAAVFLASSASDYVQGITLPVDGGWLAR

SEQ ID NO: 16893 - protein, 909 aa, Caulobacter crescentus
MRNPALSIDVDRPTSRHVRQNAHLLSDLLIEAITYLEGEEKAELVAKARKAASREDVVNGDAPLLDHLFSDLTTEQAVFLARAFASHSLLANIGEDVAGRRRHAEADAQPGDERPRTLIDAVKALKAAGKSDAELAKIFAAMNVVPVLTAHPTEVRRRSMVDRETEISRLMALRRHHLPPDLEAEIRESLFREIALMWRTRLYRPERITVKDEIRNALSIVRTSILPAIIDLYGDWTGKIGQHGQLAPLLKMGSWLGGDRDGHPGVNGQTLKLALSSQSRVILDWYAGEVRKLWSNLAVSTAYTPVSDELLALAAQAKDPSVHRIDEPYRLALELIFDRLTAVSQKLTGAPVAFASGVTSVEPYAHPDAFVADLSVIIDSLERNGGERLVGSALRTLVEVAKACGFHLMSLDLRQNADVHERTLDELFRRAGTGVEYLKLDEDARCKVLIDELSHQRPLVSPFTAYGEETSKELATMEAAAQAVRDYGHGCLGAYIISKSATLSDMLEPLVLLKQVGLVWGGAAPRASVKVAPLFETIGDLENGPAVLRQWLELPLSRTILGDRPVQEIMLGYSDSNKDGGYVASRRGVATGASALAHEADRMGVGLQLFHGRGGSVGRGGGPAAEAVLAQPAGTVQGRIRMTEQGEMIARRFGDQPTARRNLDGLAAAVLMASERPIPKRDPKVEGAMTALAQSSFEGYRALVYDDAAFEDFFWSVTPISEIVGLNIGSRPASRTASRKIEDLRAIPWVFSWSQARFMLPGWYGFASGVERAGLSVEQLRDLAGNFDFFASLLSNMELALAQSQMGIAARYVALSPDKANAERIFATIRREHEAATGLALAIRGGAALLDNQPDLAESVALASRSVDPLNHLQLELLSRRRAGDIDEELRLAIQLTVAGIAAGLRNTG

SEQ ID NO: 16894 - protein, 805 aa, Caulobacter crescentus
MFPDTDSPSPIGDFPGDLPSPRISDLARARPPAGAAPGYLDGLNPEQREAVETTEGPLLVLAGAGTGKTRVLTTRLAHILATGRARPWEILAVTFTNKAAREMRERITHIIGPEAEGLRWLGTFHSVAAQILRRHAELIGLKSNYTIIDTDDNERLLKQLIEAENIDAKRWTPRILSQIIDGWKNRGWTPDRVPTSEAGEFANGKGISLYRQYQERLRILNACDFGDLLLHNISLFTGHPDVLDEFQQRFKYVMVDEYQDTNVAQYLWLRLLAQGRQNVCCVGDDDQSIYGWRGAEVDNILRFERDFPGAKVVRLECNYRSTEHILAAASGLITANKGRLGKTLWTPSKGGEKVKVSGVWDGEAESRLIADEIERAKKAGRKYSQMAILVRASFQMRAFEERFVLLQIPYKVVGGPRFFERAEIRDAHAYLRLIQSPDDDLAFERIVNTPKRGIGDTSVQKLLQIARLGGISTVEAARQIITSDELPARTRTALSNFIRDLDRWRSLVGTAHHQRLLETVLEESGYTDALRLDKGPTSQTRLENLKELVQSMGAFDTLEAYLEHVSLVMDLDREATGDAVWIMTLHSAKGLEFPLVFLPGWEEGVFPSQRSMDDKGEKGLEEERRLAYVGITRAREEARISFVANRQVYGRWTSQLPSRFVDELPIAHVDAASETGYYGGGPGMQSTAASRWDDPGTSAFQAGSYDSPGWKRAQERTSGFGERGGSWRGAQGVRSGSSARSAPIEGEGRLVAVSAPTNSAYARGDRVFHVKFGYGKVTGIEGNKLTVAFDKAGEKKVIDSFVEKA

SEQ ID NO: 16895 - protein, 211 aa, Caulobacter crescentus
MYTLYGSPSTAGTAIHWMLLELGVPFDLKMLDFDKGEHKTAEYLALNPDGVVPTLIVDGRPVTQMAALLTLLAERHPEAGFAPTPGSADRAAYLSWSFWLANSFQPHFRAWFYSHEPAGGDAQEAVQAAARARIEAGLARLDAHLADQDYMVGKGFTTVDLLVTILCRWSRNMPKPATEWPNLKRYLDRIRQRPALREAHTREGLTDWIDG

SEQ ID NO: 16896 - protein, 275 aa, Caulobacter crescentus
MELDAYFRRIGYDGPREPTLDTLRAIAFRHPDAIPFENLDVLLGRGISIVPSDVDAKLIGAGRGGYCYEQNGLLKRVLQALGFQVEGLMARVLWMAPEGAPPRPRSHQVLGVTIDGETWLADAGFGGCVLTAPLRLFSDEVQDSPHGKFRIVDTQTNGVAERQVQADLSGRWAPLYQVSQGAWAEVDYEQANFYTYTHPSSHFTWSMTVGRTTPTARYALKNNRFTHRDVTGAVVEQRDLTVDELEATLRQVIGLPVEADWRPVLEQVVAWGTPA

SEQ ID NO: 16897 - protein, 255 aa, Caulobacter crescentus
MQNLFSLEGRVALVTGGSRGIGAMIVKGFLTHGAKRVYITARKAAACDAAAEELSQYGECVSLPGDVSTMEGIQGLAARIKEREPKLDILVNNAGAAWGAGFDEFPESGWDKTVDLNMKTPFFLTQALIGELRAAAKDRVAKVINIASIDGQSVTKDETYPYGASKAGLLHMTKRMALRLAPENIAVSCIAPGAFASDMNKVARDHADAVAKMIPAGRIGEAEDMAGAAIYLASRAGDYVMGGAVTVDGGVSFAR

SEQ ID NO: 16898 - protein, 440 aa, Caulobacter crescentus
MATTGSGGLAVFIWQYGRQTCGAPSVSQRGSDMSLSVCGLGAPCLSPGSILGKENDMRSLDAFAGQKLAALDAQSLRRRLSPTRRHDGAVVERDGKRMISFSCNDYLNLSQHHLVRAAAAEAALNYGAGAAASRLVTGDHPLLSDLEKRLAHLKGTEAACVFGSGYLANTGVIPTLVGPGDVILIDALAHACIWAGAQLSGAKVVKFAHNDPADLERLLLAERGAARHALVATDGVFSMDGDIAPLDALSELCQRHDAWLLSDDAHGVGVLAEGRGSGALFPTAKIPLQMGTLSKALGSYGGYLCGSQAVVDLLKTRARTLVYATGLPPASAAAALASLDLIAANPTMTEVPLAKARLFTRRLGLPEACSPIVPVVLGSAESALAASTELQNQGFLVVAIRPPTVPDGTARLRIAFSAAHEDADIIRLADAIAKLRETAS

SEQ ID NO: 16899 - protein, 400 aa, Caulobacter crescentus
MKTARPPLPVVATRGARLILEDGRELVDGLASWWTACHGYNHPHIAGALRKQIETMPHVMFGGLAHEPAYRLAKRLARLLPGDLDHVFFAESGSVAVEIAMKMALQYQINRGVGGRTRFLAFRGGYHGDTLATMTVCDPEEGMHSLFAGVMPAQVIADLPRDPASEAALDALLAARGHEIAAMLVEPLIQGAGGMLPHPPEVLRTLRRLADKHGVLLIFDEIFTGFGRTGSLFAMQAAGVEPDIVTLSKALTGGTLPLSAAVARRHVFEAFWSDDPAAALMHGPTYMANPLACAAANASLDLFEDGAWARDVARVSAALAEGLEPCRAGEGVVDVRTLGAIGVVEFEAPVPVSDLCARFAALGVWIRPMGKVVYLTPAFTTPDEDLSRLTSAVRQVVGVD

SEQ ID NO: 16900 - protein, 485 aa, Caulobacter crescentus
MSGGLFIDGKWRAGQGAGLSSTDPATGEDVWSAATATPADVADAVAAARKAFPAWADRPREERIAILRRYKDILVERAAPYAEALSRETGKALWETRAELASMAGKVDLSIRAYDERTGVTENAMPFGRAVLRHRAHGVMAVLGPFNFPGHLPNGHIVPALLAGDTVVFKPSEETPLAGQLMVEALEAAGAPAGVVNLVQGGRETGQALIAQDIDGLLFTGSAAAGTYFRRYFADRPDVILALELGGNNPLVVWNADDAPEAVAALIVQSAFITTGQRCSCARRLIVPDDASGAAIIEATVALAERLVIGAWNAENEPFMGPLISGRAAKAAREVASATPGKTILALDGVAGLGDAFLKPGIVDVTGLETPDEELFAPLLQVRRVSSFDEALAAANATRYGLSAGLISNESELWDKFLSRIRAGVVNWNRPTTGAAGSMPFGGLGASGNHRPSAYYAADYCAYPVASFEASMVVDTLKDIKGLKA

SEQ ID NO: 16901 - protein, 487 aa, Caulobacter crescentus
MEIREGLTFDDVLLEPAASDVMPTQVTTETRFTREISLNIPLVSAAMDTVTESRLAIAMAQAGGMGVLHRNLSNEEQADQVREVKRYESGMVINPLTIHPDTTLAEIREIKARRKISGFPVVERGSGKLVGILTNRDMRFEGDDKVPASQLMTRDNLITVSEGVDHREARELLRRHKIERLIVVDEAYRAVGLITVKDIEKAQAHPLAAKDDKGRLLVGAASTVGDAGFERSMALVDAGVDVVVIDTAHGHSSQVAAAVTRLKREANRVQIVAGNIATYDAARALIDAGADAVKVGIGPGSICTTRIVAGVGVPQLTAIMEAVRAAKESNTPVIADGGIKYSGDLAKAIAAGASTAMMGSMFAGTEEAPGEVFLYQGRSYKSYRGMGSVGAMARGSADRYFQKEVTDNFKLVPEGIEGQTPFKGPISPVLHQLVGGLRAAMGYLGAPTIPELQKRARFVRITGAGLRESHVHDVMITREAPNYPSAV

SEQ ID NO: 16902 - protein, 413 aa, Caulobacter crescentus
MGTSFRLFVMMVLQLAIWGAWAPKIFPYMGMLGFAPWQQSLVGSAWGVAALVGIFFSNQFADRNFSAERFLAVSHLIGGVALLGTAFSTEFWPFFACYLVFSLVYVPTLSVTNSIAFANLRDPAAGFGGVRMGGTVGWVLVSWPFVFLLGAQATVEQVRWIFLVAAIVSFVFAGYALTLPHTPPRKADDAVDKLAWRRAFKLLGAPFVFVLFVVTFIDSVIHNGYFVMADAFLTNRVGIAGNLSMVVLSLGQVAEIITMLLLGRVLAKLGWKVTMIVGVLGHAARFAVFAYFADSVPVIVAVQLLHGVCYAFFFATVYIFVDAVFPKDVRSSAQGLFNLLILGVGNVAASFIFPALIGRLTTDGSVDYTTLFLVPTAMALAAVCLLALFFRPPTRGPVSEADSASSAASSAQA

SEQ ID NO: 16903 - protein, 251 aa, Caulobacter crescentus
MTSDSSKPLAGRIALVTGATRGIGEAVALGLAKAGAHVIAVGRTQGALEALDDAILQATGERATLVPLDLREADGLDHLGAAIHKRWGKLDILVGAAGVLGPLTPVSHLEPKGWDMILSTNLTANWRLIRSMDPLLRASDAGRAVFFSSSVAKSRPAFWGAYAATKAALEALVDVYADEMENTTVRAFCVDPGAMRTKMRSAAFPGENPATVPAPETIAPFMVDLLRTDREAAKGVVRFKERGQESASIDA

SEQ ID NO: 16904 - protein, 274 aa, Caulobacter crescentus
MPEPPMLDHLIPFARNWLIGMQIDVTRYAVFSIGVWFVLWVLLAKPMAGRKIRDTRPAGRQLLTEFAISIRSVMVFSTFGLITFGLFRAGWLPGPLIAKGWGPVWFWTSLVLMIIAHDAWFYWTHRMIHDRRLFRTFHRRHHRSNNPSPFTAYSFDLGEAAINALFVPLWMILVPTQWPVVGLFMLHQIVRNTLGHSGYELFPARKDGRPLIPWLTTVTHHDLHHAQAGWNYGLYFTWWDKLMGTEHPEYLQRFAAVTARKDKALAATSSPSPA

SEQ ID NO: 16905 - protein, 314 aa, Caulobacter crescentus
MSIAFIFPGQGSQSVGMGADLAEAFSAAREVFQEVDDALGQKLFALMKEGPEGDLTLTENAQPALMAVSLAVTRTLEKEFGVGIDKAAFVAGHSLGEYSALAAAGAISLSDTARLLKLRGQAMQRAVPVGEGAMASLIGPKTDLALAEAAAAAGSEVGVCVVANDNNNGNVVISGAKAAVDKAIEKAKELGARAIPLNVSAPFHCPLMQPAADEMATALAAATIVAPRAPLVANVTAAPIHDPDVIRKLLVEQVTGRVRWRESMTWMATEGGVTRFAEAGAGKVLSGMAKRIAPDAEAVPLNTPADLEAFAKSL

SEQ ID NO: 16906 - protein, 246 aa, Caulobacter crescentus
MFDLTGKTALVTGATGGIGGAIARALHAQGAHVVLSGTRESALAELKAELGERASTVVANLSDAEQVDGLVAKAEEAAGAPLDIVIANAGVTRDGLIVRMKDEDWDTVIKVNLEGYFRLSRAAAKGMMKRRAGRIIGITSIVGVTGNPGQTNYAASKAGMIGFSKALAQELASRGVTVNCVAPGFIASPMTDALNEQQKAGILSTIPAGKLGEGADIAAACVYLASDQAGYVTGQTLHVNGGMAMI

SEQ ID NO: 16907 - protein, 78 aa, Caulobacter crescentus
MSDILERVRKIVIEHLDADPEKVTEKASFIDDLGADSLDNVELVMAFEEEFDIEIPDDAAEHIQTVGDAVKFITEKTA

SEQ ID NO: 16908 - protein, 426 aa, Caulobacter crescentus
MRRVVVTGIGLLTPLGQGVDITWKNILAGKSGANRISAFDPTDYSCQVACEVPRVDGRGGGGPDVEGSFDPDQTMSPRDQKRVDDFILYGVAAADEAIKDSGWVPETDEDKWRTGVILGSGIGGLSTIADTALELEAKGPRRVSPFFISSALINLISGQVSIKYGFKGPNHAVVTACATGAHAIGDAARLIKYGDADVMVAGGAEAAVCKVGIAGFQACRAVATAFNDTPEKASRPYDKDRDGFVMGEGAGVLVLEEYEHAKARGAKIYAEVAGYGLSGDAYHITAPSEDGEGGARALAAAVRDAGLKPSDINYVNAHGTSTMADGIEAKAVERFLGDHAKNVVMSSTKSMTGHLLGAAGAIEAAFSILAIRDQIAPPTINLDNPDVEVAMNLAPHKAVPMKIDVAVSNSFGFGGTNASVVFKKVS

SEQ ID NO: 16909 - protein, 139 aa, Caulobacter crescentus
MTERTFSIIKPDATRRNLTGAINAVIEAAGLRIVAQRRVKLTEAQAKKFYEVHAERPFYGELVGQMTAEPVVVQVLQGDNAVLKYREVMGATNPENADEGTIRKLFALSIGENSVHGSDSLENAGIEIAQFFTEDEIVG

SEQ ID NO: 16910 - protein, 256 aa, Caulobacter crescentus
MLLIERRGAIAIVTLNRPEAMNALSKALRLALHDAIVQLDQDPDVSVVILTGAGDRAFTAGLDLKELGGDPAAMGAANDQDARSNPVRAVETCRKPVIGAINGVAITGGFELALACDVLLASENARFADTHARVGIMPGWGLSQKLSRLIGPYRAKELSLTGNFLDARTAADWGLVNRVTTASELLPTALRMAQDMASIPVEALSFYKSLIDDGYAVAFGEGLALEHERSSAHNRTVTPERVEAQRRQVMERGRGQ

SEQ ID NO: 16911 - protein, 426 aa, Caulobacter crescentus [sequence omitted]

SEQ ID NO: 16912 - protein, 343 aa, Caulobacter crescentus
MARTRKAEASEGKAPETGVNAFVGKDELLKFYQDMLLIRRFEERAGQLYGMGLIGGFCHLYIGQEAIAVGMQSISQKGDQIITGYRDHGHMLAAGMDPREVMAELTGRAGGSSKGKGGSMHMFDIATGFYGGHGIVGAQVALGTGLALANSYRNNGNVSYAYMGDGAANQGQVYESFNMAQLWKLPVVYVIENNQYAMGTAVERAASETAFHKRGVSFRIPGEEVDGMDVIAVREAGARATEHARSGQGPYILEMKTYRYRGHSMSDPAKYRTKEEVDEVKTTRDPIDHIKERLAKAGVTEDDLKGVDAEVKRIVAEAAEFARTSPEPDPSELYTDVYLEAAE

SEQ ID NO: 16913 - protein, 450 aa, Caulobacter crescentus
MTDILMPALSPTMEEGTLAKWLVKEGDTIKAGDVIAEIETDKATMEVEAVDEGVIEAILVPAGSENVKVNTLIARLKGDGEAAAPAVAAPVAEAATVVVAAPAAGGPISAASTFADPEIPTGTALKKITVRDALRDAMAEEMRRDDRVFLMGEEVAQYQGAYKVSRELLQEFGDRRVIDTPITEHGFAGMGVGAAMAGLKPIVEFMTWNFAMQAIDHIINSAAKTLYMSGGQIKSSIVFRGPNGAASRVGAQHSQDYAAWYGNVPGLKVIAPYDAADAKGLLKAAIRDPNPVVFLEHEMMYGHEFDIPDVEDWVVPIGKAKVRRQGSDVTLVAYSRMVGFALKAAEELEKEGIAAEVVDLRTIRPMDHATILESVKKTNRLVTVEEGWGPMGVGAEIVARITEFGFDYLDAPPLRVCQEDVPLPYAANLEALSLPSVEKIVKAAKAVCYK

SEQ ID NO: 16914 - protein, 428 aa, Caulobacter crescentus
MSIDILMPALSPTMEEGTLAKWHVKVGDTVKAGDVIAEIETDKATMEVEAVDEGVVEAILVPAGTENVKVNALIAKLAGEGDSPAPAPKVEAPKAAAAAPVPAAAPAPAVPAPAAPVAADGSRVLASPLARRLASAAGLDLKALKGTGPHGRVVKSDVEAAKSGAPAAKAAPASAPAAVAPTAAAPRQIQSLEQMGIPAGSYDLVPLDGMRKTIARRMTESFRDVPHFPLTIDLEIDALLAARAKINSLLEKQGVKVSVNDIVIKAAAVALKQVPEANASYTPEGIAMHHHADIAVAVAVDGGLITPIIRKAETKGLAQISAEMKDLAQRAKDKKLKPEEFQGGTFSISNLGMFGIKSFASIINEPQGAIMSVGAGEQRPVVKNGEIKVATVMTVTLTCDHRVVDGSVGAKFLAAFRPLIEEPLTLIV

SEQ ID NO: 16915 - protein, 466 aa, Caulobacter crescentus
MSTEFDVVVIGAGPGGYVAAIRASQLGLNTAIIERENLGGICLNWGCIPTKALLKSGEVYEQLSHLGGYGLSVEKASFDFGKIIERSRGVAKNMSGGIAFLMKKHKIEVIEGEAKLEKGAPAPKVVVALKAGGSRTVQAKNVILASGARAREIPAIGAVSDGDKIWTYRDALAPKSMPKSLVVIGSGAIGIEFASFYRALGAEVTVVEAIDRIMPVEDEEVSKAAQKAFEKRGIKFRVGAKVSKIEKTKDGVAVTVEAGGKIEQLTAEKCIVAVGIAPNNDGLEALGVSLDRGHVVTDKHCRTNVPGLYAIGDIAGAPWLAHKASHEGIHAAEAIAGYKTPNVLSPIPGCTYANPQVASVGYTEAGAKAAGIEVKAGRFPFRVNGKAVASGETEGFVKTVFDAKTGALIGAHMIGHEVTEMIQGFVTAITLEATEEDLHGVVYAHPTMSEAMHEAALDAYGRVLHI

SEQ ID NO: 16916 - protein, 517 aa, Caulobacter crescentus
MPVAYDVRNGQKAIFDALIDARDKFGAKKPILEDQDRNPLTYTDLIRASFALGRKIAAMTKPGEHVGVLLPSGAGSVVTFFALHAFGRVPTMLNFTAGIRNIKAACKLAKINRVLTAHKFIELGKLHDIVDAIAEQAQVTYLEDVRGTIGLPDKLFAAAAGMFPRQFRAPAKPSDKGVVLFTSGSFGAPRGVVLTQENLVQNAMQVAAHIELDPDWVMFNPLPVFHCFGLTGGVILPILTGMKAFQYPSPLHTKQIPPLIKDAKASILLATDTFVNQYARAAESDELSGLEFVVCGAEKVRDETHTLIKERFGGVPLLEGYGATEASPVIAVNKPTDNRPGTVGGLLPGQEVRIEPVEGIPEGGRLFVRGPNIMAGYLREDGGVDAPEGGWHDTGDVVTMSDDQWITIKGRVKRFAKIGGEMVSLTAAEDLASAVWPDGRHAVISMPDKKKGEKLILVTDRHDADVAPLVAHAQTIGAPELAVPRKILKVTEVPVLGSGKTDYVAIQRMAETDTQAA

SEQ ID NO: 16917 - protein, 469 aa, Caulobacter crescentus
MRLRLLSITVAALAATSPVLAAPKLRAWVTTGDKSQLLAAQAPVAASSAEALAGLPVIAVDAQERHQSIVGFGASITDASAWLIQNKLKPADRDALLRELFGRGAGGLGFSFTRVTIGASDFSLDHYSLNDTPDGAPDPELKHFSLARPKQHVFPTVRAALKINPELKVMASPWSAPAWMKTTGSLLKGQLKAEAYPVYATFFARYVQEAAKVGVPTDYLSVQNEPDFEPENYPGMRWLPQDRARFFGEHLAPVFKRDKIKTRVLDWDHNWDQPQQPLTVLADPKARAFLTGVAWHCYAGEVSAQDKVRAAYPDKEVFFTECSGGEWAPKFDDSFAWMVEQLIIGSTRGGARGVLMWNLALDEKFGPHAGGCGDCRGVVSIDSQTGALTRTQEYYAFGHASRFVKPDAVRIGSPAKVEGLRTVAFQNPDGQRVLIVLNVSTAAVDFAIASAGARFKASLPARSAGTFVW

SEQ ID NO: 16918 - protein, 381 aa, Caulobacter crescentus
MTDPDTLSALIDVIQRFVAERLRPIEGLVSETDEVPGSIIEEMKQLGLFGLSIPESYGGLGLSLEEEARVIVAFCHTAPAFRSTFGTNVGIGSQGLVMFGDEAQKARWLPSIASGETITAFALTEAEAGSDSASVQTRAVRDGDHYVLNGVKRYITNAGRANLFTVMARTDPNTKGGAGVSAFLVPADLPGLSVGKPEKKMGQQGAHIHDVVFEDVRVPVENRLGAEGEGFTVAMRVLDRGRVHISAVCVGVAERLIADCVAYASERKQFGQPIASFQLIQAMIADSKTEALAAKALVFDTARKRDAGANVTLEAAATKLFASEMVGRVADRAVQVFGGAGYVADYGIERLYRDVRIFRIYEGASQIQQLIIARETLKRGG

SEQ ID NO: 16919 - protein, 561 aa, Caulobacter crescentus
MIYRPLIGPGAAPIPPPHRPLAKRPREAAVSWNYGDIFDAVARAAPPERPALIWRDVVVTWGEFDHRTNNMAKALIDLGLKPDARIGILCRNHPAYLEFLVAGVKARLLTVNLNYRYTADEIAYVLNDCNAEVLFYQSDFDGMLEPLRARLPGVQAWVRIENERSPEAAPEGALSYETLARTGDGKPLDITRSADDGYLLYTGGTTGKPKGVHWSTDQSRRVQLESPLIARVPQTMDEHLETVRATDSRIIPACPLMHGSGSNSAMGDLLNGGTAIILSGDRFDAVQLWREVEKHRATRVSIVGDVFAKPMLKALDDAPGAFDLTSMRAISSAGLTWSKEVKEGLLRHMPNIALVDILGASEASGLGYSVAKAGKIPETGVFDAAPLTVLIDPDTGAVMPKDRPSEGFIARSGVMANGYFGDPEKTAATYRTIDNVRYAVPGDFARWMPPNQFTLIGRGNLSINTGGEKVFPEEVEEALKLQPGVADVLVVGQPDEKWGKIVVAILKADGVFDEAQVRAGLAQTLSAYKHPKRFVLVDTVPRHESGKADYRTAIALAAETA

SEQ ID NO: 16920 - protein, 293 aa, Caulobacter crescentus
MTFTVEIIGKERCRLGESPLWDADAGVLYWVDSMAPAIWRYDPFTSEQRSIPAPKPIGSVVLGRPGELIAGLADGVYRVQLDTGAFTPIALPDTLAPIERFNDGKADRQGRFVTGTMAMHNETGRIGKLYRFSAGGAWEVLPTEPIEIANSTCFSPSGDTLYFADSLRHMVWAFSYDPKTGAVGEKRDFFDTTGFNSAPDGATVDAEGHIWLALVQAQKLIRISPDGRLDRVVESPAPFCSCPAFGGEDLDILYVTSISDSGGRLKTDVDASGRLMAFHGLGVRGIAETRCFL

SEQ ID NO: 16921 - protein, 355 aa, Caulobacter crescentus
MRLEPHEFTQWQKLLYARGWGAPSWPKEYGGTGWDPTKLYIFETEASRADAPVQFHQGLELIGPIIFTFGSPEQKAKYLPAIVSGDDWWCQGYSEPNSGSDLASLSTRAVRDGNEYVINGQKAWTSYAHVANRMFLLARTDPDARKQAGISLFLIDIDTPGVTIRPVVTMDEIHHTNEVFLDNVRVPPSALLGEEGMGWSYGKVLLDRERGVTAATTTRLAQQLRGARKVAAETMVGGRSLLDDPRVADRLAQFELEVMALEGMVMRTMAEATSGQDSGPRASMIKIRWSELLQQITEYWVELQGYDAMAFAPLGPFEAPDAWAAKGMIYSRVTSIYGGSNEIQRNIIARRALGL

SEQ ID NO: 16922 - protein, 382 aa, Caulobacter crescentus
MNFDLSEEQQLLKDSARRYGADHGDFTAWRARVERGEAYDAASWRRMADLGWLMLNVPEDDGGLGAGPTETMVVAEAVGRYLMLVPFVSTGVIAPTLLTAATEALRAHLMAGLAEGKLVISLADAEPNGRFDLNRIATRAEAVEGGFRLTGAKSHALDGGAADWFIVPARTTAADDSQDGVSLFLVPAEIEGLTVMRSRAMDNRHNASLKLDGVVVPAANLIGGLGEGFPLLRDAVDRGVVARLAEAVGAMDAVREMTMEYLKTRKQFGQTLGAFQALQHRAVDMAIACEEARSMMYLATLALSGAPVERRKVIAAAKARVGQTSLYVGRQAVQLHGGVGFTEELAVAHYLKRLIMIDMAFGNADHHRAELAASLRPGAVAA

SEQ ID NO: 16923 - protein, 544 aa, Caulobacter crescentus
MLGLMQDTPLTLSSLLDHAARFHGEVEIVSREPGGVTRTNYARVAVRARKLAAALRRRGLREGDRVASLALNSARHLELYYGATGAGGILNTVNPRLFPEQIAFILRHAENRIVFFDPAFGPLLETLVDQAPQVEAYVCLSSAGDMPSLRLPNLIAYEDLLAPEADDAPWTVVSENAGAILCYTSGTTGDPKGVLYSHRSLALHAFVATGADGMAISRRDSILLVTPLFHVNAWGIPFSAAMCGAKLVLPGAAVDGENLFNLMRAERCTFSLGVPTVWLGFLDYVATHREELDLAGLALERILVGGSAAPRSMIERFDYMLGVYVIHAWGMTETSPLATIGTPLPEHAFLDRQARYDIQALQGRAIYGVELRIVDADGVVAPHDGMAVGDLQVRGPWVVRRYFKADAPATTEDGWFPTGDVAKIHPNGYLQLTDRSKDIIKSGGEWISSVDLENVAIAHPDIREAAVIGVPHPKWQERPLLIIVPAPETTPDKDDILKFLASRVARWQVPDDVVIVESLPHTATGKLLKAKLRETYRDYLAEPA

SEQ ID NO: 16924 - protein, 521 aa, Caulobacter crescentus
MTSKAQSRVVLVTGGADGIGWAACQRFARAGDQVLVADRNVERARERADSLGPDHHAIAMDVSSEAQIREGFEQLHREFGRLDVLVNNAGVTDPQPTATLDQTAEEVARLQAINVTGAFLAAREAGRLMIEQGHGAIINLASGAGLVALAKRTSYSASKAAVISLTRTLACEWAAKGVRVNAVLPGYTRTQMVQDQIDAGLLDPSIVLSRIPLGRMGEPEEMAEGAFFLASDAASYVVGATLVVDGGYTVYGGSGPASTTPAPSPLAPSPRVSAITGGGRGIGRCVVDLFHAAGDRLLVIERDAEGAKALAEALGDEHIVVQADITDVAAVEAAFAQAQARWGRLDVLINNAGAADVFKPSLEQTAQDFTSVYDLNFSGPLATAKAAARLMSQGGVIVNLGSIAGLGALPQRNAYCAAKAAVTMMSRSLACEWASAGIRVNTVAPGYIETPAVLALKSAGRAQFDKIRRRAPIGRLGDPMEVARTIAFLASPAASYVAGATLTVDGGWTAFGDAGDASDIL

SEQ ID NO: 16925 - protein, 517 aa, Caulobacter crescentus
MTEFTDLGLSPTTLQAVADTGYTTATPIQAQAIPVALAGQDVLGIAQTGTGKTAAFTLPLIDRLQSGRAKARMPRALVIAPTRELADQVAASFEKYAKGTKLSWALLIGGVSFGDQEKKLDRGVDVLIATPGRLLDHFERGKLLMTGVQFLVVDEADRMLDMGFIPDIERIFKMTPPKKQTLFFSATMPPEITRLTKQFLRDPVRIEVARPATTNANITQLLVKVPSSDPKAKRLALRALIEKAGIETGIVFCNRKTEVDIVAKSLKVHGYDAAPIHGDLDQTQRMKTLADFRSGALKILVASDVAARGLDIPAVSHVFNYDVPHHADDYVHRIGRTGRAGRTGITYMLVTPADDKGFDKVIKLIGSTPDEEKLDLDYSNAVTVKREGDRKRGGRDRDRGERGERSERPARGRGRGRERAEETVEAPAEAVAEIVDTPAMAEERPARERRPRREREPKAAAPAPTAVEAERPARAERPERPVRGVQPVRDRDDDDRRVVGFGSDVPAFLARPPRGAK

SEQ ID NO: 16926 - protein, 485 aa, Caulobacter crescentus
MNAPVNLSSDAHKAVMNDVLQRQKAAHLRDGPPSAEKRIQWLNRCIDLLVGHQAEIAKAVNQDFGSRSPEATSLTDVAGSIGPLKHAREHLTKWMKPEKHKTTPAILGLFGAKATVQWQPKGVVGVISPWNFPVNLTFAPLAGVFAAGNRAMIKPSEFTPATSDLLKAMFAKAFNEEEVAVFVGGPEVGQAFSGLAFDHLVFTGATSVAKHVMRAAAENLVPVTLELGGKSPVILSRGADMATAAARVMNGKTLNAGQICLAPDYVLAPQEDVEAFVKEAQAAVSRYFPTIKDNPDYTAVVAQRHYDRVKGYVDDARAKGARVIEINPAGEDLSQQEHRKIPPTLILDPTDDMKVMQEEIFGPVLPVKGYKTVDEAVDYVNAHDRPLALYWFGTDEAEKDRVLERTTSGGVTVNDVIFHVAQENLPFGGIGPAGMGAYHGYDGFREFSHRKAVFQQLKKDIAPMLGLRPPYGEGIRKYLAGQIKK

SEQ ID NO: 16927 - protein, 146 aa, Caulobacter crescentus
MVKPIHVLSGPNLNLLGTREPEIYGKDTLDDVRTRCEARAASRGVSVVFRQSNHEGVLIDWVHEARESASALVINPAGYGHTSIALLDALKTLSIPVIECHLSNPAAREEFRRHTYVSLAATGIVSGFGAASYELAIEAAFGLIRA

SEQ ID NO: 16928 - protein, 448 aa, Caulobacter crescentus
MFDKILIANRGEIALRVHRACKEMGIATVAVHSEADRNSMWVRLADESVCIGPAPAAKSYLNIPSIIAAAEITGAQAIHPGYGFLSENARFAEIVGAHGFTFIGPKPEHIRMMGDKITAKQAVKDAGIPVVPGSDGGVSTEEEAFEAAEKIGFPVLIKAAAGGGGRGMKVAQTREDLAEAVSTARAEARAAFGDDTVYMERYLQKPRHIELQVIADSHGNVVHLGERDCSLQRRHQKVLEEAPSPALSAEGRAKIGKVVVDAVKAIGYLGVGTIEFLWENDEFFFIEMNTRLQVEHPVTEAITGIDLVREQIRIAAGLPLSFTQDDVVFEGHAIECRINAENARTFTPSPGVITDFHAPGGLGVRLDSAIYTGYAIPPYYDSLIGKLIVHGRDRAECIARLKRCLGEMVVGGVETTIPLFQDLLVQPDILAGDYNIHWLERWIKAQEA

SEQ ID NO: 16929 - protein, 253 aa, Caulobacter crescentus
MTLSSTTPRPLIAGNWKMNGLSVALDEARAVAAALEAKPPAARVAIFPPATLLHRLSQAVEGAHLLTGGQDCHGKSSGAHTGDVSAEMVADAGGSLVICGHSERRTDHGETSAQVAGKAEAAAAAGLEPIVCVGETLETREAGQAVSFVVSQVRDSLPTSLAGKAFSVAYEPLWAIGTGRTASVDNIVEMHAAIRAELVSRFCEQGRTVLILYGGSVKPENAREILAAPEVGGALVGGASLKAKDFLAIIQAL

SEQ ID NO: 16930 - protein, 470 aa, Caulobacter crescentus
MSNPTPTGVVTRFAPSPTGFLHIGGARTALFNWLYARHTGGKFLIRVEDTDRERSTEAAVAAIFEGLDWLGLKSDDEVIFQHTRAPRHVEVVHELLAKGRAYRCWMSIEELEVAREKARAEGRAIRSPWRDAPEGDLSAPHVIRFKGPLDGETLVNDLVKGPVTFKNIELDDLVLLRADGAPTYNLAVVVDDHDMGVTHVIRGDDHLNNAARQTLIYQAMDWAVPAFAHIPLIHGPDGAKLSKRHGAQAVGEFADLGYIPEGMRNYLARLGWGHGDDEVFTDEQAISWFDVADVVKAPARLDWAKLNHINAQHLRKADDARLTALALAAAETRGEPLPADAAERIARTVPEVKEGAKTILELVDHCAFALKTRPLALEEKTQKQLTEETVERLKRLRDQLAAAPDFDAATLETVLKSFAESEGVGFGKFGPALRGVLTGGAQAPDLNKTMAALSRDEAIGRLDDALAPRA

SEQ ID NO: 16931 - protein, 426 aa, Caulobacter crescentus
MTDKATLTIGDKSYELPILKGSTGPDVIDVRKIYGESDHFTFDPGFTSTASCESKITYIDGDAGILLHRGYPIDQLAEKSSFLEVCYLLLNGELPKADEFAKFEHNITYHTMLHAQFDRFFEGFRRDAHPMAVMTGAVGALSAFYSDSINVDDAREREISAHRLIAKMPTIAARAYKYTVGQPFVSPRNDLSYSENFLRMCFAVPAEDWKPNPVLTRAMDRIFILHADHEQNASTSTVRLAGSSGAHPFACIAAGIACLWGPSHGGANQEALEMLETIGSVDNIKDYVQGVKDRKYKLMGFGHRVYKNFDPRAKVMQKTAHEVLAELGHNNDPLLQVAQELEKVALNDPYFVDRKLYPNIDFYSGITLRAMGFPTNMFTVLFALARTVGWISQWKEMFEDPTRKIGRPRQLYTGATHRDYVTLDKR

SEQ ID NO: 16932 - protein, 159 aa, Caulobacter crescentus
MGDNAEQAVQTDIDIAEILARIPHRYPFLLVDRAEDYNPHQSIVGIKCVTINEPFFQGHFPGNPVMPGVLIIEALAQTGAVLMSKSLEVDTEGKTIFFMSVDNARFRNPVRPGDVIRMEVEVLRARSSIFKFKGVAKVGDKVAAEAEFAAMVVETGPKA

SEQ ID NO: 16933 - protein, 686 aa, Caulobacter crescentus
MAIAKVNGVEVEFEPGMTVLQVAELAGEEIPRFCYHERLSIAGNCRMCLVEVKPGPPKPQASCALPAAEGQEIFTKTPMVKKAREGVMEFLLINHPLDCPICDQGGECDLQDQAVGYGRDDSRYEENKRAVEEKSMGPLIKTVMTRCIQCTRCVRFITEVAGSPEIGLISRGEDVEITTYLGAAVTSELSANVIDLCPVGALTSKPYAFEARPWELKKTESVDVMDALGSSIRVDARSAAVLRVLPRINDEVNEEWISDKTRYAVDGLGRQRLDRPYVRVGGKLKPATWAEAFAAIAAKVKSTAPERVGVIAGDLQDAESLKATKDLFTALGVKNLDSRQDGSALGAGPREGWLFNSTIAGIENADVVLFVGANPRLEAPVLNARFRKQWLAGKTRFGVIGEQADLTFDYDYLGAGAKTLSGLAKSKNDFVAALKAAERPAIIIGQGALARADGAAILKAAAGLAKSVKVVREGWNGWNVLHTAAARVAGLDMGFVPAEGGLSTAEMLKPGALDVLFLLGADECETAASDAFKIYLGTHGDNGAHKADVILPGAAYTEKNGLYVNMEGRVQMGRRAVFPKGEAKEDWSILRALSEVLGHKLPYDSLDQLRAKLFADHPTFGQIDYAPGSVATVFDVGALGVDGEVSDAPFESPVKAFHLTNPIARASVTMAECAAVASGAAKIAAE

SEQ ID NO: 16934 - protein, 799 aa, Caulobacter crescentus
MSELRTLPVLPLRDIVVFPHMVVPLFVGRDKSVRALEEVMRGDKQILLVTQKNSADDDPAPGDIFEVGVLATVLQLLKLPDGTVKVLVEGKARAAVVSFTDQESYYEAQIGEVSEDDGAGPEAEALSRAVVEQFENYVKLNKKVPPEALASIPQIAEPGKLADSIAAHLSVKIGDKQNLLEIFDVVKRLEKVFALMEGEISVLQVEKKIRSRVKRQMEKTQREYYLNEQMKAIQRELGDPDDARDELIDLEKRIKKTKLSKEARTKAESELKKLRNMSPMSAESTVVRNYLDWLLSIPWGKAKTKKIDLVESEGILDADHYGLEKVKERILEYLAVQARTNSLKGPILCLVGPPGVGKTSLGKSIAKATGREFVRMSLGGVRDEAEIRGHRRTYIGSMPGKVVQSMKKAKTTNAFVLLDEIDKMGSDYRGDPASALLEVLDPSQNSTFGDHYLEVDYDLSQVMFVTTANSLNMPQPLLDRMEIIRIPGYTEDEKLEIAKRHILPKLAKDHGLKPAEFIVPDKAIRDLIRYYTREAGVRSLERELGALARKTVRDLAREKVASITIDDERLAKYAGVKKYRYGETDEVDQVGIVTGLAWTEFGGDILTIEAVKMPGKGRMQITGNLKDVMKESIAAANSYVRSRALQFGIKPPVFEKTDVHIHVPDGATPKDGPSAGIAMALAMVSVLTGIPIRKDIAMTGEITLRGRVTAIGGLKEKLLAALRSGVKTVLIPQENEKDLADVPQTVKDGLEIIPVSTVDEVLKHALTGPLTPVEWNEAEEPITTSAKKDDGDSDAMLTH

SEQ ID NO: 16935 - protein, 222 aa, Caulobacter crescentus
MSGGTTKAAENAKADLPRLMKALRDQGVTDPQVLKAIETTPRDLFTPDLFKDRSWEDSALPIACGQTISQPYIVGLMTQALTVEPRSRVLEIGTGSGYQTTILSKVSRLVYTIERYRTLMKEAEARFNTLGLTNVITKFGDGGEGWAEQAPFDRIMVTAAAEDDPKRLLSQLKPNGVLVAPVGKGPVQSLRRYAGDGKGGFRVEILCDVRFVPLLAGVAKDQ

SEQ ID NO: 16936 - protein, 262 aa, Caulobacter crescentus
MRIATWNVNSINARLEGVLAWFESEAPDVAVLQEIKCVDEKFPTEAFERLGYNVAVHGQKTYNGVALLSKHPIEDVRKGLPFLSEDEVDEQARYIEAVIAAPTPFRVVGIYLPNGNPIGTEKFAYKLSWMRRLHAHAQGLLAFEEPLVIAGDYNVIPEVEDVANPQAWLGDALFQPESRAAFRALKNLGFADAYMQADGAPGGYTFWDYQAGAWQRNLGIRIDHLLLSPQAADRLTGLVIHRDERDKEKPSDHVPVVGRFRI

SEQ ID NO: 16937 - protein, 333 aa, Caulobacter crescentus
MHLARFPRARFAHLPTPLEPMPRLGAELGIDLWVKRDDCTGLAGGGNKTRKLEFLLGEALIQGADTLVTQGAVQSNHVRQTIAAGARFGLKTEVILEERTGSKASDYMGNGNVLLDKLMGASLRYVPGGTDMVAELDSTAENVRQRGGKPYVIPGGGSNTVGALGYVDCARELVVQADQMDLKIDRLVTATGSAGTHAGLVAGFAALSVDIPILGFGVRAPKPKQEENVYNLAVATAETIGAGGRVRREAVVADCDYVGEGYGLVDQGVIDALALAARTEGLLLDPVYSGKAMKGLIDQARKGAFKGERVVFLHTGGAQGLFGYQTVLEPALG

SEQ ID NO: 16938 - protein, 401 aa, Caulobacter crescentus
MADFGATDLDAFRADTRAWLEANYPKSLNAPMGEDEAPWGGRKMVWKNPDAKLWLDRMAERGWTAPMWPKEYGGGGLSKAQNKVLEQELRRLKARPALMSFGVWMLGPVLLEYATEEQKQRFLPAIVRGETRWCQGYSEPGAGSDLASLQTKCEDKGDHYLINGQKVWTSYADQADWIFCLVRTDTSKKHEGISFVLFDMTSPGVEARPIKLISGSSPFCETFFDNVKVPKEQLVGKLNGGWDIAKRLLQYERQNISASGFGGGGGLSVVEAAKKELGVDSEGRIADGDFRARLAAHSMDAHAFMLTVRRAEAESKQGSGPSAAVSIIKYAAAKMNQERTELLVEALGLQGLGWSGEDFSAEELAAPRAMLRAKGNSIEGGTSEVNLNVVAKRVLGLLDHQ

SEQ ID NO: 16939 - protein, 377 aa, Caulobacter crescentus
MAVLTEEQTMLRDAAKGWASESAPVGALRKLRDSKSKQTFDPAAWAEMGQMGWAGVIVPEAYDGSAFGYLGLGLILEETGRTLAASPLLSTAMIAASALQLGGSDAQKQAWLPKIATGEAVATLAIDEGAHHAPARTALSATQSGAGYVLNGTKTLVLDGEAADLLIVAARTSGAPGDTNGITLFLVAGDAAGVTRSHLSLIDSRGAAKIAFDGVEVGADAVLGEVDKGWAVLEPTLDRAYAGLAAEMLGSASAAFDITLDYLKTRTQFGQVIGTFQALQHRAAKWFTDLETTRSCVEAALEALDAGADSRALAFLAKAKASELVHLASNEMVQMHGGIGMTDAHDAGLYMKRARVTEALFGGASFHRDRYARLMGF

SEQ ID NO: 16940 - protein, 476 aa, Caulobacter crescentus
MIRARRSRIVATLGPASSSFDMIVTLAKAGADVFRLNFSHGAHETHAAVYAAIREAEKVVNRPLGVLADLQGPKLRVGKFADGPVMLKAGQAFRFDSDPAPGDETRVHLPHPEILTAMRPGATLLLDDGKLRMTVTDAGPGYANTKVVNSGKLSERKGVAVPDVVIPMSPLTAKDREDLAFALRLGVDWVALSFVQAPEDMAELRRIVEGRAAVLAKIEKPQALKVLGPILDLCDGVMVARGDLGVEMAPEEVPVAQKEILRAARERGIPVIVATQMLESMTSSPTPTRAEASDVANAVYEGADAVMLSAESAAGDYPEESVSMMNRIIERVERDPKWPELMYAEQSHDDVDADVLVVAAAGAAKSGSTKCLVAFTTTGATARRLSRERPLQPVLALSPEISAVRRMCLVWGVEPRVSAQPDSLEVVTTDASSKALELGLVAPGERLLVVAGTPFGAPGAANLLRLAHAPAPARRR

SEQ ID NO: 16941 - protein, 473 aa, Caulobacter crescentus
MVLLGGAGDLALRMLLPSLYFLELDRLLPHDLRIIGVARADHDAASYKALVREQLGKRATVEEAVWNRLAARLDYVPANITSEEDTKKLAERIGAHGTLVIFFSLSPSLYGPACQALQAAGLTGPNTRLILEKPLGRDLESSKATNAAVAAVVDESQVFRIDHYLGKETVQNLTALRFANVLFEPLWDRNTIDHVQITIAETEKVGDRWPYYDEYGALRDMVQNHMLQLLCLVAMEAPSGFDPDAVRDEKVKVLRSLRPFTKETVAHDTVRGQYVAGVVEGGARAGYVEEVGKPTKTETFVAMKVAIDNWRWDGVPFFLRTGKNLPDRRTQIVVQFKPLPHNIFGPATDGELCANRLVIDLQPDEDISLTIMNKRPGLSDEGMRLQSLPLSLSFGQTGGRRRIAYEKLFVDAFRGDRTLFVRRDEVEQAWRFIDGVSAAWEEASIEPAHYAAGTWGPQSAQGLISPGGRAWKA

SEQ ID NO: 16942 - protein, 640 aa, Caulobacter crescentus
MSSKTPLLDTIASPADTRGLSLAELKQLAAEVRAETIDAVSVTGGHLGAGLGVVELTVALHHVFETPKDIVIWDVGHQAYPHKILTGRRDRIRTLRQGGGLSGFTKRAESEYDPFGAAHAATSISAALGFCAARDAKGEDNSVIAVIGDGSLGAGMAYEAMNAATDTTKRLIVILNDNDMSIAPPVGGMSAYLANLVSGGAYRSVRKLGKTVVEKLPTPMREAARKAEEYARGMVTGGTFFEELGFYYIGPIDGHDMDALVSVLKNAKAFGDKPVLVHCVTQKGKGYAPAEGAADKLHAVVKFDVVTGQQQKAAGGPPSYTKVFAQELIKQAEKDDKIVAITAAMPSGTGLDLFGKAFPERTFDVGIAEQHAVTFAAGMAADGMKPFAAIYSTFLQRGYDQVVHDVAIQGLPVRFAMDRAGLVGADGPTHAGSFDIGFMGALPGMVLMAAADEVELARMVATAAEIDDRPSAFRYPRGEGLGLDMPAIAEPLEIGKGRIVREGTSVAIVSFGTRLSESLKAADLLAARGLSATVCDARFAKPLDLDLLLRLAREHEAIITVEEGSMGGFGAFVLQALAQHGALDRGLKIRTLCLPDVFQDQDKPDAMYAQAGLDAEGILRGALSAMGMDNVSAAGAGRRA

SEQ ID NO: 16943 - protein, 294 aa, Caulobacter crescentus
MSDLAKRIVQAADIVTVALDELLPRADGPESRLTEAMRYAALGPGKRLRPFFALETGKMFDLPERPVLRAACALECIHAYSLVHDDLPAMDDDDVRRGRPTVHKQYDEATAILAGDALQTAAFEIMAHPDTHDDGHVRSELVRKLAIASGARGMCGGQMIDLLGVRDDLGAVARMQRLKTGALIAFAFEIPLIIARAKESERSALMAFAQDLGLAYQIVDDILDAEGDEETLGKAAGGKDAAKGKANYVTLLGLDAAKERVTLLAEQTRSHLEIFGERAEHLRASVDFVLDRRN

SEQ ID NO: 16944 - protein, 352 aa, Caulobacter crescentus
MNRRALILSACAAALSACAPLRQRPELAALGFRGPRLTDEAFISFDGAHLGLMRWLPAGEPDWVVVGLHGMNDYANAYHLAAAWWAGRGIATYALDVRGFGRSPARGVWAQPELVIEDVRLLVEAVRERHPRAKVALAGISMGGGLAISAMATPDPPRVDKLMLFAPAVWGWSNQPLPNKLSLWITAHAKGDWVVKPPEWLVRNVMPSDNIDELRRMGRDPLMIWGARSDTLYGLVGLMERAWRSPGAISTPVAWFYGANDHVIPRAPTVEAVSRLKSGALTAYYPKGYHLLLVDLQAEAVWRDAEAFLRDAPGAWPPSDVPAIPSSLAAMTALDPPKTAKRGLSQGQRSGL

SEQ ID NO: 16945 - protein, 301 aa, Caulobacter crescentus
MADIRFDGKVAIVTGAGGGLGRQHALELARRGAKVVVNDLGGSMDGSGGSSEAAQKVVDEIKALGGEAIANGSSVTDDAGVALMIKQAMDTWGRIDILIANAGILRDKTLTKMELADFELVMQVHVFGTFKPIKAVWDIMKAQNYGRIVVTTSSSGMYGNFGQSNYGAAKMAVLGLMNTLKLEGAKNDVKINAISPVAATRMTEGLMPPEVLAKLAPEYVTPGVVYLCSDEAPTGAILTAGAGAFALSRIYETEGVYLGEGGLSAEEVRDSWGQITAEDGQKAYFNGGEQGQKFFRKMAGG

SEQ ID NO: 16946 - protein, 221 aa, Caulobacter crescentus
MSFPRRVEGVVFDMDGLLLDTEIVYRAAMIEAGQVFGIGFTGEIYAAMVGKTTPECGVMLRELFGETFPVQSYFERVWADVEDLLEAETRLKAGVIEILDFLDDQGLPRGIATSNGKPAVERYLGRFDLLPRFHAVVAHHDVVRHKPHPDPYLEAARRIGVDPAACLALEDSHPGVRAAHAAGMMTVMVPDILDPNEEMHDKCVHIADSLHHVLDLLKASA

SEQ ID NO: 16947 - protein, 463 aa, Caulobacter crescentus
MTATRIETDTFGPIEVAADRYWGAQAQRSLGNFKIGWEKQPLPVVRALGIVKRAAAEANLALGKLDPKIAETIIAAANEVIEGKLNDHFPLVVWQTGSGTQSNMNANEVISNRAIEMLGGEMGSKKPVHPNDHVNMSQSSNDTFPTAMHIACAEQVVHDLLPALKHLHKALAAKAAEWKDIIKIGRTHTQDATPLTLGQEFGGYAQQIENGIARIEMTLPMLMQLAQGGTAVGTGLNAPVGFAELVAEQIAGITGLGFTTAPNKFEALAAHDAMVFTHGAINTVAASLFKIANDIRFLGSGPRAGLGELSLPENEPGSSIMPGKVNPTQSEALTQVCAQVFGNHSTLTFAGSQGHFELNVFNPVMAYNFLQSVRLVADAAISFTDNCVVGIEPRVDNIKKGVENSLMLVTALNGKLGYDACAKIAKTAHKNGTTLREEAVGGGYLTNEEFEQYVRPEKMISPG

SEQ ID NO: 16948 - protein, 338 aa, Caulobacter crescentus
MVLDAAAATLPRKSGSVDRLVRLAEADMAGVNRLITDRMQSDVAIIPALAEHLIAAGGKRLRPLMTVAAARLAGADNDHFQKLAAAVEFIHTATLLHDDVVDGSQLRRGKVAAHLIWGGAQSVLVGDFLFARAFELMVETNSMKALEILARASRVIAEGEVLQLMRSHDLNLSQAVYLEIIQAKTAELFAAASEAGAVSAGVDVAKSEALRDYGLNLGLAFQLADDALDYGGATETLGKNAGDDFREGKATLPLLLAIARSGPREAEFWERAIGRREQTEADFRRARELIIGSGALDATLDLAADYADKAKAALAMFPANDWREALEELADFAVSRRA

SEQ ID NO: 16949 - protein, 171 aa, Caulobacter crescentus
MSMPTLAIVVARAANGVIGRDGDLPWRLKSDLALFKANTLFKPIIMGRKTWDSLPRKPLPGRTNIVLSRDQSFEPEGAVACETWMEAFEIAREQAADDGADEVCVIGGSALFELALPKAKRLYLTEVAAEVEGDVRFPAFDESAWTEVRREAHPAGDGDDHAFVFRVLERR

SEQ ID NO: 16950 - protein, 403 aa, Caulobacter crescentus
MDLAFSAEDLAFQQEVRDWIATAYDDDLRRQMSQSKNGYLDKAGQVKWQKKLAERGWAAPDWPVELGGAGFTPSQRYIFNMEMSLAGVPTSSPMGLKMVAPVIMAFGSDAQKAQHLPPILNSDIWWCQGYSEPGSGSDLASLQMRAVRDGDDYVLNGSKIWTTHAQWADWMFCLVRTSTEGKPQEGISFLLLRMDTPGIQIKPLPTLDGPPDNEQEINQVFFDNVRVPVANRIGEENKGWTYAKYLLEFERGNAYAPGLMNMLKKVKRIAALERADDGGRLIDDPDFRSKIANLEIQVEALNASELRIFSGRGAGKNIGPASSMLKCVGSEHQQAITELTLEAVGNYATPFVRDTWSPANDGRAGPDYAGPAAPAYFNYRKASIYAGSNEIQRNIMAKMVLGL

SEQ ID NO: 16951 - protein, 469 aa, Caulobacter crescentus
MALGGAALGLSACEGPGETDLTPKGRQFPKDFVWGVATAAFQTEGSQTADGRGPSIWDVFERVPGHVKNGDTAADATDSYRRYQDDVDLIAGASLSAYRFSMSWSRILPTGAGAVNAAGLDHYSRLVDALLAKGITPYATLFHWDLPQGLQDKGGWANRDTAQRLADYARAVVERLGDRLKNYIILNEAAVHTVFGHVLGDHAPGLKDAALLGPVTHHMNLGQGLAIQALRAARSDLSVGTTMALQPCRPAGGPLAFWNRLASDGLDEIWNLAWLDPLFKGTYPKAMEEPLKGVVRDGDLKTTRQPVDFLGVNYYAPAYVRLDLSAPSKIAAAAAPNSAEQDAFGRHIDPSGLFEVLDRVRREYGAPKMLVTENGCSDPFSSGPAILDDTFRIKYLRRHLEAVLAAREAGCDVRGYFEWTLIDNFEWDLGYTSKFGITTMEAASGRRIPKASYGWFKALAQTGTLPSSP

SEQ ID NO: 16952 - protein, 358 aa, Caulobacter crescentus
MTDLSIRANRVAALKAAAKERILILDGSWGVMFQKKGLTEADYRAERFAAYNGQMKGNNDILCLTRPDLVAELHDAYFSAGADISETNTFSGTTIAQADYHLGEQDVWDINLEGAKIGRSVADRWNAQNPDRPKFIAGSMGPLNVMLSMSSDVNDPGARKVTFDQVYEAYRQQVDALYQGGVDLFLIETITDTLNCKAAIKAILDWRDEGHEELPIWISGTITDRSGRTLSGQTAEAFWNSVKHAKPFAVGFNCALGADLMRPHIAEMARIADTLVAAYPNAGLPNAMGQYDEEPHETGHALHEWAKDGLVNILGGCCGTTPDHIRHVADEVRGVTPRQIPERPKAMRLAGLEPFELA

SEQ ID NO: 16953 - protein, 738 aa, Caulobacter crescentus
MKKPSLTALAAVLALSTPALAQKLTPERIFGDPSLSGPTARGVALSPDGKRVTYLKGKPEAANIQDLWAADVKGGEPYRLIDSAALSSGDKELSEAEKARRERARVSARGIVEYSWDRQGRFILVPLDGDLYLDAVADGKITRLTETPGDEVDAKVSPKGGYVSYVRDQNLYIKPVAGGAETALTTDGKDALSFGVAEFIVQEELDRFTGYWWSPDESRIVYTRVDESGVDIVPRADIGPGGATVVNQRYPRAGRPNAVVDLFVRDLASGKVTALDLGANKDIYVARVAWSADGKTVYVQRLSRDQKTLDLLAFDAATGAGKTILTDTDPHFIEVSNDFRPLTDGTFLWGSEKDGNQHLYRYAADGKLIAQITKGDWPVIGLEGVDEARKVAIFSASIDTPIERRLYEVSYAKPGKPKALTSAGGWWAAKVADNGGAFAGTYSDPKTPSQTALYSADGKRVRWIEENKLAEGHPYWPYAANLPQPEFGSLKAADGETLHYEILKPIGFDPAKKYPAIVSVYGGPHAQRVMKNWHSPSERTYLEAGYVIFKLDNRGSGNRSAKFMRALDRKLGTVEVEDQLLGAKFLASQPYVDADKLGVMGWSYGGFMALMLLTAENTPFKAGAAGAPPTEWSLYDTAYTERYMGKPDENKAGYAYSDINNRIDKLAPGSLLLLHGMADDNVIFENSTRLMAALQRKAILFEMAMYPGERHSAPGSKTKGLSVLKTHLDFFDRKLKGR

SEQ ID NO: 16954 - protein, 654 aa, Caulobacter crescentus
MLSSVLIANRGEIARRIIRTARELGVRTIAVYSEADANAPFVMEADAAILIGPAPAKESYLDPRKILAAARQMGAEAIHPGYGFLSENAEFAQSVIDAGLVWIGPPPSAIRAMGLKDAAKAVMIKAGVPTTPGYLGEDQSVERLTVEAAKIGYPVLIKAVAGGGGKGMRKVERAEDFEAALGSCRREASAAFGDDRVLLEKYVTRPRHIEVQVFGDSHGNVVHLFERDCSLQRRHQKVIEEAPAPGMDEATREAVCAAAVKAAQAVNYVGAGTVEFIADASEGLRADRIWFMEMNTRLQVEHPVTEMVTGQDLVEWQLRVASGEPLPLEQDEITLDGWAMEARLYAENPATGFLPSTGKLKHFRLPEGDVRVDSAVEEGGEVTPFYDPMIAKLIAHGADREDAAQRLAEACALVEVWPVKTNAAFLAKCASHPDFVDGAVDTGFIEARLDELTERAFSDEPAMAAIGWRLDSFLEAEARRDPWEGAPSKLLGFRMNAPRASMHLPMSTDGKATPLRVALIGGGTEDWSWDIRHADGSTFDEVTRLPTTYGKGPIQVFEGGDVQEFDFVAKIGGAGEGGASDGAILSPMPGKIVSVSVSAGQTVSKGQTLLTLEAMKMEHAMAAPFDGVVAELSAVAGGQVSEGVVLARLEPAVA

SEQ ID NO: 16955 - protein, 378 aa, Caulobacter crescentus
MDFALGETADAIRETTARFAADKIAPIAAKIDETNSFPRELWVPMGDLGLHGITVEEEFGGLGLGYLEHVVAMEEVSRASASVGLSYGAHSNLCVNQIRRWATPEQKARYLPKLISGEHVGSLAMSEAGAGSDVVSMKLRAEQVGDRYILNGTKFWITNAPHADTLVVYAKTGEGSRGITAFIVEKGMKGFSVSKKLDKMGMRGSDTAELVFEDCEIPEENVMGPVGGGVGVLMSGLDYERAVLAAGPLGIMQACLDVVLPYVRDRKQFGQPIGSFQLMQGKIADMYVALNSARAYVYAVAKACDAGKTTRFDAAGAILMASENAVKVSLEAIQALGGAGYTKEWPVERLLRDAKLYDIGAGTNEIRRFLIGRELIGG

SEQ ID NO: 16956 - protein, 669 aa, Caulobacter crescentus
MFSKILIANRGEIAVRVIKTCRRLGIKTVVVYSDADAGSLAVEMADETVHIGASPANQSYLVADKIIAACKQTGAQAVHPGFGFLSENAGFAQRCADEGIVFIGPNPGAISAMGDKIESKKFAQAAGVSCVPGHIGEIADTAEAVKISEEIGYPVMIKASAGGGGKGIRVAWTRKDVEEGFPAVRAEAKASFGDDRIFIEKFIESPRHIEIQVLGDKHGNVVHLFERECSIQRRNQKVIEEAPSPLLDEATRNAMGAQAVALAKAVNYDSAGTVEFVAGQDKSFFFLEMNTRLQVEHPVTELITGLDLVEQMIRSAYGEKMAFGQSDLSINGWAIESRIYAEDPYRKFLPSIGRLVRYDPPAEGDKDGPNGGYVVRNDAGVREGDEISMFYDPMISKLCTWAPTRLAAIDGMGRALEDFHIEGLGQNIPFLAAVMDEERFRSGKLATSYIKDEFPDGFNGTTPTAVQLDILTAVGAAMQRVYATRARSYESGLIGEARDEWVVAIGETRLRVKVGGEDGAVAVELLDEGRTLFLTDIDWRPGKPVFKAVLNGLAFTVQAAPAAEGFTIRHRAAKTRVLVLTPRSAELHDKLPEKQAADTSKLVLSPMPGLVVSMDVTTGQQVREGEVVCVLEAMKMQNIIRAERDGVVKAVNAKGGDPVAADEVLVEFA

SEQ ID NO: 16957 - protein, 279 aa, Caulobacter crescentus
MTFVTRFAPSPTGYLHRGHAYSALTAFEAARVTGGRFLLRIEDIDATRCRPEYEAAILEDLAWLGLNWEAPVRRQSEHLADYEAAIAGLRDRGLVYRCFKTRKEIDIGRAPHEPAIAYVGAPLGADEEAQRLARGEPFAWRLSLAAAREALGGFDHLSFLEEGADGSSPRTVQALPETAGDIVLARKDVGVAYHLAVVHDDALQGVTHVTRGEDLFEATHIQRLLQALLGLPTPIYRHHGLLTGPDGKRYAKRDKAQTLRELRASGVSAQDLRAELGFS

SEQ ID NO: 16958 - protein, 442 aa, Caulobacter crescentus
MQAINVSIGFDKRLWAQDLAGSRAHARMLMNQGVIASHDGEEILEGLARVEDELLSGTFPFRDEYEDIHMNIEARLRELIGPTAGRLHTARSRNDQVAVDFRLWVRDACDRTVGQLEALQKALLTQAEAHAESLMPGFTHLQPAQPVTFGHHLMAYVEMFGRDAGRFRDARARMNECPLGAAALAGSPFPIDRQQTASALGFDRPTANSLDSVSSRDFALEALSAASITATHLSRLAEEIVLWTTPMFGFIKLTDAFTTGSSIMPQKKNPDAAELIRAKVGRILGSLTTLTVVMKGLPLAYSKDMQEDKVPTFEAFDALELSLLAMAGMIADLTPNTENMAKAAGAGFSTATDLADWLVRTLNMPFRDAHHVTGSAVKTAEGLGVDLADLSLAQFQAIEPQITKEVYAVLTPAASAASRMSYGGTAPAQVRAQIARWKELLA

SEQ ID NO: 16959 - protein, 421 aa, Caulobacter crescentus
MNHFEYGPQGLACEGVPLAKIAAEVGTPVYVYSRATLERHFVVFRDALAMSGVVDPLIAYAVKANSNVAVLKVLGDLGAGADTVSEGEVRRALAAGIPGERIVFSGVGKARREIAFALQAGVAEINVESEPELNLIAEVAAELGVRAKVAFRVNPDVAAGGHAKIATGKSENKFGVSFAEAARLYANASNNANLQPVGVACHIGSQITDLAPMRAAFTKMRGLVEQLLAEGLSVERLDLGGGLGVPYFNHPEPPSPAEFAAMVGEVTQGLPVTLAFEPGRVIAANAGVLVSEVIHVHERPEGRKFLVIDAAMNDLVRPAMYDAFHDIRPVIQRTGETVYDVVGPVCETGDTFTRDRALPPFAAGDLVAFMSAGAYGAAMASEYNTRPLVPEVLVDGDRYAVIRQRPTYDEMLARDLVPDWV

SEQ ID NO: 16960 - protein, 176 aa, Caulobacter crescentus
MNDLPKPEVLISEAEIAERVQKLAEQIAPRIDDDTVVVCLLTGGLWFAADLTRALWKAGRDVRFDALWLASYHDERKSSGRCEVRADLQRPLVGRRALVVDDVFDTGLSLSEAARLVKDAGASEVLTAVFARKPWPKDRGMEPDFVAWEAPARYLVGYGLDDEGKSRGLPYIGAMD

SEQ ID NO: 16961 - protein, 359 aa, Caulobacter crescentus
MPKPGIMDIHAYVGGKSKVEGIAHPVKLSSNENILGSSDKAKDAYRNAVDRLHIYPDGKANFLRAAVAERYKLEPERLTFGDGSDEIFALLCQVYLEPGDNIVQGEHGFAAYAIGARACQGEVRMAKEVNHRVDIDEVIKCVDERTRLVFIANPANPTGTWLTGEEIRALHAALPPSVVLVLDGAYAEFCSDPHFEDGLELARTAENVIVTRTFSKIHGLAALRVGWGYAPEHIIAPIERIRPPFNTSIPAQEAAVAALFDDDFQDRSRALVEQWRPWLAQQLGGLGLEVTPSAANFVLATFPTTPGKTAPEAEAFLASKGYLVRAVGNYNLPHAIRITIGLEEQNRAVVELLSQFMGR

SEQ ID NO: 16962 - protein, 404 aa, Caulobacter crescentus
MRAFCVGGGPVAENPKDWDVATKLIRGGIARSQFMETAEALYLTQGFTYDSAEGADRRFAGEDPGFVYSRFNNPTVKMFEDRLALLEGAEVCRAQATGMASIHAALMGLVRAGDHVVAGRALFGSCRWIVSEWLPRFGVETTFVDATDPKAWEAAMRPNTKAVLVETPSNPVLEITDIRAVSELAHAVGAKVIVDNVFATPIFQKPLELGADVVVYSATKHIDGQGRVLGGAILTSEAINEEFYRDSLRHTGPSLSPFNAWVMLKGLETLDLRVRRQADSAFALANTIAEHKKVQTVLYPFRPDHPGHNVAKAQMTGGGTVIALDLGSREAAFKFLNALEIVDISNNLGDAKSMATHPPTTTHRSVPEAERPSLGVTEGGVRLSVGLESVEDLKRDVIRALDQA

SEQ ID NO: 16963 - protein, 311 aa, Caulobacter crescentus
MTQPRHFIDLWKLDGATLRLLLDDAHARKAARKGWPQGKVDADAPAKDRVLSMIFQKNSTRTRFSFDAAMRQLGGSAIISTASDMQLGRGETIEDTAKVLSRMVDAVMIRANSHADVERFAQVSTVPIINGLTDKSHPCQIMADILTIEEHRGPIAGKTIAWVGDGNNVCSSFIHAAPLLGFELKIACPAVYHADLHDLARAEGLQGKVSMTTDPKAAVSGADVVVADTWVSMGDTDHDERLAALEPYQVDDRLMDLAAGNGVFLHCLPAHRGEEVTDAVLDGPRSLVWDEAENRIHAQKSVLAWCFGAIG

SEQ ID NO: 16964 - protein, 405 aa, Caulobacter crescentus
MSTATSSTTSQHHIMGVYNRAPLAFERGRGARLISTEGEEYLDCVAGIATNGLGHAHPALVEVLKAQAEKLWHVSNIYRIPEQEELADALCANSFADVVFFTNSGTEAVECALKTARKYHSANGQPERIDIYGFDGSFHGRTYAAVNASGNPSYVDGFGPRLPGYSQLTFGDHDAIKAAIASPTTAAIIVEPVQGEGGARSIPTQCLVGLRQLCDEHGVLLIYDEVQCGMGRTGKLFAYEWAEGGEPHIMAVAKALGGGFPIGACLATTEAAKGMTVAAHGSTFGGNPLAMAVGKAALEIIKSPETLDNVKTVSGFFTQQLNGLKDRFPDVIVDVRGKGMLIGVKLIPNNRDFMVLARDEKLLIAGGGDNCVRLLPPLNLTIEEASEAIAKLEKACEAARAKAAA

SEQ ID NO: 16965 - protein, 326 aa, Caulobacter crescentus
MEEPAPLVSIPEAPVPDHGKAEWFRGADGATLRAATFFPAGPARGSVVLSPGRSEPLEKYFEVVDDLLARDFAVLLHDWRGQGLSARALPDRLKGHARGFKTFVSDYEALLDAFETRMPKPWIAVSHSMGGCLTTLALAQGETRFAAAVLSAPMLGLNTAGVPPWLARPLAFVMSRVGLAGEYVQTPYDPLTQTFQGDGLTHDETRYDRYQAQLRAHPEIALGGMTWGWADFAISACAWLRRSKSVEAIAIPVIILGAELDNRVLNADSESIARRIPKGRYVEVPGAFHEILVETDARRALFWQAFDETVDPIAAREPLISPNVSD

SEQ ID NO: 16966 - protein, 237 aa, Caulobacter crescentus
MPTLVLLRHGQSQWNLENRFTGWVDVDLTAEGEAQARKGGELIAAAGIEIDRLFTSVQTRAIRTGNLALDAAKQSFVPVTKDWRLNERHYGGLTGLNKAETAEKHGVEQVTIWRRSYDIPPPELAPGGEYDFSKDRRYKGASLPSTESLATTLVRVLPYWESDIAPHLKAGETVLIAAHGNSLRAIVKHLFNVPDDQIVGVEIPTGNPLVIDLDAALKPTGARYLDDSRAEALPKVG

SEQ ID NO: 16967 - protein, 498 aa, Caulobacter crescentus
MFSSPRADLVPNTAAYENEALVKATGFREYDARWLFGPEINLLGVQALGLGLGTYIHELGQSKIVVGHDFRSYSTSIKNALILGLISAGCEVHDIGLALSPTAYFAQFDLDIPCVAMVTASHNENGWTGVKMGAQKPLTFGPDEMSRLKAIVLNAEFVERDGGKLIRVQGEAQRYIDDVAKRASVTRPLKVIAACGNGTAGAFVVEALQKMGVAEVVPMDTDLDFTFPKYNPNPEDAEMLHAMADAVRETGADLAFGFDGDGDRCGVVDDEGEEIFADKIGLMLARDLAPLHPGATFVVDVKSTGLYATDPILAQHGCKVIYWKTGHSYIKRKSAELGALAGFEKSGHFFMNGELGYGYDCGLTAAAAILAMLDRNPGVKLSDMRKALPVAFTSLTMSPHCGDEVKYGVVADVVKEYEDLFAAGGSILGRKITEVITVNGVRVHLEDGSWVLVRASSNKPEVVVVVESTQSEDDMRALFRQEVKPRLGDRVGKYNQEI

SEQ ID NO: 16968 - protein, 498 aa, Caulobacter crescentus
MRDIAHFVKGQTLVGASGRFGDVFNPNTGEVQARVQFATDAELDAAVQVAAKAQVGWAQTNPQRRARVMFEFKRLIERDMNTLAEILSSEHGKVIADSKGDIQRGLEVIEFACGIPHILKGEYTEGAGPGIDVYSMRQPLGVCAGITPFNFPAMIPMWMFGISIAVGNSFILKPSEKDPTVPVKLAELMMEAGAPAGVLNVVHGDKSAVDAILTHPLIRAVSFVGSSDIAHYVYQTGTAHGKRVQAMGGAKNHGIVLPDADMDQVVKDLSGAAFGSAGERCMALPVVVPVGQKTADELRERMVAEIASLKVGVSTDPDAHYGPVVSAQHRDKIADYIRIGQEEGAELVVDGRDFQLQGFEKGFFIGPSLFDGVKKGMKTYHEEIFGPVLQIVRAETLEEAIALPSEHQYGNGVAIFTRNGRAAREFAANVNVGMVGINVPIPVPVAYHTFGGWKRSAFGDTNQHGVEGVKFYTKVKTVTARWPEGEVADSSFVIPTMK

SEQ ID NO: 16969 - protein, 771 aa, Caulobacter crescentus
MRTLKTFALASAATLIATAAQAAPTTWAYSAKTGVGASYEAYVDGAYKAGGKTGAVSKVWFSIADGVLTETMYGLIHEAQIKQMRVAVETASGLAIEGADTTSKTEYLHVDAAGRPLSPAYKITTTDRQGRFVIEKRIFTDPDRNALFVRVTVTALKGAVTPTLLLEPHMANTGGGDVGAASASALTAHEGKAFLSLKASKPFAKASASVLKDGDALAALKATTTSAKGAIVLAGELPKVAKSETFDVVIGFGADAKAADRTAAATLKTGYAEVLARYNGEGAHVGWEDYLASLNELPRLRDASEDGGKLLQASALMLKVQEDRTYAGALIASLSNPWGDTVDATKSSTGYKAVWPRDFYQCAMALAALGDKETPLAAFHYLPTVQVGPKTPGNKGDGGWFLQKSHVDGTPEWVGVQLDQTAMPIMLGWKLWTWGWLPDAELKAFYGKMLKPAADFLVKGGKVNLDWNTATITPPFTQQERWEEQGGHSPSTTAAVIAGLVVAGDIAEAAGDAGSAELYRKTADDCAGKLEARMVTTKGTFGDGHYYLRLNSDQDPNNKSPVEARNGQAPVAEDKMLDAGFLELVRYGVRRADDPAILASLPEIDDEALEDLYRVRYSFTFPGVEGSFPGWRRYGVDGYGEDTKTGANYGADNQMRPGQRGRVWPIFTGERGHYELAVAGLSGKPDPTAVQKIRDTYVKAMELFANEGLMIPEQVWDGVGTDSAHGYVRGEGTDSATPLAWSHAEYVKLLRSVSDGQVWDHYAPVKARYAR

SEQ ID NO: 16970 - protein, 526 aa, Caulobacter crescentus
MNAEWWRGAVIYQVYPRSFADSNGDGVGDLPGITAHLDHIASLGVEGVWLSPFFTSPMKDFGYDVSNYCDVDPIFGTLADFDALIARAHALGLKIIIDLVFSHTSDEHPWFVESRQDRSNAKADWFVWADAKPDGSPPSNWQSVFGGPAWTWDARRGQYYMHNFLSSQPQLNLHNPAVQEALLAVTQFWIDKGVDGFRFDAINFSMHDPALTDNPPLPPGGKRTRPFDFQDKIHNQSHADIPKFLSRLRALTDAAGGRFSVAEVGGDHAEREMKLFTAGEDRLNSAYGFLYLYADKLIGEMIPQGAAMWPGEAGEGWPSWTFSNHDAPRAVSRWAEGRDRKAFAELCLLLLMGLRGNVFVYQGEELGLPQAHVPFERLQDPEAIANWPQTLGRDGARTPMPWVSGALNAGFSGVEPWLPVDPEHLPLAVDAQEADPASTLNVARRLIGLRRAYPALRTGAITFIDTNSPLLIFQRGEGADAVLLAFNLGFETVTWSLPDGWTLIDGVNLGGEGQMPVCAGLIARRG

SEQ ID NO: 16971 - protein, 580 aa, Caulobacter crescentus
MTTAAAAAPDPYLQRKPQDEVIYFVLPDRFENGDATNDHGGPALGALADGFDPARAGFYHGGDLKGVTRRLDYIQGLGATAVWLAPIFVNRAVQGPPGQESAAHHGYWITDFTDVDPHLGTKADFKALVDAAHARGMKVYMDIVLNHTADVIQYKECPDNRCAYRGVSDYPYVRRGGVDGAPINDGFDGKDFSKLKRPDWAYTPYVPPGQERAKTPAWLNDPIYYHNRGDSTFAGESSLLGDFATLDGVFTEHPRVVEGFIEVYGRWIDDFGIDGYRIDTARHVNPEFWQAFVPAMLARAKAKGIENFHIFGEVFDADVATLARHVKVDKLPTVLDFAFQAAVTDVALGRAGPDRLASVFAGDVVYEGGEATARQLPTFLGNHDMGRIGHFVLKAHPKIGDDALLARITLANAIMLTARGVPTIYYGDEQGFTGDGDYADSREDMFPSQVASYNDNRLVGSSAKGPRTAFQTDSVLYRRIAALAKLRGMTPALREGRQVTRIAEGKPGLLAFSRLMAGTEVLAVFNTSDKPIKARVPVEMGSAAWKSLHGACISSAVAPGSYAVELAPFDYMICVSEGRS

SEQ ID NO: 16972 - protein, 635 aa, Caulobacter crescentus
MARLSGRVLPRTLIGLHCSTRRLDRSRGPLQWLLPRERRMRLRQKIKREIRFLKGLSRTLKRVKTIAPDSPNLICDDLEAAVDKWGPRPAITFEGKTITYADLDAMANRYAHWAKGLGLTRGQTVALFMPNRIEYLAIWYGLTKVGVATALINNQLTGAALAHCLTISQAMHCIVDAETSPCFEDVKGQLERHMQQWVLGPVHDDQRDLLKALKSCSQLRPDRETAREGLTASDTALYIYTSGTTGLPKAARITHMRAQLYMRGFAGSTGAKDTDRIYITLPLYHATGGLCALGAALLNGGSVVLRKKFSATHFWPEIVAEQCTMFVYIGELCRYLANQPEHELERAHKLRMIFGNGLRADVWDDMLDRFKVGDVLEFYGATEGNVSFFNFDGKRGAIGRIPSYLRKKFNIRIVKFDVETETPIRGPDGCCIEAGPEEVGECIGHIGSDARSNFTGYADKAATEKKVLHDVFEKGDAWFRTGDLMKVDHDGYIYFIDRIGDTFRWKGENVATSEVAERLAGFEGVLEVNVYGVKVGDLDGKAGMASLVTEGDFDLEAFAKYVDEALPSYARPLFVRLQKAIETTGTFKYRKIDLVNEGFDPSKTKDPLYFRDPAKGYVKITKTICAKIEGGGFRL

SEQ ID NO: 16973 - protein, 459 aa, Caulobacter crescentus
MTARWTPAAWRAKPAKHLPTDYPDMGAVERVEQTLRQMPPLVFAGEARRLKSQLGEVAEGRAFLLQGGDCAESFKEFHADNIRDTFRLILQMAVVLTFAGGKPVVKVGRIAGQFAKPRSEPIEVQGDVTLPSYRGDIINGMDFNEAERVPDPDRLLKAYGQSAATLNLLRAFASGGYADLYNIHRWTLGFVGDSPQGARYRELSEKISEALTFMSAVGVTPDTQPDLRRVEFFTSHEALLLGFEEAMTRVDSTSGDWYDTSAHLLWIGERTRQLDGAHVEFMRGVKNPIGLKCGPTMEGDDLLRLIDVLNPHNEPGRLTLYGRFGSDKIADRLPRLMKATKSAGRSVVWATDPMHGNTLKASTGYKTRPFDRILSEVKSFVEIAQAEGVHPGGVHLEMTGQNVTECLGGARAVSETDLADRYHTHCDPRLNGEQALELAFLVAEKLKAARDDQRRLAAG

SEQ ID NO: 16974 - protein, 252 aa, Caulobacter crescentus
MDIKDSIVLVTGGNRGIGEAFVRAFLAAGATKVYVGARDPASAAHLVAEAPDRVTALRLDVSDAETISAAAAQCPDVTILVNNAGAFTMQTLMGAQDMSAARQEMEVNYFGPLAMSRAFAPILARAPRSAIVNVLSAGGLVAVPSMGGYSPSKFAARAMTTCLRAELAPQNTHVLALNVGSVDTRMASHVEGFKEAPATIAQAGLKALKREADEVDTDFMAIDVRAHLARDPKGLELAMRRALTSDRVSTGR

SEQ ID NO: 16975 - protein, 387 aa, Caulobacter crescentus
MSGFWLTEEQEAIREGVAKVCAAFDDEYWRRTDETGEFPEAFVAAIAEGGWLGVAMPENVGGAGLGLTEAAVMMQSVAQSGAGFSGASAIHLNIFGPMPLVKFGSDEQRNRLLPRIISGEDKMCFAVTEPNSGLDTSSLETRAEKVEGGYRLNGRKIWTTGAQRANKILIIARTTPKDQCAKPHQGLSLFYTDRENIEAKPIPKMGRKAVECNMLFIEDLFVPAQDLVGEEGKGFQYLLHGLNPERVLFAVEAIGLGRAALAKATTYANERIVFGRPIGQNQGVAHPLAKSWAELEAANLLAFKAASLYDQGKECGAEANAAKYLGAEAGFHACEASVLAHGGMGYAKEYDVERYFREAMIARIAPVSREMILNFIAERVLGLPKSY

SEQ ID NO: 16976 - protein, 428 aa, Caulobacter crescentus
MRRFLFSDPDFQTAFKAFLDERRGSPADVDAAVAGVLEAVRTQGIEALLDYSRRFDKVDLTAETIRVTAEEIEAGAAETPADVREAIAFAAARIRAYHSRQRPADQAWTDEAGVELGWRWTPLEAVGVYVPGGRAAYPSTVLMNAVPAQVAGVDRIAMVTPPGKLQPAVLAAAKEAGVTEIWRVGGAQAVAALAYGAGPIQPVDKIVGPGNAYVTAAKRRLYGVVGIDALAGPSEIVVVADNKNNPDWIAADLLSQAEHDPAAQSILITDDEAFAAAVEQAIAERLKTLATGEDAAASWRDHGAVIIAPLDESPALVDAIAPEHVEFALDNPERLSDRVRHAGAIFLGRVTPEAIGDYVAGSNHVLPTSRAARFQSGLSIYDFIKRTSIVKCDPASFAVLGPHTVALAKAEGLPAHALSASVRLPSGD

SEQ ID NO: 16977 - protein, 429 aa, Caulobacter crescentus
MDRIAIIGGAQLNGTIPVSGAKNSAIKLMAASLLTDEPLRLTNMPRLADTRFLGKLLTRLGVQVTESDGSDGQQTLLHAPEITSGFAPYDLVRQMRASFNVLGPLVARSGQAKVSLPGGCTIGARPVDLHLQAIEALGAKIDLHEGYVYAQAPRGLKGAEIRFPFVSVGATEHAMLAAVLADGVSVIHNAACEPELVDLQECLNAMGAKVEGAGTPTVTITGVPRLHGATHAVIPDRIEMGTYAVAAAMAGGEVRLSNARPGLIDALLDKLKEAGASVEETADGCIIRRNGQRLTAVDIETAPFPGFATDLQAQFMALMTTAKGESRIRETIFENRFMHAPELMRLGADISVSGGEARVRGVDQLEGAQVMATDLRASVSLVIAGLVARGETTVSRIYHLDRGFERLEEKLGACGAQVRRIKGDGEAEL

SEQ ID NO: 16978 - protein, 500 aa, Caulobacter crescentus
MANAGPGARVIDLDLRRAAGPVDRFFDLSIGSDYPGTLIREDSQAQLKTTVDELGFRYIRFHAIFHDVLGTVKVQDGKIVYDWTKIDQLYDALLAKGIKPFIELGFTPEAMKTSDQTIFYWKGNTSHPKLGPWRDLIDAFVHHLRARYGVEEVRTWFFEVWNEPNLDGFWEKADQAAYFELYDVTARAIKAIDPSLRVGGPATAGAAWVPEFLAHVKKSGSAVDFVTTHTYGVDGGFLDEKGVQDTKLSPSPDAVVGDVRRVREQIEASAFPGLPLYFTEWSTSYTPRDSVHDSYVSAAYIVEKLRRVKGLVQAMSYWTYSDLFEEPGPPTAPFQGGFGLMNPQGIRKPSWFAYKYLNALKGRELVCADDQVFAARDGDRVAIVAYAWRQPDQKVSNRPFYTKLHPASDVEPLKVRLTSLKPGRYKLRVRRVGYRRNDAYSAYIDMGSPTTLTESQLQSLQALTEDRPEIEKALKVSGETVVDLPMRANDVVLIELEPLA

SEQ ID NO: 16979 - protein, 324 aa, Caulobacter crescentus
MSKAPIIVTGAAGFVGYHVAERLLDRGETVIGVDVFNAYYDPALKEARAARLDGRDGFTMLRMDIADHEALADLVKASGAQKVIHLAAQAGVRYSIENPFAYERSNLAGHLSVLEACRHAGVEHLVYASSSSVYGDRPLNGDGFRESDPAETPVSLYAATKRSCELLSQSYAKLYGFPQSGLRFFTVYGPWGRPDMAYFSFTEKMLKGETIEVYGEGKMARDFTYIDDIVDGILGVLDNPPAKGGHEVYNIGDNDPVGLMDMINTLEAALGIEANKVFRPMQPGDVTATYANIDKLHALCGYKPKVKLAEGLARFVDWRRGARV

SEQ ID NO: 16980 - protein, 435 aa, Caulobacter crescentus
MRVAMIGTGYVGLVSGACFADFGHVVTCIDKDPSKIERLERGEIPIFEPGLDDLVARNVREGRLFFTLEGAQAIKDADAVFIAVGTPTRRGDGHADLSYVYAAAEEIAGLIDGFTVVVTKSTVPVGTGDEVEAIIRKTNPNAQFAVVSNPEFLREGAAIEDFKRPDRVVVGTDDERAQAVMRDLYRPLSLNETPIVFTGRRTSELIKYAANAFLAMKITFINEMADLCEKVGADVQSVAKGIGLDKRIGAKFLNAGPGYGGSCFPKDTIALVKTAQQYGAPTRLIETTVEVNTARKKAMAEKVAEAMGTRELTGKTIGVLGVTFKPNTDDMRDAPSLDILPALQAMGAKVQAFDPEGAKEAAHMLAGVEFKSGAYDAAEGADALVILTEWDQFRALDLDRLKSLLKTPVVVDLRNVYKPAEMERHGFTYASIGRG

SEQ ID NO: 16981 - protein, 435 aa, Caulobacter crescentus
MRVAMIGTGYVGLVSGACFADFGHVVTCIDKDPSKIERLERGEIPIFEPGLDDLVARNVREGRLFFTLEGAQAIKDADAVFIAVGTPTRRGDGHADLSYVYAAAEEIAGLIDGFTVVVTKSTVPVGTGDEVEAIIRKVRPDAQFAVVSNPEFLREGAAIEDFKRPDRVVVGTDDERAQAVMRDLYRPLSLNETPIVFTGRRTSELIKYAANAFLAMKITFINEMADLCEKVGADVQSVAKGIGLDKRIGAKFLNAGPGYGGSCFPKDTIALVKTAQQYGAPTRLIETTVEVNTARKKAMAEKVAEAMGTRELTGKTIGVLGVTFKPNTDDMRDAPSLDILPALQTMGAKVQAFDPEGAKEAAHMLAGVEFKAGAYDAAEGADALVILTEWDQFRALDLDRLKSLLKAPVVVDLRNVYKPAEMVRHGFTYASIGRS

SEQ ID NO: 16982 - protein, 327 aa, Caulobacter crescentus
MQTVLVAGGAGYVGSHCCLALAAAGFRPVVYDDLSNGHREHVQWGPLEVGDIRDGARLDAVFAAHAPVAVLHFAARIEVGESVKNPGAFFDNNVGGTITLIEAARRAGVNAMVFSSTCATFGDPVHLPMAEDHPQAPLNPYGRSKLMVEQALADYDRYVGFKSAVMRYFNAAGADPEGRIGEWHEPETHAIPLAIQVALGQRSHFTIFGDDYDTRDGTAVRDYIHVLDLADAHVSALRRLLAGGSSDSYNLGTGTGTTVRELVDGVGRVTGKPLPVQMAPRRAGDAPVLVGDNTRAREHLGWKPSRDLDATLSSAWRWHQAQALVGR

SEQ ID NO: 16983 - protein, 487 aa, Caulobacter crescentus
MSEPLLSADAWTDRLFSDGWVKPSGGVIAVQEPATETVLTQVGRADRSDVARAAASAKAAQPAWAALTADARQAILLRAADLLVEHAPDLAPWIMRESGSVAAKAAVELEHAAGFVRQAGAMATEAAGLVLPSSPGKTSIARRVPLGVVAVISPFNFPLVLSIRAVAPALATGNAVVLKPDPRTPISGGFLIARVFEAAGLPAGLLHVLPGDAEAGDALCRDPNIAMVAFTGSTGAGRKVGEVAGAHLKKVALELGGKNPLIILDDADPDVAASNAAWGAWLHQGQVCMTAGRLLVQRGIHDAVVERLAAKAGHLPVGDPMRGDVALGPLISRGQLDRVHAIVSDTVADGARLVAGGTHKGLCYAPTVLTGVAPGMRAFEEEIFGPIAAVTVFDDLDEAARLANDGPYGLSAGIISGSVGRAMTLGAKLEVGHLHINDQTVDAGPHSPFGGMKASGNGTRISGPANLDEFTTWRWETVKAAATAYPF

SEQ ID NO: 16984 - protein, 496 aa, Caulobacter crescentus
MTPIDHVAFQARLQPGGLAAVELANGRRWTYAELDADIARAVGVLRRRGVGEGDRLAVLAKNQVLLVILHLACARLGAMFAPLNWRLSASELHALIEDADPAMIVGDDQLAAAGLDGVDLDVLRAEIDCADPDTRARADRERPSLILYTSGTSGRPKGALLSERNLDQTAINFGRLGKVTHESVFLVDAPMFHIIGLITSIRPVLMHGGAILVSDGFEPARTLGRLGDPTLGITHYFCVPQMAAMLRRQPAFDASALRRLTAIFTGGAPHPAPDIRAWLAEGIPMVDGYGMSEAGTVFGMPADATLIDARAGSAGLCMPPVFTRIVDEQDRDCPPGVPGELLLKGDNVFRGYWRRPEDTARAFTEDGWFRTGDIALADAEGYHWLVDRKKDMFISGGENVYPAEIEAALADHPAILECAVVGVPDPRWGEVGHLVVTCREGAVLDLALILSHLEDRLARYKLPKALTLVAALPRTASGKIQKTVLRERLLAGDPRT

SEQ ID NO: 16985 - protein, 470 aa, Caulobacter crescentus
MSSPQAVFERRDPVTGAVATTSIAMTADQARVAVDAAQAALPTWSALGPNARRALLSKAAAALEARADDFVAAMMGEIGATEGWARFNLMLAASMVREAAALTTQVSGEVIPSDKPGCLAMAVREPVGVILGIAPWNAPIILGVRAVATPLACGNTVVLKASESCPRTHELIAEAFAAAGLPEGALSIVTNAPADAAEVVGALIDHPAVRRINFTGSTAVGKIIAKRAAEHLKPVLLELGGKAPLIVLEDADLDEAVKAAAFGAFMNQGQICMSTERIIVVDAIADAFVAKFAAKASSLAVGDPREGKTPLGAVVDLKTVTHVQGLVADALADGAVQVSGGPANGVLMPATVVDKVTPAMRLFREESFGPVVAVIRARDEEHAIALANDTEYGLSASVFTRDIARGLKVARRIQSGICHVNGPTVHDEAQMPFGGVKASGYGRFGGKAGVDAFTELRWITVETQPGHFPI

SEQ ID NO: 16986 - protein, 399 aa, Caulobacter crescentus
MTAAYICDGIRTPIGRYGGSLSKVRADDLAAIPLKALVARNPSLDLAAIDEIVLGSANQAGEDNRNVARMALLLAGYPVSVPGVTVNRLCASGLEAVGYAARAIASGHNDLVIAGGVESMSRAPFVMGKADSAFSRSAEIFDTTIGWRFVNPAMRKLYGVDSMPETAENVATDYGVNREDQDAFALRSQARTAAAQANGFLAGEITPVEIPGKAGPTIVDRDEHPRETTMEALAKLKPIVREGGTVTAGNASGVNDGAVALVIASEDAVKRHGLTPRARITGYASAGVEPRVMGIGPVPAVRKLMAKTGLAIGDFDVVELNEAFAAQGLAVLRQLGLPDDGAHVNANGGAIALGHPLGASGARLVLTALRQLEASGGQRGLATLCIGVGQGAALAFERV

SEQ ID NO: 16987 - protein, 241 aa, Caulobacter crescentus
MSRPIELHYWPTPNGWKISIALEEMGLPYEMVPVNIGVGEQFKPEFLAISPNNRMPAIVDPDGPDGQPISIFESGAILQYLARKSGQFYGANERERVDIDQWVMWQMGGLGPMAGQTHHFRQYAPAIIADQRQIAYGVIRYTNETHRLYGVLNKRLEGREFVCGQLSIADFMIWPWIVPWKNQGIILEEFPHLKAWFERVGAREAVQKGFKLGAELRSGGLQASGKAAEDARRVLFGQRAR

SEQ ID NO: 16988 - protein, 332 aa, Caulobacter crescentus
MTASAHDPAREAIETIRARVFAFPKRHFLSAGDLNAPQAADLLDLADAFVALNRQTSKTLDILKGRTLMNLFFENSTRTQSSFELAGKRLGADVVNMNPKTSSVAKGETLIDTAVTLNAMRPDLLVVRHASSGAASLLSQKVSGHVVNAGDGQHEHPTQALLDALSIRRAFGRVSGLTVAICGDVLHSRVARSNVALLHTLGASVRLVGPPTLMPAQAERWGVAVHHDMKSGLAGADVVMMLRLQLERMQGAFVPSTREYFRFYGLDREKLSRAAPGAKVMHPGPMNRGVEIDSDVADDPAVSLIQDQVEMGVAARMAVLASLAARIEGAGR

SEQ ID NO: 16989 - protein, 381 aa, Caulobacter crescentus
MRAEIEPFHAIAISRLAHQLKMEGRSIIHMEFGQPSTGAPSKALAKAHDILDAEAMGYWESPLLREKIAQRYQTLYGVTVEPERIILTCGASPALVLALSSLFKPGDRIALARPGYVAYRNTLKALHLEPVEIACGPEDRFQLTAKHLADLEPAPVGVIVASPANPTGTIIEPAELEAIAKVCAARGIRIISDEIYHGLSYAGRTPSMLEFAPDALIVNSFSKYFSMAGWRLGWLLTPPGEDLDRARAYVGNLFLTAPSLAQHAGLAAMDCIDELEGHIDVYRANRQLMLDALPALGLKEIAPPDGAFYIWANIAHLTDDSLGFCEDLLRDTGVATAPGVDFDPVEGKRFIRFSFAVSTPEVEEALRRITPWFEARTASAA

SEQ ID NO: 16990 - protein, 776 aa, Caulobacter crescentus
MPSFSRPLEESLHRAVAYANQRKHEYATLEHLLLSLTDDEDAAGVMRACDVDLAALKKSLSNYLDVELTSLVVDDEEDAKPTAGFQRVIQRAVIHVQSSGREEVTGANVLVAIFSERESHAAYFLQEQDMTRYDAVNFIAHGIAKKAGASEPKSVKGASTGSNATEEDGDKSTTKTGGEALEAYCVDLNEKARQGKVDPLIGRANEVERAIQILCRRTKNNPLLVGDPGVGKTAIAEGLARKIVTHQVPEVLEGATIYSLDMGALLAGTRYRGDFEERLKQVVKELENHPNAVLFIDEIHTVIGAGATSGGAMDASNLLKPALASGTLRCMGSTTYKEFRQHFEKDRALVRRFQKIDVNEPTVEDTIKILKGLKTYYEDFHKLKYTADALKVAVELSAKYITDRKLPDKAIDVIDEAGASQMLLPESRRKKTIGVKEIESVVAKIARIPPKSVSKSDTEALKELESDLKRAVFGQDEALSQLAAAMKLARAGLREPNKPIGSYLFSGPTGVGKTEAAKQLAQTLGIEMLRFDMSEYMERHTVSRLIGAPPGYVGFDQGGQLTDAVDQHPHAVVLLDEIEKAHGDVYNILLQVMDNGTLTDSNGKKVDFRNVVLIMTTNAGASDAQRNSIGFGRSKVEGEEEAALKRLFTPEFRNRLDAVVAFKPLSADIIRQVVQKFVMQLEAQLADRNITIELSDDAADWLAKNGFDELYGARPLARVIQEHIKKPLADDILFGRLVRGGHVKVVLKDSKIDFEIDSSTAPKAGKTDETEPAMAE

SEQ ID NO: 16991 - protein, 407 aa, Caulobacter crescentus
MDFNDSTEEAAYREKARAWLAENAAAHRAKWGELKPNTPEHMAAAKEWQATKASAGYACITWPAAIGGGGGTPIQSVIFGQEETKAGLGYGYFTIGLGMCVPTVMAFSDGETKKRFVSPAVRGEEIWCQLFSEPAGGSDVAALRTRAVKDGDEWVINGQKVWTTGAHYCDYGILLTRTDPDVPKHKGLTMFWIDMKDPAVECRPIHQMSGGREFNEVYFTDLRVKDSQRLGEVGDGWKVALVTLMNERLAVGGSAGPNYREIMKLARELAGPTGPSLKDQSFREKLADWYVQSEGLKFTRFRTMTALSRGQTPGPESSIGKIISANQLQELANTAVEMEDQYGILSDPEVAPAEAAFQQSLMWAPGLRIAGGTDEILKNIIAERVLGLPGDVRVDKDVAFKDMPTGR

SEQ ID NO: 16992 - protein, 344 aa, Caulobacter crescentus
MVRGVLDNADRSFDEKLWKGVTEQGWLGACIPEEHGGLGLGRVELCAIAEELGRAVAPIPFASTVYVLAEGLMAYGSDAQKASILPRIAAGEVIGCLATSEGPGVVGPATLQCRVEGGKLSGTKIPVTDGDVADIALVLASEGGRPGLFLVDLKGAGVSRETLKSLEPTRGVAKIAFDGAPAERVGDAGAGFEVVQGILDRAAVLLAFEQLGGADRCLEMAKEYALGRYAFGRVIAGYQAIKHKLADMYVKNEVARSNAYYGAWALNDGAPELPVAASAARIAASEAFWFASKENIQVHGGMGFTWDVDCHLYYRRSRQLSLVAGAPKVWKERLVAELEKKNAA

SEQ ID NO: 16993 - protein, 436 aa, Caulobacter crescentus
MISRYARPEAAAIWSSQTKYKIWFEIEAHAADAMAELGVIPKLAAETIWEKGRDAVWDSDRIDEIERVTKHDVIAFLTHVSEIVGPEARFLHQGMTSSDVLDTCFAVQLSRATDLLLEDVDLVLAALKRRALEHKMTVCVGRSHGIHAEPITFGLKLAGYYAEFQRAKERLAMAKFEIATCAISGAVGTFANVDPRVEQHVADKMGLAVEPVSTQVIPRDRHAAYFAALGVVASSVERLATEIRHLQRTEVLEAEEPFDPGQKGSSAMPHKRNPILTENLTGLARLVRSAVVPAMENVALWHERDISHSSVERGIGPDATIHLDFALRRLAGVIERFNIYPDNMAKNLDKLGGLVFSQRVMLALTHKDVSREDAYAAVQGNAMKVWRGEGRFLDFLKADPVVSKALTETELEELFDLGYHTKNVDVIFQRVFGEQG

SEQ ID NO: 16994 - protein, 637 aa, Caulobacter crescentus
MAATDCLRSGWGGHLSLLLGRHRDSDDLRSPAINPAAIRVRILRAVPAVCLIVGVAMAMDYIVTILLLNEPAAYVPIATLVISTIIAVPLAYWLAGQRLRLETMHAELKASLDAKQDAIEDAEVALAKYREVDRLYRLLGDNLTDHVALWSPLGERLYSSPSIERITGYTLEEFMALPPAALVGEADFRRVQGIIRSLEPGGEPVSADYESLCKDGSRIWVESTYSLLGDGSGILLVTSRDITERKRLELDIAKALQMAEAASAAKSDFLANMTHELRTPLTAIIGFAEVLRRSRNLNKTAARQVGHILDASNTLLSVVNDVLDFSRLEAGGLELDPAPFDPAAMASSCAGLVAERAEAKGLAVEVRAPRGLKPMNLDGPRLSQVLLNFLSNAVKFTSHGAITVALRQTIDGDQAVLRGEVTDTGIGIAPEHRENIFDRFSQADAAVSRRFGGTGLGLAISRRIIERMDGRIGVDSVEGQGSTFWFEVRGPLADLPTQEAVETSPLDADAGVRLLLVEDNAVNRELICAILEPFGVAIETANDGVAGVEAMRQGHYDLVLMDVQMPMMDGLTATREIRAMEGARGASTPIIAMTANVLPEQVANCMAAGMDDHLGKPISPAKLLEAVARWSGRSHAA

SEQ ID NO: 16995 - protein, 369 aa, Caulobacter crescentus
MKTRAAVAFEAKKPLEIVEVDLEGPKAGEVMVEIKATGVCHTDAYTLDGFDSEGIFPSILGHEGAGVVVEVGAGVTSVAVGDHVIPLYTPECRQCKSCLSGKTNLCTAIRATQGKGLMPDGTSRFSYKGQPIYHYMGCSTFSNYTVLPEIAVAKIRRDAPFKTACYCGCGVTTGVGAVTNTAKVEPGANAIVFGLGGIGLNVIQGLKLVGANMIVGVDINPDREEWGRKFGMTHFVNPKDVQGDLVAHLVALTDGGADYTFDATGNTGVMRTALEACHRGWGESIIIGVAEAGKEISTRPFQLVTGRVWKGTAFGGARGRTDTPKIVDWYMDGKIQIDPMITHVLPLEEINKAFDLMHAGESIRTVVTF

SEQ ID NO: 16996 - protein, 403 aa, Caulobacter crescentus
MAKIKVANPVVDMDGDEMTRIIWKLIKDKLIFPYLDLELDYYDLSVENRDATDDQVTIDAANATKKHGVAVKCATITPDEQRVEEFKLKKMWKSPNGTIRNILGGVIFREPIICQNVPRLVPGWTQPIIVGRHAFGDQYRATDFKFPGKGTLSIKFVGEDGQTIEHEVFKAPDAGVAMAMYNLDESIRDFAHASFAYGLNRGYPVYLSTKNTILKAYDGRFKDIFQEIYDAEYAEKFKAAGIHYEHRLIDDMVASALKWSGGYVWACKNYDGDVQSDIVAQGFGSLGLMTSVLMTPDGKTVEAEAAHGTVTRHYRQHQKGESTSTNSIASIFAWTRGLAHRAKLDDNQDLANFAATLEKVCIDTVESGYMTKDLALLVGDKQGWLTTEGFLDKIDENLKKAMA

SEQ ID NO: 16997 - protein, 425 aa, Caulobacter crescentus
MDLRYQTGFGSYFETEAHPGALPVGRNSPQKVPFGLYAEQLSGSAFTAPRHENRRTWLYRLRPSAGHEAYQPYAQDKLVSAFPGPATPNRLRWSPLEIPAAPTDFVDGLVSLAGNADAATLGGIAAHVYLVNVSMKNRVFYNADGEMLIVPQMGELTLVTEMGVLKAGPGHIAVIPRGVRFRVEVEGPARGYVCENYGAAFRLPELGPIGANGLANPRDFEAPVAAFEDIDTPTQVIQKFQGALWAATWDHSPLDVVAWHGNLTPYRYDLSRFNTINTVSYDHPDPSIFTVLTSPSDTPGTANCDFVIFPPRWMVAEDTFRPPWFHRNVMSEFMGLIHGAYDAKAGGFVPGGASLHNCMSDHGPDVASHKKATEVVLAPHKIDGTMAFMFESRWVFRPTHLALESAALQSDYDACWTGFPKARLS

SEQ ID NO: 16998 - protein, 357 aa, Caulobacter crescentus
MTLVTDQNPLGLDGFEFVEFTSPDPAAMKALIEQLGFVAASKHPTKAATRYKQGRVNLIVNEETTGQVADFRADHGPSANGMAFRVENAEQAYADAVKRGAKPADASRSLLGADAKVLEGIGGSLLYLVDRYGDAGTIYDAWEQVPGAALAEAKNNVGLDLLDHLTHNVKRGQMRTWSTFYNQIFGFEEQKYFDIKGQATGLFSQAMIAPDKAIRIPLNESQDDKSQIEEFIRQYNGEGIQHLAMTTDNIYDTVEKLRARGVKLQDTIETYYELVDKRVPGHGEDLERLRKNRILIDGAVGEEGLLLQIFTENLFGPIFFEIIQRKGNEGFGNGNFQALFESIELDQIRRGVITVDA

SEQ ID NO: 16999 - protein, 378 aa, Caulobacter crescentus
MERGRMLVLDRKPLTPAWASPMRQALEGVQGYKAGMTLAEAARRTGLSAFSKLASNENLLGPSPKVAEAVMAAMAEPHIYPDPHSDVLRAAIGARLGVSPARVVVSPGSEALIDYVFRAVLHPGDSILLSSPTFPTYEIFGRCAEARIIDVPRLANFDIDVPAVCAAAALGPKLLVLCTPNNPTGNALKAADFQAILAATPRSTVVFVDEAYREYHEAFDTFAMLDAWGGPWVSARTFSKAYGLAGLRMGYGVASSPELVDYLDRIRPPFNVTAVSQAAALAAWEDQDYLKRTVDLTIAERGRVEAVLDDMGVEHTESHANFVFLRSPAGPEATAAHLLHQGLIIRPTPVAGGWVRITIGRPADNDALIAALPAALSL

SEQ ID NO: 17000 - protein, 265 aa, Caulobacter crescentus
MSLILTEKRGHIAILTLNRPDAMNALGAPGDGDQVAAACEAINDDQDIRCVILTGAGKAFSAGGDVKAMKAREGAFGGNGVKVRDGYRKNIHRIVRAIYGLEVPSIAAVNGAAIGLGCDVACMTDIRIAADTARFGVTFLKLGLIPGDGGAWLMPRTIGMSRAAELLFTGDVIDAAKAAEWGLISKAVPAGDLMGEALALAERIAQQPPHALRMAKSLLKHGQTASYDTLMEMSAAAQAIAHHTEDHMEGVDAILEKRSPVFKGA

SEQ ID NO: 17001 - protein, 693 aa, Caulobacter crescentus
MAQRIASHEERRQTALLLALSFAVAAAIVFSENLTRTTLGVAAFWPANAFLAAGLLTLTSVRRLVLIAVFVFFHVAVCLQAGDGPLKALVFATVDGLEAGAVWAAFRRFWNGAPRVRTLRALAQLPAITTPIAAGSALICATVLHFGYGAPFAESLVDWLLRSALGLAVALPATLVLIDAEHRRSFQRPWSEKLLLMFSVVTVALLCAHPAAGAPPVLMFPVTLAAAYRLGARGAALAAFLTIGIIMPMVISVGSSSFNSTQDTVIQARTIQVFMGVLFYTCLAAGLAFGQQNRLKRLLLRREQLTRAARGRALAATEAKTEFLATMSHEIRTPLNSVLGFAQLLAAREDLPPDARRQVNLIDSAGAALLTVVDDILDFSRVEAGQIELLPGPTSAAALLRDTVAIMAPEARAKGLSMDVEIIDPIGVLHDLDADRLRQVLINLLNNAVKFTEEGRIDARLIIEPGDIEDRLRFEVLDTGVGIELDKQGLLFQRFSQTDSSPSRLHGGPGLGLAIAKALIDVMGGKIGVDSVPGRGSCFWVELSAPVAEPAPAPEPAKPPAPGAARILIVDDHPINLEIGAALLTLVGYEVDLAENGKQAVEKAEAGAYDLILMDIHMPLMDGLQATRAIKALRTSTGKAPIIAMSADALPRQVERCYAAGMVDHVAKPIQREVLYAKIERWLHPLRDGDKPA

SEQ ID NO: 17002 - protein, 555 aa, Caulobacter crescentus
MASERFDYIVIGAGSAGCVLAARLTEDPNIKVLLLEAGGKNKSILVKMPAGVGQLIKDKGEQNWGFWTEAEPHLDNRKLWWPRGKGLGGSSAINGMIYIRGHARDYDQWRQMGLTGWSYSEVLPYFKRSETHHAGGDAYHGGSGPLHVSKGESDSPFYSTLVEAGRQAGHKTTKDFNGYQQEGFGPYDLTIRDGQRWSAAMAYLNQALSRPNLTCVTEACTTRIILDKRRAVGVEYVVGKSREKQVAYADAEVLLSAGAVQSPQILQLSGIGAAEDLAPHGIAVAHESKGVGANLQDHLDVCVSWTAKNLKTAYSANKGLNKLGVGMNYMFFGKGLGRQQFLESGAFLKSRPDLDRPDLQIHGVLAIMQDHGKVVVEKDGFTLHVCQLRPESRGKVGLRSADPFDDPTILGNYLATEEDRRAIREGVRIARETVAQAAFDPYRDAEYAPGADVKSDADLDAWIRSKAETIYHPVGTCRMGVAGDPMAVVDDQLRVQGVQGLRVIDASVMPTLIGGNTNAPTIMIAERAADLIRGKTPAAPLDVPVYEDGRAVAAE

SEQ ID NO: 17003 - protein, 267 aa, Caulobacter crescentus
MLGRDFEGFTVVVTGGSTGLGRAIAVETARRGAGLVVINFARSAEEAEETARLVQAEGAKAVLAQGDVSSDEDCRRIAAAADASGRIDALFNNAGMTKFAPNHADLDAVNAEDFLRLYSVNVVGAFQMVRAARTLLEAAPSPGAVVNTSSIAGVVGNGSSVPYAASKGAMTTMTLSLARALAPRIRVNAVCPGFIDTPWFEKAMDAERIDRLRAGAAAATPLKVASTAEDIAGAAVFLASPASRHVTGETLLVDGGLHLGGASLSMR

SEQ ID NO: 17004 - protein, 690 aa, Caulobacter crescentus
MRRTTAHRAFRRTMNLIAGGKPLASALKAIVQAVEAEDPTILCGILLLDADRRRLLMGAAPSLPTFYNQAIEGVEIGPSVGSCGTAAYLGRRVMVDDIQSSPLWVGYQELAAQAGLAACWSEPIKTSDGAVAGTFAIYHREVSKPNKEDIAFIEAAAQLAAFAIDRRRAEEELAASEARARLLAEQALETSRNLSNFFDVSADLLSISNMQGRFVKVNRAWETALGYPIEALEGVPFLPLLHPEDQQSTRVQINRIEVDDEVNGFVNRYRRADGSYCQLEWRARRCDDLVFGVARDVTERLRIQAEMAEARDAAEAANRAKNDFLANMSHEIRTPLNGVIALAAALDETPLTSKQAEMVAMIRRSGETLERLVSDILDVSKIEAGQMTLQPQAFDLGALVDGLLDVTRLRAKEKGVAVRLERSPTAAGGFLGDSVRIGQVLSNLFSNAVKFTDQGEVIVRVDVEEAGNGQAARLFVEVEDTGVGFDAEKAEMIFQRFNQADSTITRRFGGSGLGLSISKTLVEMMGGEITAQSSPGAGSLFRVTLPLSRTQMGPDAEIDAPRSAAPGEGLKVLLAEDHPINQRVVQLILEPCGAAVTVVENGAQAVEAMASGAFDVVLMDMQMPVMDGLAATRAIRAREGEGQRTPIIMLSANAMDVHRREALQAGADLHVPKPITIAALLDSIGQVMAR

SEQ ID NO: 17005 - protein, 376 aa, Caulobacter crescentus
MTLSRRDLLAAGAAGALAGPALAAEGPSLRELAKAKGIVFGSAVGAGPKGSITGSFEDARYREILARECGVLVHENELKWYVLRARGPQGFDFERADRIADFAKANGQALRGHTLLWHHPQWFPNWVKGHDFGAKPAEAAAKMVTEHIQALCRRYPQMISWDVVNETVDPADGSIRSTFLSDAMGKEEVLDLSFHVAREAAPKARLVYNDYMSQEAGNEKHRYGVLKLLEGFRKRGTPVDALGVQSHIGAENADSFTGFGKPQEKAWTAFLNDVTGMGYDLMVTEFDVHDKGLPYDFGPRDAAVAAYAKAYLDQMLSYRQTKEILAWGLVDKYSWLQGRWPRQDGQPKRPTLYDDTYQPKPLREAVAAALKAAPAR

SEQ ID NO: 17006 - protein, 388 aa, Caulobacter crescentus
MSQDLLPGVTGVLALADGAILQGVGCGAVGDAVGEVCFNTAMTGYQEILTDPSYMAQIVAFTFPHVGNVGVNGEDVEQITGVAETAARGALFRDVPTVQANWRADGDFDAWMKARGVVGLAGVDTRALTRKIRETGMPHGVIAHSPDGQFDLAALVAKAKAWAGLEGLDLAKDASTTQTFTWDEGLWSWPEGYAKLDKPKYEVVVIDYGVKRNILRALAHVGARATVVPASTSAEDILARNPDGVMLSNGPGDPAATGQYAVPEIQKLVASGKPVFGICLGHQMLALALGAKTVKMEQGHHGANHPVKDLTTGKVEIVSMNHGFTVDTASLPAPVKETHVSLFDGTNAGIALDGKPVFSVQHHPEASPGPTDSLYLFERFAGLMDAAK

SEQ ID NO: 17007 - protein, 346 aa, Caulobacter crescentus
MKALRYHGARDVRYESMDDPTPQSDRDAIVQVTACSICGSDLHIYHGHGFSEDLGFCVGHEAVGEVVEVGRGVQRLKVGDKVMLPAAVGCGRCRSCLSGVIQTCENGQGACYGLSARLQGSQAEAVRVPAADMNAVPVPDGVSMDQALMMTDALATAWFGARNAEVRPGASVAVIGLGPIGLMAVESAYVMGAHVVYAIDPLPARRALAEEAGAIALHPDEALARVREDTKGRGLDCVIEAVGGEATVDAALRLVRPRGVVSVIGVQQAKRFAFPLERAFGAGLTFRVGTCSVPEELPALFPLVRSGRLRPEKYISHRLPLSDGPEAYRLFESREAGALKMVLTPG

SEQ ID NO: 17008 - protein, 653 aa, Caulobacter crescentus
MNAATLVDTHAVDTALQEAFEAAPEGFALFDAEDRCVIWNARYGELWSKWGVTLAVGATFESLLLAGLAAGRFPEANGDRAAWLAHQLGRRKLDRIEEIREEFGEYLRFESRRTPAGGLITTCANLTNLRRREAQALAARSFLDTIVENTPAMLFVKDGDTGAFLLVNRAAENQLGVPRAELLGKSDYDFFPKEQADAFAADDRRVIASGKLVTIDEEPLDTPHNGRRWLQTRKIAIPGEDGRRHLLVICEDITERKAGAAALAEALQKAEAGSVAKSEFLANMSHEIRTPLNGVIGMAEVLSRTALDDAQREMMEVILNSGRALNLLLSDILDLSKIEAGGLELSRDPLDLREAITAAVAVFKAVAESKGLVFRLTFADDFHDHVLGDALRVRQIVANLTSNAVKFTTAGSVIIEARTLVAEDGRIDLTVSVQDTGEGFDEDSADRLFERFQQADGSVTRKVGGTGLGLPIARRLARLMDGEISCVAHPGEGATFVFEALFLADGQRTPAASADPAGELALDRRLRVLLAEDHPTNQKVIGLMLADAADVTVAEDGQAAVEAFEKHAYDVVLMDTQMPVMDGLAAIAEIRRREREAQARRTPIISLTANAMPHQVRACLEAGADLHLAKPVSIQGLFATLGAALETRPGGEG

SEQ ID NO: 17009 - protein, 263 aa, Caulobacter crescentus
MAQDMTYARYLALDELLSAQKPLSDRHDELLFIVIHQTKELWLKEILHEVALALKLIAGGDVEPAYKALARVSRIQTVMTLSWDILATMTPADYLSFRDDLGTSSGFQSHQFRALEYLLGLKDQSFLKFHTERPEALAMLKSALESPSLYDVAIAQLPRHGLTVPDAALHRDFSQTYVPSPEVEAAWLEVYRDPKRYWELYQLAEKLVDLDDALVTWRHKHVLTVERIIGGRPGTGGTDGVGYLASTLRRRAFPELWSLRTKL

SEQ ID NO: 17010 - protein, 1099 aa, Caulobacter crescentus
MPKRTDISSILIIGAGPIVIGQACEFDYSGVQACKALRAEGYRIILVNSNPATIMTDPDVADATYIEPITPEMVAKIIEKERPDALLPTMGGQTALNTALALEADGTLAKFGVEMIGAKAEVIDKAEDRQKFRDAMDKLGLESPRSRACHTLDEAMEGLEFVGLPAIIRPSFTLAGTGGGIAYNVEEFKEIVERGLDLSPTTEVLVEESVLGWKEYEMEVVRDKADNCIIVCSIENIDPMGVHTGDSITVAPALTLTDKEYQWMRAASIAVLREIGVETGGSNVQFAVNPADGRMVVIEMNPRVSRSSALASKATGFPIAKVAARLAVGYTLDELKNDITGGATPASFEPSIDYVVTKIPRFAFEKYPGSEPLLTTAMKSVGEVMAIGRTFKESVQKALRGLETGLSGFDEVEIAGADDPDNGKEAVIRALGVPTPDRLRVIAQAFRHGLTVDEVNAACSYEPWFLRQIAEIVRQEGWVKAGGLPQTAQGFRELKAQGFSDARLAKLTASTEKAVRAARQALNVRPVFKRIDSCAGEFLASTPYMYSTYEFGALGQIPQCESDPSAAKKAVILGGGPNRIGQGIEFDYCCCHAAFALDQIGVESIMVNCNPETVSTDYDTSDRLYFEPLTAEDVLELLHVEMSKGTLAGVIVQFGGQTPLKLAHALEEAGVPILGTSPDAIDLAEDRERFQQLLNGLNIAQPENAIARSWDEARAEGDKIGFPFVMRPSYVLGGRGMEIIRDHEAMERYIAGAGEISLEHPILLDHYLSRATEVDVDALCDGKDVFVAGVLEHIEEAGVHSGDSACSMPPFSLKAETVEELKRQTVQMALALNVRGLMNVQFAIEEPHSDNPRIYVLEVNPRASRTVPFVAKTIGQPVAAIAAKIMAGESLASFGLKDVPYDHIAVKEAVFPFARFAGVDTVLGPEMRSTGEVMGLDWKRDGETGMGPAFARAFAKSQLGGGVKLPTKGTAFVSVKESDKPWIVEPVKLLQAAGFKVLSTEGTQAYLAAQGVQVEHVKKVLEGRPHIVDVMKNGGVQLVFNTTEGKQALEDSFEIRRTALMMKVPYYTTSAGALAAAQAIAGAPAEALDVRPLQSYAAE

SEQ ID NO: 17011 - protein, 511 aa, Caulobacter crescentus
MTQYRITFEGPVILGAGLAGLTAALSATTGAAKTALVLSPTPLASGCSSAWAQGGMAAALSGDDSPALHAADTIAAGAGLCDPQAVDLLTREGPQAVRDLAALGAPFDRKADDGFVLSLEAAHSAARVARVGGDGAGAAIMAAVIAAVRATPGIEVRENARARRLLQDANGRVVGVLADVDGALVEIRSTAVILATGGVGGLYAVTTTPAQVRGEGLGLAALAGAMIADPEFVQFHPTAIDIGRDPAPLATEALRGEGAILRNADGKAFMADYHPAKELAPRDVVARALHAERAAGRGAFLDATAAVGAHFPHEFPAVFEACMSAGIDPRRQMIPVTPAVHYHMGGVATDLDGRASLPGLYAAGECASTGVQGANRLASNSLLEAAVFGARAGRAAAAEGATGGPPVSLEPLPDLPDAALQGLRKAMSRDAGVIRDADGLTRLLGEIETLEAGHGQGPILVAARLIVTAALAREESRGGHCRIDFPATDPVGVRTFVTLDGREPGLRYAAE

SEQ ID NO: 17012 - protein, 270 aa, Caulobacter crescentus
MIREGSMPANGRKSIFITGAASGIGLACAKRFAQEGWFVGLSDIDKVGLKAALLAVGPENGSIHPLDVRDREAWENAIGEFGRETGGKANALLNNAGVARFGMLNEMSDADCDIQIDINLKGVINGARAGLPLLKAAGGRLINVASCAGLYGSPKLAVYSATKFAVRGLSEALDVEYAAYGVSVACVMPWFVETPILNAASDGSNKSMSESLKAGGLEVYPVEDAAQVVWEAAHGKALHYLVGKRAKQMRFAASHMPGSLRKQLRSRPLL

SEQ ID NO: 17013 - protein, 200 aa, Caulobacter crescentus
MTETDQTPDTAPEAAPEVAPIVSDDLAPLRAKTIVLVGLMGVGKSSVGRRLANVLGLPFRDADNEVEAAAGRSISEIFAELGEPAFRDGERRVIARLLDEPPHVLATGGGAFVNAETRALINEKAVSVWLKADVELLARRVSRKDNRPLVRGKDPVKVLTELAEARYPAYAEAQVHVETGDTPHMVAVEAILTALRQAHA

SEQ ID NO: 17014 - protein, 370 aa, Caulobacter crescentus
MIRTVPVGLGERAYDVVIGPGLLDQAGERVAAVLGKRKRVAVVTDAHVGAHHGERLSAALQGAGITVDLITIAPGEESKSFEGLADLSDRLLALNLERGDQIVALGGGVVGDLAGFAAAIYKRGIDFVQVPTTLLAQVDSSVGGKTAIDTPRGKNLIGAFHQPRLVLADLDVLATLPARELACGYAEIIKYGLLGDFAFFEWLETNVQAVLDRDVDALVRAVGRSVEMKAEIVAEDEKEAGRRALLNLGHTFGHAIEAEMGFGEALKHGEAVGVGMAQAFRFSARLGLCPSQDAVRAQAAIKAAGLPTTLADVRPEPFSADALIAHCGQDKKAQGGKLTFVLARGIGDAFVAKDVDRAALKAFLVEEGAV

SEQ ID NO: 17015 - protein, 366 aa, Caulobacter crescentus
MKAAVLREVGKPLQIETVAIGKPGPREVLIRTKAAGVCHSDLHFVEGSYTHALPAVLGHESAGIVEAVGSEVRTVKVGDHVITCLNPYCGHCEVCLTGHMNLCISPETRRSKSDAPRLFKEDLNGATGPMAQFLNLSSFAEMMLVHEHACVAIRKDMPFDRAALIGCSVMTGVGAVMHTSNVRPGETVAVIGCGGVGLATINGAAIAGAGRIIAIDRLAGKLELAKTFGATDVVDASQVDDIAKAVVELTGGGVHHSFEAIGLKATAEASFKMLRRGGTANVIGMIPVGTKIELHGVDFLGERRIQGSYMGSNRFPVDMPRLVDFYMSGKLKLDELISRRIKLEDVNSAFDELKRGELARSVIVFD

SEQ ID NO: 17016 - protein, 686 aa, Caulobacter crescentus
MPHLDRRSLLAALGALALPPALARAAAIDADVRSGTIQDVEHVVILMQENRSFDHYFGTLNGVRGFGDRFPIPVRDAAGRKESSVFVQAWSKDKLLAPFPLNSAQTFAHMRVEGTPHSWTDAQDAWDQGRMDRWPDAKKPWSMGYFQRADIPFQFALADAFTLCDAYHCSTQTGTNTNRLFLWTGTNDGLGKAGGPSISNSHDNFAEKGGAKESYTWTTYPERLLQAGVSWRIYQDMADNFTDNPLAGFKAYRDAYKDLPGSNPRLKQLGLSTWHLDKLREDVVNGRLPQVSWIIAPAADSEHPNPSSPAQGADYTARVIDALTADPKVWARTVFLVMFDENDGFFDHVPPPAPPSYDASGKLLGASTVDLTAEHHRVRNPTEARSERDDLMGRPYGLGPRVPLYVISPWSRGGWVNSQVFDHTSVLRFLEQRFGVMEPNISPWRRAVCGDLTTCFDFKTPNTNPFPALPATREPAGRAARLGRAKPPTPASVVAPPQAKGPRPSRALPYALAVDGRYADGALALTFSNAGQAAGVLHVYDRLRLDQVPRRYTVGPQTQLTDVWPAGAYDLWVLGPNGFHRRLAGENVGVEIAARPSPEGLLLTISNVRPSPRKVRVEILGQEPWQVDFTGVDTVARTFATQQGWYDLTARLEGEPTWLRRLAGRIETGADSISDPWVGGEAVLKV

SEQ ID NO: 17017 - protein, 444 aa, Caulobacter crescentus
MRSLIAAVERIDPLTIYGRVAAVNGLLIEVRGGLTRLAVGARVEIERFGQKPLPAEVVGFRETRALLMPFGPVEGVGPGAEIRIVPEGAVVRPTKAWLGRIINAFGEPIDGLGPLPQGEVPYPLKTPPPPAHARGRVGERLDLGVRSMNVFTTTCRGQRLGIFAGSGVGKSVLLSMLAKEATCDAVVVGLIGERGREVREFVEETLGEEGLRRAVVVVATSDEPALTRRQAAYMTLAISEFMRDQDQEVLCLMDSVTRFAMAQREIGLAAGEPPTTKGYTPTVFTELPKLLERAGPGPIRPDGTTAAPITALFTVLVDGDDHNEPIADATRGILDGHIVMERAIAERGRFPAINVLKSISRTMPGCQHPHERDIVKGARQVMSAYSNMEELIRIGAYRAGADPVVDRAIRLNPAIEAFLSQDKEEATSLDDSFGMLGQILQSEY

SEQ ID NO: 17018 - protein, 330 aa, Caulobacter crescentus
MQSQPVADTPLKSIASTPVGACLQRHQLDDPAFAALLTRHYSQITAEWEMKMEYILQDDGRFRFDRPDAIADFARRHGLRLHGHALIWYSQVMPAFRALDGQGKRFADAYRNYILAVAGRYRGLAASWDVINEAVDDNGVDLRRSAWTDNLGVDEHMILAFHHAKEADPDAVLFINDYNLENNPTKRATFLRMVERLLKAGAPIGGIGTQSHLGLDFTPPGMCRIALRDLASLGLPIHVSELDISFGDKPETAPLPKLLSRQADLARELAQAYMDLPRAQRFAFTVWGVRDRDSWLRGANGERPWEHPLPLDDAGQPKPMFQALAEVLSG

SEQ ID NO: 17019 - protein, 737 aa, Caulobacter crescentus
METPARRNTPMDAKVEDNIAGKCPMGHGRGPANRDWWPQSLRLEGLNQHAPRSNPMGEAFDYAEAFKSLDLDAVVSDLHALMTDSQEWWPADFGHYGGLFIRLAWHAAGTYRITDGRGGAGGGQQRFAPLNSWPDNTNLDKARRLLWPIKQKYGAKLSWADLYVLVGNVALESMGFKTFGFAGGRADQWEPEELYWGPESTWLDDKRYSGERELDSPLGAVQMGLIYVNPEGPNGNPDPLASARDIRETFARMAMNDEETVALIAGGHTFGKAHGAGDASLVGVEPEGGAIEAQGFGWASKHGTGKGPDAITGGPEVIWTQTPTRWSNHFFDNLFKYEWELTQSPAGAKQWQAKNAPADIPDAFDPNKTHVPRMLTSDLALRFDPAYEKISRRFYENPDQFADAFARAWFKLTHRDMGPIGRYLGPLVPKEELIWQDPIPAVDHPLADDKDIAALKAKILATGLSASDLVSTAWASASTYRQSDKRGGANGARIRLAPQKDWAVNNPPVLAKVLAALEGVQKDFNASAGGGKKISLADLIVLGGAAAIEKAAKDAGTSVTVPFAPGRMDASAEQTDAHSFEALEPRSDGFRNYRGPGKHYMAPEEALVDRAQLLGLSGPELTVLVGGLRVLGANADGSKDGVFTNRPGALSNDFFVNLLSMETTWSPTAANAFAGHDRKSSEPRWTATRVDLIFGSHAELRAFAEVYACADSQEKFVCDFVTAWNKVMNADRLDLAA

SEQ ID NO: 17020 - protein, 403 aa, Caulobacter crescentus
MPFPTIPPIAGVEIATGRAGFYKHEREDLLLMRFAEGTSAAGVFTRHGVGSAPVDWCKRQLAATGGADVRALVVNAGCANSFTGKPGADAVRRVATAVGKRFDCRQRDVMMASTGVIGVILDDSKITARLPEVESRLKADAWAEAGRAIMTTDTFPKGAYATAVIDGHEVKIAGIAKGSGMIAPDMATMLAFVATDAAIAPAALQTLVSLYTRTTFNCVTVDGDRSTNDTLLLFATGQSGAPKIHRAGDKRLADFREKLEGVLLDLALQLVKDGEGATKFVKITVNGAESPASARKIARTIAESPLVKTAFAGEDANWGRIVMAVGRADEPVAREKISVKFGDLYAARDGLISAEYDEAKMSAYVKNQAFEVSVDVGVGRGSATVWTCDLTKQYVAINGDYRS

SEQ ID NO: 17021 - protein, 254 aa, Caulobacter crescentus
MSLFDLTGKVAIITGSSRGIGKAIAERMAEHGAKVVISSRKAGPCEEVASELNAKHGAGTAIAVPANIASKDELQNLVDETRKAFGKIDICVCNAASNPYYGPLAGIADDQFRKILDNNIISNHWLIGMVAPEMQARKDGSIIIISSIGGLRGNAIIGAYNISKAADFQLARNLAHEFGPDNVRVNCIAPGLIKTDFAKALWDNPETLKRSTTAVPLRRIGEPDEIAGAAVYLASKAGSFMTGQAMVVDGGATI

SEQ ID NO: 17022 - protein, 424 aa, Caulobacter crescentus
MTIQTLETTALKDLYEIGEIPPAFHVPKTMYAWSIRKERHGKPTQAMQVEVVPTWEIGEDEVLVLVMAAGVNYNGVWAALGEPISPLDGHKQPFHIAGSDASGIVWKVGAKVKRWKLGDEVVIHCNQDDGDDEECNGGDPMFSSSQRIWGYETPDGSFAQFCRVQSRQLLPRPKHLTWEESACYTLTLATAYRMLFGHKPHELKPGQNVLVWGASGGLGVFATQLAAVAGANAIGVVSSEDKREFVLSMGAKAVLNRGEFNCWGQLPKVNGPEFNDYMKESRKFGKAIWQITGNKDVDMVFEHPGEQTFPVSVFLVKRGGMVVICAGTTGFNLTMDARFLWMRQKRVQGSHFANLMQASAANQLVIDRRVDPCLSEVFPWDQIPAAHEKMLANQHLPGNMAVLVCAQRPGLRTFEEVQELSGAP

SEQ ID NO: 17023 - protein, 564 aa, Caulobacter crescentus
MTDTVSENTNETLILPGLTGLLREAADAVALFVAEAKPAVLAHIAPQGGKVDRKLADVHQHRVHGYGWYASYAELMNQVAGWAQRLEAEGRFGEIEALLAQLLFSEYSAQLVGGVPMNQGEIVRPQHLVEDRAVLNRLTSEAMTRLAAEGGSQAVKARIAQRLAEARGRPTLEQTGLDETFEMIRDQFHAFAEEKVTPFAHEWHLKDELIPLELVQELGELGVFGLTIPEEFGGSGMGKTAMCVVSEELSRAWIGVGSLATRSEIAGELILTGGTDAQKEYWLPRIASAEILPTAVFTEPNTGSDLGALRTRAELKGDSYVVTGNKTWITHAARADVMTLLVRTDPATTDYRGLSMLLAPKPRGTDEAPFPAEGMSGGEIGVIGYRGMKEYELGFDGFTVPAENLLGGVTGQGFKQLMATFESARIQTAARAVGVAQAALEVGLSYALDRKQFGQPIFDFPRVHNKLAMMAAEIMGVRQLTYFAAHQKDEGKRCDLEAGMAKLIAARVAWAAADNALQIHGGNGFAMEYAASRLLADARILNIFEGAGEIQAQVIARRLLDGGN

SEQ ID NO: 17024 - protein, 208 aa, Caulobacter crescentus
MIKVHHLNESRSQRILWLLEELSLPYEIVQHTRDAKTRLAPPSLTDVHPLGKSPVIQDGALVVIESGAIIDYIIRRHGGGRLAPDAASADYDRYQQWLHYAEGSAMLPLMLNMYVGRLGEAGAPLHPRIQSEIANHLAFVNDSLAGRDYFVGDSLTGADIQMSFVPEVAKAMGKLADYPHMAAWIGRMHARPAWKTALDKGGPYALGA

SEQ ID NO: 17025 - protein, 560 aa, Caulobacter crescentus
MLVVTRRSRAARLIATAMVGGLLFFYLGWTALIVWLVANTICELWVVYLERAYRPHWGQGVIRFMRIGPPSAFAMVWSFMSAYCVLNGPMAMRYAALLILFGIVVEGVRYAMNSLAAMLSLTVWPFLMLAALPLLAKRFDLLDRLAAFAILLGLIGYVADAVRTMRASAKAREEAEAQALEASRAKSAFLAMMSHELRTPMNGVLGLAHALRGTKLDAQQSEYLEMIEQSGHGLMTILNDILDLSKIEAGKLNLEVAPFDLRKLALQTRAVWSESARLKGLDLILEVSPSAPPWVSGDATRVRQILMNLVSNALKFTESGRVVIRLGGEAGGVVTLSVTDTGVGMTAEQIGRLFTPFAQGDASIARRFGGTGLGLSICRQLAELMAGEIIVSSEPGVGSTFTVRLGLPAAAPLVAAPARAAVTQLDGARVLVVDDNLVNQTVARTILEAVGAAVAVAGDGHAALARLRIEDFDVVLMDVHMPGMDGVEAVRRIRAGEAGRTDLPVVALTADAMVGDAERLLAQGFDDAHPKPVQPAGLLATVASLRKAPTELQRLRAVGM

SEQ ID NO: 17026 - protein, 428 aa, Caulobacter crescentus
MANVTVVGAQWGDEGKGKIVDWLSNRADVVVRFQGGHNAGHTLVVDGKVYKLALLPSGVVQGKLSVIGNGVVVDPWHLLSEIDKIADQGVAITPDLLILADNACLILPLHRDLDQAREAASTQKIGTTGRGIGPAYEDKVGRRAIRVADLADPEALKPKIERLLAHHGALRRGLGLPEANAQELFDALMELAPRILSYAQPAWRVLDQAYKAGRRILFEGAQGSLLDVDHGTYPFVTSSNTAAGQASAGSGMGPSATGFVLGIVKAYTTRVGEGPFPAELFDEVGKHLSTVGREVGVNTGRARRCGWFDSVLVRQSVAINGIHGVALTKLDVLDGLKTLKICVGYKIGDKVVDYLPAGLRDQAAATPVYEEIEGWTESTAGARSFKDLNANAIKYVRRVEELIGAPVALLSTSPERDDTILMRDPFQG

SEQ ID NO: 17027 - protein, 407 aa, Caulobacter crescentus
MVYVLGGWQSDFAANWSREGRELADAFAEAVGEGLAAVDLDPEDVETGHVGNFAAELFAGQGHLGGMFGLVHPAFDGLPTARHEAACASGSVAILAAAAEIEAGRYDLACVVGVEQMRNVPGQKAAENLGSAAWVGHEFQDARFLWPRAFSDLADEYDRRYGLKYEHLMGIAEVNFANGKRNPNAQTRGWNFGPDAFTADEVANPVVEGRTRKQDCGQVTDGSAVIFLASEKRARAYADKRGIALESLPRIKGWGHRSAPLSYARKIEASRDQDYIFPQVRRAILDARARAGIAPDVSGLDAVETHDCFTATEYMAIDHLGLTAPGESWKAVENGDIAIGGKLPINPSGGLIGTGHPVGATGVRMVLDAWKQTTGQAGDYQVEGAKTVQTLNIGGSTTTTVSFVVGT

SEQ ID NO: 17028 - protein, 433 aa, Caulobacter crescentus
MTAVRSKPLGVWMCAALVVGNMIGSGVFMLPASLAPYGWNAVIAWILTIGGSLCLAYVFAKLAGAFPRAGGPFAYTEEAFGRAPGFLVAWSYWISVWVANAAIAIAAISYLSVFLPVIAKVPALPALLTVAVVWTATAINCAGARSAGWTQVVTTVLKLVPLIAVAGLAVSVLLRKGPAAITPFEPSALSGASITAAAALTLWALLGVETATIPADKVKDPARTIPRATLAGTAFAGLVYLVVSSGVLLLTPTAVLQGSNAPFVDFVSYHGGGDFRLALAAFATISALGALNGWSLIQGELPAAMAREGVFPAWFAKTSANGTPVRAHLVSSVLVTILVLMNYAKSMADAFTFMALLSTTSTLFAYLFCSLAVLRLQGQGRMDRSKALTLVAALGALYSVWTFSGAGWSVTLWGLVLLAVGAPIYWLMRRAAR

SEQ ID NO: 17029 - protein, 467 aa, Caulobacter crescentus
MNAPIRNHDVAELKRLDLAHHLPAQADHKVIAELGGSRIVTRADGCYITDGDGHRILDGMAGLWCVNVGYGRKELADAAYEQMLELPYYNTFFKTATPPTVKLAAKIAEKMGGHLTHVFFNSSGSEANDTVFRLVRHYWKLKGQPNRTVFISRWNAYHGSTVAGVSLGGMKHMHVQGDLPIPGVEHVMQPYPFGEGFGEDPAAFRDRAVKEIEDKILEVGPENVAAFIGEPVQGAGGVIIPPDGYWPAVEAVCRKYGILLVCDEVICGFGRLGQWFGHQHYGIKPDLIAMAKGLSSGYLPISAVGVADHIVAELREKGGDFIHGFTYSGHPTCAAVALKNIEIIEREDLITRTREDTGPYLAKALARLNDHPLVGETRSLGLIGAVEIVREKGTNHRFLDKEGEAGPIVRDICIRNGLMVRAIRDSIVCCPPLIVSHAEIDELVGIIEKSLTEAEPILRALKPEAVS

SEQ ID NO: 17030 - protein, 466 aa, Caulobacter crescentus
MGPAHEARDDGGGGGGMIAELAKSLSDLLTAERARFTVEHPRSVAMAKAAGAHWRGGAPMHWMNDWASPSPIFAAQGVGAQITDVDGKLYDDFCLGDTPSMFGHGDPSVAAAVSDQIKRGAGFMLPTASAAIVGKLLSERFGLPLWQAATTASDANRAAIRWARAVTGRPVILVFDGCYHGMVDDAFVVLKDGAPVMKPGLLGQVHDLTATTRVVAFNDLAALEAALAPGDVAAVLAEPVMTNCGMILPEPGFLEALRRLTREAGTLLVIDETHTISTGPGGYTRAHGLEPDVFVLGKAVAGGVPAAVWGVTAELSARMDAAQQRIGPGQSGIGTTLSGNALAMAAMRAMLSEVMTEAAYGKMLAGAERLVAGLNAVIAARRLPWSVVHVGARVELVFADPPPKNAAQMRKVLDHEAVEALHLWLINRGVLIAPFHNMMLVSPVTEDAAIDRLVAAVDGFAAAMGE

SEQ ID NO: 17031 - protein, 482 aa, Caulobacter crescentus
MTALNLVETAALIDGQWVRGEASFDVLNPADGTLIAAVADLGAAETTLAIDAAHRALPAWAARTAKERGAILRRWSDLILAHADDLARLMTDEQGKPLAEAKGEVVYGASFIDWFAEEAKRAYGHTIPTPMPGKRLASIKQPVGVCAAIAPWNFPIAMITRKVGPALAAGCTVVVKPAAETPLSALAIARLATEAGVPAGVLNIVTTTRSSEVGKVLCDDSRVRKLSFTGSTPIGKVLYQQCAGTMKKLSLELGGNAPFIVFDDADLEAAVDGAIASKYRNAGQTCVCANRLIVQSGIHDAFAARLAEKVAALKVGPGTGEGVQIGPLINEKALTKVVGLVSGAVQAGAEVLTGGDVHGLGGHFYQPTVLVGATPEMRIFQEEIFGPVAPIVKFETEAEAVELANATPFGLAAYFYSRDVGRCWRVAEQIEAGMVGINEGLISTEVAPFGGVKESGLGREGASEGLDEYLETKYLCFGGVAG

SEQ ID NO: 17032 - protein, 496 aa, Caulobacter crescentus
MTLPADMTERLAKLAPPSQAVIDGDLVEAASGATFHNVSPRDGQVLNLVTACQADDVERAVAGARAAFEDGRWRDQGPRQKKAVLFRLAELMERDADELALLESLDVGKPISDARNVDIPLAINTCRWYAEALDKVYGEVGTSPADRLSYAVHEPLGVIGAIVPWNFPLHMAMWKVAPALAMGNSVVLKPAEQSPLTALKLGALALEAGLPPGVLNVIPGLGGVAGEALALSMDVDMIAFTGSGPVGRRLMEYSARSNLKRVSLELGGKSPQIVFADCPDLEAAAQAAAWGVFYNQGEVCTAASRLLVEAPIKDAFLARVIEVAKGMKVGDPLDPSTQFGAMVSERQMNTALDYIATADSQGARRVLGGQRVRQEAGGFYVEPTIFDQVRPDQTLAREEVFGPVLGVMTFSSEDEAMRLANDTVYGLAAGLWTADVSKALRGARRLKAGLVWVNGWDACDITMPFGGFKQSGFGRDRSLHALHKYADLKSVSVTLR

SEQ ID NO: 17033 - protein, 439 aa, Caulobacter crescentus
MPDFGANDLDAFWMPFTPNRRFKRHPRMLSSASGMWYRTPESREVLDATSGLWCVNAGHDRPKIREAIQKQAAEMDYAPCFNMGHPLAFQFASRLAQITPKGLDRIFFTNSGSESVDTALKIALAYHRARGKGTKTRLIGRERGYHGVGFGGISVGGIPKNRMYFGSLLTGVDHLPHTHGLPGNTCAKGQPENGAHLADDLERIVALHDASNIAAVIVEPVAGSTGVLIPPKGYLERLRAICDKHDILLIFDEVITGFGRVGAPFAAERFGVTPDLICMAKGLTNAAVPCGAVAASGKIYDAMMDGADAPIELFHGYTYSAHPLACAAGLATLETYREDDLFARAAGLEGYWQDAMHSLADARHVVDVRNLGLVAGIELEPRPGAPTARAMEVFETCFDEGLLIRVTGDIIALSPPLILEKDHIDRMVETIRRVLGQVD

SEQ ID NO: 17034 - protein, 372 aa, Caulobacter crescentus
MSHNTFGHLFRVTTWGESHGPALGCVVDGCPPGIALTAEMIQVFLDKRRPGNGKFVTQRQEPDAVRILSGVFEDARSNGQRTTGTPISLMIENTDQRSKDYSEIAQAFRPGHADYAYFAKYGVRDYRGGGRSSARETAARVAAGAVARLIIPGVTVRAALVQIGPHKIDRSNWDWAQTEQNPYWSPDAAIVPVWEEHLEKIRKAGSSTGAVVEVEATGVPAGWGAPLYAKLDAELAAALMSINAAKGVEIGDGFDSAALTGEDNADTMRMGDDGQPVFQSNHAGGILGGISSGQPIVARVAFKPTSSILIPRETVNEAGEEIELRTKGRHDPCVGIRGVPVVEAMTACVLADAFLRHRGQTGREHFPLGASA

SEQ ID NO: 17035 - protein, 401 aa, Caulobacter crescentus
MRDDQTGFSTRAIHAGYDPADEHGALTPPLHLTSTFAFESAEAGGEMFAGTREGHFYSRISNPTTDLLERRLASLEGAEAAVATASGMGAITATLWSFLRAGDEVITDQTLYGCTFAFLRDGLTRFGVTVKQVDMTRPETLAAAISDQTRIVYFETPANPNMRLVDIAAITRIAHAAGAKVVVDNTYATPCLTRPLALGADIVVHSATKYLGGHGDLVGGIAAGGIEDMARVRLCGVKDMTGAVMSPFTAFLVLRGLKTLSLRMARHSQSAQAVARWLEDHPAVEQVFYPGLQSFPQRDLAARQMAAGGGMMAFELKGGHAAGVAMMNRLALIRRAVSLGDAETLIQHPASMTHSPYTPEERAAAGIGEGMVRLSVGLEDVADILADLAMALEPLKVAQPA

SEQ ID NO: 17036 - protein, 278 aa, Caulobacter crescentus
MAKNPFQDKVCIVTGAASGLGRALSAQLAEAGATLIIADINFPAAEELAHRMNQLGVTAKPVRTDVTLSESVRQLIEGTAAEFGRIDYLFNNAGIAVFGEIRDLSLDHWRRVIDINLMGEIYGIHYAYPQMIKQGFGHIVNVASGFGMAPGPVNSPYVASKFAVFGLSHALATEARAFGVHVTVACPGFIKTPLVDNIHCVNAAPADVLANIPVAMVPVDRAANIILTGVAKRKMVIAFPGYVGVLAFIHRFLPAVWDSMGKGEIARFRKIRKDPAVS

SEQ ID NO: 17037 - protein, 517 aa, Caulobacter crescentus
MTLAAMIAADYGTIGDILRERARENPDRLAVVMETGEAVTYAQFDALVDRVAAALQRDGVAPGEAVAVCALSSIPYAALFLGALRAGVAVAPIAPSSTPESIAGMVADCGAKLFFLDAGVAEAQKPAPVPVRPIALDGSSAGQAFDAWLAPEDATPTPVEIGPKHPFNIIYSSGTTGTPKGIIQSHGMRWKHIFVGDAIGYGHTPVSLLSTPLYSNTTLVCFFPTLAGGGTVVLMKKFDVVRYLELAAKHRITHTMLVPVQYRRLMEHPDFDRYDLSSTRMKFCTSAPFAADLKAQVLKRWPGGLVEYFGMTEGGGTCILMAHEHPDKLHTVGRPAPGHDIRLVDEDGRQVGPGVVGEIVGRSASMMNGYHGRPDKTAEATWVSPEGWTFIRTGDVGRFDEEGFLTLMDRKKDMIISGGFNIYPSDLEAVLVQHPAVFEAAVVGVPSDAWGETPVAFVALKSSQVAEADAIKTFVNGQVGKTQRLAEVVVVDSLPRSHIGKVLKRELRDSWQNSPSQ

SEQ ID NO: 17038 - protein, 642 aa, Caulobacter crescentus
MGKRLDTKAGARIEAAAADWFFQNSLDMFVVLRDSRIIRANPAWSQLTGWAAEDTLGREIRDFFHLHDTEVLTAAGHTLKTVGHAHSENRLARKGGGWLWVRTQSTILEGGGQLIVFQDISEDRAREAARLQAERSNELLRNAAGVYVWRFNPRRGVYAFDQDIPTPSAPEGGARTMTVAEMTQSIHPEDSARVWQAFSRTLQTGEHVEIDYRYLDPGADDWIHLHVAWRGVRGSSPDTYDVIGITQNVTELVAARDAALAAAETKSQFLANMSHEIRTPMNGVLGVLHLLKTEKLSDDGRRLLTEALSCGEMLSALLNDIIDFSKIEAGKLELSAEPVCPAELLRGVADMLRAQAETKGLYLRVEASDDLGWVATDPLRLRQALFNLIGNAVKFTLEGGVVARLSGRRIDSPDGARLRLRFEIDDTGVGIGEEAGARLFERFRQGDGSTTRRFGGSGLGLAICRRLAELMGGEVGFESQLGKGSTFWLEVETQACARPDTQETLADGPLFDGLHVLLVEDNATNRLIATRMLEALGARVTTAEDGAQGVAAARQGFDLILMDIQMPVMDGVEATHRIRAFNSPAGAAPILAMTANAMAHQQASYLAAGMDGAIAKPLSPLALTQAIAAALTLDPSRQRKAS

SEQ ID NO: 17039 - protein, 1078 aa, Caulobacter crescentus
MSLSRVLIANRGEIAVRIARTAAEAGLESVAIYAADDAQSPHVSAADHAVALPGAGARAYLDIAAVVAAAKAQGCDALHPGYGFLSENPHLARACAEAGIVFIGPSPEHLTTFGDKAAARALAAERGLPLIPGTGAITLEAARAFQAEHGAIMLKARAGGGGRGMRMVLDPGELDAAFAACEREALAAFGDGGLYAEKLIERARHIEVQIVGDGDQVLALGDRDCSLQRRNQKLVEIAPAALPDNLRAALAGWSERLCAGYRGLATVEFLVDADPHSPSGGEAFFIEVNPRLQVEHTVTEEVTGLDLVRLQFDLAAGKRLGELELTNTPPPFGVAIQARINAETLTPEGQVRPSTGTLSAWTPPGGPGVRVDAGVAAGLTIGAAYDSLLAKVIVRGRTPSEAASRLDRALTELKVAGVATTAPLVRAILAHPTAVTGEATTTFIAQHAETLAAEAQRLTPETTASVTRFEVLAGAEPVVAPLAATVGAITIREGDLVRPGQALAVLEAMKMEHLVSASAGGRVVKIVVQGGATVAEGQPLVFLEPAEVESALDGETVEQDLDALRPDLAEVVARHRHTLDEARPEAVAKRRKTGHRTARENIDDLVDPGSFLEYGALAIAAQKRRRSTEDLIANTPADGLITGIGTVNGALFPPDKARTAALAYDFTVLAGTQGAMNHRKSDRLMALIADQKLPVVWFAEGGGGRPGDTDTTAVAGLDVPTFRSFAQLSGLVPKIAIVAGRCFAGNAAIAGLSEIIIATRDSNLGMGGPAMIEGGGLGVFRPEEIGPSAHQWKNGVIDILADDEAHATRLAKQALSYFQGTLSTWTAPDQRRLRHAIPENRLRVYDVRGLINHLVDEGSFLELRGGFAAGMVTGLIRIEGRPMGLIANDPRHLGGAIDCEGAEKAARFLQLCDAFALPVLSLCDTPGFMVGPDSEDAAAVRRVSRQFIAGAKLRSPLFTIVTRKGYGLGAQAMAGGSFHSPAFIAAWPTGEFGGMGLEGAVKLGYRKELEAETDPVKQKALYDQLVARLYAAGKATSMAAALEIDAVIDPADTRRWVIGGLDAAAGVSRPWEVRVDSF

SEQ ID NO: 17040 - protein, 396 aa, Caulobacter crescentus
MTTTLAKPAIRPARPEFSSGPCAKRPGWTPENLRNAVLGRSHRSKLGKARLKAAIDQTREVLEVPADFLIGIVAGSDTGAVEMAMWSMLGARPVQLLAFESFGKDWVTDVTKQLKLPDVEVLSAPYGQLPDTSKVDPAKDLVFTWNGTTSGVRVPNADFISADREGITICDATSAAFAQDLDWTKLDVVTFSWQKALGGEGAHGVLILSPRAVARLESYTPAWPMPKLFRMTKANKDGGNKVSLDIFEGATINTPSMLCVEDALDALKWASSIGGLQAMQARADQNLKVLADWVAKTPWVDFLAATPEIRSNTSVCLKVVDPAICALPEDAQADFAKKLASLLEKEGAALDIGGYRDAPAGLRIWCGATVEASDLEALTPWLDWAFATVSAELAAA

SEQ ID NO: 17041 - protein, 657 aa, Caulobacter crescentus
MFCRATLLSDGSEALGTFRHTLAKSEVLGAMSENRNHNVSSHAPLQARIAGVALATTVLALVAACLCFMLQQWSVARQEARANHEVLVQMAAAGAAAPLADHNMVGVYRALEAVAKAPGVAGVRIIDAKGRAVAQLGEANPSNADTLQRPIKLSSQTVGTLVLVAKRPGLAQTLARDLALTGALFFGAAGMAILLANSLARRLAQPMERLSEAMHETAVGGRFKALEETADDDVFRSLIASFNHLVARLECNDQDLRGAMAELVKARDDANAANVLKSHFLANMSHEIRTPLNGVLAMADVMAMDQLSDIQRERLAVIRESGAVLLGVLNDVLDLSKIEAGRLEIQDRPFDIAQLAQSIRETFVPQARAKGLAFEVGVAPEAQGLWRGDADRLRQILGNLISNALKFTLDGAVAVRFASAEDGSGLRIDVADTGIGISPEILPRLFDKFVQADSTTTRRFGGSGLGLAICRELAAMMNGSIKVQSREGRGSTFTVLVGLPREETLTDVHYIDDGDPIMAPPAAEPPRLRVLAADDNPTNQKVVAAVLAPLNADVTLVDDGAACVEAWKTGDFDVVLMDIHMPVMDGLEAARSIRATEQAEMRRRTPIIAVTANALTHQIEEYLSVGMDGHVAKPIEVSKLYDAIEAAMAGTRLSRAA

SEQ ID NO: 17042 - protein, 626 aa, Caulobacter crescentus
MNFRNLAIWLVIVAVLGGVFVVSQNSRTKSSSEISYSQLLKDVDAGKIKSAEIAGQTVLAKTADNKTLTVNAPMNSEELVNRMVAKNADVKFKSGSISFLAILVQLLPILLVVGVWLFLMRQMQGGAKGAMGFGKSKARLLTENKNRITFEDVAGVDEAKEELQEVVDFLKDPAKFQRLGGKIPKGALLVGPPGTGKTLIARAVAGEAGVPFFTISGSDFVEMFVGVGASRVRDMFEQAKKNAPCIIFIDEIDAVGRHRGAGLGGGNDEREQTLNQLLVEMDGFEANEGIILIAATNRPDVLDPALLRPGRFDRQVVVPNPDVAGREKIIRVHMKNVPLAADVDVKTLARGTPGFSGADLANLVNEAALMAARKNRRMVTMQDFEQAKDKVMMGAERRSMAMNEEEKKLTAYHEGGHAIVALNVPLADPVHKATIVPRGRALGMVMQLPEGDRYSMKYQQMTSRLAIMMGGRVAEEIIFGKENITSGASSDIKAATDLARNMVTRWGYSDILGTVAYGDNQDEVFLGHSVARTQNVSEETARLIDSEVKRLVQYGLDEARRILTDKIDDLHTLGKALLEYETLSGEEIADILKGIPPKREEEEAATAVIAPSLVPLSPGAGASVTA

SEQ ID NO: 17043 - protein, 335 aa, Caulobacter crescentus
MAVRVAINGFGRIGRLVLRSIAEHGRRDIEVVAINDLGPVETNAHLLRYDSVHGRFPGVVTSGEDWIDVGMGKIKVTAIRNPAELPHKDLGVDIAFECTGIFTSKEKAAAHLEAGAKRVLVSAPCDGADKTIVFKVNDDTLSADDLVVSNGSCTTNCLAPIAKVIHDLVGIERGYMTTIHSYTGDQPTLDTMHKDLYRGRAAALSMIPTSTGAAKALGLVLPALKGKLDGSSIRVPTPNVSVVDLKFVPGRETTVAELNDALKAAAAGPLKGVLGVTDEALVSTDFNHIAESSTAALAQTQVIEGKLGRVLSWYDNEWGFATRMSDTALVMAKFL

SEQ ID NO: 17044 - protein, 396 aa, Caulobacter crescentus
MTFRTLDTADLAGKRALVRVDFNVPVDGGKVADDTRLKAALPTIRFLADKGAKVVLLAHFDRPKGKVVPEMSLAFVAEPLAALLGAPVAFVGDCVGPAAAEVVNGLADGGVALLENVRFHAGEEKNDAEFAKALAANGDVYVNDAFSAAHRAHASTEGLAKLLPAYPGVSMQRELEALDAALGNPKKPVIGIVGGSKVSTKLDLLNNLVAKLDRLAIGGGMANTFLFAQGHDVGGSLCEKDLADTAREIMEKAKAAGCELLLPVDVVVAKKVAPGVETAVRSLSEVQADDLILDAGPESAKRLLAAMDQSLTLIWNGPLGVFEVPPFDEATVSAAKHAASLAKSGKIVAVAGGGDTVAALNHAGVSADFTFVSTAGGAFLEWMEGKTLPGVAALES

SEQ ID NO: 17045 - protein, 363 aa, Caulobacter crescentus
MARITLRQLLDHAAEHEYGLPAFNINNMEQGLAIMEAADAVNSPVIIQASRGARNYANDIMLAKMIDALVDIYPHIPVCMHQDHGNGPATCATAIQYGFTSVMMDGSLMEDAKTPASYEYNVEVTRKVVQMAHSCGVSVEGELGVLGSLETGMGEAEDGHGFEGKLSHDELLTDPDQAVDFVAQTGVDALAIAMGTSHGAYKFTRKPDGDVLAMNVIEEIHRRLPNTHLVMHGSSSVPQDLQDIINQYGGEMPQTWGVPVEEIQRGIKHGVRKINVDTDNRMAITGAIRKLLVEKPGEFDPRAYLKPAKEAMRKVCQARFVEFGSAGHADKIKPMSTATMAKRYASGELHAKFGASAAKAAAE

SEQ ID NO: 17046 - protein, 616 aa, Caulobacter crescentus
MTDANSGDQKVEGRPGAGAELVQGMTEAGARRPRRKDIRPLAHLLPFVIAHKGDGLAAGFFLLFSTAATLGLTYAFKNVIDHGFSKGQDAAINSAFVGLGAVALVLALATALRFFFITRLGERVVADLRRKLYGHTLSLDQPYFLKTRTGEVLSRLTTDVALVEQLVGASISIALRNILNLIGGLTAMAVVSPKLAGFIVLMVPVILAPMFLVGRRVRKLTVTAQDRFADAVGYAGESLDALETVQAFGRESASSGRFGAAVEAAYKASVRRITTRATMTAMVITLAFGGITLLLWTGARLVLAGEMTGGTLAQFAMLAVMAAGSIGALGEVWGDVQKASGAMDRISELLNAKPDIAAPPQPKTLPVPGQGEIAFENVVFAYPGRPDLPALNGFDLRVKPGETVALVGPSGAGKSTVLRLLLRFYDPQSGCILLDGVNLRDAEPAEVRARMALVAQDSPLFSGSAMDNIRFGRPDATDEQVRAAADAAQATGFLSALPEGFDTPVGERAKTLSGGQRQRLAIARALVREAPILLLDEATSALDAESEQLVQQALATAMEGRTTLVIAHRLATVLKADRIVVMEEGRVVEQGAHAELFAKGGLYARLARLQFGVEAA

SEQ ID NO: 17047 - protein, 621 aa, Caulobacter crescentus
MTPPDGASPPRDVSSAPFKPLAMKGPEVSVDRRPDGSIVITSNHAPGEGPRSIAHLIAAKAAEHPDRPYLKQREPNHGPWRGVTYGEAHRAVEGVAQWLIDQKLQPHDSVMILSGNSIEHALMTLGAYTAGVPAAPISPAYSLISTDHAKLKHCFEKVAPRVVFAQSGAMFAGALATLKALDPSLLVITADGAGEGAITFAEVAATTPTAAVAAARDAVGPATVAKYLFTSGSTGLPKAVPQTHGMMAGVIAGQEGLRTDVPTDEVPQSLEWMPWSHISAGNIGFNAVIWGGGTLHIDEGKPLPGMFETTIKNLYEVSPIVFGSAPIAFSMLAEAMENDPVLRRSFFKNLRYMGYGGATLSNDVYERIQALAVAETGHRIPLTTMYGATETQGITVTHWITERVGLVGLPLPGIQLKLAPSGSKYEVRVKGPTVAAGYHKDPERTAAAFDEEGFYKLGDAARFVDPDDPAKGLVFDGRVTEDFKLDSGTWVSVGVLRPDLVAACSPYIHDAVITGQDKAFIGAMLWPSPAGLAALVADPGPGTPLEKLVAILKDRLAAFNAAAGGSSRRVARFTILTEPPSIDAGEITDKGYINQRCVLERRADRVEALYAKTPGEGVFAV

SEQ ID NO: 17048 - protein, 121 aa, Caulobacter crescentus
MRFTKDHEWVIVEGDVATVGITAYAAEQLGDVVFVETPEAGKVVKQGEGLAVVESVKAASDVYAPVSGEVIEGNGELAGAPETVNALPESGGWFAKIKLANPAELDALMDRDAYEAFLGTL

SEQ ID NO: 17049 - protein, 314 aa, Caulobacter crescentus
MVRGDGVTSIISVQGLTKTYASGHQALKRIDLDIRQGEIFALLGPNGAGKTTLISIICGIVNPSQGVILADGHDVVRDYRAARTKIGLVPQELHTDAFETVWATVSFSRGLFGKPRNDALIEQILRDLSLWDKKDSKIMALSGGMKRRVMIAKALSHEPTILFLDEPTAGVDVELRRDMWEMVRKLRESGVTIILTTHYIEEAEEMADRIGVINKGEIILVEDKTVLMRKLGKKQLTVHLKAPLAALPAALADASLSLANDGADLVYTFDAQADDTGIADLLKRLSEQGIEFKDLKTDQSSLEDIFVSLVRAPQ

SEQ ID NO: 17050 - protein, 260 aa, Caulobacter crescentus
MAYAPFNLSGKVALVTGGNRGIGLGMAKAMAQAGADIVIWGSNPERNLAAEQTLTALGVRVKAQTVDVSDEAQVREGMEEAVAAMGRVDSVFANAGIGYGSPSFVDMSTEVYRKVLAVNLDGVFFTLREACRHMVERAKAGDPGGSLVGVASLAAIEGAARNEAYAATKGAVISMIKSVAVEHARYGVRANAILPGWIATDMTAGAQGNAAFAEKVIPRVPARRWGEPEDFGGMAVYLASDASSYHSGTTLVIDGGYSIF

SEQ ID NO: 17051 - protein, 265 aa, Caulobacter crescentus
MAVDFGLQGQVAIVTGSTSGIGHAMADALAAQGCNIVMNGLGEMNAIERARAEMAETHGVEVLYHGADMTRPIEIADMVRAAKAEFGELDILVNNAGVQHVAPVEDFPEDKWDLIIAVNLSSAFHATKAAVPIMKEQGRGRIVNIASAHGLVASPFKSAYVAAKHGIMGLTKTVALEVAQHGITCNAICPGFVKTPLVEAQIADQAKARGISEEAVMRDVILASQPTKQFVTFDQLNGMLLYLVSDLGASANGAAYQIDGGWVAQ

SEQ ID NO: 17052 - protein, 460 aa, Caulobacter crescentus
MSRLKAVLGEGGWSQDRDVIAPKLVEWRGRWQGETPLLVTPRSTAEVAAVVGICAAEGVAITPQGGNTGLVAGQIPRGEILLSTQKLTAIRDVDPIDDAMVLEAGVTLYEAHQQAAKVGRRFTVGVASEGSCTIGGLISTNAGGTAVLRYGMMREQVLGIEAVLPNGEIWNGLKRLRKDNTGYDLKQLLIGAEGTLGIVTAASLKLQALLASRAVAIVGLASPANAIQLLARAKDETGGAVEAFELMGRLGFELTVRNVPGLRDPLPEAHPWYVLIEIASGEPGAAEAALERLLAGALERGLIADAAVAQTETQMKAFWHIREGHSAGQKPEGAVWKHDVSVPVSKIPDFIGQANAAIEKSFPGTRIVAFGHVGDGNVHYDVLQPVGGDGDAHGAQREAGAKIVHDITAGFGGSISAEHGLGAMKTAEALTYKDPIEVAALRAIRGALDPQRIMNPRVLF

SEQ ID NO: 17053 - protein, 603 aa, Caulobacter crescentus
MATLGAPLKDGARPGVSPMTFRAPVRDLAFSLRHVAGFERLADAFPEADADTVAAVLEAAGAFASDILAPLNRQGDLVGARLENGVVRTAPGFADAYQQFAQGGWTSLAAPAEHGGQGLPKTLEVAVLEMVQAANMAFGLCPMLSLGAIEALELCGSPEQKAKYLGKLVSGEWTGTMNLTEPQAGSDLAALTTMATPDGDGGWRITGQKIYITWGDHDAADNIVHLVLARTPDAPPGVKGISLFLAPKVLVGDDGKLGPANALRAGSLEHKLGIHGSPTCVMLFEGAKAELVGGLGQGLPNMFVMMNAARLQVGTQGVAIAERAYQQALAFSQDRAQGRSAWTGAYPSRLFDHPDVRRTLVLMKAHIEAARGICLSTAVAADLARAAPDAATRTAAKLREELLTPIAKAWSTDIGVWVASQGVQIHGGMGFIEETGAAQHYRDARIAPIYEGTNGIQAIDLVGRKLMLGEGQAVGDLMDDIRDTIDLLKASDLKSVGLRLEAALDAAASATAWLIERRAKAMPDALAGATAYQTLLGDVVGGWMLAKGALAADGEADAAWAESKRALARVFAEAVLAQVPGAAAGVMIGAADFEAMTPEVLGA

SEQ ID NO: 17054 - protein, 423 aa, Caulobacter crescentus
MTASLRTLKNGVRVVCDPMPGLETLALSVVAGRGAAYEDPARSGWSHLLEHMVFKGAGSRSARDIVEVIENQGGSINAATGYERTSFQVRALKGGLDLGMDVIADLVRRPTLDPADLTREKQVVAQEIAEAADAPDDYVFDLIQRASWGDHPVGRPILGSDETVNAASVEALSDWRGDLYAADRLVIAATGAVEEAELMAAAERAFGDLPATPGVGLAQSAAFVGGPQAEARKLEQAHLVFMLPACGAREDDYFALRIFAECLGGGMSSRLFQEAREKRGLAYNIDAYADTYADHGALGIYAGCAASDAVETAKVCADELIKLADRIEEAELARAKAQLKAHMFMAREQPLSRAEQGAGQVLLFDRLYPPAELAREVDAVTPQDVARLGQRLLAAGRAATAVLGAKSALKAGEVFDKALFSAA

SEQ ID NO: 17055 - protein, 832 aa, Caulobacter crescentus
MDLLVPRREGLGVTPRSSRHDPVTPFRRRAPHPGLEPAAGRRRGRDRSAASGDHSPVDGRDPAVREGRRRGDGRPPDLGDQVRAAHPAASRQSASPGGPPSPPRLRAPGLASRSQFSRQRGFGARGSAHGFRRPGPPFAPPPPHPRRALGAGRDGRGAAGHRRGRGGGAGHADHGVLDRRGAVLPEDPSPRRAPDAAGAGGGPRDPLVPALATVWRRAKARAGLTRGRESPISRAMTDMIEDEDETGARKRALSNRQVLGFVARFWKRRPVLFGLGVGLTLVAVAFDLALPYAAGHLVDTVATQPRGDAQAWSALAIFVGVYFAFAVVRNIAHRFWIPLAARNMEEMTNESFAKVQAFSSDWHADSFAGATVRKLTRAMWGYDSVTDAVTIWLGPGVIVLIGLSIAMLVRQPLAGIISLVVVAAYLTVNLVITERYVRPSNLKSNALDSKIGGALADAVTSNPTVKSFGAETREAERLAKVTAQWREAVMVTWNRFTDVWLGQNLLLVVLQAGLTGAMVWGWTQGTATPGDVAFAITAFMLMSGYLRNLGENIRMLQKGLDDTEDVAAWTRLAPQIADDPNAPEFQPGSGAIEFQDVTFRYKAAGAPLYDRFSLKIAPGERVALVGPTGSGKSTFVKLIQRLHDLQDGAVVIDGQDVSTVKQASLRRAIAVVPQDPALFHRTLFENIAYGKPDATREEVEDAAIKARAHEFILRLPKGYDTLVGERGVKLSGGERQRVAIARAFLADAPILVLDEATSSLDVETEGHVQEAAEALMEGRTTIVIAHRLSTVRGADRILVFQGGRVVEEGRHAELTAKGGVYARLNAISAGVV

SEQ ID NO: 17056 - protein, 279 aa, Caulobacter crescentus
MSKLVPAVRSGDVLMPALGFGTWQLENGTAVPLVEKALEIGYRHIDTAQIYGNERDVGAAIRNSGVKRDEIFLTTKVWIDQFADGDLQRSAEKSLEKLGVDQVDLLLLHWPKPEVPLAETLKALNAVRAKGWTRAIGLSNFPSAQLEEAAKLSEAPIATDQVEYHPYLSLKTLKAKADQLGVSITAWSPLAQGKVAQDPVLIEIGRAHGKTPGQVTLRWIIQQGIIAIPRTSNPKRIEENFDILDFELSEKEMAQIHGLARPDGRIGDWIDRAYAWDAE

SEQ ID NO: 17057 - protein, 413 aa, Caulobacter crescentus [sequence omitted]

SEQ ID NO: 17058 - protein, 539 aa, Caulobacter crescentus
MAKTPAEKPATAAKKPAAPKAAAAPKAAAAKAPAAAKAPAAKKPAAPKAAAAPKAPAAGLEGATGRLVQIIGAVVDIEFDGALPAILNAVETVNTATGQRLVFEVAQHLGQSTVRAIAMDATEGLVRGQPVRDTGEPIRVPVGPGTLGRIMNVIGEPIDEQGPIRSDISRTIHRDAPSFAEQTNTAEVLVTGIKVIDLMCPYTKGGKIGLFGGAGVGKTVTMQELINNIAKAYGGYSVLAGVGERTREGNDLYHEMIESNVNVDPKANNGSTEGSRCALVYGQMNEPPGARARVALTGLSIAEYFRDEEGKDVLLFVDNIFRFTQAGAEVSALLGRIPSAVGYQPTLATEMGNLQERITSTNKGSITSVQAIYVPADDLTDPAPATSFAHLDATTVLSRDIAAQAIFPAVDPLDSTSRIMDPLVIGEEHYTVARRVQEVLQQYKALKDIIAILGMDELSEEDKLVVARARKIQRFLSQPFHVAEQFTNTPGAFVQLKDTIRSFKGIVDGEYDHLPEGAFYMVGPIEEAVAKAEKMAAEA

SEQ ID NO: 17059 - protein, 291 aa, Caulobacter crescentus
MASLKEMRNRISSVKATQKITKAMQMVAAAKLRRSQDAAESARPYARRLASVIANLAAGVSGDGAPKLLAGTGRDDRHLVVVAAADRGLAGGFTSSIVRAARAHIDGLIAQGKDVRVVCVGKKVTAQLAKPYAGRIVETFDLSSYRQLTLSVAQPIADVITREYEAGETDVVTLFYSRFKSVVQQIPTGLQLIPAVVETGEAASGPTAVYEYEPSEEAILETLLPRNLTVQILSALLDNMAGFYASQMTAMDNATRNAGDMIKRYTLEYNRSRQAQITKELIEIISGAEAV

SEQ ID NO: 17060 - protein, 510 aa, Caulobacter crescentus
MDIRAAEISAILKSQIANFGEEAAVSDVGQVLSVGDGIARIYGLDNVQAGEMLEFPKAGVKGMALNLERDNVGAVIFGQDQEIKEGDEVRRLGEIVDVPVGRGLLGRVVNPLGEPIDGKGPIQYTERRRVDVKAPGIIPRKSVHEPVQTGLKSIDTLIPVGRGQRELIIGDRQTGKTAVAIDTILNQKAVNAGKDESAKLYCVYVAIGQKRSTVAQIVKTLEEHGALEYTTVVVASASEPAPLQYLAPFAGCAMGEWFRDNGLHGLIIYDDLSKQAVAYRQMSLLLRRPPGREAYPGDVFYLHSRLLERAAKLNEDNGSGSLTALPIIETQANDVSAYIPTNVISITDGQIFLETDLFYQGIRPAVNVGISVSRVGSSAQIKAMKQVAGPIKGELAQYREMAAFAKFGSDLDASTQKMLARGERLTELLKQPQYAPLSVEEQVCVIYAGTRGYLDGIPTSSVRRFEAEFLARLHSQHADLLEGIRTKKALDKDLENTLKSALDSFSSTFA

SEQ ID NO: 17061 - protein, 184 aa, Caulobacter crescentus
MADETKATDAGQRYAQSLFELTIENGSLQKVEADLKSLKAMVADSADLRRLIASPAFSAEDKGKGLTAVAKKAGFQPLTTKFLGLVAANGRTGDLLGAISAFVELSAKHRGVVTAEVVSAAALSPAQLKGVQTALAQALGKTPEVSTRVDPSLLGGLKVRVGSRLFDASLRSKLDSLKFALKRA

SEQ ID NO: 17062 - protein, 435 aa, Caulobacter crescentus
MTMDFRLSPELSAYLEELDAFIAKEIAPLQAKDDNQRFFDHRREWARTDWDAGGLPRHEWEELLAKARKLADKAGHYRYALPKAYGGQDGTNLGMAVIREHLASKGLGLFNDLQNEHSIVGNNPFVLMIRDFGRPDQQHLIEDMLDRGAFRPTFGLTEPDHGSDATHMETQAVREERHGQAGWRIDGEKMWTTGMHVATHCCLFARTSGQDGDARGITAYLVPAHAPGVKIEEYLWTFNMPTDHPRVSFTDVWVPDSAMFGPEGGGLALAQHFVHENRIRQAASSLGAAAYCIEESIKYARARKPFGKALSENQAIQFPIVELSTQVEMLRLLIRKTAWEMDQMSKPEVEKRLSDKVSMCNYWANRLCCEAADRAMQIHGGIGYSRHKPFEHIYRHHRRYRITEGAEEIQMRKVAAWLFGYMGPRKQAFAEMDKV

SEQ ID NO: 17063 - protein, 395 aa, Caulobacter crescentus
MREAVIVSYARTGLAKSVRGGFNNTHGAAMAGHAIQHAVSRAGLEGAEVEDVVLGCGGPEGATGMNVARNAAMWAGLPVTTSGQTINRFCSSGLQAIATAANYVRNDGANVAIGGGVESISLVNAGGHMNRFHITEEKLMQTHPALWMAMIDTADIVAKRYNVSREYQDEYALRSQQRIAAAQAAGLFKDEIVPMATKMKVVNKETKEESFVDYVVDKDECNRADTTLEGLASLKPVMGEGKFITAGNASQLSDGAAAVVVMEAKEAEKRGLTPLGAFRGFAVAGCEPDEMGIGPVFAVPRLLERHGLKVDDIDIWELNEAFASQCLYSRDRLGIDPEKYNVNGGSIAIGHPFGMTGARCAGHLLLEGKRRKAKLGVVTMCIGGGMGAAGLFEIF

SEQ ID NO: 17064 - protein, 348 aa, Caulobacter crescentus
MSFKFSRANPPHVGVVGATGLVGGMMRELLVERDFPVASLRLFASARSAGGKIDFNGQQIVVEDAATADFSGLDIVFFSAGGSTSRELAPKAAAAGAVVIDNSSAWRSDPEVPLVVAEVNPHALQNIPKGIVANPNCTTMAAMPVLKPLHDKAGLKRLTVSTYQAASGGGMEGIEVLSEQLRAGAAGDLDGLARSPDAAPLPAPRKWAVPLAYNVVPLNYVLGEDGYTEEELKLRDESRKILEIPGLPVSGTCVRVPVFTGHALSINAEFDGPVSVAEALDLLAAAPGVVIDDVPNPLAATGQDPVFVGRVRPDPTVPHGLALFVVGDNLRKGAALNAVQIAEVMLGA

SEQ ID NO: 17065 - protein, 619 aa, Caulobacter crescentus
MKSSVRNEARLAAIKPAKRPQLALVRKVEVDRSRDALLTDFGKTTLEDRYLLPGESYQDMFARVSTAFADDADHAQRVYDYMSRLWFMPATPVLSNGGADRGLPISCFLNAVNDSLDGILGVWNENVWLAANGGGIGTYWGGVRSIGEKVKGQGQTSGIIPFIRVMDSLTLAISQGSLRRGSAAVYLDIHHPEIEEFLEIRKPSGDFNRKSLNLHHGLSITDEFMHAVRDGTKFGLRSPKTNEVLREVDARALWQKVLELRLQTGEPYLIFSDTVNRAMPSFQRELGLKVRQSNLCSEIMLHTGTDHLGQERTAVCCLSSVNAETYLEWRDHPTFIEDVMRFLDNVLQDFIDRAPDAASAAAYAAMRERSVGLGLMGFHSFLQSQNVPFESALAKSWNMRMFKHLRREADKASIKLGEEKGPCPDAADRGSMERFSHKLAIAPTASISIICGGTSAGIEPIPANIYTHKTLSGSFAVKNPYLEKLLEEKGQNTDAVWGSILENEGSVQHLDFLSQDEKDVYKTAFELDQRWVIELAADRTPEICQSQSVNVFLPGDVDKWDLHMLHWMAWERGVKSLYYLRSKSVQRAAYAGAEDKAEAAAGGFDVPEKTDYDECLACQ

SEQ ID NO: 17066 - protein, 706 aa, Caulobacter crescentus
MKKVWFGAAAIAALSLSAFGAQAHEKHACIDDACVMQSLLPSITAGGAAADVASLESPRFGTWGFDLSGMDTTVKPGEDFYKFANGAWDARTQIPSDRTRYGNFDKLAELSEARTKAIIEAAAANKAATGDTAKVGAAYRAFMDEAGIEKLDAKPIAPYLAEIRKVKSKDEFTTLMGKSSTTPFTSLLGLGISTDAKNPKAYAVYAGAGGLSLPDRDYYLDAKFADKKAAYLAYVEKLLTMAGWDKPAEHAKAVVDFETKLAEVTWTRAERRDRDKTYNPATLAELQAMSPGYDWNRYIAASGLPKVDRFVVTTNTTFPKYAKIYAETPLDTLKAWQAFKVTDNAAPLLSKRFVDAGFEFRNKTLAGQPEQRPRWKRGVGAVNGLLGEAVGKDYVAAYFPPESKAKMLELVANVRGAMKVRIDNLDWMSAETKVKAQEKLAKFTVKIGYPDVWEDYSKLEIKDNDAYGNVQRAGAWAFAKDVERLFKPVDKTEWGMTPQTVNAYYNSVNNEIVFPAAILQAPFFHPDADPAINYGGIGGVIGHEIGHGFDDQGRKSDGDGVLRDWWTAEDAAKFKAQADRLGAQYGAFEPLPGMKLNGALTMGENIGDMGGLAFALDAYRASLKGQPAPVLDGFTGDQRVYLGWAQVWRGKQRDEALKQQIIAGPHSPGYYRVNGTIRNMEGWYSAYDVKPGDKLYIAPENRVKIW

SEQ ID NO: 17067 - protein, 260 aa, Caulobacter crescentus
MVELALPKNSQVKSGKHWPAPAGAKKVKTFKIYRYDPESGGNPRWDTYDVDVDAVGPMVLDALLYIKNTIDPTLAFRRSCREGVCGSCSMNIGGRNTLACTHGWAEVPGKAVQISPLPHMPVVKDLIPDLTLFYAQYASIEPWLHTDTPEPQTEWKQSPEDREKLDGLYECILCACCSTSCPSYWWNGDKYLGPAALLHAYRWLIDSRDEATGDRLDALEDPFKLYRCHTIMNCAQVCPKGLNPAKAIAEIKKMMVERVV

SEQ ID NO: 17068 - protein, 596 aa, Caulobacter crescentus
MMSAYKFIDHKFDVVVVGAGGSGLRAALGAAQAGLKTACITKVFPTRSHTVAAQGGISASLGNMGQDDWRWHMFDTVKGSDWLGDQDAIEYLTRNAPAAVYELEHWGVPFSRTPDGKIYQRAFGGMTKNFGEGPIQRTCAAADRTGHAMLHTMYGQSLAHDTEFFIEYFALDLIMDDGVCRGVTAWKLDDGTLHRFQAQMVILATGGYGRAYFSATSAHTCTGDGNAMALRAGLPLQDMEFVQFHPTGIYGAGCLITEGARGEGGYLTNSEGERFMERYAPTVKDLAPRDMVSRAMTIEIREGRGVGPNKDHIFLHLDHLDPKILAERLPGISETAKVFAGVDVTKAPIPVLPTVHYNMGGIPTNYHGEVVTKSGDNPDQVIPGLMAVGEAACVSVHGANRLGSNSLIDLVVFGRAAALRCAEILKPGAKQPELKDVQTDAHLARFDRFRNASGSTGTAELRLEMQKAMQEDAAVFRTGESLDSGVARLQAVWDKKADLKVSDRGLVWNTDLMETLEFDNLIGQAVVTVNGAANRTESRGAHAREDFSDRNDAEWMKHTLAWLDLDTGKVKIDYRPVHSYTMSDDIAYIPPKQRVY

SEQ ID NO: 17069 - protein, 219 aa, Caulobacter crescentus
MSISAHGAKICGLSTPETVKAAFDGAAAFLGFVFFDKSPRNVAPEVAARLVEPVRGRGVQTVAVTVDPDDALIDRLMATMRPDLIQVHGKETPSRVREIAARAGVGVIKAFSVSSSADVDQAAAFDGVAQHLMFDARPVEGSVLPGGTGARFDWGLLAGRRFSRPHFLAGGLDPWNVGEAIKTSGTPLVDVSSGVERGPGLKDPALISAFLDAVKRAKD

SEQ ID NO: 17070 - protein, 257 aa, Caulobacter crescentus
MSQPVKIAIAGANGRMGRAVAQALEGRSDAVVAARFERPGDAGEGLVARETALAAAEAVIDFTLPEASVALAEEAAANGGPALVIGSTGFSDEQLDRIDAAATKIVIVRSGNYSLGVNMLMGLVRQAAAALPAQDWDIEVFEAHHKRKIDAPSGTALMLGEAAAEGRGINLAKVSDRGRDGVTGPRKDGDIGFSVVRGGGIIGEHSVIFAGESESLTLSHSAIDRGLFARGAIAAAVWVKGKPPGLYDMQDVLGFKK

SEQ ID NO: 17071 - protein, 294 aa, Caulobacter crescentus
MLIIENLTHVYGNGTRALDEVSLTIPRGMYGLLGPNGAGKSTLMRTIATLQAPTSGHIRFGDIDVLKHPEELRKTLGYLPQDFGVYPRVSAYDMLDHMAVLKGISGGKERKATVEHLLNQVNLWDVRKKAIAGFSGGMRQRFGIAQALIGDPRLIIVDEPTAGLDPEERNRFLNLLAEIGENVVVILSTHIVEDVSDLCPAMAIICNGAIVREGAPADLVAQLKGRIWKKIIDKAELEAAKARYKVISTRLLAGRTVIHIESETDPGDGFTAVEGGLEDVYFSTLSSTRSRQAA

SEQ ID NO: 17072 - protein, 506 aa, Caulobacter crescentus
MTKPEFIESLSRPPFKARYDNFIGGQWVAPADGRYFDNSSPIHGRKICEIARSQAIDIERALDAAHAAKAGWARTSAADRSRILLRIADRMEENLAALATAETWDNGKPIRETLAADIPLAIDHFRYFAGCLRSQEGSISEIDHDTIAYHFHEPLGVVGQIIPWNFPLLMACWKLAPALAAGNCVVLKPAEQTPASIMVWAEMIGDLLPAGVLNIVNGFGLEAGKPLASSPRIAKIAFTGETSTGRLIMQYAAQNLIPVTLELGGKSPNIFFDDVAREDDDYLDKALEGFTMFALNQGEVCTCPSRALVQESIYEKFMERALKRVNAVVQGSPLDPATMIGAQASEEQLNKILGYMDIGRNEGAKLLAGGQRKILPGQLADGYYVEPTVFEGHNKMRIFQEEIFGPVLAVTTFKTEEEALEIANDTAFGLGAGVWSRDANRCYRFGRGIEAGRVWTNCYHAYPAHAAFGGYKQSGVGRETHKMMLDHYQQTKNMLVSYSPKALGFF

SEQ ID NO: 17073 - protein, 647 aa, Caulobacter crescentus [sequence omitted]

SEQ ID NO: 17074 - protein, 443 aa, Caulobacter crescentus
MSLAGLKSAPGGALRGIVRAPGDKSISHRSMILGALATGTTTVEGLLEGDDVLATARAMQAFGARIEREGVGRWRIEGKGGFEEPVDVIDCGNAGTGVRLIMGAAAGFAMCATFTGDQSLRGRPMGRVLDPLARMGATWLGRDKGRLPLTLKGGNLRGLNYTLPMASAQVKSAVLLAGLHAEGGVEVIEPEATRDHTERMLRAFGAEVIVEDRKAGDKTFRHVRLPEGQKLTGTHVAVPGDPSSAAFPLVAALIVPGSEVTVEGVMLNELRTGLFTTLQEMGADLVISNVRVASGEEVGDITARYSQLKGVVVPPERAPSMIDEYPILAVAAAFASGETVMRGVGEMRVKESDRISLTANGLKACGVQVVEEPEGFIVTGTGQPPKGGATVVTHGDHRIAMSHLILGMAAQAEVAVDEPGMIATSFPGFADLMRGLGATLAEA

SEQ ID NO: 17075 - protein, 217 aa, Caulobacter crescentus
MQIFLDSTDTKVIADLASTGLIDGVTTNPTLIAKSGRPMLEVIAEICDIVPGPISAEVAATTADAMIAEGQKLAKIAPNVVVKIPLTRDGLIACAAFADEEIKTNVTLCFSPTQALLAAKAGATYISPFIGRLDDYGFDGMDLIRDIRAIYDNYGYETEILAASVRNAAHVKEAAIVGADVVTIPPAVFSDLYKHPLTDKGLEQFLKDWASTGQSIL

SEQ ID NO: 17076 - protein, 595 aa, Caulobacter crescentus
MGGGGAPMSAETKDIDLERAVASRRVNTYLRLSSTFAICATLHLVVGLRWVWIWGALYTAIQFLETWLALQLIKRPQSSPDRWRRFSVIALPFLTSAVFGFLAIPLFASDARFAPTLGGMLLAGALMNVVIVHGGLRSATIAAATPYVGYLLVIPIVARQANPDAPLANALWFGALLLIAAVAVASRTLHAALKAEADAKTEAERRRHEAEEAVAAKSAFVAMISHELRTPISAILAGAGRLHSEAPEASSKVHAQLIADAGGLMRTLLNDLLDFSRLEAGRMSVEKSPFNLRQSLSDTLRFWRPELARKGLKLRVVGASTIPQWTLGDAMRLKQVLNNLLSNAAKFTRSGGVSVTLRAEIVGDQVRLVVDVVDTGPGIPEAALPRLFTPFDQLNESVARLHGGSGLGLAISRELARLMGGDLTASNALGQGAHFRFSALLEAAEAPVVPTLGPSISGLRVLVVDDHVVNRRAVELVLQPFGVEATLAESGEEALELLRSEVFDAILMDVYMPGMDGRETTRTLRAGQGPNRDAPVVAVTASATIKDWEACAAAGMNAHVAKPIDPAELFSALAQVMAARDAVGPFRTDVAASSA

SEQ ID NO: 17077 - protein, 356 aa, Caulobacter crescentus
MSQQNLRVMVTGGSGFIGSAVCRHLAGQNNVAILNYDKLTYAASQASLAMLEGKADYQFVQGDVADAARVCATIKAFRPDVVMHLAAESHVDRSITGPGDFIQTNIVGTYVMLQAALEHWRGLEGEAKGRFRFHHISTDEVFGSLGAEGLFSETTPYDPRSPYSASKASSDHLARAWQHTYGLPVVVSNCSNNYGPYHFPEKLIPLVTLNALEGKPLPVYGKGDNVRDWLHVEDHARALHLIATKGVPGESYNVGGRNERTNLQVVEAICDILDELRPIPGQSRRDLITFVADRPGHDARYAIDATKLETELGWTAQETFDTGLRKTIQWYLDNEAWWAPLRERYAGQRLGLSKQA

SEQ ID NO: 17078 - protein, 291 aa, Caulobacter crescentus
MKPVRKAVLPVAGLGTRVLPGTKTTPKELLNVVDRPILSYIVEEGRKAGIEHFVFVTGRSKGAIEDYFDHQIELEAQLEAKGKIEILEQLRAELPKPGEMSFVRQMAPLGLGHAVWCARDIIGDEPFAVMLPDVIVDAERACLGQLIDLYNKVGGGNVIGVEEVPESETHKYGVVAPGKVDGRMATMTGMVEKPAKGTAPSNWAIAGRYILQPEIFALLAAQEKGAGNEIQLTDSMAKLMQDQAFHAYVYEGVTHDCGDKIGLLRANVALALKRADLGAAARAAVEAALKA

SEQ ID NO: 17079 - protein, 320 aa, Caulobacter crescentus
MARAKIALIGAGMIGGTLAHIAAREELGDVILFDIAEGTPQGKALDIAEASAVFGKDVALKGANDYADIAGADVCIVTAGVPRKPGMSRDDLLGINLKVMKAVGEGIKAHAPNAFVICITNPLDAMVWALQQFSGLPKEKVIGMAGVLDSARFAYFLAEATGVSVEDIHAWTLGGHGDDMVPMVRHSTVGGLPLPELVKQGWLSQDKLDAIVERTRKGGGEIVALLKTGSAFYAPAESAIAMATSYLKDKKRVLPCATYLTGQYGLNDLYVGVPVVIGAGGAEKIVEFETNDDEKAMFAKSVESVKGLMEACKAIDSSLV

SEQ ID NO: 17080 - protein, 903 aa, Caulobacter crescentus
MDREGSLKMASVDSLKARRELKVGKQSYVYYSLRAAEEAGLADVSSLPVSMKVLLENLLRNEDGVSVNEDDLKAVAAWLNNKGSVEHEISFRPARVLMQDFTGVPAVVDLAAMRDAMVALGADPAKINPLNPVDLVIDHSVMVDNFGNPKAYDDNVKREYERNIERYRFLRWGSSAFNNFRVVPPGTGICHQVNLEYLAQTVWTNTVDGAEVAYPDTVVGTDSHTTMVNGLAVLGWGVGGIEAEAAMLGQPIPMLIPEVIGFKLTGAMPEGATATDLVLTVTQMLRKKGVVGKFVEFYGDALANLTLEDQATIANMAPEYGATCGFFPISAATIAYLKGTGRAAERVALVEAYAKEQGLWWEPGVAEPTFTDTLELDLSTVLPSLAGPKRPQDRVLLSDAAAKFAESLAGEFGKAENPELRAPVEGEDFDVGHGDVVIAAITSCTNTSNPSVLIAAGLLAKNAVAKGLKAKPWVKTSLAPGSQVVTDYLAKAGLTKHLDALGFNLVGYGCTTCIGNSGPLPEAISKTINDNDLVACSVLSGNRNFEGRVNPDVRANYLASPPLVVAYALAGSLKIDLATQPIGQDKKGNDVFLKDIWPSNEDIAALQRKAINEKMFATRYGDVFKGDKNWQGIKVTGGQTYAWEADSTYVQNPPYFPNMSMTPAPVTDIVEARILAVFGDSITTDHISPAGSIKASSPAGKFLIDNGVEPVDFNGYGARRGNHQVMMRGTFANIRIRNRITPDIEGGVTKHFPTGEVMSIYDAAMKYQEEGRPAVVFGGKEYGTGSSRDWAAKGTKLLGVRAVICESFERIHRSNLVGMGVLPLQFVQDGWQKLELTGEEIVSIRGLTDLAPRKQLIVELYRPTDGRIARFPVRCRIDTPTELEYFKNGGVLNYVLRNLAKAD

SEQ ID NO: 17081 - protein, 288 aa, Caulobacter crescentus
MSRTFLKMNGLGNDFVVIQTLTEAFDPTPEQIRAIAKRPGVDGKGGIGCDQVIAIDPPRAEGASAYVRFWNSDGEVAGACGNGTRCVAWLLMQSAGKDAVAFDTVAGRLSGVAAGDKLVTVDMGPPGLDWTQIPLAEEMNTERVELQVGPIDAPLVHTPVCVSMGNPHVVFFVDAPVTDDFARGTGSLVEHHPLFPEGVNVGFAHIASRDHIRLKVWERGAGLTQACGTGACAAQVAAVRRGLTDRKARVEFDTGSLTIEWRESDGHVIMTGPITMEYAGKLPELVAA

SEQ ID NO: 17082 - protein, 677 aa, Caulobacter crescentus
MTQKWVGPFGGVPAFDKVKVADFKSALEAAMAKNLAEIDAITAGKAAPTFENTIAALEDAGRMLNDVQTYYYIWGSNMSTPEFQKVEAEMDPKLSAHYDKINQNAALFARIEAVYNSPDKAKLTPEQQRVLWIYYTNFVRSGAKLSPEAKARVGAINTELAGLYTKFSQNQLADENTWIELSDADLAGLPEGLKAAAASNATARKLPGKHVIVNTRSSVDPFLTESPVRAAREKVWRAFVNRGDNGGATDNNAIISKILKLRVERAKLLGYKTHAHWRLENAMAKTPENAMALMEAVWKPAIAQVAIDVADMQAIIDKEGGVFTLEPWDYRFYAEKVRKAKYDLDMNEVKPYLQLDKLREGMFWASGQLYGFEFKKLEGIPVFHEDVTVYEVTRGGKHVGLWYFDPYARPGKRSGAWMNAYRTQERFKRETTTIVSNNSNFIKGKPGEPVLISWDDAVTLFHEFGHAIHGLNANATYPSVSGTAVARDYVEFPSQLNEHWLSTPQVLNQFALHYQTGKPIPAELVKKIEAAGKFGQGFGTTEYLASALIDMKLHLAGDVDIDPDKFEREELAKLNMPKEIVMRHRTPQFGHVFSGDGYSAGYYSYLWSDTLTADAAEAFAEAPGGFYDKAVAKRLYEDIMSAGNTIDPVEQFRAFRGRDVKIGALMRKRGFPVPPGA

SEQ ID NO: 17083 - protein, 268 aa, Caulobacter crescentus
MRLRIATWNVNSVRLRAEQAARFVDEQAPDVLCMQEIKCQEGEFPREAFEAMGLPHLKIAGQKGWHGVAIASRLPIEDVPTLMTCREGHARCVAVKVAGVEIQNFYIPAGGDTPDRIGNPKFDHKLDFYETLTAALKKRDPKAPLIVTGDLNIAPGENDVWSHRQMLKVVSHTPPELEAFDALIKSMDLLDLPRLATPEPQKLFSWWSYRAADFRKSNRGLRLDHILASPGLRDAASLDGKVSSRVHDDVREWERPSDHAPVTADLKV

SEQ ID NO: 17084 - protein, 502 aa, Caulobacter crescentus
MATLEAFWRLTGAGWALVRADALIPRELEPLLPPSAKLAGRVLRLFAGPAARKGRPGERLAAVLERQGPAAIKMGQFLSTRADIFGAAFADDLSRLKDRLPAFPLSVAKAEIARNLGKPLDEIFAEIGEPVAAASLAQAHPATLVDGQKVAVKVLRPGVERQVARDTAVLRLAARLAETLVPVSRRLRPTEFVEVVIRALELEMDLRFEAAGCAELGEAMAKDPYMRAPAVCWEGVGKRVLTLSWAEGAPLSDPAALDLPGLDRKALAENVTRGFLAQALDHGLFHADLHEGNLFIAAPAAITAVDYGIVGRLGPGERRYLAEILYGFLNRDYARVAKIHFDAGYVPAHQDMDAFAQALRAVGEPVFGRNAREVSMGRLLAQLFEITALFDMALRPELVLLQKTMVTVEGVARRIDPTHDLWAAADPVVRRWIGRELSPAAKARDFAEEAIRAIKALARLAETPTTPPPVAAERLHTWPLLWFLVGAATAGAAFVTGVLLAR

SEQ ID NO: 17085 - protein, 278 aa, Caulobacter crescentus
MRKRAPHMADDYAFPKGELMRGKKGLVMGVANHNSIAWGIASQLAAQGAEMAFTYQGEELERRVRPLAESIGVKTMIPCDVTDDASMDAAFAEIEKAFGTIDFVVHSVAFANKNELKGSFVDNTTREGFLLAMNISAFSFVDVAKRASKLMPNGGSLITMTYLGSERTIPNYNTMGVAKAALEASTRYIARDLGPKGIRCNAISAGAMRTLALAGIAGGRGMIAQGRAFSAMKEDTSMEGVAGCALWLASDLGKSTTGEVVHVDAGFHMMGMPDAEEA

SEQ ID NO: 17086 - protein, 403 aa, Caulobacter crescentus
MRRVVVTGLGIVSSIGNNAHEVLASLREAKSGVIAAPEYAELGFRCQVHAAPQIDWEAMVDRRAARFLAPGTAYAHIAMEQAIADSGLSETELSHERTGLIVGSGGPSTRVIIDAAAITREKGPKRIGPFAVPKAMSSGPSAVLSTWFKIRGINYSISSACATSAHCIGAAAEQIQMGKQDVVFAGGCEELDWSLSNLFDAMGAMSSNFNDRPAVASRAYDKNRDGFVIAGGAGIVVLEEYERAKARGAKIYGEVVGYAANSDGYDMVAPSGEGAARCMRLAMAEAGNRAIDYLNPHGTSTPVGDSKEMGAVREVFGDKAPMISSTKSLTGHSLGAAGAQEAIYSILMLNNDFAAESANIEELDPEFADLPILRQRVDKPLETVMSNSFGFGGTNGTLIFSRV

SEQ ID NO: 17087 - protein, 365 aa, Caulobacter crescentus
MSQGDGQPSRCHGRSHPLIATLLGPSVLFFQRFFRLMTALYDVAAIGNAIVDVIAQCDDAFLEREGLVKGSMALIDPARAASLYDVMSAAIEASGGSAANTVAGVASFGGKAAFLGKVADDQLGRVFRHDMNAIGCVFTTPPLAEGPATAQSLINVTPDAQRTMSTYLGACVELNPADVDPDIIEAAQISYLEGYLFDPPEARRAFAKAAALAHGSDRKIALTLSDSFVVDRHRGALLGFVETQCDIVFANAAEVCALFETDDFDAAVKALAERCEIAAVTRSEKGSVVAANGQLHEISAYPVEKVVDTTGAGDQYAAGFLFGLSQGRPLPICGQLGSLAAAEVIDHYGPRPQVSLRELAEKNGL

SEQ ID NO: 17088 - protein, 196 aa, Caulobacter crescentus
MARTAEVVRETKETQIRVWIDLDGTGVSTISTGIGFYDHMLESFARHGGFDLKVETKGDLHIDMHHTVEDTGIVLGQAIHKALDGFKGIRRFGSAYIPMDETLTRCAIDLSNRPYLIWKVEFKRPKVGEMDTELFKEFHHAFAMNSGACIHLETLYGDNTHHVAESGFKALARALRQAVEIDPKTGGQAPSTKGVL

SEQ ID NO: 17089 - protein, 260 aa, Caulobacter crescentus
MLKTRIIPCLDVKDGRVVKGVNFVSLRDAGDPVEQARAYDAAGADELMFLDITASSEGRGLILDVISRTAEVCFMPVSVGGGVRQVSDMRRLLLAGADKVSVNTAAVENPDLIAGGADAFGSQCVVVAIDAKAREDGSGWNVWTYGGRKDTGIDVVEWAAKVVERGAGEILLTSMDRDGAKIGYDIPLLQAVTGAVNVPVIASGGAGKTEHLIEAAREGHAAAVLAASIFHFGEISIGEAKQAMADAGIPVRLDALKGAA

SEQ ID NO: 17090 - protein, 107 aa, Caulobacter crescentus
MSQRLTDVLQRLAATIEARKGGDPSVSYTAKLLNDPALAAKKLGEEAVETVIAAVAQGSDALAAESADLLYHWLALMAASGVSLDAVAEKLEAREGTSGIAEKASRA

SEQ ID NO: 17091 - protein, 231 aa, Caulobacter crescentus
MSETLTINTPDGAFSAYVARPKAASAPAIVVIQEIFGVNKVMRDICDGLAAQGFVAICPDLFWRIEPGIDITDQSEAEWKKAFELFNAFDVDAGVTDIAATIAAARKLDGVNGKVGAVGYCLGGLLAFLTATRTDIDAAVSYYGVGIEKHVGEAEKLNHPLLMHIAEKDQFVPPEAQQLILSALKDHPQIEIHIYEGRDHAFAREGGAHYDAADAAKANGRSLTFFQQALA

SEQ ID NO: 17092 - protein, 347 aa, Caulobacter crescentus
MTQKLAVVLFNLGGPDGPDAVRPFLFNLFRDPAIIGAPALIRYPLAALISTTREKSAKANYAIMGGGSPLLPETEKQARALEAALALAMPGVEAKCFIAMRYWHPLTDETARQVAAFAPDQVVLLPLYPQFSTTTTGSSLKAWKKTYKGSGVQTTVGCYPTEGGLIEAHARMIRESWEKAGSPTNIRLLFSAHGLPEKVILAGDPYQKQVEATAAAVAAHLPPQIEWTVCYQSRVGPLKWIGPSTDDEIRRAGGEDKGVMITPIAFVSEHVETLVELDHEYAELAEEVGAAPYLRVSALGTAPEFIDGLAKAVRDSVGKAPGTVSSACGWRCGADWSKCPCREGASA

SEQ ID NO: 17093 - protein, 351 aa, Caulobacter crescentus
MTSSSPILKQTPKFLSALEGQSHANPPVWFMRQAGRYLPEYRAVRATAPDFISFCFDPEKAAEVTLQPMRRFPFDASIVFADILLIPGALGQKVWFEAGEGPKLGDMPSVESMAEKAGEAGKALSLVGETLTRVRSALDPDKALIGFAGAPWTVATYMIEKGSSDRSGARTFAYQNPETLDALIQVLVDATIDYLAMQVDAGAQALKLFESWAEGLSEPLFDRLVTQPHIRIIEGLRARGVTVPIIGFPRGAGTLVEDYAARTPVQGVALDTSASAKLGQTIQKTKTIQGALDPLLLRAGGDALLKRVDEMLEQWNQGPYIFNLGHGILPDTPIAHVEAVLERVTGQKVGQ

SEQ ID NO: 17094 - protein, 641 aa, Bacillus halodurans
MKKAILSLISFFLVLTCFQTPFAEAKGKPHVTKEEYLITLLDELELEVAMYEGADVPFSDVSKEAIPYIEAAIRMDILDDTLGAEFGATRPISKEEAYVLLIRALQLEPSNLDVLKKVRDQRQITYPAEVAATLEYGLVVLEKNNKLRPKTKLTRTELTDMFERLDENFERLSIVHTNDLHGRILPNESNGEMGLAKIASIANSVRESNSESLLLDLGDTFHGTNYVNFNEGEAAAEAMNLMGYDAMVAGNHDFNFGYERLVQIAEETLAFPLLSGNVLKTETGDTLFSTHQIVQIHNQKVALIGLTASDTPVKTHPDNIKGLTFTDEVEAAQSLVDQIAPTVDHVFLLTHIGYGVDRQIAEQVEGIDLILGGHSHTTLESPVKVNDTYITQAYEHGKAVGVTYVLFHQGEFASAYGQLIRDYPGLTADPEVENLLDTYKKEVEDALAEVIGTVPERLVGAREFVRTQESNLGNLITDAMRDMTGADIAFTNGGGIRANIEAGDVTKGDVIAAFPFTNTVIALEITGEQLFQSLEHSVRLAPAENGGFLQVSGVQMTYDQTKAPGERIIDLTVNGEPLDKNKTYTVATNDFLAAGGDGYSWLADGTLVIDTGELLSEAASRYIASGQPIPPVEGRIQVVGQ

SEQ ID NO: 17095 - protein, 482 aa, Bacillus halodurans
MKKASTLPLFERLVQHDRGGPISCHVPGHKQGALFHKDACSYFQSILSLDVTELTGLDDLHDPRGVIAEAQALTARYVGAEATCFLVNGSTVGNLAMILGTLEPGDTVFVQRDSHKSVMNGLAMARVHPIFLSPSYDERTQLPTGITEQTLKQALIEHPNGKALILTYPSYYGVARSIRPLVQMAKEAGLYVLVDEAHGAHFPVGDPFPKQALEQGADVVVQSAHKTLPALTMGSYLHFAHGLHSKIKDSIREQLQILQSSSPSYPILASLDAARGFLEDLTNVKDTLDSIAEMNRRIEQVERLSVATFSPLPTDPLKTVITVEGATGFALQTELEKEGIYSELADDRHVLLMWGLTPLQKVRQEEIIDKMCRATKRLPALEQISKGCPLSLSWQAHTSLDLSYDEQKRYSIEEVAVEEAVGKVSGATVIPYPPGVPLLLKGEKITEPLIAQFQQLQEAGARFQGRPSEQQGLYVFTLEAMT

SEQ ID NO: 17096 - protein, 210 aa, Bacillus halodurans [sequence omitted]

SEQ ID NO: 17097 - protein, 287 aa, Bacillus halodurans
MKQSVKAPAKINLSLDVLHKRPDGYHEVDMIMTTVDLADRIDLTLREDGLISVDVSEGFVPNDEKNLAYQAAALLKARYHVNEGVSIYITKRIPVAAGLAGGSSDAAATLRGLNDLWQLGLSLDELAVLGAEIGSDVSFCVYGGTARATGRGEIIERIASPPPCWVILAKPPIGVSTADVYKRLNVSAIDHPTTEHMIAAIEGKDFDGICHHLHNVLESVTLDLYPEVRNIKEQMKRFGADGVLMSGSGPTVFGLVSKESRVQRIYNGLRGFCHQVYAVRIIGSAGS

SEQ ID NO: 17098 - protein, 316 aa, Bacillus halodurans
MANYGDPNLKVFTLNSNKGLAYEITERIGVPMGKSSVTRFSDGEVQINIEESIRGCDVFLIQSTAAPANEHIMELLIMIDAVKRASAKTINVVIPYYGYARQDRKARAREPITAKLVANLLETAGATRVLTLDLHATQIQGFFDIPVDQLMGVPILAEFFEKKGLDDVVVVSPDHGGVVRARKLADRLKAPIAIIDKRRPKPNVAEVMNIVGHIEGKTAIIIDDIIDTAGTITLAANALVEHGAKEVYACCTHPVLSGPAIERIKNSKIKELVVMNTIELEEEKLIDKITTLSVAPLMAEAIVRVHEHSSVSLLFD

SEQ ID NO: 17099 - protein, 179 aa, Bacillus halodurans
MRDEIQEILITEEEIQAKIVELGKQITEEYEGKFPLVIGVLKGAMPFMGDLTKRIDTHLEMDFMDVSSYGKGTVSSGEVKIIKDLDTSVEGRDVLIVEDIIDSGLTLSYLIELFHYRKAKSVKVVTLLDKPEGRKVDLVPDMAGFTVPDAFVVGYGLDYAERYRNLPFIGILKPEVYES

SEQ ID NO: 17100 - protein, 657 aa, Bacillus halodurans
MNRIFRNTIFYLLIFLVIVGIVSFFTGDQTQTKQITFEEFTQHLEAGEITSLSIKPERDVYLVRGQLRGADEDEFFETYVLPTEQMAETISEAAGLQVIPADETSGWVTFFTGIIPFIIIFILFFFLLSQAQGGGSRVMNFGKSKAKMVNEDKKKAKFKDVAGADEEKQELVEVVEFLKDPRKFSAIGARIPKGVLLVGPPGTGKTLLARAVAGEAGVPFFSISGSDFVEMFVGVGASRVRDLFENAKKNAPCIIFIDEIDAVGRQRGAGLGGGHDEREQTLNQLLVEMDGFSANEGIIIIAATNRADILDPALLRPGRFDRQITVGRPDVKGREEVLKVHASNKPLADDVNLKTIATRTPGFSGADLENLLNEAALVAARQDEKKISMVHIEEAIDRVIAGPAKKSRVISEKEKNIVAWHEAGHTVVGVKLENADMVHKVTIVPRGVAGGYAVMLPKEDRYFMTKPELLDKIVGLLGGRVAEEIQFGEASTGAHNDFQRATSIARKMVTEYGMSEKLGPMQFGSGSGGQVFLGRDIQNEQNYSDAIAHEIDLEVQRIIKECYERCKQILLDNKKSLDLVAETLLDLETLDAEQIKSLIHDGKLPDNHHLAEKIAETRENGQDSEVKVNIHSKKGEEAEGEESAPNTEDVKEDDEKK

SEQ ID NO: 17101 - protein, 813 aa, Bacillus halodurans
MMFGRFTERAQKVLALAQEEAIRLGHNNIGTEHILLGLIREGEGIAAKALQALGLGPEKIQKEVETLIGKGQDGAKTIHYTPRAKKVIELSMDEARKLGHSYVGTEHILLGLIREGEGVAARVLNNLGVSLNKARQQVLQLLGSNETSSSSQQGGGAANANTPTLDSLARDLTAIAREEGLDPVIGRSKEIERVIQVLSRRTKNNPVLIGEPGVGKTAIAEGLAQAIIHNEVPETLRNKRVMTLDMGTVVAGTKYRGEFEDRLKKVMDEIRQAGNVILFIDELHTLIGAGGAEGAIDASNILKPSLARGELQCIGATTLDEYRKYIEKDAALERRFQPIQVNEPSLDESIQILKGLRDRYEAHHRVTITDEAIEEAVKLSDRYIQDRFLPDKAIDLIDEAASKVRLRSYTAPPNLKELEQKLEETRKEKDAAVQSQEFEKAASLRDSEQRIREELDQMKNDWKQKQGQENTQVVVDDIAQVVASWTGIPVSKLAEEETERLLKMEEILHKRVIGQEEAVKAISKAVRRARAGLKDPKRPIGSFIFLGPTGVGKTELARAVAETLFGDEDAFIRIDMSEYMEKHATSRLVGSPPGYVGHDEGGQLTEKVRRKPYSVILLDEIEKAHPEVFNILLQVLEDGRLTDSKGRTVDFRNTAVIMTSNVGASTLRKNKFLGFTTDSEGSEYKDMKDKVMTELKNSFRPEFLNRIDEIIVFHSLEKKHVREIITLMADQLKKRLEEQGVSFELTEAAKDKITDLGYDPEYGARPLRRALQREVEDRLSEELLKGTIQKGQRAIIDVENGELVVHSKEGATL

SEQ ID NO: 17102 - protein, 485 aa, Bacillus halodurans
MASEVRVRFAPSPTGHLHIGGARSALFNYLFAKNQGGMFVLRIEDTDQARNVGQAKEKLLDSLKWLGVEWDESIDVGGEYGPYSSMERLDIYKKHIEQLLNEGKAYYCYMTEEELEAEREAQIARGEMPKYSGRDRDLTEEQRRAYEAKGIKPVVRFRVPEGQVIKIQDAVRGEVSFESDGIGDFVIARKDGVPMYNFAVVVDDHLMKISHVIRGEEHLSNTPRQVMLYEAFGWDVPTFAHASLILNPNRQKMSKRDESIIQFVEQYKELGYMPEAIVNFLALLGWSPVGEEEIFSLEELAAQFSLERVSKAPAVFDTDKLAWMNNQYIKNADLDDVVALALPHLQKAGKLPESLSEEQAEWAKAVISLYQEQLHYGAEIVELTELFFKTEIQYNDEAQEVLNEEQVPGVLSGFLQELEGLDTWDAVSIKGAIKATQKATGQKGKKLFMPIRVATTGQTHGPELPSAIKLIGKEIVTHRLRSLLN

SEQ ID NO: 17103 - protein, 1180 aa, Bacillus halodurans
MTGQLIQYGRHRQRRSYARINEVLELPNLIEIQTASYQWFLDEGLREMFQDISPIQDFTGNLVLEFIDYSLGEPKYPVDESKERDVTYAAPLRVKVRLINKETGEVKEQEVFMGDFPLMTDTGTFIINGAERVIVSQLVRSPSVYYSEKIDKNGKKGYTATVIPNRGAWLELETDAKDIVYVRIDRTRKIPVTVLLRALGFGSDQEIIDLLGEDEYLRNTLEKDNTDSAEKALLEIYERLRPGEPPTVENAKSLLDSRFFDPKRYDLANVGRYKVNKKLHIKNRLFNQRLAETLIDPETGEVIAEEGSIIDRRTLDRILPYLENNVGFRTVRMSGGVVEEDEVRLQSVKIYAPDDQDGEHVIRVIGNGLVEKEIKHITPADIIASINYFFNLLHSVGGTDDIDHLGNRRLRSVGELLQNQFRIGLSRMERVVRERMSIQDPNSITPQALINIRPVIASIKEFFGSSQLSQFMDQTNPLAELTHKRRLSALGPGGLTRERAGFEVRDVHYSHYGRMCPIETPEGPNIGLINSLSTYAKVNEFGFMETPYRRVDPETGKVTAQIDYLTADEEDNYVVAQANMKLAEDGSFIDENIIARFRGENIVVSRDRVDYMDVSPKQVVSAATSCIPFLENDDSNRALMGANMQRQAVPLLVPEAPIVGTGMEHVSAKDSGAAIVSKHRGIVERVTAKEIWVRRLEEVDGKEIKGDLDKYRLQKFIRSNQGTSYNQRPIVKEGDVVEKREILADGPSMEKGEMALGRNVLVGFMTWEGYNYEDAIILSERLVKDDVYTSIHIEEYESEARDTKLGPEEITRDIPNVGEDALRNLDERGIIRVGAEVKDGDILVGKVTPKGVTELTAEERLLHAIFGEKAREVRDTSLRAPHGGDGIVLDVKIFNREDGDELPPGVNQLVRVYIVQKRKIHEGDKMAGRHGNKGVISRILPEEDMPYLPDGTPIDIMLNPLGVPSRMNIGQVLELHLGMAARRLGLHVASPVFDGASEEDVWATLEEAGMARDGKTILYDGRTGEPFDNRVSVGIMYMIKLAHMVDDKLHARSTGPYSLVTQQPLGGKAQFGGQRFGEMEVWALEAYGAAYTLQEILTVKSDDVVGRVKTYEAIVKGENVPEPGVPESFKVLIKELQSLGMDVKMLSSTEEEIEMKELDDEDEQASDKLNLNIDSTESNV

SEQ ID NO: 17104 - protein, 276 aa, Bacillus halodurans
MAIKKYKPTSAGRRGMSTLDFAEITTDKPEKSLLAPLHKKGGRNNQGKMTVRHQGGGHKRQYRIIDFKRNKDGIPGRVATIEYDPNRSANIALINYVDGEKRYILAPKGLKVGMTIESGPEADIKVGNALPLKNIPVGTVIHNIELKPGKGGQLVRSAGAEAQLLGKEGDYVLVRLNSGETRYILATCRATIGQVGNLEHELVNIGKAGRSRWLGKRPTVRGSAMNPNDHPHGGGEGRAPIGRKSPMSPWGKPTLGYKTRKKNKASDKYIVRRRKK

SEQ ID NO: 17105 - protein, 282 aa, Bacillus halodurans
MKGSPFEKVALSDVSFTIPSGSFTAIIGHTGSGKSTLAQHFNGLLRPSKGTVRLGELEITADQKPPSLKEIRRKVGLVFQYPEHQLFEETVEKDICFGPMNYGVSEARAKKRAKELLHLVGLPDTYLQASPFSLSGGQMRRVAIAGVLAMEPDVLVLDEPTAGLDPEGQRLIMDMFYRLHQEKELTTVLVTHNMSDAAKFADQIIVMSQGNVAMTGDRQTVFARADELVALGLDVPETLQLLLQVKERFGLHDVPPLFSLEELADFLAKELQQKEGQPCSKI

SEQ ID NO: 17106 - protein, 442 aa, Bacillus halodurans
MTEGIKIATIGGGSSYTPELVEGFIKRYDELPVRELWLVDIEEGKEKMEIVGNLAKRMVQKAGLPIDIHLTLDRREALKGADFVTTQFRVGLLDARAKDERIPLKYGVLGQETNGPGGLFKGLRTIPVILDICRDMEELCPDAWLINFTNPAGMVTEAVLRYANIKKVVGLCNVPIGIEMGVAKLLDVDHSRIRIDFAGLNHMVYGLDVYLDGVSVKDKVIEMITDPNNSSFVKNIEGLGWEPSFVKALGVLTCPYHMYYYKSREMVEKDLKKAKEEGTRAEVVQRLEKELFELYKDPNLDIKPPQLEERGGAYYSDAAVRLIHSIYTDRRDIQPVNTMNRGAIASIPDDSAVEVSCVITKDGPKPIAMGDLPVPVRGLVQQIKSFERVAAEAAVTGDYDLTVLAMTINPLSPSDTIAKQIVDDMLEAHKEHLPQFFNEVQA

SEQ ID NO: 17107 - protein, 354 aa, Bacillus halodurans
MKALNLYGIQDLRFEETPAPSIEHDDDIIIKVKAVGICGSDLSRYKKLGPYVPGMTFGHEFAGEVVKIGRSVTGFSIGDRVAACPTYTCGQCRYCQLGEPTRCERLSVIGARHPGAYAEYVKLPAKHVIPLPNVVNYDEAALIEPASVVAHGFYRTNIKPGASVAIMGVGSIGLLAVQWAKIFGATTVFAIDIDEQKLNVANQLGADVLISSLQRPAHKQILEYTNGIGVDVAVESAGTPSTSAQVFALPKKGGEVVFLGIPYADVQIERFYFEKIVRNELHVYGSWNALSSPFPGKEWATTIHYMSSGQLNVAPMISYRLPLAKGPETFQQIAKGELKPTKVLFYPEKLSERK

SEQ ID NO: 17108 - protein, 343 aa, Bacillus halodurans
MKALVKTQHGTGHFAVQEKPEPTPGKHQVKIKVKYTGVCGSDIHTYEGHYPVAAPVTLGHEFSGEIVELGEGVTGFNVGDRVTSETTYSICGKCSYCTSGDYNLCSHRKGLGNQQDGSFAKYVIARQESLHHLPAGVDDRSAAMTEPLACTHHAIAKTSINKGDLVVVTGPGPIGLLAAQVAKSHGGTVIITGLSNDQVRLKKAKEVGIDYAIDTQEVDIKELVSELTDGYGADVVLECSGAVPAAKQGIDLLRKKGQYAQVGLFAQPEIQFNFEKIIQKEISVVGSRSQKPADWEPALSLLNEKKVNAKTLVTHEYTISEWDKAYHAIKSGEAIKVLLTPID

SEQ ID NO: 17109 - protein, 257 aa, Bacillus halodurans
MSSDFIQSWTEGAVGVIQLNRPKVANALNRQMVQEIVEQAERYDRDQEIRVILVKGSERAFAAGADIREMEGETPIRFELADPFADWDRFTRIHKPMVAAVSGFALGGGFELALHCDLIVAATNARFGFPEVSLGVLPGAGGTQLLTRAVGRKKALEWIWTGKHISAQEALQIGIINKIVEPELVEEEAFRLARTIVKQAPIAVRLIKEAVHQAEDVTLADGMMLERKNFYLAFATKDQKEGMKAFLEKRPPIFKGE

SEQ ID NO: 17110 - protein, 260 aa, Bacillus halodurans
MCEEFKDIIYEEKGQVAWVTLNRPATYNAFTPVMNREVTVALKKANQSDAIRAIVLTGTGRAFCSGEDLDGVTVDTDHGAILRARYHPMMQGMKQVEKPIIAAVNGTAAGAGMSLALAADFRLVHENAKFVSAFLGVGLIPDSGFLYQLPRMIGYAKALELAVLGKPLSAEDAQRCGLVTEVFAADEWEDGVASFSMKLAALPTKAIGLIKRLMIDGMNEGFLEVLEKEAQAQRIAGQSADHREGLEAFKQSRPPMFTGL

SEQ ID NO: 17111 - protein, 490 aa, Bacillus halodurans
MKRDHYRMVINGERVDSDETFETFNPAKGEILATVAKASREHAEKAVQAARHAFDHGKWRKYPVGKRARVLNQIAAIMRERFQELVEIEVLNSGKAISAAQAQINQAIEDFEFYAGAIVGHRGTVNNVPNGFLNYTQKEPVGVCAQIIPWNYPLMMAAWKVAPALAAGCSVVVKPASLTPITAILLNEICHEAGVPEGVVNTVAGAGSVVGDYLVGHEDVNKVAFTGSTPIGKDIMEKASHTLKRVTLELGGKSPNLVFADADMEAAVAGSLFGIYFNTGQSCEARSRLFVHEEIYDEFIEEFITRAKKLQLGDPFDKGTHVGSIISRDQLEIIDSYVRSAEEEGATIALGGKERRVEGFENGHWYEPTVITNVTPDMKAVQEEIFGPVVVVETFQDEREVIKRANDTKFGLGSAIWTKDQGRATRVAHQLEAGIVMVNCPFSAFPGTPFGGYKESGFGRELCVETLDLYMEDKSILSYYGPKPINPFGV

SEQ ID NO: 17112 - protein, 282 aa, Bacillus halodurans
MVKQVTVVGAGVMGRGIAYVFALAGFQTTLTDISEEQLNRAQQYVEETAEKGVAKGKVTEEQKAAIVHGLNVTTHLKDAVKQADLIVEAVPEKRELKQAVLEVADEYSPPHAVIASNTSTISPTELGSYTKRSNQTAVMHFFNPVPLMPLVEIVKGLETSQQTVDTIREVSEQIGKETVEVNEFPGFVTSRISALIGNEALHMLQEGVASAEDIDKAVRLGLNFPMGPLELADLVGLDARLNNLRYLHETLGEKYRPAPLLEKLVKAGRLGRKTKQGIYKYD

SEQ ID NO: 17113 - protein, 400 aa, Bacillus halodurans
MEEVVIIDAVRTPIGRYNGALRDVRPDDLGAIVLRALKERNPQVPIDEVEEVVFGNANGAGEDNRNVARMSTLLAGYPVQVAATTLNRLCGSGLDAVAYAARMIAVGEGEIVIAGGTESMTRAPYVMEKPGQSYMRGDQTLYDTTIGWRFVHPVMEETYGVDSMPETAENVAKTYSISRLAQDHFAYVSQMRAKEAMECGRLDEELVPVEIEDKKNGKYEVRTDEHPRPTSTMEKLNSLSPLFENGTVTAGNASGINDGAAAVLLMSRKKANELGLTPLASYIGAATAGVEPRIMGIGPVYATNKLLNRIGWTVNGLDLIELNEAFAAQALACIHELGLNQEVVNVNGGAIAYGHPLGASGARILTTLLYEMRRRGSRKGLATMCIGVGQGISVAVERID

SEQ ID NO: 17114 - protein, 367 aa, Bacillus halodurans
MAIENKGIQRELKHEENLFQVLTPKGECQYEGSEFLDKTFVLSMYKQMINCREFDEKALKLQRQGRIGTYASFKGQEACQIGGALALRPTDWLFPTYRDHAAISTHGQPWHRIFLYWMGHMDGSLSPDDRNILPPAVPIATQMLHAVGTAWADKLKGNPHVSLVFFGDGATSEGDFHEALNFAGVYQTPTIFFCQNNGYAISVPFEKQSASKTIKQRSVAYDMRGERVDGNDIFAVYLTVKRAIEQARKGRGPTLIEAVTTRFGSHTTADDAKKYRDQEEIERTWKEMQDPLTRLKAYIQAKGWLSEEEEAQMKAKIRETIDEELSMAEQYPKPSISQMFEHVYENQPWYVKEQEQELAELLGKEKR

SEQ ID NO: 17115 - protein, 328 aa, Bacillus halodurans
MGSQQQTMLQAINQTLDDLLATNDDVMLLGEDIGINGGVFRATDGLYEKYGKDRVVDTPLAESGIIGSAIGLAMNGKRPIVEIQFLAFIYPGFEQLISHAARMRYRTRGQYNVPMVIRTPYGAGIRGPELHSESVEAFFAHTPGLKVVAPSNPYDAKGLLTAATSDPDPVIFLEDTKLYRAFKEDVPNTLYEIPLGQAKVVQEGEDVTVIAWGGMVREALQAAKEAEKAHGWSCEIIDLRTIAPIDRETIIESVKKTGRAIIIHEAHKTAGLGGEITALINEEALIYLKAPVKRIAGFDIPVPQFLSENQYLPTIERMFRGIEETVSF

SEQ ID NO: 17116 - protein, 414 aa, Bacillus halodurans
MVEFRLPDVGEGMHEGEIISWFVQEGDHVKQDEPVVEVQTDKMNAELTAPVSGKIKRVYYKVGEVAEVGSLLFTIDENLSTFKSETHERTKRENSTEQTRPISNISLTSQQKAPVRKGLATPYVRQLAREMNINLEDVVGTGPGGRVLEQDLQNDTNLQKVKTVPSGVANVQESIERTGSSAEKRIPLKGIRKAIAEKMIKSVATIPHVTHVDEIEMDALKELREQLKHYSEQKGIKLTFLPFFIKAIVSALKEFEYFNASIDEETNEIVLKKDYHIGIATDTEKGLIVPVIQNADQKSLLELAGEITQLSTQARKGTLNVQQMTGSTFTISNVGPIGGLHATPIINYPEVAILALHKMEPRNVVREWESVIKLMMNMSLSFDHRLVDGATAVRFTNRMKELIENPNLLLMELR

SEQ ID NO: 17117 - protein, 473 aa, Bacillus halodurans
MVVGEVAVEVDTVVVGGGPGGYTAAIRLGQLGKSVVLIEKNQLGGVCLNRGCIPSKALIQMAEKFDELTHLKEMGVELPGKPASIDLHKWQKWKQEITTKLNTGIHQLCQQNGVTVVTGEAHFLSSHRVGVETGNAFDVYKFEHAIVATGSSPRSLPFAEVDHTYILDSTSALELTEVPRSLSIVGGGYIGMELGLAFAKLGSAVTIVEMSPHILPATAPHISREVLNKAEKLGVTIKSSTSVEHLTVNDGYVELIVQSNGEQETLQSEKALMTVGRSPNTKGLGLEQVGVFFNEDGTLPINEECRTNIDHIFAIGDVTEGPALAHKASKQGIVAAEVIGGLPSAIDSSYIPYVVFTDPQIAGVGLTAKQAQEQGHRVKTARFPFQANGLALVASKPDGFAEVIVDEESHLLLGFHIVGADASNLIGEGVLALELGARVEDVALTVHPHPTFSEGWLGAAEAALGHAIHVVNK

SEQ ID NO: 17118 - protein, 447 aa, Bacillus halodurans
MGKYFGTDGVRGVANTELTPELAFKLGRIGGYVLTKDKENPKVLIGRDTRISGEMLEGALVAGLLSIGVEVMRLGVISTPGVAFLTKAVSASAGVMISASHNPVADNGIKFFGPDGFKLLDEQEKEIETLLDQEDALPRPTGADLGQANDYFEGAQKYLQFLKQTVDEDFTGIHIALDCANGAASSLAPHLFADLEADISTMGTSPNGKNINDGVGSTHPEALAAFVNAKNADIGLAFDGDADRLIAVDEKGNIVDGDKILYICAKYMKEKGLLKQQTLVTTVMSNLGLYKALEALQIDTKQTAVGDRYVMEEMRKGGYNLGGEQSGHIIFLDHITTGDGMLSALQLVNIMKQTGKKLSELAEEWETFPQTLVNIRVTDKHAVTDNEKVPAVIKEVEQEMNGEGRVLVRPSGTEPLVRIMVEAKTEELCDAFVNKIADVVKAELGQE

SEQ ID NO: 17119 - protein, 600 aa, Bacillus halodurans
MCGIVGYIGTEDAKEILLKGLEKLEYRGYDSAGIAVATEEGVHIFKEKGRIATLREVVDQGVKSTVGIGHTRWATHGEPSKVNAHPHQSESSRFTIVHNGVIENYEQLKRDYLQAVTLQSDTDTEVVVQLVERFVHEGQSVEAAFRHTLSLLKGSYAIALLDKKDTDTIYVGKNKSPLLVGVQDGVNVVASDAMAMLQVTDQFLEIMDEEIVIVTKDDVTIKTLDGTAVSREPYTAELDASDIEKGTYPHFMLKEIDEQPFVIRNIIQKYQNEDGSVRLDEDIRQAVMEADRIYIIAAGTSYHAGLVGKQLIENFAKQPVEVHIASEFLYNMPLLSKRPLFIFISQSGETADSRGVLVEVKKLGYKALTITNVPGSTLSREADFTLHTHAGPEIAVASTKAYTAQMAVLTLLAADTAKAKGIDLGFDPIQELSIVANAMETLCNQKETLEKIARDYLAVTRNCFFIGRATDYFVCLEGALKLKEISYIQAEGFAGGELKHGTIALIEEGTPIVALATQEHVNLSIRGNVKEVAARGAFPCIISMEGLNEEDDTFVLPKVHSHLTPLVSVIPLQLIAYYAALHRGCDVDKPRNLAKSVTVE

SEQ ID NO: 17120 - protein, 302 aa, Bacillus halodurans
MKPLIGKVALVAGATRGAGRGIAVELGAAGATVYVTGRTTRERRSEYNRPETIEETAELVTNAGGTGIAVPVDHLDPQKVEALVSQIEREQGKLDVLVNDIWGGELLTEWNAPVWQHSLDDGLRMLRLAIDTHLITSHFALPLLLKSRGLVVEMTDGTAEYNREHYRQPLYYDLAKTSVLRMAWGLAQELQPHECTAVALTPGWMRSEIMLDHFEVTERNWRDATIKEPHFVISESPRFVGRAVAALASDPNVSRWNGQSLSSGQLAQAYGFTDLDGSKPDCWRYLVEVQLTGKEADATGYR

SEQ ID NO: 17121 - protein, 756 aa, Bacillus halodurans
MLTSNLGYPRIGENREWKKALESFWANDTTEEQLLATMKELRLNHLRVQQEQEVDLIPVGDFTLYDHVLDMAVMFGIIPKRFLQQGDTPTLSTYFAMARGSKNAQACEMTKWYNTNYHYIVPELHDAAPRLTKNAPLEAYLEAKNELGIDGKPVILGPYSFVKLAKGYEEDKLQETIQSLLPLYIQVIQELVDAGARSIQVDEPSLVTSISAREMALVTRIYEQINEAIADAPLFLQTYFDAVTFYEEVVSLPVKGIGLDFVHGGAKNLEALRTFGFPEDKVLAAGIIDGRNIWISNLRERHELVHQLEQHVAKDRLVLQPSCSLLHVPVTTKREEKLDPTLLGVLAFANEKLTELHTLKQLAAGNEAEVKEALEANDDALAALEKSGWRSGAATSHNLENKKRPQSFNERRPLQEEKWQLPLLPTTTIGSFPQTKDVRRTRSLWRKGELSTVEYERTMKSYIEKWINIQEELGLDVLVHGEFERNDMVEFFGEKLDGFAFTANGWVQSYGSRCVKPPIIYGNVSFTEPMTVAETVYAQSLTDKPVKGMLTGPVTILNWSFVRDDLPLTVIAHQIAEALTHEVTALEEAGIEMIQIDEPAIREGLPLKAEDQQEYLDWAVSAFRASCAHVKATTQIHTHMCYSEFHEMIEAIDDLDADVISIETSRSHGEMISAFEKTTYEKGIGLGVYDIHSPRVPSEEEMLNVIRRALTVLPASLFWVNPDCGLKTRAEKETVAALKNMVAAARAAREELKTKA

SEQ ID NO: 17122 - protein, 306 aa, Bacillus halodurans
MTTTNYLIETNNLTMTYKHVHAVDRINLKVKEGEIYGFLGPNGAGKTTTIRMLLGLIKASHGSIKIFGKDLKQHRLDILKNIGALVESPSYYPHLSGEDNLETVRKIVKVPKSRIAEVLELVRLTKVADRKVQEYSLGMKQRLAIAAALLANPRLVILDEPTNGLDPAGIIEIRNLILRLPKEYGITVLLSSHLLSEVEQVASQVGIIAKGKLIFQDSIEELRKKANRKIFLSTSHPEVAATILQERGINVDTQARGLVMNDRSDEEIAQLVKAFVEKDIDVYRISDETSSLEEIFLQLTKGGQTL

SEQ ID NO: 17123 - protein, 318 aa, Bacillus halodurans
MSYVLLLLGFALLIKGADFFVDGSSSIARLLNVSPLLIGLTIVAFGTSSPEATASIIAALNGNPDVALGNVIGSNMFNITLVVGLTALLSPLIVTNATLRKEIPFTLLASIALYIFINDQMIEGAVESTLSRSEGLILLLIFCVFLYYIFEVARTSPREQKIVQDFAIKPTWRKNIFLSILGLAMIIGGGELVIRHSTAIAFSHGMSETLVGLTIVAIGTSLPELVTSLTAALKKESEIALGNIVGSSIFNIFFVLGTAATITPMHVDSRVVVDLLLLIFLTLLLLVFSRTRYTVGKYEGLILASFYIGYMVYIIWRN

SEQ ID NO: 17124 - protein, 183 aa, Bacillus halodurans
MKRIPSIRERNIVLIGFMGVGKTSVGEQLAKRLFRDFIDVDQEIEKTWKMKISDIFRLKGEEAFRKIEREMTIDYCTNTSLKVISLGGGAYMQDAIRTACLDHCIVIYLDLSWSLWKERLNVLIDNRPVLQDKKVEEMEQLFTKRQPTYQKNSFQVETDGREVAEIVSYLEEVIKLGWEIYGS

SEQ ID NO: 17125 - protein, 726 aa, Bacillus halodurans
MTMTINKELHWQERLKERFPQLEVEDVLSQGASLESMRMKAMDEISAEQPEWTFITARIYLEELYNSVKEQRGLAKPYTQFYELIEVLVDKGIYEKDLLNRYTKEEINELGEHLNQEKDELFTYIGLKTLADRYLARLYDRTLMELPQERFMVIAMSLMKKEVNSQRLSLVKEAYWALSNLYMTVATPTFANAGKAVGQLSSCFIDTVDDSLRGIFDSCTDAATVSKSGGGLGIYLGKIRAKGSSIKNYQNVSSGVLPWMKQLNNVAVSVDQLGQRQGAIAVYLDIWHKDIFSFLDAKLNNGDERQRTHDLFTAVSLPDLFMEAVEARDNWYLFDPHEIRQKMGFSLEDSYDEQKGSGTFRERYEACVNNPDLSRTEVPAIEIMKRIMISQLETGSPFMYYRDEANRMNPNKHEGMVYGSNLCTEIIQNMSPTTVVEEKTEDGKILITKQPGDYVVCNLSSLSLARVVEDDVLERLIPIQVRMLDNVIDVNRIEVKQAEQTNQKYRAIGLGTYGWHHLLAKKGIAWESEEAIRYADELYETINYLTIQASMKLAEEKGAYPMFGGSDWETGEYFERRQYTTDKWTELAEQVKEKGLRNGYLLAVAPNATTALIGGTTASIDPIFQKTYVEEKKNYRIPVTAPDLSPETTWYYKSAYHIDQTWSIRQNGARQRHVDQSISFNLYVSNTIRAKELLELHLLAWKEGLKTTYYLRSTSMEIEDCESCAS

SEQ ID NO: 17126 - protein, 345 aa, Bacillus halodurans
MEQLQKRKIYDTTASNASTGILNGKSSNVLNWDDVRFSWAYPLYKNMLANFWTPFEINMSHDAKQFPTLTETEQEAFKKIIGLLAFLDSVQTDYSMRAAEYLTDSSLAALMSVLSFQEVVHNQSYSYVLSSLVPKATQDEIFEYWKHDDVLKERNEFIIDGYEKFVDNPTPKTFLESIVYDVILEGLNFYSGFAFFYNLARNQKMVSTSTMINYINRDEQLHVYLFTNIFKELLVEFPELNTEETKTFVKTTLMKAADLEKDWFRYIIGDKIPGINPEDMETYISFIANKRAVQLGMEKPYPEIKHNPMKWIRAYEDVNSGKSDFFEQKSRQYAKVSADNGFDEL

SEQ ID NO: 17127 - protein, 260 aa, Bacillus halodurans
MKNLHGKRAIVTGVSRLSGIGAAICREFAKRGADVFFTYYFHYDQTLGVKGENDEPMRLAKELESHGVAVAHLELDLSEDNAYVQIFNAFEQRFGTTADILVNNACVSVNDSYETITSENLDAHYVINVRATTLLTSEFAKRFSKGHGGRIIQLTTGWSQGPMANELSYAITKSTVEALTYTLKTELAKKGITINAVNPGPTNSGWMSDQLKQELLPRFPFGRLGEPKDAANLIAFLASDDAEWITGQVIHSEGGFQNTL

SEQ ID NO: 17128 - protein, 382 aa, Bacillus halodurans
MNINKFVTPEIIFGGHAIRQAGDACVRLGAKKVLIVSDRGVANAGWLEKVMELCKESHLPFATFVGVTTDPKDREVEQGCQVFVQHECDAIIGVGGGSVLDVAKAIAILATNGGAISDYEGIDKIKKPLPPMIMIMTTAGSGSEVSQFSIIVDSNRKKKMTIVSKTLVPDIAIIDPYTLVTKDSSLTATTGMDVLTHAIEAYVSIAATPLTDVQAKNALILCAQYLRPSVASKTNTEAKEAMAMASLQAGLAFSNAILGAAHAISHAIGGKFPLPHGEINAILLPYVMDFNFIATPKRFLDIATCLGIDTRGLTEREAGNAAIHFVKELSFDIGIPTRFREVGITQEMIHHISEVALEDACMITNPRDMNVEQVKQVLKNVL

SEQ ID NO: 17129 - protein, 498 aa, Bacillus halodurans
MQKISTNDSKLNPRLVAFLNGGPKKLFINGEWVDSFSGQSFETMNPATGETLALVAEAGSEDIDFAVKAARKAFDEGPWSKMSAAERSRLIYKLADLIEDHKEALAQLETLDNGKPIRETANADIPLVIEHFRYFAGWATKIVGQTIPVQGHYFNYTRHEAIGVVGQIIPWNFPLLMAAWKLGAALATGCTVVLKPAEQTPLSALYLGELINEAGFPKGVVNIVPGFGHSAGTPLVNHPAVDKVAFTGSTDVGKLIMKQASESLKRVTLELGGKSPNIILPDADLSKAVPGSLMGIMFNQGQVCCAGSRLYVQKKQYDHVVADLVSLTNEIQQGDGLLEQTTMGPLISNQQQSRVKNYIDRGVEEGAELLTGGNIPYDQGYFVAPTIFADVDHSMTIAKEEIFGPVVAAMPFDSIDDLIDKANDSDYGLAAGVWTQDIKKAHYIAHRIKAGTIWVNCYNVFDAASPFGGYKQSGIGREMGSYALENYTEVKSVWVNMD

SEQ ID NO: 17130 - protein, 381 aa, Bacillus halodurans
MREKKFATKSVHFTEKEISKNRSKSKPIYQTSAFVFQDLDDMESFYRGEKEYLYTRYGNPNSDDLGKGVASLEQAEDGVATSAGMSAILVALLALLEKGDHLIAANDLYGGTYQLLAEELPKLGIDVSFVPFQEREVVKRAIRKETKVLYSETVTNPLLRVEDIHQVVELGKEHGLSTVIDNTFATPYFVQPLTCGVDVVVHSATKYIGGHSDVTAGVVVGSAEIIQQVRQKVATLGCNLSPFEAWLASRGLKTLALRMERQGENAQALATFFADHPGVSQVFYPTTVSKRGNGAIVTIRLAEKVEAATFFESLDWVKIAPTLAGVETTVSYPIQTSHRTVPESLRQELGIDKQLVRISVGIEDIEDIMAAFDKAIKKAGS

SEQ ID NO: 17131 - protein, 806 aa, Bacillus halodurans
MKNQKELTLDIQGMTCAACSNRIEKGLQRMDGVQEANVNLTLERSTVVYDPEKVQPEQVIEKVEQLGYKVVIDRVEFDVVGMTCAACANRIEKKLNRLEGVHKAVVNLALETATVEYRPESVSPSDLEQAIEQIGYTLKRKTGDAEEGDVRERELQKQKRRFWISAVLTLPLLWSMVTHFEFTSFIWMPHLFMDPWVQLLLATPVQFYIGAPFYVGAYKALRHKSANMDVLVALGTSAAYFYSMYLGYDWLYGTREGMMPELYFEASAIIITLIVLGKYFEARAKGRTSEAIRKLLGLQAKTARVIREGKEEQIPLEEVKTGDLLLVKPGEKIPVDGEVVEGYSAVDESMLTGESIPVEKDVGDQVIGATVNHNGSLRIRATRVGKDTALAQIVKVVEEAQGSKADIQRAVDKVSSIFVPVVVAISVLTFLVWYMVIDPGNVTSALIPTISILVIACPCALGLATPTSIMAGSGRSAELGVLFKGGEHLEHTQRIDTVVLDKTGTVTEGKPSLTDFVTYGSADEKEMATMLHAAERRSEHPLATAIVDGMKQLGVDRLEADSFSAIPGHGVEAMVAGRNVLVGTRKLMAEHQVDYKEALSSAEAREARGETVMFMAVDGILTAHVAVADQLKSSSKKAIERLKALGLDIVMLTGDNERTARAVANDVGIEQVIAEVLPKDKSEQIRKLQKQGRTVAMVGDGLNDAPALATADVGMAIGSATDIPIEAADLTLLGDDLHRVADAVLMSQKTMRNIKQNLFFAFVYNTSAIPIAAAGLLAPWVAGAAMAFSSVSVVLNALRLQRFQIK

SEQ ID NO: 17132 - protein, 544 aa, Bacillus halodurans
MAKDIKFSEDARRSMLRGVDKLADAVKVTLGPKGRNVVLEKKFGSPLITNDGVTIAKEIELEDAFENMGAKLVAEVASKTNDIAGDGTTTATVLAQAMIREGLKNVTSGANPMVIRKGIEKATQVAVEELSKISKPIEGKDSIAQVAAISSADDEVGKIIAEAMERVGNDGVITIEESKGFSTELEVVEGMQFDRGYASPYMVTDSDKMEAVLDNPYVLITDKKISNIQEVLPVLEQVVQQGKPILIIAEDVEGEALATLVVNKLRGTFNAVAVKAPGFGDRRKAMLEDIAILTGGEVITEDLGLDLKSANITQLGRASKVVVTKENTTIVEGAGESDKIAARVNQIKAQIEETTSDFDKEKLQERLAKLAGGVAVLKVGAATETEMKERKLRIEDALNSTRAAVEEGIVAGGGTALVNVIKAVSSIGAEGDEATGVNIVLRALEEPVRQIAHNAGLEGSVIVERLKKEEAGFGFNAATGEWVNMVEAGIVDPTKVTRSALQHAASVSAMFLTTEAVIADKPEENEGGGGMPDMGGMGGMGGMM

SEQ ID NO: 17133 - protein, 477 aa, Bacillus halodurans
MSKHSFPEGFLWGGAIAANQAEGAYLEDGKGLTLVDLLPTGQKRWDVMLGKLDSFTPLEGEFYPSHEAIDFYHRYQEDVALLAEMGFKAFRLSISWARIFPNGDDPEPNEKGLQFYDDLFDELLKYNIQPVVTMAHFDVPVHLIESYGGWRSRKLVGLFETYAKTILSRYKDKVKYWMTFNEINMLLHLPFVGAGLVFKEGENKKQIQYQAAHHQLVASSLAVKACHELIPDAKIGCMLAAGATYPYTCHPNDVFEAMTKDRESFFFIDVQSRGEYPGYAKRFFRDHNIVIDMEEGDEALLKNHTVDYIGFSYYASRVTSTDPEVLKNITSGNVFGSVENPYLEKSEWGWTIDPKGFRTTANQLYDRYQKPLFVVENGLGAVDDVTLEGEINDEYRIDYLRKHIAEMAEAIADGVDIIGYTSWGPIDVVSASTGEMKKRYGYIYVDRDNEGKGSLKRMKKKSFHWYKKVIETNGEKR

SEQ ID NO: 17134 - protein, 572 aa, Bacillus halodurans
MGNERLKAPEGPPSDVERIKEESNYLRGTLKESMLEPISAGISDDDNRLMKHHGSYLQDDRDLRNERQKQKLEPAYQFMLRVRMPGGVATPEQWLVMDELAQKYGNGTMKLTTRETFQLHGILKWNMKKTIQAIHSALLDTIAACGDVNRNVMCTSNPYQSEIHQEVYEWSKKLSDDLLPRTRAYHEIWLDEEKVAGTPEAEEVEPMYGPLYLPRKFKIGIAVPPSNDIDVFSQDLGFIAIVEDDKLVGFNVAIGGGMGMTHGDKATYPQLAKVIGFCKPEQIYDVAEKIITIQRDYGNRSVRKNARFKYTVDRLGLETVKNELENRLGWSLDEAKPYHFDHNGDRYGWVKGVKGRWHFTLFVEGGRVTDYADYKLMTGLREIAKIHTGDIRLTSNQNLIIANVTSQKKKKINELIEQYGLTDGKHYTALRRSSIACVALPTCGLAMAEAERYLPKLIDKIDEIIEENGLKNEEITIRMTGCPNGCARHALGEIGFIGKAPGKYNMYLGAAFDGSRLSKMYRENIGEEEILKELREILPRYAKERKEGEHFGDFVIRAGIIKETTDGTNFHD

SEQ ID NO: 17135 - protein, 743 aa, Bacillus halodurans
MEEMIQFFREKQKQQGKEARYDTRCPFCSVQCSMTLTEEKLVATSRFKAIPNKQDPTSEGRLCIKGVHAHQHTVHRERIRQPLVKTGGAFVETSWEVALGLIAERFKRLQKSYGQDAVGVFGGGSLTNEEAYLLGKFARLALGTRYIDYNGRYCMSSAAAAANLTFGVDRGLTNELREVEDAECIVLAGTNLAECQPTLMPYLRRAKKNGAFIIVLDPRETGTTKIANLHLKPKPGTDGAIAAGMLKVLIEEELIDRTFIEARTNGFEQVESELQEIALAELALAAGVPEEQIREAAIRFGEAQTGMIFTARGVEQQATGTADVRQFLHILLATGKIGRYACGYGAVTGQGNGQGGREHGQKADQLPGYRSIESPEDRAYIASVWNVEEKDIPRKGVSAFELFQKIDQQDVRGMFIMGSNPVLSSPHENLVKRALSRLDVLVVVDMFISETAEYADIILPTTSYLEDEGTMTNFEGRVVHRPGSKPPFGKAKHDWQILCELAEALDRSHGFQFSSPEEIFNELCLASKGGKADYSGLSYEKIKGEGVLWPCPTKEHEGTGRLFEDRFYTEDGRAQFGSVHCPVDSENDEYPILLTTGRVLTQYLSGTQTRRSDALLFKEPEPFVLLHPETASSYQIQDEDWVMVRSPYGEAKLKARQSEGIREDTVFVPFHWAGSVSINHVVAPELDPTSRMPAFKRTKVKLKKIIEEKGESWYSGQKNDRQESENTDDILDPVHSGGVAKNR

SEQ ID NO: 17136 - protein, 365 aa, Bacillus halodurans
MASIVSVSSYPPPYLLKQETTTEFAKELFQEDFRDIERLLKSFSNGQIEERQFAVPLDWFRQDHSLQEKNDTYIKLATMFSVEVVRQCLQSNVFLKKPVAEEEIDTIVFVSSSGMATPSIEARMMNELPFSPHTKRVPMWGLGCAGGAAGMSRAYEYCRAFPRANVLVVCVELCSLTFQRQDRTKSNLIGASLFSDGVACALVSGDESDVLGRMKMPTRPLILGSSSTLMPDSEQVMGWDVKDTGLHVVFSRDIPNIIRHWLRPNVERFLETYRLSLEQIEAFIAHPGGRKVLEAYEEALSFSDEMTEYSRDILRHHGNMSSPTVLYVLEKFMKDTRDPGQYGLMAALGPGFCSELVLMQWEAVH

SEQ ID NO: 17137 - protein, 433 aa, Bacillus halodurans
MIERYTRPEMGAIWTEENRYQAWLEVEIVACEAWAELGEIPKEDVKKIREHASFDVERILEIEQETRHDVVAFTRAVSETLGEERKWVHYGLTSTDVVDTALSYLLKQANEIIEADLVRFLDILKEKALEHKYTVMMGRTHGVHAEPTTFGLKLALWYEEMKRNLERFRLAAEGVRVGKLSGAVGTYANIDPFVEQYVCEKLGLERAPISTQTLQRDRHAEYMATLALIATSIEKFAVEIRGLQKSETREVEEYFAKGQKGSSAMPHKRNPIGSENMTGIARVVRGHMLAAYENVPLWHERDISHSSAERIILPDATIAINYMLNRFGNIVKNLTVFPENMKRNMTRTYGLIYSQRVLLSLIDKGMVREEAYDLVQPKAMEAWEKGVQFRELVEQEERITSVLSPEEIEACFDYNHHLKHVDTIFERLGLTNE

SEQ ID NO: 17138 - protein, 747 aa, Bacillus halodurans
MFGGVTNVQRKIIEKMLAGLNDRQREAVKHTEGPLLLMAGAGSGKTRVLTHRIAYLLREKGVAPWNVLAITFTNKAAREMKDRVAQLVGPIADDIWISTFHSMCVRILRRDIDRIGYSRNFTILDSTDQLSVIKQILKNNNIDSKKFEPRSILGTISGAKNELKTPEQFMGIAKGPYEETAAEVYVEYQKQLKKNQALDFDDLIMKTTSLFKKVPEVLEYYQRKFQYILVDEYQDTNRAQYMLVKMLGDRHKNVCVVGDSDQSIYKWRGADIANILSFEEDYQDAEVILLEQNYRSTKTILEAANRVIENNVKRKPKNLWTENEQGAKIGFYKADTEQGEAQFVVEKIREAIQDGASYKDIAILYRTNAQSRVMEEMLIKSNIDYNIVGGTKFYDRKEIKDVLAYLRLVANPDDDISLQRIINVPKRGIGATTVDKIAAYAERQGISMFAALKEIEQIGVTSRAVSKLVEFTEQLGHWVQMQEYLSVTELVEELLERTGYRDMLQNEKTLEAQSRLENIDEFLSVTQEFEKSSDDKSLIAFLTDLALISDIDKLDDEDDGAKPTDAVVLMTLHSAKGLEFPIVFLIGLEEGIFPHSRSLFEDDEMEEERRLAYVGITRAEKQLYLTSAQLRTIYGRTNANPPSRFIDEIPEDCLEFLNEPQEELPWMKTSRPVTKAKQPSRSVPQMTTTGGEQFAWTVGDKAEHKKWGIGTVVSMKGEGDSLELDIAFPPPTGIKRLFAKFAPITKA

SEQ ID NO: 17139 - protein, 288 aa, Bacillus halodurans
MENIVELINVTKTFKDFSINKMDLQVKKGFVTGFIGANGAGKSTTIKMMMNLLKPDDGEVKLFGMDYTTHEKAIKERIGFVYDGNVFFEGLNLKDIKHIVGPAYKRWDDTLFYQYVDKFELPLNKAIKTFSKGMQMKASLAIALSHHAELIIMDEPTAGLDPIFRRELLDILQELMIDNDRTIFFSTHITTDLDRIADYIAFMQGGNLVFNQSIHDIDENYALVKGGLDLLDKDTEKAFVHVRRASTGFEALTNNLSAVKNIFGDTVIIERATLEDIMYYMKGGVHYV

SEQ ID NO: 17140 - protein, 506 aa, Bacillus halodurans
MVYKRPNEEGAVVSFKKRYDNYVNGEWTPPVKGQYFENVTPVTGEVFCEVARSTAEDIDLALDAAHAAKEQWGKTSPAERANLLNKIADRMEENLEKLAVAETWENGKPVRETLNADIPLAIDHFRYFAGAIRAQEGTLSQIDNDTVAYHFHEPLGVVGQIIPWNFPILMATWKLAPALAAGNCVILKPAEQTPASIFVLLELIEDLLPKGVVNIVNGFGVEAGKPLASSSRVAKVAFTGETTTGRLIMQYASENLIPVTLELGGKSPNIFFDDVMAKDDAFLNKAIEGFVLFALNQGEVCTCPSRALIQESIYDTFMERALARVQAIKQGNPLDPNTMIGAQASQEQLEKILSYLAIGKEEGAEVLAGGERNHLPGELANGYYVSPTVFKGTNDMRVFQEEIFGPVVSVTTFKDAEEALAIANDTLYGLGAGVWTRDMNKAYRFGREIQAGRVWTNCYHAYPAHAAFGGYKKSGIGRETHLMMLSHYQQTKNLLVSYSEDALGFF

SEQ ID NO: 17141 - protein, 801 aa, Bacillus halodurans
MQKGKRTFSIQTIGEEGIHFTNETGTLDVSVFVLEEHLFRVLFRKHHTLTVQATWLVAPGMEDIPYEGRDRLDLTPFSLPGFSYERSENEGTVSIHTERLKAYIQLEGFKVTWFEKKDGVWTEVAADRNTQAYNFDGSLGRGIFHYMKRGQEDRYYGLGEKTGSLNRHGRRYRMMNLDPMGYDPIYTDPLYKHIPFYLTRTKEKSWYGLFYDNTATSTFDMGNELDNYHGFYRFYHAEEGDLDYYMIVGADAAEVVETFSWLTGKTTMLPKWSLGYSGSTMTYTDAENAQEQLYQFLDDCKTYDIPCDSFQLSSGYTSIGEKRYVFNWNRSKFPDPKQFIADFHEQGIRLCANIKPCLLQDHPLYEQLKEKGMFINDEDGQEEEVVQFLDDVGAYLDFTNPETIDWWKRNVTEQLLEFGIDSTWNDNNEYEIWKPDAKAHGFGKPIDIGKIRPIQPLLMMKASFEAQLEFDTKKRPYLISRSGCPGMQRYCQTWTGDNRTSWDSLKYNIKTGLGLSLSGIYHVGHDVGGFAGEKPDPELFIRWIQNGIFHPRFTIHSWNEDKSVNVPWMYPEIVKPISDLMRFRVTLIPYLYQLMYESYQAYKPIIRPTFYQFPKDERTFTENDDFMVGDHLLVASVVEKGVHQRDVYLPENGKGWYDFHSERTYEGGQTITLPAPFNQTPLLVEAGAIIPINDHEVTFETKNEEARGFLCYPHLTEGNEVFRLYEDDGETNDYKDGVYTFVTVKMDCTKEEIRVHIEKEGTFPLPYEKVRVYFPKGEQRTIYVNGSEVCTNARQKIEVSI

SEQ ID NO: 17142 - protein, 284 aa, Bacillus halodurans
MELSFQVDLTNKVAVVTGGSGVLGREFCLALAKCGAKVAVIGRTDDKLKAIVNEIIVNGGEAIAISADVLAKTDMERAREQVRTELGTCDLLINGAGGNHPKGTTQLDYLREADLHGIDQDVRTFFDLDADGIRHVFELNFLGTLIPCQVFSQDMLGKEGASIVNISSMNAFTPLTRIPAYSGAKAAVSNFTQWLAVHFSKVGIRVNAIAPGFFLTEQNYSLLVKDDGTYTDRANKILSQTPAERFGKPEELISTLLWLVDSSTSFVNGVIVPVDGGFSAYSGV

SEQ ID NO: 17143 - protein, 578 aa, Bacillus halodurans
MEKQQQTSLKPFFSLILSTNIPKVALTFGLIGSLITTLVGLTIPLLTREMVDGFSLESLNTLLIAAIIVVFILQAVLDGLSMYALAYVGQKIVARLRERMWFKLLRLPVNYFDKNTSGQTVSRVVNDTGIVKDLISQHFPQFVGGIITIIGAVIILFIMDWKMTLLMFIAVPITVAVMVPLGMRMSKISRGLQDETANFTGNVQQTLSEIRLMKASNAEQTEEKKGLTGIEKLFSFGLREGKIFALIAPLMYLVVMVVIVIIIGYGGIRVAEGTMTTGSLVAFLLYLFQIIFPITSFTMFFTQLQKAKGATERIIEILDIEEENGQQGLEMDISNKAIHVKNVSFAYNEEEPVIQKVSFDVEPGTMVAFAGPSGGGKTTMFGLLERFYEPTSGEILIGDTSIQELSMYSWRKQIGYVSQDSPMMVGTIRENLCYGLEDRDDIDDDRLWEVAKMAYADQFISEFPKGLDTEVGERGVKLSGGQRQRIAIARAFLRDPKILMMDEATASLDSQSEGIVQQALTRLMEGRTTFVIAHRLSTIVNADKIIFIEKGQITGIGTHQELVQTHDLYREFAEQQLT

SEQ ID NO: 17144 - protein, 332 aa, Bacillus halodurans
MNVSKARITAIGSYVPERRLTNDDLEKMVDTNDEWIVKRTGIRERRIAADDEFTSDIGYKAVQDLIARYEKSVDDVDMIIVCTFTPDFKTPSAASLIQAKLGIQNTGAIDLNAACAGFTYGLHMANGLISSGLHRKILVIGAETISKVTDYTDRTTCILFGDGAGAVLVEYDENEPSFVSFNLGSEGERANKLYCTGLAEQMNGEELVNTGNLVQSGREVYKWAVNTVPAGMKAVLEKAAMKRNEIDWFVPHSANLRMIESICDKSGIPLEQTLYSLVQYGNTSSATIPLALDIGVREGKLKHGDNVLLYGFGGGLAHAGLILRWTVPTEKN

SEQ ID NO: 17145 - protein, 326 aa, Bacillus halodurans
MKTVKFPAQMTEKKLVDLFKQMWLIRYFEEKVDEFFAKGMIHGTTHLAVGQEASAVGSIAVLEERDKLTSTHRGHGHCIAKGADVNRMMAELFGRETGYCKGKGGSMHIADVERGNLGANGIVGGGFSIATGAALTSKMKKEGYVVLCFFGDGASNEGSFHEAVNLASIWKLPVVFICENNQYGMSGSVKEMINIEHISDRAAGYGIPGMVVDGNDVFAVMNVVGRAVDRARRGEGPTIVEAKTYRWKGHSKSDAKKYRTREEEKEWREKDPIARLRATLVKEGIVTEEEADSIQEEAKQKIEDSVQFARNSPEPEIESLLEDVYA

SEQ ID NO: 17146 - protein, 327 aa, Bacillus halodurans
MREITYLEAIREAMTLEMRKNEDVFILGEDIGVYGGAFGVTRGMIEEFGSERVRNTPISEAAISGTAIGAALTGMRPILELQFSDFITIAMDNMVNQAAKLRYMYGGKAKVPMVLRTPAGSGTGAAAQHSQSLEAWMTHIPGLKVVQPATAYDAKGLLKAAIDDNNPVIFYEHKLCYRTKCHVPEEEYSIPLGKADVKRKGTDVTVVATAVMVHKALEAAVELEKEGISVEVIDPRTLVPLDEETIIRSVKKTSRLIVVHEAVKRGGFGGEIASIIAESEAFDYLDAPIKRLGGKPVPIPYNPTLERAAIPQVPDIIEAVKETLNWS

SEQ ID NO: 17147 - protein, 436 aa, Bacillus halodurans
MAKEIFMPKLSSTMQEGTLLQWFKEEGDRVEVGEPLFEIMTDKINIEVEAYEEGTLLKRYYGEDDEIPVNHVIGYIGTPDESVPTEPPGASEITASSTDEAGDHRTTAVKKAPSSDRENVRATPAARRIAKEKRIDLRQVEGSGPEGRVQAVDVATFKKKGQKATPLAKKVAEVKGVALEKVQGSGPYGKVYREDVEHAQAASPVEDKGNRVKLSGLRKVVAKRMVDSAFSAPHVTITTEIDMSSTIKIRSQLLGMIEQETGYRLSYTEIVMKAVAHALMSHPTINASFFENEIVYHEDVHIGLAVAVEGGLVVPVVKHVDKKGLAQLTNECKTVAMAARDNRLSQEMMSGGTFTISNLGMYAIDVFTPVINQPESAILGVGRIQEKPVGIDGQIELRPMMTASLSFDHRVIDGAPAAAFLTDVKSMLEQPFQLLM

SEQ ID NO: 17148 - protein, 462 aa, Bacillus halodurans
MKSYDIVVIGGGPGGYVAAIKAAKLGKKVALVEAKDLGGTCLNRGCIPSKTLLHQGEIIEKIKQAKEWGIETGAVTLSLPKMLARKNEIIQKLRAGIHFLLKQGKIDVYFGYGEIERDRSVKIKMKETAEIVSVRTENMIVATGTEPTIPPVPGLAEAVVDTSDTIFELDSIPQSIVIIGGGVIGVEIACIFSSLQVDVTIVEMGKRILPQEDEEAAKVLAKALAAKGVHLLTNTKVTAVLQGDKQKVEIETSTGDRDWLEGERILLAVGRTPNLSVVKELGLGMAGPFLKVDDQMRTSDPSIYAIGDVIGGWQLAHVASAEGLVAAANASGKVEIINRQVIPRCIYTQPEIASVGLTEQEAKEKGYSYKVVKVDLRANGKAMALGETTGFVKMIADPNYGEILGVTMVGPHVTEMIGEPAAFIHLEGTVDELKAMIHPHPTVSEALYEAAASWLGQGVHQP

SEQ ID NO: 17149 - protein, 451 aa, Bacillus halodurans
MTSNDLLAKSKKHLWLPFTQMSDYEKDPLIIESGNGVYLKDIEGNTYLDGYSSLWLNVHGHRKKEIDEAIEKQLQLIAHSTLLGAANIPSIQLAEKLVELAPEAITRVFYSDSGAEAVEIAVKMAYQYWQNRGYENKKSFVTLSNGYHGDTVGTMSVGSIELYHKVYTSLLFDAIVIPFPASKEEQTESDLCRESLKQLRELFEAKHEEIAGITVEALIQGAGGMNLMPKGYLKGVEQLCKEFHILLIVDEVATGFGRTGKMFAVEHENVQPDIMTVAKGITGGYLPIAATLTQEHIYEAFYGEYTDLKTFFHGHSYTGNQLGCAAALANLEIFEKENIIQQVEEKALFLEEQLKHVAELEFVGAVRQLGLMCGIQLVQHKRTSEPFPWEQRVAYRSTLKMRALGMLTRPLGDVIVLMPPLAATNDQLKQMVDIMKEGIMEAATECLEQQV

SEQ ID NO: 17150 - protein, 1039 aa, Bacillus halodurans
MFYQLEKLQNRINELASYRYRDVKPLDSFYMYEPEQGKESVVPTHYPKQTFHVNDTWSGRNKYVWLNTSLHLPEAWSDKRCVLFLDVGRTGGGNNSGFEALLFVNKQPFQGVDSNHQEVLLPKEGGNRLEIDVMMWSGLEGGGTPRTQYYRFKQAWYGWLDQKVDAFYFQAKAILEAIGQLDVHDATRVAMLSRLNQAFASINWTQPGNEQFYDSVYEALERLERDMEHLPKHSDVHIHAIGHSHIDLAWLWQTKHTKEKAKRTFSTVLRLMDLYPDYVYLQSQPQLYQWMKEEEPKLYEAIKQKVDDGQWEVEGGMWVEADCNIPSGESLVRQLLYGKRFFKKEFHKESKILWLPDVFGYSWALPQILKKSGIDTFMTTKISWNQYNRMPNDTFYWRGLDGTEILTHFITTPEPGRPKDSWFYTYNGLMSAETIKGTWEKYRDKAVNQDLLLAYGYGDGGGGVNREMLEMKRQLDQVPGVPHVKSTHVKEYFHQLHENVANTAEYVHTWDGELYLEYHRGTYTSQAKMKKKNRQLEFSYRDAEILAVTASAEKGWDAYPGSSLEKGWKLLLLNQFHDIIPGSSIKEVYEDAAKDYTEAAAIQKQVVTTQEKRMVNDKREKWTFFHPYQYDTPILVTIPKGTDERFVDQTGHGLSSQQTANNETLVLLEKSIPFAYQTISRATMVAEEVQMLSQVNFEERRWETPWYQLEWNDEGQFIRMYDKLGKREWLAQGKLGNVFKRFEDKPLAHDAWDIDLFYQEKSSTVSSFQGCELIENGPLRTTVLFRWKEDGVVIKQAIRCYRHTARIDFATEVDWQARQQLLKVEFPVDIRTNEAIYDIQFGNLKRPTHWNTSWDMARFETVGHKWAAIAEADYGISLLNDSKYGYSIKDNVLSLSLLKGAIYPDPEADIGNHQFTYALYPFQGPAFKRDVEREATYLQSAIIAVPGEAEMPFDQPLFTVSSDQVIVDAIKKSEDGTSVIIRLHEMEGARATVKLDCRYEAKQWREVNLIESEALSEWSTRPVELTFTPYEIKTIELTL

SEQ ID NO: 17151 - protein, 393 aa, Bacillus halodurans
MKRDQHFETRAIHTGYKPNEHFDSLTPPIYQTSTFTFASMEQGGNRFAGEEAGYVYSRLGNPTVQILEQRIAELEGGEAALAFGSGMAAVSAILVGLTKANDHILVSNGVYGCTFGLLTMLKEKYNIDATFSPMDSVEEILANIQDNTTCIYVETPINPTMQLIDLELVVRVAKEKGIKVIVDNTFATPYLQQPIALGCDFVVHSATKYIGGHGDVVAGVLIGDKETIQLIRKTTQKDMGGVISPFDAWLLLRGLKTLAVRMDRHCENAEKLAEKLKEHPKVSTVLYPGDFEHPDHSIVAKQMKKGGGLLSFEIKGTEADIAKVVNQLKLIRIAVSLGDAETLIQHPATMTHAVVPEKRRTQMGISKKLLRMSAGLEAWQDVWADLEQALNQL

SEQ ID NO: 17152 - protein, 299 aa, Bacillus halodurans
MYPKHEPIDTHQKCDDIPVHFPPQSQPWHPGLEYLMEPRPISENPHRPHSHKLLDRVAIITGGDSGIGRAVAYAFAKEGADLVISYLSEHEDAIETKKRVEEIGRDCLLVPGDLQHEQMSVKVVEKTIERFGKLDVLVNNHAVQFRQTSLLDITEEQLDITFRTNIYAYFFMTKAALPHLKKGSAIINTTSVTSYLGHSQLIDYAATKGAVTTFTRALSGSLADQEIRVNGVAPGPIWTPLIPSSYPAHSIPTFGSDTPLSRPGQPFEVAPSFVFLASDDSKYLTGQILHPNGGRVTGS

SEQ ID NO: 17153 - protein, 210 aa, Bacillus halodurans
MAVLGATGAGKSTLLQLILRLYDPTAGAIRIDGKDVQDIGISRLRQEIGYVPQEVLLFSGSVRDNLAFGKEDATQEDIKQAAKAAQIHETIMAMPNQLDTKIGQKGINLSGGQKQRMSIARALVRKPAILLFDDCTSALDVKTESELLRELASYQSTVLIVTQKLSTAIEADAILLLEDGKVAAHGQHEELLRTSSLYQRLYESQYGKRA

SEQ ID NO: 17154 - protein, 611 aa, Bacillus halodurans
MANPLTEPFRYRKIPINETEGSEKKKVRPAQASKTLRRIWTYLVNYRGRLLLVFLAVLLSSVLGLLGPFVIGMAIDHYLVEGDTSSLFKVMIGLLAIYAVYSLSMWLQQVWMIGIAQQTVYSIRSDLFHHFHRLPIPFFDKKQHGELMSRMTNDIENISNTLNSSVIKIFSSVLTLVGIMIVMLWLSPLMTVITMTVVPLMVFGLKWITRRTAVFFKQQQKALGDLNGYIEETVSGQSVIQAFSREGAAIATFSEKNRELKTTSFWAQTYTGFIPKVMNVLNSLNFAVIAGVGGILAMRGSITIGIIVIFAEYARQFTRPLNDLANQFNMLLAAIAGAERVFDILDEQEERHHDQTKQVKSIKGEVSFEQVSFSYEQKTTLNNLSFHVNPGETVALIGPTGAGKTTIIRLLSRFYEWDGGAIYVDGEDVTTWDRESYRRHLAFVLQESFLFQGTIRENIRYGRLEATDEEVEAAAKMANAHSFIMRLPDQYDTVLDSDGSGISQGQKQLLSIARAMIANPSILILDEATSNIDTITELNIQEALHRLMNGRTSFVIAHRLNTIQHADVILVLEKGTLVEQGSHEELMAKKGVYYDMIDRGQQTLAEGEVIR

SEQ ID NO: 17155 - protein, 464 aa, Bacillus halodurans
MDRKETAKLMENVMTELSEKEGFLGIEDDEKRKRIVLSAQEILTTTDKIIKSYIRVSTEHGIMRIPAYRVQHNNISGFYKGGIRFSEFVSEEEVENLAILMTLKNALHRLPFGGAKGGVHVDPRKYSEKELNLISKKYVQRFARDLGPNHDIPAPDLGTNEQVIDWMVGEFKTIHPGQAYLGSFTGKSVENGGARGRREATGKGTFLSYIWLLSQWYDEHVSGNGINRTKQWETISNLKQQADNSDPIRVAVQGFGNVGSVAALEAYQCSEIAHRVVAVSDRYTTLYNEKGLDVRALAAYTIGGKDLPKNSEELAAAGVEASVLPVDAVLTCETDVLILAAIENQIHERNMKQVNARVLVEGANAPISTEADDYFEAAGTVVIPDILANAGGVIVSYLEWKQSRITELYSEDDILDEMGTQMKETLKSVYERYFSSVGHTLRFTCFTLALERLTSLLYKHGKLY

SEQ ID NO: 17156 - protein, 306 aa, Bacillus halodurans
MIYTVTLNPSIDYIVQVENFQQGVVNRSERDRKQPGGKGINVSRVLKRLGHETKALGFLGGFTGAYVRNALEKEEIGLSFIEVEGDTRINVKIKGKQETELNGTAPLIKKEHVQALLEQLTELEKGDVLVLAGSVPQAMPQTIYRSMTQIAKERGAFVAVDTSGEALHEVLAAKPSFIKPNHHELSELVSKPIASIEDAIPHVQRLIGEGIESILVSFAGDGALFASAEGMFHVNVPSGEVRNSVGAGDSVVAGFLAALQEGKSLEDAVPFAVAAGSATAFSDGFCTREEVERLQQQLQRTIKKEG

SEQ ID NO: 17157 - protein, 452 aa, Bacillus halodurans
MKEKVQMQRRYFHTNETKELSFRMNMLKKLKKALLDYENELLAALKEDLNKSTSEAFLTELGPLYHEITFMLKHLPTWMKRKKVKTPLTHVGSKGYIHYEPYGVVLIIAPWNYPLQLAINPLIGAIAAGNCAIVKPSELTPATSGVITKMIENTFPEEYVCSVEGGVETSQALLAEKMDYIFFTGSVGVGKHVMKAASRHLTPVTLELGGKSPAIVCEDAQIAVTAKRIAWGKFLNAGQTCVAPDYVLVHDSKKEDFLKALQTEIKTLFQRKIDRGDYPTIVSDRHFARLIRFLQDGDVVIGGQHERNKRFIAPTVLTNVSWESPVMEDEIFGPILPVFSFSELDEVIEKVRERPHPLALYLFTESKETEEKLIHSLSFGGGCINDTVMHLATPYLPFGGVGESGMGAYHGEESFYTFSHRKSVLKQPTSVDLPIRYKESKLSLKMLRKLFQ

SEQ ID NO: 17158 - protein, 559 aa, Bacillus halodurans
MYQEWWRKAVVYQIYPKSFNDTTGNGVGDLEGIIQKLDYLKTLGVDVIWLTPIYASPQKDNGYDISDYYSIHPEYGTMEDFERLLTEVHDRKMKVIMDIVVNHTSTEHEWFKQSAQSKDNPYRDFYIWKDPVYGLEPNNWQSKFGGSAWKFDSKTDQYYLHLFDVSQADLNWENEEVRNRVYEMMDFWFTKGVDGFRLDVINLISKDQAFPNDDGSVPPGDGRRFYTDGPRAHEFMNEMNRKVFSKYDAMTVGEMSSTTLEHCIQYTRPENKELSMTFNFHHLKVDYPNGEKWAIGDMDFFALKEILSKWQVGMHKGGGWNALFWCNHDQPRVVSRYGNDGKYHEKSAKMLATTIHMMQGTPYIYQGEEFGMTDPKFDRIDQYRDVETLNYYDILKEQGLSEEEVMEIIKRKSRDNSRTPVQWDDSPHAGFTSGTPWIDVASNYRSINAKKALADKQSIFYHYKKLIELRKTYDIVTYGDYELLLPEDPRVFAYVRRYQDETLLVVNHFFAGEVTIQVPEDVTAEKHQVDVLLANYHDPSREFQQLVLRPYESVVYYMK

SEQ ID NO: 17159 - protein, 267 aa, Bacillus halodurans
MKQHHMLIIGAGRMAEAIFSGILKREENPFQITVSNDKDVARLEKLKKTYPVKTTTDWTAVVETADVILLACPPAAHENVLKKLSPICNGQLVITVAAGIGPTDLETHLPKGTPTAWIMPNTAASVGESMSIYCFGQHVKERDKQLISFILDAIGMSEQLTESQIHHLTAITGSAPAFLYFLAEALEQSAQSYGVAPEKARELVIGMITGSAKMLEEYKDPTQLREQVTTPGGATAAGLQSLLHDDFQGALQRAVQATNGRAQERAN

SEQ ID NO: 17160 - protein, 735 aa, Bacillus halodurans
MDTNNTGKCPFHHGATTSPKSSGTTNNDWWPNALNLNILRQHDKKSNPMGEEFDYAEEFSKLDYDALKQDVRDLMRDSQDWWPADFGHYGPFFIRMSWHAAGTYRIGDGRGGGGTGNQRFAPLNSWPDNGNLDKARRLLWPIKQKYGNKISWADLLVLAGNVAIEDMGGPVIGFGAGREDIWHPEEDIYWGSEKEWLTGDKRYSGDRELENPLAAVEMGLIYVNPEGPDGKPDPIKAAHDIRETFGRMGMNDEETVALIAGGHTFGKAHGAGNPDHVGPEPEAAPIEAQGLGWQNTYGSGKGRDTITSGLEGAWTANPTQWDNGFFDLLFGYEWWLTKSPAGAYQWQAVDPDEKDLAPDAEDPSVKVPTVMLTTDLALRHDPEYEKISRRFHKNPDEFADAFARAWFKLLHRDMGPKARYLGPEVPAEDFIWQDPVPTVDYELTDAEVEELKAKILDSGLTVSELVTTAWASASTFRNSDKRGGANGARIRLAPQKDWEVNQPEQLEKVLSVLENIQSQLDKKVSIADLIVLGGSAAVEKAAKEAGFDVTVPFAPGRGDATQEQTDVEGFAVLEPVSDGFRNYQKKEYSVSPEELLIDKAQLLDLTAPEMTALIGGMRALGANYGGTQHGVFTDCVGTLTNDFFVNLLDMGIEWKPVDYNLYEGRDRKTGEVVRTATRVDLVFGSNSILRAIAEVYAQDDNKGKFVEDFIAAWVKVMNADRFDLKLNKKAQLTSK

SEQ ID NO: 17161 - protein, 441 aa, Bacillus halodurans
MSLKVVVIGGGSSYTPEIIEGLITRYDQIPVREIVLVDIEAGAKKVAIIEALSRRMIENSGYPIHVHSSFDLRASLEGANFVTTQIRVGGLEAREKDERIPLKHGLIGQETNGAGGVFKAFRTIPVLLEIAQAIHDICPQAWMINFTNPAGIVTEALLHHSPHKKVVGVCNIPFNMRTGIAEMFSCPVEQVEIEFIGMNHFVFGKRVFIHGEDRTTEALAKLTEDKVDYSPANIVSLGWSKAFVTALQLLPNPYHLYYFQTEEVLKKDLDAFRNNGTRAEIVKQVEDSLFLTYQNPSLSEKPKELEQRGGAYYSEAACNLMESLYTNKQDIQTVNTLNNGSIRDLPDDAVVEINAVITKDGPRPLAIGKIPPHIKGLIGHMKTFEQLVIKAALSGDYYDAYNALIMNPLVADEKKAKIVLDELLDAHKEHLPQFYRKGAVI

SEQ ID NO: 17162 - protein, 599 aa, Bacillus halodurans
MRFRKRMGKLLIWIVTVLLVVTWMPADQVVGAAETSDDQYKIVAYYPSWGAYGRDYQVWDIDASKISHINYAFANICWDGRHGNPDPAGPNPQTWSCQDENGVIDVPNGSIVMGDPWIDAQKSNPGDTWDEPLRGNFKQLNKLKEEHPHLKTLISVGGWTWSNRFSDMAATKETRENFANSAVEFIRKYGFDGVDVDWEYPVSGGLPGNSRRPEDKENHVLLLQEVRDKLDEAGQEDGKDYLLTIASGASPGYVENNKLNEIAEIVDWINIMTYDFNGGWQNISGHNAPLYYDPATANTELPTPEHFNVESAVEGHLQAGVPEHKLVLGMPFYGRGWSNCDGANQGEYQRCAPPREGTWENGVFDFSDLEDHYINKNGYQRYWNDVAKVPFLYNATNGNFITYDDEESFRYKTDFIKSNNLAGSMFWDVSGDRNGTLLTALADQLGFTPHEGQEPEEPSSAPTNIQATEVTSTTVTLTWQAPTEEPTQYSVAYDSKEKTTTHTTITIEDLQPETTYTFVVSAEHKDGIRHAGQALQVTTKSETGGDGCTAPTWQANNVYTGGDQVQHGGKLYEAKWWTTGEEPGTTGEWGVWKLIGDCE

SEQ ID NO: 17163 - protein, 427 aa, Bacillus halodurans
MSQTDMNVFEQLESEVRSYCRSFPTVFTKAKGYKMWDEAGKEYIDFFSGAGALNYGHNDEKMKKALVDYIMDDGITHSLDMATTPKGKFLQKFHDVILKPRNLDYKVMFPGPTGTNTVESALKLARKVTGRTDIISFTNGFHGMTIGSLSVTGNSFKRKGAGIPLTNVVTMPYDNFVSESLDTLDYLERFLEDGGSGVEIPAAMILETVQGEGGINAARTEWLQRVEKICKRWGILLIIDDVQAGVGRTGTFFSFEDAGITPDIVCLSKSIGGFGLPLAITLFRPELDIWAPGEHNGTFRGNNHAFVTATEALSYWEDDSFEKDIQEKSATISDFLVKLVTEYPEIKGEVKGKGFMVGIASDVEGFASKVTEEAFSRGLIMETSGPNDEVFKLFPPLTIDDEGLEKGLAIIEESIKALVETKELVMQ

SEQ ID NO: 17164 - protein, 252 aa, Bacillus halodurans
MDLQLKDKVVLVTGGSKGIGKGIAQAFVEEGAKVAIVARDAHGLQEAKRQLGNVLTIQADVTDKNEREKVFSQLLETYGTIDILVNNAGGSNGGLISETELSLFEEAFSLNYFSAVHFSQLALPVMKAKQSGAIINISSIFGRESGGKATYNSAKAAMISFTKSLADEVIRDGIRVNGIAPGSILHPTGNWQKRLEENREKMEQFIDQNIPAGRFGTVEEIANVAVFLASEKASWVVGATLNVDGGQSYSNF

SEQ ID NO: 17165 - protein, 249 aa, Bacillus halodurans
MERKVALVTGSSRGIGKEIALRLADRGYDLVINYARSRKAAEETAAEIEQKGVKALIVKANVGKRDKIEELFAQIDDTYGRLDVFVNNAASGVLRPLMELEESHWDWTMDINSKALLFCAQEAAKRMEKNGGGKIVSLSSLGAIRYLKNYTTVGVSKAAVEALTRYLAVELAPKNIVVNAVSGGAVDTDALTHFPNRDELLEDAAKRTPAGKIVEPSDLANAVLFLLSEEASMIRGQTLIVDGGISLLT

SEQ ID NO: 17166 - protein, 584 aa, Bacillus halodurans
MVTLESIRRYLLFVRPYWKQIFITIIIGLLKFGIPLLIPLLVAYIIDGIIFAEQMTNEEKFSALFTVMGGIFFIFIVLRPPIEYYRQYFAQWIGNKILYDIRDHLFTHIQKLSLRFYSNRKVGEIISRVIHDVEQTKTFVMTGLMNIWLDMFTIIIALAIMFSMNAWLTLVAIAMFPFYGFSIKYFYAKLRHLTRVRSQALADVQGHLHERVQGMSVIRSFALEDYEQTQFAKRNGTFLNRAIDHTKWNAKTFAVVNTVTDIAPLLVIFVAACFVINGELEVGAMTAFVLYMERLYNPLRRLVNSSTTLTQSIASMDRVFEFIDEKYDIVDKEGAVKLEEVHGDVTFDHVSFSYEKEETPALKDVHFHVKRGETVAFVGMSGGGKSTLISLIPRFYDVSSGRILIDGHDIRDYQVRSLRDQIGMVLQENILFSDSVRMNILMGKPDATEEEVIAAAKAANAHDFIMNLPNGYDTEVGERGVKLSGGQKQRVAIARVFLKNPPILIFDEATSALDLESEHYIQEAMEKLAKNRTTFIVAHRLSTITHADRIIVVENGEIVESGTHDELMSCNGVYKKLFEVQNLD

SEQ ID NO: 17167 - protein, 437 aa, Bacillus halodurans
MNRSRSESLFQKAQSLIVGGVNSPSRSFKAVGGGAPVFMEKAKGAYFWDVDGNQYIDYLAAYGPIITGHAHPHITNAIQRAAENGVLYGTPTKLENQFASMLQQAIPSLEKVRFVNSGTEAVMTTIRVARAYTGRDKIIKFAGCYHGHSDLVLVAAGSGPSTLGTPDSAGVTKNIAEEVITVPFNQLDSLKEALDHWGEEVAAVLVEPIVGNFGIVEPHEGFLEGVNELAHNAGALVIYDEVITAFRFMYEGAQNYVGVEPDMTALGKIIGGGLPIGAYGGRIDIMEKVAPLGPAYQAGTMAGNPASMSAGIACLEVLQEEGLYDELDRKGAILEKGIKAHAEAHGITISINRLKGALTVYFTDETVTCYEQAERSDGEKFSLFFKEMLNQGINLAPSKYEAWFLTIAHTDEDIEKTLQAVDHAFSVMAAKGYHLKR

SEQ ID NO: 17168 - protein, 443 aa, Bacillus halodurans
MSQSIQTQEEDLKSLLTRRERIVPRGVVNNIQTFAKEAKGAIVIDVEGKSYIDFAGAIGTINVGHSHPKVVQAVQQQADQFIHTGFNVMMYESYIELAERLAALAPGSFEKKVLLQNSGAEAVENAVKMARKYTGRQGIVSFSRGFHGRTLMTMTMTSKVKPYKFGFGPFAPEVYKAPYPYEYRRPEGMSEDAYHAYVLQEFIQFMNVEVAPESVAAVVMEPVQGEGGFIVPSKSFVQGVYRYCKEHGILFIADEIQTGFARTGHYFASEHFEIEPDLLTVSKSLGAGVPISGVIGRREVLDEASPGELGGTYSGSPLGCAAALAVLDIIEEEGLNERARKLGQVVMDKMAQLQEQYECIGHIRGLGAMCAMEVVKDRHTKEPDKELTAKIVSEAGNRGLLLLSAGQYGNVLRFLMPIVITDEQLNNGFAILEEALATAIVNR

SEQ ID NO: 17169 - protein, 468 aa, Bacillus halodurans
MDLYINGEWMRSGKTLDVTNPATGEVIDTVPFAGKKEAELAVSAAYEAFPQWSSQTASERSRYLMRWFQLIDEQQDEIGEIMTKEQGKPLREAIGEVQYANSFIQWYAEEAKRIYGDTIPASAINKRILVQKQPVGVIAAITPWNFPAAMITRKVAPALAAGCTAIVKPAEQTPLTALKLAQLAEEAGIPAGVLNVITGNAQDIGEAWLEDSRVRKITFTGSTEVGKLLMRGAAQTVKKISLELGGHAPFIIMDDANLEEAVDQVIASKFRNAGQTCVCANRIYVAREIAEAFTEKFAAKVNELKVGNGLEEGVTIGPLIDKAAVEKVEAHIHDALKKGGQVTVGGRWTNHFFEPTIITGATDEMLCMNEETFGPLAPVATFDTEEEVIERANHTPYGLAAYVFTENIGRAIRLSEKLEYGIVGVNDGMPSVAQAPFGGWKESGLGREGGKYGIEEYLEVKYVSVAFK

SEQ ID NO: 17170 - protein, 305 aa, Bacillus halodurans
MEIVKATNVTKRFGAFTALNRINLEVQRGEIYGFIGPNGAGKSTTIRILLGILKASEGEAKIFGKDVWSDAVEIHKHLAYVPGDVSLWPNLTGGEVIDLFMKLRGSVDKKRRDHFIERFKLDPSKKCRTYSKGNRQKVALVAAFASGADLYILDEPTSGLDPLMERVFQECVLEAKEAGKSVLLSSHILSEVERLCDKVGIIRQGEMIETGTLDELRHLTRTTLVVKTKQPIPALQEQKGVHDLAEKNGGFSFQVDAESLDEVMKYVSQYGLITLESAPPTLEDLFMRHYEGAGQSPTSQAGGEG

SEQ ID NO: 17171 - protein, 485 aa, Bacillus halodurans
MFNIQDLNKQYIDGEWRDGKSPRVLRDRNPYNQEVLAEFQIATDSDVDAAYHAALKAQNEWATVNPYRKREILERAVTYIEEHEEEIVAIIIDELGGTRLKAAFEIGLVKNMIKEASTFPLRMEGKILPSTENGKENRLYRVPAGVVGVISPFNFPFFLSVKSVAPALGAGNGVVLKPHEETPITGGTLIAKIFEEAGVPKGLLNVVVTEIDEIGNAFVEHPIPRIISFTGSTNVGSHIGQLAVKHFKKPLLELGGNSAFLIFADADLDYAVQAATFSRFTHQGQICMSANRIFVQRDVYDEFVERYVTKVASLKVGDPRDPETVIGPVMNSRQAETLKQAIESGIAAGAKPVLHGAISGNMVEPTILIDASPEMAIAQEELFGPVVCVIPFDTEEEAVEMANDTKYGLSGAIHTANVERGVEIAKRIQTGMIHVNDITINDEPIVAFGGEKHSGLGRLNGEWSLEEFTTLKWVSVHYSQRVFPY

SEQ ID NO: 17172 - protein, 625 aa, Bacillus halodurans
MERKEFKAESKRLLEMMVNSIYSQKEIFLRELISNASDAIDKIYYRALSDDSITFNKDDYFIKVTANKEDRTLTVSDTGIGMTKEELESNLGTIAKSGSLAFKTENESKDGHDIIGQFGVGFYSAFMVADKVTVTTKALGEESGYQWESTGADGYTILPIAKESVGTEIRLKLKENSEDESYDEFLEEYRLTSIIKKYSDFIRYPIKMDVTKRELKEGTEDEYEDVIEEQTINSMVPIWRKNKNELKDEDYTNFYHEKRYGFDQPLKHIHISVDGAVRYNAILFIPENIPFDYYTKEFEKGLELYSNGVLIMEKCPDLLPDYYSFVKGMVDSEDLSLNISREMLQHDRQLKLIAKNIKNKITSHLKTLLKDEREKFEQFYRSFGRQLKYGVYSDFGANKEDLQDLLLFYSSTEKKMVTLDEYVSRMKEDQPYIYYATGESYARIEKLPQTEMVADKGYEILYFTEDVDEFAIKMLASYKEKEFRSVSSGDLGFEDDEQKDTAADTDEQKELFEHMKTILDGKVKDVRASKRLKSHPVCLTAEGEVSIEMEKVLRAMPDNQNVQAEKVLEINVNHDVFDVLKASFESDKDKVDLYTKLLYNQALLIEGLPVEDPVAFSNDICKVMA

SEQ ID NO: 17173 - protein, 175 aa, Bacillus halodurans
MAEQSLLYDEMESPIGCLSIVSTDQGVCTILFGSLESNQVTLNVWLKKHRLPCQLLKDEEAIRPVIAQLLEYFDGKRHSFDVPLDLYGTPFQKRVWQALQTISYGETRSYKEIAQHIGAPKAVRAIGGANNQNPIPIIIPCHRVIGSNGAMVGYGGGLEKKEWLLSIEGAYEKIS

SEQ ID NO: 17174 - protein, 434 aa, Bacillus halodurans
MKKNDETSRNLIGLDQQHFIHPTSSMQQQQQHGPAHIFVRGKGVYLYDHDGKAYLDGMSSLWNVNVGHGRRELGEVAKKQMDTLAFSSCFATFSNKPAIELAAKLARVSPPSLRATFFTSGGSEANDTAFKLARHYWKVKDQPKKRKIIARMKSYHGVAMGATSATGLKPFRDFAPSLAPDFLHVDHMSIEALRALIDREGPETIAAFVCEPIQGAGGVHVAPDSYLCDIRSICDEYELLFIADEVITGFGRTGAYFGCDHANISPDMMCIAKGITSGYAPLGGVMLSKSLHEQLTAHSHGTLLHGYTYSGHPTSCAVALKNIQIIEEENLIDHAATMGEKLLLGFRTIQEQYSEIHDARGRGLMAALAFSHNGKNEPLAPKVVQAADQRGLILRAVTFDQQDVLVCAPPLIINEEELNQLLSILESSVQAVVS

SEQ ID NO: 17175 - protein, 395 aa, Bacillus halodurans
MKTFEQAKMMKRLPEQFFAKLVEQVQEVKKDHDDIINLGQGSPDLPTPEHIVEKLQEAAENPLYHRYAPFSGYPFLKEAVSKYYEREYGVSVDPKTEVAVLGGAKTGLVEVSQCFLNPGDMALVPDPGYPDYWSGIAIAGGSMYGMPLKKELGFHPDLRGIPAPVLYEAKLMFLNYPNNPTGAVATEELFAEAIELAEEYDICVVHDFAYSAIGFDGQKPLSFLQVEGAKNVGIEMITLSKNYNMAGWRIGFAVGNPSVIKAIETLQDHYFCSLFGGIQAAAAHALLSDQSNVTTLVQTYEERRNALVKAARAIGWDVEAPKGSFFAWFPVPSGFTSEEFATYLLKKARVVVAPGKGFGEHGEGYVRVALLADIAKLEEAMGRVGKLDVFSNKRG

SEQ ID NO: 17176 - protein, 281 aa, Bacillus halodurans
MLPINENLKGKVAVITGGSGVLCRAMAYELGRQGVKVAILNRNRDTGNEVAETIREAGGDALAISCDVLEVDQVKAAEKQIRKEFGACDILINGAGGNHPDGTTDEEIVRMENVAKKTKTFFDLTVEGFQRVFELNLISAMVSSQVFAKGMTHRKGAVIINMSSMSGPTPMTKVPAYSAAKAGIDNFTKWLAVHMVEVGIRVNAIAPGFFLTDQNKKLLLQDDGSWTERSKKILSHTPMRRFGKPEDLLGTVIWLADETMSGFVTGVTVPVDGGFMAYSGV

SEQ ID NO: 17177 - protein, 353 aa, Bacillus halodurans
MKKITLSVIPGDGVGKEIMPHALRVLDAVAEVHGGLTFEKVEYPWSCEYYLEHGEMMPEDGLVQLTESDAVFLGAVGNPQLVPDHVSLWGLLIAIRRGFQQSLNIRHAKQIRGIDPPIKHANQFDLLVVRENSEGEYSEVGGRIHQGDDEVVVQNAIFTKKATKRAIDYAFQLAATRGKRVTSATKSNGIVFSMPFWDNVFQEVGKQYPDIEQQSVHIDALTAFLVTKPAEFDVIVASNLFGDILTDVSAAIMGSIGIGPAANLNVEGTYPSMFEPVHGSAPDIVGKGMANPIGQIWTGKMMLDHFGEEELGKTLLDIVEDVTEAGIKTPDIGGRATTGEVADAIIERVKSLT

SEQ ID NO: 17178 - protein, 815 aa, Bacillus halodurans
MSLSVQEFRQQFSDKLMTTFGKKVEKATPFEAFQTVGLILRELLNRKWQDTKGTYRSNSQKQVYYFSMEFLLGRLMITNLLNSGLLETCKQGLEELGFNLEEVLGQEQDPGLGNGDLGRLAACFLDSLASLELPGHGCGIRYKYGLFQQKIVDGNQVELPDYWLKNEYVWETKRLDQTVEVHFGGEIETVEESGRLTFKHHHYEKVLAVPYDIPVSGYQNHTVNTLRLWSAESTTNDFHFYSIDRKDYYHYLDYKRSVEQISEFLYPDDSSYEGRLLRLKQQYFLVSAGLQCILREFKNSYPSVDLLPEKIAIQINDTHPSLVIPELMRLLLDQEQLSWEKAWELTTRTVAYTNHTTMSEALETWPVDMVKTLLPRIYMIIHEINERFCRHLWLAHPTLRDEIKHMAIISYGQIHMAHLAIVGSYSVNGVAKLHTDILKNSVMKPFYTVFPEKFNNKTNGITHRRWLLMANPPLASLITEAIGETWVREPKQLITLLKYAGDAAFQEKIAGVKQANKTALAKYIQERTGIRVDDRSIFDVHIKRLHGYKRQLLNVFHILHLYEMIRDNPNMDMVPRTFIFGAKAAPGYHFAKKVIKLITTTAAKIAADPIVREKIRVVFLENYNVSLAEQIIPATDVSEQISTASKEASGTGNMKFMLNGAITIGTLDGANVEIREMVGPDNIFTFGLTAEDVLAYQLSRMYRSRDVYNGDQRIRRVMDQLVNGSLSNDDVEFKDIYYTLLSNNDEYFVLKDFDSYVEAQDLLEQAYRQPTEWLKKSITNIAHSGKFSSDRTISEYASEIWDIHPVTISSTTQSR

SEQ ID NO: 17179 - protein, 476 aa, Bacillus halodurans
MNVLHVASECNPFFKTGGLADVLGSLPKALIKQGINVSVILPKYGHLSDEWQNQLTLKKSFTVSVTWRNQYCGLEQFVDQGVTYYFIDNEYYFKRERLYGYLDEAERFTFFNHAVLSSLPFLDESPDLIHCHDWQSGLIPAYMKTGSVENPVPTVFTIHNLRYQGAFPPDVFRELLHFAPEHFAGLEMDGAINFLKGALVHSDRVTTVSPTYAQEIQTPAFGEGLHGLLHQERGKTRGILNGIDLEDFDPKTDPHVTYPYKHNQMEKRKNKQVIQRLFELPERKDIPLIAMVSRLVEEKGVPLLTQIAGELVTTENVQLAILGTGDPSLEDQLHHLASLHPHQISFKCVFAEPLARKLYAGADLFIMPSRFEPCGLSQMISLRYETVPIVRETGGLYDTIQSYNEEIGEGNGFSFTHYNAHDFLYTIKRALRFYRTEKEWENLLLNIYSSEVGWDVSAKQYTALYEEILGKRKVEA

SEQ ID NO: 17180 - protein, 368 aa, Bacillus halodurans
MKSLMGVVNLDHDQDLLHELTYFRSVAGVPFGGRYRMIDFVLSNMVNSGIQDIAVFARNKYRSLMDHLGTGAPWDLNRKRGGLFILPPDWNDPTDISKGDLRHFHNHRDFFHRGNADHVLVSGSQFISKVDYEDAFKRHQETKADVTVLYKKVDQLEPEDRYRMKLEFDSFGNVKSITNDEMNSNLYMQMYIIRKELLLELLNHCIGYHKQDLFVDGIMSNLNELAIRAYEYKGYLSIISSVASYYKHSMDLLKPEIYQSLFLAGSPIYTKIKDEPPAKYVNGSEVSNSLVANGCVIEGHVENSILFRGVYVAKGVSIKNSIIMQRCYIHEDTHLDHVILDKDILISPNRQFAGAPEQPFVIAKRKAM

SEQ ID NO: 17181 - protein, 383 aa, Bacillus halodurans
MKKEIVGMLLAGGEGKRLGQLTRKLAKPAVYFGGKYRIIDFPLSNCTNSGIDTVGVLTQYEPLALNGHIGIGSPWDLDRRHGGVTVLPPYIEKQGGSWYKGTADAIYQNRYYIEQYDPEYVLILSGDHIYKMDYDRMISHHKKLGADATISVIEVPWEEASRFGIMNTNEEMTITQFEEKPTTPISNLASMGIYIFNWSVLKSYLIQDAKQANSSHDFGKDIIPKMLAKDLKLVAYPFEGYWKDVGTIKSYWEANMDLLDEHSSLMLNDPSWRIYSVNRNQPPQYISTRAYVRCSLVNEGCVVHGNVEQSILFPGVHIGANSSVFESVLMPNVKVGENVVLRRTIIMEGACIPSGTHLAPSDPDDILVIDKDTEFSPSIAANQ

SEQ ID NO: 17182 - protein, 497 aa, Bacillus halodurans
MTKKYILALDQGTTSSRAILFNEAGEIIGIEQKEFQQIFPKPGWVEHDANEIWASVLSVIAGVLLKTNVEAKEIAAIGITNQRETAVVWEKESGRPIYNALVWQSRQTAGICERLRAEGFSEMVTEKTGLLIDPYFSGTKVRWILDHVDGAQERAERGELLFGTIDTWLIWKLSGGKAHVTDYSNASRTLLYNIYEQCWDDELLKMLNVPRAMLPDVRPSSEVYAETVSYHFFGEEIPIAGAAGDQQAALFGQACFEKGMAKNTYGTGCFMLMNTGNQGVKSKHGLLTTIAWGLDGKVEYALEGSIFVAGSAIQWLRDGLRMMKSAKESEGYATKVTSADGVYVVPAFVGLGTPYWDSDVRGAVFGLTRGTSKEHFIRATLESLAYQTKDVLQAMEADSGISLKTLRVDGGAVANNFLMQFQSDLLGVSVERPTVQETTALGAAYLAGLAVGFWTSKEEITNNWNLEQKFSAEMEETDRAKLYEGWQKAVRAAQAFK

SEQ ID NO: 17183 - protein, 553 aa, Bacillus halodurans
MFSAKKRDKCIGEMSEKQLDLLVIGGGITGAGIALDAQVRGIQTGLVEMNDFASGTSSRSTKLVHGGLRYLKQFEIKLVAEVGKERAIVYENAPHVTTPEWMLLPIFKDGTFGKFSTSLGLKVYDYLADVRKDERRYMLNEKQTLEKEPLLRKENLKGGGIYVEYRTDDARLTLEIMKEAVARGAVALNYMKVESFIYDQGKVVGVVAKDRLTDTTHTIYAKKVVNAAGPWVDTLREKDRSKHGKYLKLSKGVHLVVDQSRFPLRQAVYFDTESDGRMIFAIPREGKTYIGTTDTFYDKDIASPRMTVEDRDYILAAANYMFPSLNLTADDVESSWAGLRPLIHEEGKKASEISRKDEIFFSDSGLISIAGGKLTGYRKMAERTVDAVAQGLNVNEPCTTAAIRLSGGLAEGAQGFPRFLDEASRKGAKLGFDADEVRRLAKLYGSNVDHVLNYAYEGKEEAEHYGLPALLLGQLQYGVEQEMVATPLDFFVRRTGALFFNISLVHQWKEAVLRWMAEEFSWTEEEKTRFQNELETELKMAVDPLFQVEPTTV

SEQ ID NO: 17184 - protein, 578 aa, Bacillus halodurans
MSWRQRYEKWKGFNELELELKQSLEAIGGDEQQLEDCFYKNLEFGTGGMRGEIGPGPNRMNTYTIRKASEGFARYLLEQGEHVKAQGVVIAYDSRHKSPEFAREAALTIGKHGIKAYLFEELRPTPELSFAVRKLGAAGGIVITASHNPPEYNGFKVYGSDGCQLPPEPANRLVKFVNEIEDELVIPVGDERELKENGTLEMIGEEVDVAYHEALKTIIVNPELLEASAKDVRIVFTPLHGTANLPVRRVLEAVGFENVTVVKEQELPDPQFSTVKAPNPEEHAAFALAIEYGKKTEADVLIATDPDADRVGVAVQNQAGEYIVLTGNQTGGLMLHYLLSQKKEKGQLPVNGIALKTIVTSEFGRAIAEDFGIPMVDTLTGFKFIGEKIKEYEQSGEHQFLFGYEESYGYLIGDFVRDKDAVQACLLAAEMTAYYKSRGMTLYDGLLELFDRYGYYREGLTSITLKGKVGVEKIQHVLSQFRQSPPKQVNDQQVVVIEDYQTKEKVSVKERTVEAITLPTSNVLKYMLEDGSWFCLRPSGTEPKLKIYYGVKTEALEKSEAALDAVKRDVEEIVHSYL

SEQ ID NO: 17185 - protein, 395 aa, Bacillus halodurans
MEVAYKEDLLTSFAEAFSIDRLTDVRVFFAPGRVNLIGEHTDYNGGYVFPGALTNGTYMVIKLRDDGEYHLRSANFDTSVVFRNSDLRFDPKDDWGNYPKGIIAELAKLGVDLPGATIYFYGNIPNGAGLSSSASIGMVTAYGLTQCSGIDIDRVTLAKLCQRMENDFIGVSTGLMDQFAVGMGKKDHALFLNTSSLEYDQVPLILKGYKLVITNSNKRRGLADSKYNERRRECEIGLEQLRKKQTNLSHLGEVTEEMFAELGPVIEDELIYRRVRHVVTEDARVLAAVSALKAGELQTFGELMKASHLSLREDYDVTGVELDTLFDLQASAPGCIGTRMTGAGFGGCTVSIVHEEEITAFQTVVSKGYEKKIGYKPTFYVTELGDGVNEWKGGA

SEQ ID NO: 17186 - protein, 581 aa, Bacillus halodurans
MDTFKRLAQFYWPYRRYFYWSLFAMGVMTLMTVLYPIILQFTIDNAVIGGRYDLIPWLALALIIVMGFKGVMVYIHQYLGDLFGVTAVYRLRNSLYEKLQYLPFRYYDNAKTGDLMSRLTGDVETFRFFLSFGFAQFIQFILLVSFSMGVMLYYSVPLTLATMCTLPFLAIVVAKFDRRVHPGFRDIRKSLAKLNTKVQENVSGMNTVKALSQEDEEVSRFEDRNVDYRQKHLDIARVWGNYFPLMEFIGNLSAVFLLSFGGYLVITGSMQTGQLVAFFSLVWYIIGPIMNLGFIINTFSQSKASGERLLEILDEENRVDEGKDERTSLQGSVTFRDVCLNYRGAETPALQNVSFEAPAGKTIGLVGATGSGKTSIVQLVNRFYERTSGEILIDGKPIESYPLETLRSQIGVVLQESFLFSSTIRDNIAYGRPDVSMKEIIAAARRAQAHDFIAELPDGYDTVLGERGLGLSGGQKQRIAIARAILMNPSILILDDATSAVDMKTEHKIQAAFREVMKGRTTFIIAHRISSVKQADEILVLDGGKVCERGTHHTLLQNKKGLYRRIYDIQSKDQEYVLQHA

SEQ ID NO: 17187 - protein, 601 aa, Bacillus halodurans
MSEGKRRARFHYASDQVIEKPFNWAQMMRLLTYMKPYAASLLPKTVVAMLIVTAVRLFVPIIIGVLAIDHAIAAGDLNVMYQLAALVLGLYSISYVANVFRIRWMNEIGQHVIYDIRADLFNHIQRLSHRFFDQRSAGSILVRVVNDVNSLQDLFTNGVINLLMDIVILLGIIVILFSLSPELAILILIVLPIMFFISTKLRRNIRRSWQTVRLRQSKLNSHLNESIQGIRVTQAFSQEKENMRFFRDINEENFQSWKDATRMNALFRPFVEMASAIGAVVLIWYGVSLIQSEVLTVGVFVSFAFYLGMFWEPISRLGQVYNQLLVGMASSERIFEFLDEKPSVPEKENAVTLHEMRGHVTFEQVEFSYDDKRKALNDISFEIKAGQTIALVGHTGSGKSTIVNLISRFYDPTAGVIKIDGVDLRDIQLNSLRTNVSFVLQDTFIFAGTIMENIRFGRPTATDEEVKAAAEAIGANDFIERLPNGYDTEVEEKGNVLSVGERQLLSFARALLADPKILILDEATASIDTETELKIQAGLKKLLHDRTAIMIAHRLSTIRDADQIIVLEQGDIIEQGTHSELMDARGTYYGLVKAQYEASAG

SEQ ID NO: 17188 - protein, 381 aa, Bacillus halodurans
MNFELTKEQQMVRDMVRDFAENEIAPNAIHYDKTAQFPEDVFKKMGELGLLGIPFPEEYGGSGGDTISYALAVEEVGRACGGTGLSYAAAVSLGASPIYYFGTERQKQEHLVPLATGESLGSFGLTEPNAGSDAGGTRTKAVLEGDEYVINGEKCWITNAGYARTVIVTAVTGKDERGKPVISALIVPTGIEGFTISCNYDKMGVRASNTCELVLEDVRVPKENLLGDPTKGFKQFLYTLDGGRISIGALAVGIAQAAFDRALAYANERKQFGQKISSFQAIQFKLADMAMEIELARNMVLKAAWLKDQKKPFTKEGAYAKLYASETAMRTANQAIQIHGGYGYMQEYEVERMLRDAKLLEIGEGTSEIQRMVIARQLGCR

SEQ ID NO: 17189 - protein, 546 aa, Bacillus halodurans
MSERLQVTVGALLEKVAKRQPTHEALVYPDRGLRYSYDQFLSKCQQAAKGLMKLGIERGEHVAIWATNVPEWVITQFATGTMGAVLVTVNTNYRTSELEYLLKQSDATTLLLIDGYRDASYVEMLYEILPELKTSEPGACYSKKLPHLRRVIHLGEERYPGMYTWEDVLNLGTEVTNDELAERSASLDPDDVINMQYTSGTTGFPKGVMLTHNNIVNNARNIAECMKLTNEDRLCIPVPFFHCFGCVLGTLACVSVGATMVPVQEFNPTRVLQAVEAEKCTGLHGVPTMFIAELNDEDFMNYNLSHLRTGIMAGSNCPIEVMKAAIEKMGMSDITIAYGQTETSPVITQTRVDDPIELRVQTVGRPLPNVEVKIVEPGTEKEVAPGVQGELCTRGYHVMKGYYKNQQATREVIKEDGWLHTGDLAVMDEAGYCRITGRLKDMIIRGGENIYPREIEEFLYQHPDILDAQVVGVPDEKYGEAVSAWIKLKPGVSVTSEEIRDFCQGKVAHYKIPRYIEFVDDYPMTASGKVQKFKLRQMAEQIFQKG

SEQ ID NO: 17190 - protein, 452 aa, Bacillus halodurans
MFKKVLIANRGEIAVRIIRTCQKLNIRTVAIYSEADVDSLHVKHADEAFLIGKPPVAESYLKVDTILEVAKQAGVDAIHPGYGLLSENARFARACVEAGISFIGPSPEVIERMGSKIAARTAMQTAGVPVIPGSDVALADEEEAVHLARKFGYPVMLKASAGGGGIGMQLVRNDEEMRKAFAGNQKRATSFFGDGTMFLEKAVENPRHIEVQIAADHHGHVVHLWERDCSIQRRHQKVVEEAPSPFVDEALREKIGQLAVKAAKAIDYRNLGTVECLVDGEKNIYFLEMNTRLQVEHPVTEEITGIDLVEWQLLIAAGEQLPYAQHEIPLQGHAIEVRIYAEDPVTFFPSPGMIKRFTLPEGEGIRHEYAISEGYKVTPFYDPMVAKLIVSADTRGEAIQRLGRALKQYEIEGIKTNIPMLKQVINHPVFQAGEATTAFVTNHLKVKTGRNP

SEQ ID NO: 17191 - protein, 303 aa, Bacillus halodurans
MNSSKKVSIREVGPRDGLQNESTWIDTEQKIEWINHLSRTGLPYIEVSSFVHPKWIPALADAEEVLARIDRVDGVTYAALVPNEKGLERALRAGVDEVAIFMSATETHNRKNINKSIADTLPVLKNVTRIAKQEGKSVRGYLSTVFGCPYEGTTEQTKLLQTVEALMTMGIDELSLGDTIGVATPNLVEAVVREVTKLVPTEKMALHLHDTKGMAIANIACGLRTGVRKFDSSVGGLGGCPYAPGAAGNVATEDLLYLLHGLGYETDVSLNEIMKAAAYIQEKLDKPLPSHNLQSFLAKEGSV

SEQ ID NO: 17192 - protein, 648 aa, Bacillus halodurans
MTAPVWFPSDAYKEQTRLYQWMKMLGYSSYDDFYQRSIDDIAWFWREVERELDIPWMKPYDHVLAMEKGPAWPEWFIGGKLNVTEAAVEKWANDPKTANKTAIVWEGEEGKTSLLSFAALDEAVKRAAHGLKQHGVKKGDVFALYMPMIPETVIAMLAVAKLGAIFTPIFSGYGAEAIATRLRASGAKWLITVDGCYRRGKLIDMRQEAEKALADAPNVQSIVVVERVGTLTSYGANDIRWTELMTYAPLQETAAMNSADPLMLIYTSGTTGRPKGAVHTHSGFPIKAAFDAGIGMDLRKEDTLFWLTDMGWMMGPFLVFAGLINGATIVLYDGAPDYPNHDRLWQLVEQKQVSHLGISPTLIRAMMKYGTERMAEHDLSCLKVIGSTGEPWNPEPWHWLFEHVGNKQVPIFNYSGGTEISGGILGNVLVRPIGPITFNSAIPGMAAAVYNESGEKVTAEVGELVLTKPWVGMTNGFWQEPERFLETYWSRWSNTWVHGDWVTLDADGFWTITGRSDDILNVAGKRLGPAEVESVLVGHQAVIEAGTIGVPDDVKGEVPICFVVIAPSFSESDSLRHELIQLVGTKLGKALKPKAVYFVSDLPKTRNAKVMRRAIRAAFLQKEAGDLSSLENPHVLKEIERLGTKQSS

SEQ ID NO: 17193 - protein, 583 aa, Bacillus halodurans
MLRVLGQLSWFFKEEWKRYTIALVLLLIVGITDLAPAWILGLAIDDFQMGQLSVQSGLYYGGILTLIMVISYGLTFVWMSKLFGGAFVIERKLRSKFMRHLFKMDPTFYERQRTGDLMARGTNDLKAVSNTAGFGILTLIDSSVFMFTILIAMCVLIDWKLTIAAVLPLPLMAIIITVLGKKIHGRFMMAQDAFGSLNDKVLESVGGLRVIRAFSKERADEDHFREMSENVYQKNILVAKTDALFEPAVNIIVGMSYIIGLGFGSYLVFQQQITLGQLVTFNVYLGMLIWPMFAIGELINIMQRGSASLDRIDETLREREDVPNPEQPTNTTDFQDIRFQQLSFKYPGSKGTQLKQVSFQVNRGETLGIVGRTGSGKTTLVKQLLKYYPIHEGEVSLTDTALRDMEKQHVRKWIGYVPQDHILFSKTVKENILFGKQDAMEEELQKAIRLSAFDQDLSFLPDGLETLVGEKGVALSGGQKQRISIARALIADPDILILDDSLSAVDAKTEAKIIGNIRKERAGKTTVITTHRISAVEHADRILVLDEGRVIEEGTHQQLLQKDGWYAEQARRQALDPVEGVSP

SEQ ID NO: 17194 - protein, 674 aa, Bacillus halodurans
MTAGKRLYQYALTSKKTILFALALLTVSVAAGLTGPFIAMTIIDRHITGIEEPWYETTEQAKAVEYNGTWYIRETYMPDDAPREHEVQIAQVGLTFVFTEEPLPMDGAKSYNDGVLRVTVGDDMYETEAVPLTTQEVMAFFTPEIRPIVQLLLFYFGLMVVASFFQYGQRFYLQKAANRIIQRLRIDLFNHLSRLPVRFFDNMPAGKVVSRITNDTEAIRELYVAVLANFFTSIIYMIGIYIAMFLLDVRLAFICLGLIPILVLWIVLYRKYASAINHRIRSKISEINASMNENIQGMSIIQAFVREKDSADTFDRLNDSHYRDQVKLLRLNALTGHNLSWVLRNLVFVGLIWSIAGTSLGAGSALTLGVLYAFVDYVNRLFEPVNRIVHQLPNLEQARVAGERVFELMDKEGTEVSDETIPRPKGDVVFDNVSFAYKENEKVLKNLTFHAKPGQTIGLVGHTGSGKSSIMNLLFRFYDSDEGQIRIDGQDIKEISPQALRQHMGIVLQEPYLFTGTVASNLSLSNPAITREAMEEALRLVDGEHVFADLEQGLDEEVKEKGSTLSSGQRQLISFARALVADPAILVLDEATSNIDSETEAIIQRGLEALKRGRTTFVIAHRLSTIKNADQILVLDKGKIIESGTHDELMEQEGAYAQMYYLQNQEKSTASTAG

SEQ ID NO: 17195 - protein, 299 aa, Bacillus halodurans
MSLTIDGVTKKFGTFTAVNNLHVSVPKGEMFGMLGANGAGKTTTFRMILGLLEPTEGTIHWREQPLTYNQTNCIGYLPEERGLYPKLTVKDQLKYLGRLKGMKTQDIQKEMKMWLERFEVPEYEHKRVEQLSKGNQQKIQFIASVLHRPELLILDEPFSGLDPVNVELLKKAVIDLKKEGTTILFSSHRMEHVEELCQHLCILHRGSPVVEGNLKNIKRSFGKKNVIIQGEFALEPLVDIPGVLRHQETSAGAKFQIANEETAKLLFQAVATAGFVQKFELEEPSLHDIFVEKVGTRYE

SEQ ID NO: 17196 - protein, 361 aa, Bacillus halodurans
MKRAYNFNAGPSALPTEVLEKAQSELLDFENTGMSVMELSHRSKEYENVHHTAAQLLRDLLNIPEDYDVLFLQGGASLQFAMIPLNFLDEGKVANYILTGSWSEKALKEAKFIGKTAIAGSTKESNYTFIPDISSLQYNEHDSYVHLTSNNTIFGTQWHTYPSVSHAPLIVDMSSDILSRPLPVKNFDLIYAGAQKNLGPSGVTVVIIRKELLKRNVDHVPTMLRYQTHAEKQSLYNTPPTFGIYMLKEVLQWLKNIGGTEQIAERNQTKANLIYGAIDESEQFYKGHATKESRSLMNVTFTLPTEELTQQFLSEAKEKGFVGLNGHRSVGGCRASIYNGVPVEACEALADFMHSFYQTHR

SEQ ID NO: 17197 - protein, 247 aa, Bacillus halodurans
MEERVVVEGLTGGYRPNKPVLHDLHLKIRANELVGLIGLNGAGKSTTIKHILGLMEPHKGSVMINGNTITTDRETYRRSLAYIPETPILYEELTLWEHMELTALAYGIERKAFEERSKLLLDEFRMTKMKHWYPSHFSKGMRQKVMIICAFLIDPPVYIVDEPIVGLDPIGIQSFLQLLATKKKNGAAVLMSTHILATAERYCDRFIILNRGRIVLEGTLESMRAELNMPDATLDDIYIEMTKEESQ

SEQ ID NO: 17198 - protein, 344 aa, Bacillus halodurans
MSNSFNDTFLKACKGEVHDHVPVWYMRQAGRSQPEYRKIKEKYSLFEITKQPELCAYVTKLPVDQYNNDAAILYKDIMTPLPFIGVDVEIKTGKGPVIDNPIQSYADVERLGTIQPEEDVPYVLDTIKLLREQLTVPLISFAGAPFTLASYMIEGGPSKSYNKTKAFMYAEPKAWHLLMDKLGEMTITYVKAQIAAGAQAIQIFDSWVGTLNVQDYRVFVKPVMERTFSELQKEKVPLIMFGVGASHLVNEWNDLPLDVVGLDWRLQIKEARELGVTKTVQGNLDPAILLAPWEVIEARAKEILDQGLETPNFIFNLGHGVFPEVEPDTLKRLTAFVHEYSANN

SEQ ID NO: 17199 - protein, 310 aa, Bacillus halodurans
MTKKKIGLLVMAYGTPRTKEEIEPYYTHIRHGRKPSQELLDDLTERYEAIGGVSPLAKITDDQAIALEQKLNELYDDIEFKSYLGLKHIDPFIEDAVEQMKEDGVQEAVSIVLAPHFSTFSVKSYNGRAHEESKKIGGPRIQSVESWYDEPLFIQYWVDQVNDTMAKIEDKDKACVIFSAHSLPEKIVDYGDPYPQQLKETADLIAKGAGITNYAVGWQSEGNTPEPWLGPDVQDLTRDLYETHGYTSMIYCPVGFVADHLEVLYDNDYECKVVTDELGIDYYRPEMPNAKPEFIDCLATVIQKKLAEKE

SEQ ID NO: 17200 - protein, 467 aa, Bacillus halodurans
MTTNNHRVAVIGGGMTGLAAAWALQKARKQMPIEYELIEASAQLGGKIQTDVTEGFVIERGPDSYLARKESMTRLAREVGLEGELVRNDTGQAYILKDDQLYPIPGGAIMGIPTEIGPFIRSRLFSSIGKLRAAQDLVIPSFTHENEDVSLGYFFRKRLGDEVVDQLIEPLLSGIYAGDLDTLSLQATFPQFQQLEAKYGSLIRGIKASKGKQSQSQVGKKQGMFLTFRRGLQSFIETIEQHLDEKAIRKKTEVRFCEREGKRYRLTFNDGTVQTYDHVILTTPPYVTGRLLEPYVDVDYMREMKATTVATVAMAFKSEDLHIPYEGTGFVVPRKSRYEITACTWTHKKWRHTTPEGHALVRCYVGKPGSESIVHETDEAIVEQVQKDLDQIMTVKREPLFYKVTRWKKAMPQYEVGHRYKLEKVRQELKKAMPGIILAGAGFDGIGLPDCIDQGEAAVATVLEEIL

SEQ ID NO: 17201 - protein, 509 aa, Bacillus halodurans
MRCDGEVIIVGSGIAAMMSAYLLRKSFHVIMITKSDVFASNSFLAQGGIAAPIAEGDDWQAHTADTWKAGAAHGDETSIEMMTKHAVNMIELLDDLGVSFDREESGGYSLGLEGAHGTRRIVHVNGAETGKAVMRALWKAIKNEITLLDRTCVYRFIKNKDEIIGVETDQGSLFAPVTIVATGGCGQMYSVTSNGKEATGDGIALAYRSGAAISDVEFIQFHPTVYTGNEKEKGLLISEAVRGEGGQLITSAGERLQSLKSRDVVSREIFRQEREGHTVHLDLTGISDFERKFPALYKGFNKSDRRTLKPRVTPGAHFLNGGISVDAWGQTSLSRLYAVGEVACTGVHGANRLASNSLLEGLVFAHQAATHIQQTFQPLTAGLFVERDKAEPRSFKLPTREDLQKKMMRYVGIERHARSLWYMNNWFQPFLDTAHYNGPWPERDMFEQANMTLLASLITRSAAIRTESRGGHFRADYPNGLDKFQQLIIEWQNGAHMKRQRPTIKELSR

SEQ ID NO: 17202 - protein, 171 aa, Bacillus halodurans
MDFKQHITIVENFPKEGIRFKDITTLMQNGEVYKRAIDEMARFAKEKEVDLVVGPEARGFVVGCPIAYAIGKGFVPVRKAGKLPREVISVDYGLEYGKDRLTIHRDAIQKGQRVLIADDLLATGGTIEATVQMVEQLGGEVVGIAFMIELGYLNGRDKLVTYDVFSLTTYE

SEQ ID NO: 17203 - protein, 417 aa, Bacillus halodurans
MIKVGVIGFGTVGQGVVESLVQLERGLRKEVTLEMLLVTNRRKHEHSEQYALVTDDWETFAARYYDVVFEAAGGIEPVYDYVRFFLKKGVPVVTANKKLVAERGEELERLAAENDTYLCYEAAVAGGIPILNAIKGTLATTSFTSVAGILNGTTNYILTGMIEQNRPFQDMLEEAQAKGYAEADPTDDIEGYDAWYKIRILARLCFGIWPNRDDISRSGLHDVLDWHVELGQSLGLTLKLDGRASVKNNTIIGSVAPAFFTNDHPFSTVYGVTNAVVLEGKAIERLLFTGPGAGKEATANSMVEDYLFHERYKGERQPMLIKEKEQNRIANVLVMVAAHEKKEAEKVVEHLPCQRINTFAADEGEAWWLKVYEDVIPFISKQLGLSLYRVYGAFEKQLVTTNMHHPSSIDETLEQKA

SEQ ID NO: 17204 - protein, 533 aa, Bacillus halodurans
MKDQNQDPNKRSDNETDETLTNRQGHPVTNNQHVRTVGDRGPTTLENYDFLEKISHFDRERIPERVVHARGAGAHGYFESYGTYGDEPISKYTRAKVFTEKGKQTPVFVRFSSVIHGGHSPETLRDPRGFAVKFYTEDGNWDLVGNNLKIFFIRDPLKFPDLVHAFKPDPVTNVQDGERIFDFISQTPEAMHMITFLFSPWGIPANYRMMQGSGVNTYKWVNEEGNAVLVKYHWEPKQGIKNLTQKEAEAIQAKNFNHATLDLYEAIEDGDYPEWELYVQIMSDDAHPELDFDPLDPTKLWYKDQFPWVPVGRMVLNKNPENYFAEVEQAAFGTGVLVDGLDFSDDKLLQGRTFSYSDTQRYRVGANYLQLPINAPKKRVATNQRDGQMEYHVDIGPKQNPHVNYEPSLLNGLKEAKQDGQDHTPYVEGELQRASIDRQNDYGQAGETYRRLSDWERDDLILNLVNTLAPCHEDIQKQMIDHFSQCDPEYGRRVKEGLEKQKGADTHRQPQGGADGDAAMHAAEALGHPSDPY

SEQ ID NO: 17205 - protein, 259 aa, Bacillus halodurans
MRKTFFRLCFELSSHPVLSSMLQAFTTSKASRWLIPSFVRVYNINGQEAEKPLHTYQSLQEVFTRTLTENCRPIDLSPKSIVSPVDGVLAEQGTLSDEANFVVKNQTYTLEEMLGGKEKAKLYREGTYLLFYLSPSHYHRIHSPVNGTIKEQWTLGNKSAPVNNLGLRYGKRPLSRNYRLLTELEAEEGRCIVAKIGALNVNSIVPTHQSEHVDKGEEIGYFAFGSSVMLFFEKGTIQLDHQPRAVEVKMGEKVGSWLR

SEQ ID NO: 17206 - protein, 278 aa, Bacillus halodurans
MKKLFGLLGHPVGHSLSPLMHNQMFQLLDFDGYYHAFDVEPSQLEKAVEGARALQMQGFNVTIPHKVTIMDYLDMVDEEAQEIGAVNTVVMKDGQLFGSNTDGQGYLESLMDVVTTPFPTQDVLIIGAGGAARAIGTVLKREKVRSITIANRTLAKAEEFSGVLESSETSCSALSLKEAEQQLERFSVIINTTSVGMSPRVDDMPLSLERLSRETVVSDLIYNPLETKFLREAKQKGAKTVDGLGMFVNQGALAFELWTGLRPDREKMRRCVLEQLGG

SEQ ID NO: 17207 - protein, 275 aa, Bacillus halodurans
MKIGFIGTGSMGTILIESFLESSALTAEQIVITNRTQEKADALARRYPGLSVVDRPEEVVQQTDCFFVCVKPMQFHRVLMDIRPHCSANKLLVSITSPISIAQLENSVDCKVARAIPSILNRACAGSTLVSFSERCLEEDRSFLCGLLGTISEPLLIEEKITRVSSDIVSCGPAFFSYLTQRFIEAAVRQTAISEEDATALATEMLIGIGKLLDQELYTLPSLQKRVCVPGGITGEGIRVLEEDVGHMFDRLFQKTHQKYYHEQEKISSQLTLKG

SEQ ID NO: 17208 - protein, 614 aa, Bacillus halodurans
MSKIIGIDLGTTNSCVAVMEGGEATVIPNPEGNRTTPSVVAFKDGERQVGEVAKRQAITNPNTVISIKRHMGTNHKENIEGKEYTPQEISAIILQKLKSDAEAYLGEEVTKAVITVPAYFNDSQRQATKDAGKIAGLEVERIVNEPTAAALAYGLDKEDDQTILVYDLGGGTFDVSILELGDGFFEVKATSGDNKLGGDDFDQVIIDHLIAEFKKENGIDLSQDKMAMQRLKDAAEKAKKDLSGVTSTQISLPFITADATGPKHLELTLTRAKFEELSSHLVERTLGPTRQALQDSGLSASEIDKVVLVGGSTRIPAVQEAIKNLTGKEPHKGVNPDEVVALGAAVQAGVLTGDVKDVVLLDVTPLSLGIETMGGVFTKLIERNTTIPTSKSQIFSTAADNQPSVDIHVLQGEREMAADNKTLGRFQLTDIPPAPRGVPQIEVTFDIDANGIVNVKAKDLGTNKEQSITITSSSGLTDEEIDQMVKDAEANAEADKKRREEVELRNEADQLVFTTEKTLKDLGDNVDEAEKTKAEEAKEKLKKAIEANNIDEIRTAKEELQQVVQALTTKLYEQAAQQAQQAQSAEGDQGTAEKGQDDNVVDADYEEVNEEDKK

SEQ ID NO: 17209 - protein, 370 aa, Bacillus halodurans
MSKRDYYEVLGVDRNASADEVKKAYRKLARKYHPDVNKAPDAEDKFKEVKEAFDTLSDPQKKAHYDQFGHTDPNQGFGGGGAGDFGGFSDIFDMFFGGGGGRRNPNAPRQGADLQYTMTLEFKEAVFGKETTIEIPREETCHTCSGSGAKPGTKPESCPHCGGSGQLNIEQNTPFGRVVNRRVCHHCEGTGKYIKHKCATCGGKGKVRKRKKINVKVPAGIDHGQQIRLSGQGEAGVNGGPAGDLYIVFNVKPHEFFERDGDDIYCEMPLTFVQVALGDEIEVPTLNGKVKLKIPAGTQTGTSFRLRGKGVPNVHGRGQGDQHVQVRVITPKQLSEKEKELLREFAQMSGGRPDEQDDSFFAKVKRAFKG

SEQ ID NO: 17210 - protein, 438 aa, Bacillus halodurans
MKSANFARFQIKKFLLEALSDKGITHPTEIQERLIPAIRNGKDVIGQSQTGTGKTLAFLLPIVDRIEGEREEVQAVITAPTRELAGQIFEELQALLRHVPHDEEIRAKLIVGGTDRSRTLEKLRVQPQIVVGTPGRISDLVHEQALNVYTATMLVVDEADQMLDMGFIEDVDKVAARMAENLQMMVFSATIPEKLKPFLKKYMNEPRHVHVQPKQATANLIEHRIVPLRHRDKLEITTEVASVLNPFLAIVFTNTKEQADELADAMLAAGLNVERLHGGLQPRQRKQVMKRVKNYEVQYLVATDLAARGIDIKGVSHIINYSLPKDLDFYVHRVGRTARAGADGIALTIFAPEDEQAVHKLMKRGIQFTYYDLKKGEWQKLDKPPLGVPGEKRRKEDKGLEAPIVKKAKKVKPGYKKKARLAQADQQRRQRRLNRKKK

SEQ ID NO: 17211 - protein, 250 aa, Bacillus halodurans
MNPVVKVDNLSVFYEQHQAIKNIRFQAGPGQMIGILGPNGAGKSTLMKAILGLERYTGTVKVLDKHVRHVRKQIAYVPQRNAIDWDFPVLVEDVVMMGRFAHIPWFKRAGKNDKRLVEESLKKVGMEEYRSRQIGELSGGQQQRVFIARALAQESELFFLDEPFVGIDVTSESIILSLLQELRDRGKTIFVVHHDLSKVEKYFDQVLMLNKELIAYGPVADVYTPEMVAKTYQGNLATFSKKDEVMVVNV

SEQ ID NO: 17212 - protein, 249 aa, Bacillus halodurans
MKGVILAGGRGTRLKPLTDQIPKPMLPIAGVPCLAHGLAHLAAHGIRDIVMLVHYLNHQMKAYFQDGSKYGMRITYVQEDAPLGTAGSLKAAERYLDEPFVVMSGDVLTTISIQEAIVFHKRQNSLMTMLTKRVKNGQNYGVVQTGPNHRVVAFREKPTEDKTREVLVNTGLYVMDPFVLSYIPKGSAVDLGKDVIPYLVDRKLDIFALEGGGYWRDIGSFHDYLQANNDVNSGSVPSFVGRPSLLSRD

SEQ ID NO: 17213 - protein, 471 aa, Bacillus halodurans
MTDYRVERDLIGEKKVPKEAYYGIQTMRARENFPITGYPPHEELIRAFGFVKKAAAMANRDVGVLPANIVDAIITAADEVIEGTFNDQFIVDAIQGGAGTSFNMNANEVIANRAIEILGGEKGEYLRVSPNTHVNMAQSTNDAFPTAIHIACLYLAKGLIQSLEDLIAAIKEKEQQFDDVLKMGRTHLQDAVPIRMGQEFGAYRRVLTRDLGRIRSSIDHMHEINMGATAVGTGLNAKPEYMEKVVAYLSDITEFPFRHAADLVDATQNTDAYTELSSALKILAINLSKMANDIRLMSSGPRTGLNEINLPPRQPGSSIMPGKVNPVMAEVINQISFQVIGNDHTISLASEAGQLELNVMEPVLVFNLLQSLSILQNGMKVFRQHAIEGMTANVERCKEMVESSVGIITAINPHVGYETASRIAKEAIQTGRPVREICLERGILTEEELNEILDPKEMTKPGIAGARFIYG

SEQ ID NO: 17214 - protein, 462 aa, Bacillus halodurans
MNTRIERDTLGEMHVPQDKLWGAQTQRSYENFHIGTEKMPMEIIYAFALLKKAAANVNKKLGQLSAEKADAITWAANEVLAGKHDDHFPLFVWQTGSGTQSNMNMNEVLARRGNQLLQEKGLDVTIHPNDDVNRSQSSNDTFPTAMHIAAYNKLDDHLLPTLQMFKQTLHQKAKQFDDVIKLGRTHLQDATPLTLGQEISGWARMLEKTEQMIRESMIYLQELAIGGTAVGTGVNAHPKFGEMVAADIANETGKPFKSAANKFHALTSHDELVHTHGALKALAADLFKIANDIRWLASGPRGGLGELIIPANEPGSSIMPGKVNPTQSEALTMITSQVIGNDATIAFAASQGNFELNVFKPVIIYNFLQSTTLLTDGLRTFHDKCLIGLEANETIIKKHLNESLMLVTALNPHIGYENAAKIAKKAHAEGLTLKEAAMQSGLLTEEEFEKMVDPAKMVHPQG

SEQ ID NO: 17215 - protein, 179 aa, Bacillus halodurans
MSESKWALATFAGGCFWCMVSPFEEEPGIHQVVSGYTGGHTENPTYKEVCSETTGHYEAVQISFDPEVFPYEKLLEIYWTQIDPTDPGGQFHDRGDSYRTAIFYHDEQQKQAADASKQKLEESGKFNAPIVTRILPAKPFYPAEEYHQKYHKKNPFHYKMYRHGSGREAFIKQHWGESR

SEQ ID NO: 17216 - protein, 231 aa, Bacillus halodurans
MDQSIQVNINEVNQALERKDSLDVIKWAYKTYGDKLVYACSMGAEGMVLIDLISKVRPDAPVIFLDTDFHFSETYELIERVKERYPKLQLKLVKPELTPEEQAETYGDRLWERQPDLCCKLRKLVPLEKELAQYDAWMSGLRRDQSPTRTNTQFVNEDRRFGSTKICPLIHWTSEEIWMYIELHQLPYNDLHDKQYPSIGCEYCTRPVKEGEDERAGRWSNTSKTECGLHQ

SEQ ID NO: 17217 - protein, 381 aa, Bacillus halodurans
MSLSQPHGGTLVQRFHPEANVESVEKSIELDAFSLSDLELIGIGAFSPLTGFLTEKDYRSVVESMRLENGTVWSIPIALPVTEEKAATLSVGDVVKLDHQGETYGLLTIEDIYQPDKELEAENVYRTTDLAHPGVKKLFDRPNVYIGGPITLTKRVERTKFSSYYLDPKETRAVFAEKGWKRVVGFQTRNPVHRAHEYIQKTALEIVDGLFLNPLVGETKADDIPADVRMESYEVLLEKYYPQDRVFLAVFPAAMRYAGPREAVFHALVRKNYGCTHFIVGRDHAGVGDYYGTYDAQLIFHHFTREELGITPLFFEHSFYCKACGNMASTKTCPHGKEHHVILSGTKVREMLANGVTPPPEFSRPEVVNVLIKGMQKKVEV

SEQ ID NO: 17218 - protein, 202 aa, Bacillus halodurans
MGTSNQPHIVWHEASVSKEERQKRNRLKSCVVWFTGLSGSGKSTLANALDRKLFEEGIHSYVLDGDNIRHGLNAGLGFSEEDRKENIRRIGEVAKLFVDAGVVTSTAFISPFREDRDNVRGILDDGEFIEVYVRCPLETCEKRDPKGLYKKARSGDIPEFTGISSPYEEPVNPELIIDTDQLAVEEAVEKIYAYLHAQESGK

SEQ ID NO: 17219 - protein, 456 aa, Bacillus halodurans
MKVTKFGGTSVASAEQIRKVATIVADDVERKIVVVSAPGKRHSSDTKVTDLLIRLGETYLEKGYANEELEAVLRRYEEIAKGLELGQEIIDQIANDLHTRLTFNQSNPGAFMDQLKASGEDNNAKLIAAYLQTKGMNAVYVSPKEAGLLVSDEPGNAQVLPEAYDHLKKLRERDEMIVFPGFFGFSPDGALVTFPRGGSDITGAILAAGVKAELYENFTDVDSVFAANPNVVESPAQIRRMTYREMRELSYAGFSVFHDEALIPAFRQKIPVCVKNTNNPSSPGTMILAEREYFLNPVIGIAADKGFATIYVRKYLMNREIGFGRRLLQIIEDEGLSYEHIPSGIDDASVILRQEQLTDEIEHRILARIKEELCVDDVFVEKDFAMVMIVGEGMHNTVGISARATAALARAHVNIEMINQGSSEVSLVLGIHEKDADAAVRELYEEFFGGAEETVQ

SEQ ID NO: 17220 - protein, 274 aa, Bacillus halodurans
MKMEARQKQNSFTSKMQKIVNHRAFTFTVIALILFNALIVGIETYPRIYADHKWLFYRIDLVLLWIFTIEIAMRFLASNPKSAFFRSSWNWFDFLIVAAGHIFAGAQFVTVLRILRVLRVLRAISVVPSLRRLVDALVMTIPALGNILILMSIFFYIFAVIGTMLFQHVSPEYFGNLQLSLLTLFQVVTLESWASGVMRPIFAEVPWSWLYFVSFVLIGTFIIFNLFIGVIVNNVEKAELTDNEEDGEADGLKQEISALRKDVAELKSLLKQSK

SEQ ID NO: 17221 - protein, 279 aa, Bacillus halodurans
MLQDHKITFLGAGSMAESIIAGLLSKKLLLPSQVIATNLCDEAKLTKLEDRYGICTTQNRQEAVRQGTIIFLAMKPKNIEEAIEEIRGEITEKQLFISVLAGTTTSYIETLLAHEVPVVRTMPNTSAKVGASATGLCGGRYANASHVKLATLIFTAIGTVTEVTEDKLDAVTGLAGSGPAYFYYMVEAMERAAVQSGLTESEAKAFISQTLIGTGKRLEQTSKTAEELYKEVMSPGGTTEAGLRVLEQQQMQQAIEEAITAAINRSRELGSTPSLEIKK

SEQ ID NO: 17222 - protein, 416 aa, Bacillus halodurans [sequence omitted]

SEQ ID NO: 17223 - protein, 259 aa, Bacillus halodurans
MRKKTIFITGASSGLGRQLAIDFSWEETVLCLFARSQERLENVQRIVVENGGEAHIYPVDLADPQSIDRSFAEAISAVGVVDVLINNAGYGVFEPFCDSQMDENERMFRVNVFGLMRATAAVLPTMREQGSGHIINIASQAGKIATAKSAIYSATKHAVLGFTNSLRMELKGTGIHVSAVNPGPIQTPFFDQADKEGAYTSKVQRIMLDPEDVSEKIVQLTKKPKRELNLPWWMNIGATAYQVAPRLLELLAGKQFRQK

SEQ ID NO: 17224 - protein, 243 aa, Bacillus halodurans
MTKRIVLVTGAAQGIGTEIAAAFAAAGDRVILADVNVDKGHEAAERITQNGEARFIHCDVKNISEINHLFAQIRGEEGSLDVLINNAGISIWKNLFDVTEEAWDEVIHTNVRSVFFCSQQAARLMKEGGAIINIASTRAFMSEPDSEMYAAAKGGVIALTHALAASLQPYNIRVNSISPGWIHTGKREELRPIDHKQHFSNRVGTPADIASACLFLASNEQQFINGENLIIDGGMTKKMIYEP

SEQ ID NO: 17225 - protein, 287 aa, Bacillus halodurans
MTKQYPSSQPPQHQMKQPGIEQEMNPRPVFDRADYRGSGKLSGKVALITGGDSGIGRAVAVAFAKEGAKVAISYLDEHGDANETKQYVEQIGGVCHLLPGDVGEEAICQQIVQETVNQFGRLDIVVNNAAEQHPQAGLEAIDSTQLEQTFRTNVFSFFYTTKAALPHLQQGASIINTTSITAYQGSKDLIDYASTKGAIVALTRSLSESIVGQGIRVNGVAPGPIWTPLIPASFDAQKVAQFGSDTPMKRAGQPEELAAAYVYLASDDSSYVSGQVLHVNGGVIVNG

SEQ ID NO: 17226 - protein, 439 aa, Bacillus halodurans
MFFHGTSRVNGKGHLEIGGVDTVELANLYGTPLFVYDVALIRERAKDFKQAFADEGVQAQVAYASKAFSCIAMFQLAEELGLSLDVVSGGELYTAQQAGVSMERIHFHGNNKSRAEIEMAVEAGIGCFVVDNFYELDLLADICEQKRATANILLRITPGVEAHTHDYISTGQEDSKFGFDLVSGQATLAVKKALAVDSIHLLGVHSHIGSQIFETTGFVMAVEKIFEHLVTWREDHGFEPSVLNLGGGFGIRYIEGDTPRPVGDYVKEMIRAVKQQIAEHEMSMPEIWIEPGRSLVGDAGTTLYTIGSRKEIPNVRHYLSVDGGMSDNLRPALYQAEYEGALANRVNEQPVGMFSVAGKCCESGDMLIWDLPLPEANHEDILAVFCTGAYGYSMANNYNRIPRPPVVFVEDGDAQLVIQRERYEDLVRLDMPLVKKVKV

SEQ ID NO: 17227 - protein, 661 aa, Bacillus halodurans
MLLLSLIALTSNFCWWGFFVVTGIKVLFYPFDLIISTTCFAAVWFRRYFTIQRKTDKLVDQLKRANKTKDDFLANTSHELRNPLHSILNLSEGILEREKRSLNEKSVADLKIVLSVGRRMSFMLNDLLDAMSLKENTPRLMLQHLSIHTIANGVLEMFRFMVEGKPIRLNNQIPENIPNVLADESRVIQILFNLVHNAVKFTREGEISLEAYVKDDRVYIAIRDTGIGMDKDALKRVFDPYEQVRSEETMVEGGFGLGLSISQKLVELHGGILTVRSTPGQGSVFTFSLQISKQTGLADDNHLLVQSDRENELAAATLSKPTISPVAYRPRILVVDDEPVNLKVIASILANEAYEVKTVISGEEAIAVLDTKEWDLVVADVMMPKMSGYELTKNIRQRFTLTELPILLITARSRPEDIENGFRAGANDYLTKPVNLLELRARIKALTEAKQSIRDQLRMEGAWLQAQIQPHFLFNTLNAILALSEIDIKRMQKLLEVFADFLKNKFTFTNLDELAPIEIELSTVQSYLYIEKERFAQRLNVRWEVEDCKALMIPLFTIQPLVENAVKHGLNRSSGGEITIKIKNEDTYVKVTVTDNGVGMDENIVQHLLTERPSARSGIGLRNTDMRLKRHYGKGLHIESKLGVGTSVSFLVQKQMVQADV

SEQ ID NO: 17228 - protein, 467 aa, Bacillus halodurans
MNYSLAVDIGASSGRLIVGECNKKIQLTEIHRFENQIIEKNGQFCWDVDALFSEIKTGLKKCREAGIEPVSMGIDTWAVDFVLLDEHDKPLTDAVSYRDPRTDGVMEEVIEQFMKERLYLETGIQFQQFNTIYQLYALKKQHPDIFKKAKSFLMIPDYFHFLLTGKKANEYTNATTTQLVNAFTKKWDKDIIEALGFNPDMFQEIKLPTESLGKLKSEWVEEVGFDLEVILPATHDTGSAVVAVPKVADTIYLSSGTWSLIGVENSFPICVTKALDYNFTNEGGMNYQFRFLKNIMGLWMIQEVRRNYDNRYSFAQLVELSKGISFKSTVDVNDPRFLKPTNMIKEIQRYCQETGQQAPELPGEVAKCVFESLAESYTSAVAEIEDIFEKDFKSINVIGGGCRNELLNQLIADRTKKDVFAGPIEATAIGNLVAQWMALGEIESIQQARKLIYDSFDVKRYVSADRE

SEQ ID NO: 17229 - protein, 370 aa, Bacillus halodurans
MRLPNHGANPKTLATQMGTSLTGEAIDFSVNTNPFGPPPQLLAYLRKQLDQGLFTQYPDQEASELARAIAIKEHVPPSSVLVANGAAQIIYTIAQLWHKQRVAIVEPTFSEYEEACLANDCSVERIMLPPPWSLDLDRMTAVLKRTDLLFICHPNNPTGVAYRKEQLIELLELAKQFGTTLVIDEAFYDFMEVPITFTAQAAANEGIIVVRSMTKMFTIPGLRLGYAISAPSVIEKLKSKIPPWSVNGLADKAGQFCLRETMFVRDSAQRIAAARAEMQAGFRHLGFDVSPSVVNFFVISDPRESIGMLAMLKGLLDRGFVLRHTENFPGLDGRYLRVAVKDQDTNRKLLQAVKDWVEGETSCLSSFQER

SEQ ID NO: 17230 - protein, 491 aa, Bacillus halodurans
MNLEQELHKWFGYHSFRSGQKEVIEALVEGNDVFAMLPTGTGKSICYQLPARITEGVTLVISPLLSLMEDQVQQLKSNGWKDVAALSSFLSKGAKERIIKQLHLYKLLFLSPEMVQHPVVFKRLKQVKVSYFVVDEAHCISQWGHDFRPDFLRLSDVKHQLGNPPCLALTATATPAVQQDILTQLSIDEAVTIVHSVDRPNISISVEQTPTVKDKLEVIRGIIERHSGAGIIYFSSRLWSEQIARELMLNVKKRVAFYHGGMSNEDRILIQQQFMAGELDLICSTSAFGMGINKQDIRFVIHYHYPQQIASYVQEIGRAGRDGLASSAYVLFSEEDKGLARSLMTHDHPSKDEIIQMIQDCQTTEVPSYGGDVATAHRFVRFLLERFKKRNRTVDDFVSIVESHFQQRERIKAKELYLVEEWLQTKECRRERLLSFFSEQLTSRPVRCCDNCGLKDQPGEQASAIIAVDQTVPHWRERLALLCHQSKGGRG

SEQ ID NO: 17231 - protein, 421 aa, Bacillus halodurans
MEDKDKRSGKTTDVLASTQTVIKKALDKLGYPDEMYELMKEPIRMLTVRIPVRMDDGSTKIFTGYRAQHNDAVGPTKGGVRFHPNVTEKEVKALSIWMSLKAGIVDLPYGGGKGGIVCDPRDMSFRELERLSRGYVRAISQIVGPTKDIPAPDVFTNSQIMAWMLDEYSRIREFDSPGFITGKPIVLGGSHGRESATAKGVTICIREAAKKKGIDLQDARVVIQGFGNAGSFLAKFMHDAGAKVIGISDAYGALHDPDGLDIDYLLDRRDSFGTVTKLFKNTISNEELLELDCDILVPAAIENQITEKNAHNIKAQIVVEAANGPTTIEATEILTNRDILLVPDVLASAGGVTVSYFEWVQNNQGYYWTEEEVEGKLEAVMVHAFDNIYKLAKGRKVDMRLAAYMVGVRKMAEASRFRGWV

SEQ ID NO: 17232 - protein, 378 aa, Bacillus halodurans
MNRKELETALVQIGNRMDDRTGAINTPVYFSTAYRHSGIGESTGYDYARTGNPTREVLEKAIATLENGDQGFACSSGMAAIQTVFSLFQSGDEIIASQDLYGGTYRLFEGGWKKWGLSFSYADPRNLAALEQQITEKTRALFIETPTNPLMQEANIRELAALANKHGLLLIVDNTFYTPLLQQPLNEGTHIVIHSASKYLGGHNDVIAGLIVAKGQELCEQIAYYHNGIGGTLSAFDSWLLIRGMKTLALRMEQHQNNARAIASYLEKHEGVTDVLYPGRGGMLSFRIQSESWVNPFLQSLKLISFAESLGGVESLMTYPATQTHADIPEDVRIANGVCNRLLRFSVGIEHVGDLIADLDQAFNRVIEQSAVKGSEAQ

SEQ ID NO: 17233 - protein, 390 aa, Bacillus halodurans
MSEQYSLQTKLLHNEHKVDQATGAVSVPIQHASTFHQFDFDTFGTYDYSRSGNPTRDALEAAIAELEGGNHGFAFASGMAAISTAFMLLSKGDHVVLTKDVYGGTFRLVTEVLTRLGIEHTFVDMTNLAEVAAAIRPNTRVLYMETPSNPTLNITDIRGVVSLAKEHECLTFLDNTFLTPALQRPLELGVDVVLHSATKFIGGHSDVVAGLAVTKNEELGKKLAFLQNSFGAILGVQDVWLVLRGLKTLHVRMEHGEKGAQQIAEWLQGVPEVKRVYYPGLKDHPGHELQKRQAEGFGAVLSFELENEEAVRRFVEHVKLPVFAVSLGAVESILSYPAKMSHAAMPKEEREARGIRDGLLRLSVGLEKPEELMADFKAAFAHVRGKVEHL

SEQ ID NO: 17234 - protein, 345 aa, Bacillus halodurans
MKNVAVIGAGSWGTALSLVLADNGHHVTLVARREEIAREINERHTNETYLPSIEIPSSIVATCSMEEIIDVEIIVLVVPTKAIRQAVRSLNDVLKWPVTIVHASKGIEPGSHLRISEMIEEELEPTLLKEVVVLSGPSHAEEVSLRQPTTVTVSSKSLSTTKQIQDLFMNQQFRVYTNEDLIGVEIGGALKNIIALACGLTNGLGYGDNTKAAIMTRGLAEIGRLGVKLGASPLTFAGLSGLGDLIVTCTSIHSRNWRAGQMLGKGKSPAEVEESMGMVVEGIRTTQAAHELAQKLQIEMPITSALYSVLFEGKKPEHAADELMGRVKKHEMENLHDVVSDQKND

SEQ ID NO: 17235 - protein, 188 aa, Bacillus halodurans
MSKVDHEKIQQAVVMILEAIGEDPAREGLEDTPKRVAKMYEEVFAGLNQDPKEHFATIFGEDHEELVLVKDIPFFSMCEHHLVPFFGKAHVGYIPKGGKVTGLSKLARAVEAVARRPQLQERITSTVADALVETLEPHGVIVVVEAEHMCMTMRGVKKPGAATVTSAVRGTFANDAAARAEVLSLIKG

SEQ ID NO: 17236 - protein, 323 aa, Bacillus halodurans
MKLADIYAHFQEDIFTIERELEEAVQARHDILRKASVHLLKAGGKRIRPVFVLLAGKFGTYDVNVLKHIAVPLELIHMASLVHDDVIDDADLRRGKKTIKSQWDNRIAMYTGDYMFAKAVQTATYFDDPNIHQIISNAINEMCLGEVEQIRDQYNPNQHLRIYFRRIKRKTALLIAVSCQLGALAAKADPAIVQKLYYFGYYVGMSFQITDDVLDFVGTEEQLGKPAGSDLLQGNVTLPALYALHHDMHAKRLIEQVLADRGNNSVHMEEVIAAIVSSGGIDYALSISDLYLKKAMRMLDHLPDDEPKQFLQEIANYIGRRKF

SEQ ID NO: 17237 - protein, 147 aa, Bacillus halodurans
MERTYLMIKPDGVQRNLIGEIVSRFEKKGFTLIGAKLMTVTKEQAETHYAEHKERPFFGELVDFITSGPVFAMVWEGENVIATARKMMGATNPADAEPGTIRGDFGVQVAMNVIHGSDSPESAKREIDIFFDSSELNEYDKVVNRWV

SEQ ID NO: 17238 - protein, 390 aa, Bacillus halodurans
MRYLTAGESHGPQLTTIIEGAPAQLELVADDINVDLARRQGGHGRGRRMQIEKDQVQIVGGIRHGKTTGAPIALVVENKDWKHWTKIMGAEPLTGDEEKEIKRKITRPRPGHADLNGAIKYGHRDMRNVLERSSARETTVRVAAGAVAKKILRTFGIEVGSHVLEIGGVKAEKTSYDQLSNLKELAEASPVRCLDKEAEQEMIAAIDQAKENGDSIGGVVEVIVEGVPIGLGSHVHYDRKLDAKIAAAVMSINAFKGVEFGIGFEAASKPGSEVHDEIAWDEERGYYRKSNNLGGFEGGMTNGMPIVVRGVMKPIPTLYKPLQSVDIATKEPFAASIERSDSCAVPAAAVVAEAVVAWEVANALLERFGADQVEEIEKNIREFNEKARLF

SEQ ID NO: 17239 - protein, 322 aa, Bacillus halodurans
MTDDQVADLYLDTVKSSLHNLAPLHAVVLPNGEETKSFDNYYALQTAALEYGLDRKSMIIALGGGVIGDLAGFVAATYMRGIAYVQVPTTLLAHDSSVGGKVAINHPLGKNMIGAFHQPEAVLYDPQVFATLPEREWRSGFAEVVKHGLIKDAAFYAWLQKYINDFSRIQGEIAEELLLRSIQVKANIVAADEKEKGERALLNLGHTLGHAIEAELGYGKITHGEAVVIGIIFAMKLSEKVYHQSLPIQDLEKWLKFLGYETRIPKGLDTGALIGTMKKDKKVERGVIRFVLLEEVGHAVIKEVDEQLIRELLNVEIEEETT

SEQ ID NO: 17240 - protein, 218 aa, Bacillus halodurans
MQPMLKYCGNRSLEDVQAAATSKADYLGFVFAKSKRQVTVNEVTRWLDQVNVNGKKLVALFVNEPIDQIVNVVKQGPFDVIQCHGTENRDYIMTLKERIDLPVWKAIHHSGQGLQMMRALEGVVEAFVVDAKVEGQWGGTGQSFDWHVVPLYLQEGKRQQVPVFIAGGINPHNVELLLPYGPCGIDISSGIEENGQKSSAKICQIEKKVLGDDSHISR

SEQ ID NO: 17241 - protein, 369 aa, Bacillus halodurans
MKIKPQIIGLPPYKPGKPMEDVKRELGLETVVKLASNENPFGASPKVAEAIQEALHHTAIYPDGYARTLRDKVAHYVGVAPEELIFGNGSDEVIQILCRAFLNEQTNTVMAEPTFSQYKLNAVIEGAELREVPLKDGVHDLDGMLEVIDENTRIVWVCNPNNPTGTYVSAEAFQSFLAKVPEDVLVVSDEAYVEYVTADDYPDTVPMIRTYKNLVVLRTFSKVFGLAALRIGYGVANQALIEKIEPVRPPFNNSTFSQVAAVAALEDEAFVQSSVEKNNEGMEQLTEWCSRMGLDYFPSQTNFLLIHVNRSSDDVFNAMLKKGYIIRSGRALGYPAWIRITIGSKEQNDGCLAALADVLAEELTTQHLS

SEQ ID NO: 17242 - protein, 431 aa, Bacillus halodurans
MENKTVIPHAKGLKGTIKVPGDKSISHRAVMFGALAKGTTTVEGFLPGADCLSTISCFQKLGVSIEQAEERVTVKGKGWDGLREPSDILDVGNSGTTTRLILGILSTLPFHSVIIGDESIGKRPMKRVTEPLKSMGAQIDGRDHGNLTPLSIRGGQLKGIDFHSPVASAQMKSAILLAGLRAEGKTSVTEPAKTRDHTERMLEAFGVNIEKDGLTVSIEGGQMLTGQHVVVPGDISSAAFFLVAGAMVPHSRITLTNVGINPTRAGILEVLKQMGATLAMENERVQGGEPVADLTIETSVLQGVEIGGDIIPRLIDEIPIIAVLATQASGRTVIKDAEELKVKETNRIDTVVSELTKLGASIHATDDGMIIEGPTPLKGGVTVSSHGDHRIGMAMAIAALLAEKPVTVEGTEAIAVSYPSFFDHLDRLKSE

SEQ ID NO: 17243 - protein, 264 aa, Bacillus halodurans
MIKVAVAGPRGKMGREAVKMIHEADTLELVAVVDSKHDGMLVRQLDGLPPSDAPVYNELERCLTSQTIDVLVDLTTPAHGKRHMEIALDHGVRPVVGTTGFTDEDITNLRKKAEEKGIGAIIAPNFAIGAILMMKFAQTAAKYLPDVEIIEMHHDRKLDAPSGTALKTAQLISEVRKAKQQGHPDETEELKGARGADFEGMSIHSVRLPGLVAHQEVLFGGVGQTLKIRHDSMNRESFMPGVKLSIETVMGIDTLVYGLENIIE

SEQ ID NO: 17244 - protein, 375 aa, Bacillus halodurans
MKRKIGISCYPTVGGSGVVATELGKLLAEKGHEVHFITSSVPFRLEPVNPNIYFHEVEVNQYSVFKYPPYDLTLSSKMAEVAKRQELDLLHVHYAVPHAICAILAKQMVGDSLKVVTTLHGTDITVLGYDPALAEIIKFGIEKSDLVTAVSDDLVKQTKTLLHTEKPIETVYNFVDPREYYRKDVSELKATYGIGEDEKVVVHVSNFRRVKRVPDIIRCFRIIREHVKAKLLLIGDGPDATLACHLIKELDLKDDVLMLGNQKHIPELMSLSDVMLLLSEKESFGLVALEAMACGVPVIGANIGGIPEVIVDEETGYICEIGDIQGVAQKAIELLTNKRRHEMFAEASINRAATVFSSEQIVRQYEDLYEQLLSE

SEQ ID NO: 17245 - protein, 395 aa, Bacillus halodurans
MELAKRVSTLTPSSTLAITAKAKELKEQGHDVIGLGAGEPDFNTPQYIIDAAVRSMEEGHTKYTPSGGLPKLKEAIIEKFKQDQGLTYTAKEIFVGTGAKHVLYTLFQALLNEGDEVIIPSPYWVSYPEQVKLAGGEPVFVEGKESNDFKLTPAQLEPVLTDRTKAIIINSPSNPTGSLYTQEELAALGEVCLKHNVLIISDEIYEKLVYDGAKHTSVAEISPQLKENTVVINGVSKSHSMTGWRIGYAAGPEALIQAMTNLASHSTSNPTTSAQYGAIAAYTEDDGSVEKMRVAFEERLHTIYDKLVAIPGVSCVKPKGAFYLFPNVEEAAALTGHETVDDFVKVLLEEEKVALVPGSGFGAPDNVRLSYATSLELLEAAIDRIFRFVEAKRSK

SEQ ID NO: 17246 - protein, 283 aa, Bacillus halodurans
MKQYTVSLDWLSEHLEGVKVVDCRFSLQDSADGLRRYQDGHIQGAVYFDLVHDLSGTVQDHGGRHPLPEVDTFLEKVEAAGIDHETTVVAYDDEGGPFASRFWWLLRYLGHENVYVLDGSFSEWQAVGYPVDRNIPMYAKTTMDVKVKPERLATYTYVKQNLSDPAVHLIDAREPARFLGKVEPIDKKKGHIPNAKNRFWQDGLNGKKRKSAKEQAERFADLPKEDEVIVYCGSGVTACPNVLTLEELGYKRVRLYVGSWSDWISHDESEIATGEEGERTRDK

SEQ ID NO: 17247 - protein, 398 aa, Bacillus halodurans
MNPHMMMNDKALGTKAVWAGERSFLAHGATQVPVVHSVSFGYDDVDEWYEVATGKKDGHIYGRNTNPTVQAFEEKVRELEFAEAATSFATGMAAISNSLLTVLKPGDRVVSIKDTYGGTNKIFSEFLPRLKIEVTLCETGDHEALEREITKGCTLVYLETPTNPTVKITDLERITSFAHEHNALVFVDNTFATPINQNPLLTGADLVVHSATKFLGGHADALGGVACGNKELVSAIYHYREINGATLDPMAAYLLLRGMKTLKLRVEKQQENAMKVARFLTEHDKVRAVYYPGLETHPHHEVAKRQMRGFGGMLSFALKGEMEAVRKFLPALTYANRAANLGAVETTVGPARTTSHVENTPEERAALGIPEGLVRYSAGIEDAVDLIEDLSQALDSIT

SEQ ID NO: 17248 - protein, 342 aa, Bacillus halodurans
MTQKVALIGFGGVAQGFIQILRERGEELPEHIQVVSITDWRRGAVHDPNGLDLDFIAKIIETDGTFEHYPERSGVIKGWNSFETIQQTNADTIVEVTFTDVLTGQPAIDHCKEALRLGKHVVTTNKGPIAVAYQELKELADANGVQLLYEGTVMSGTPALRLPEHTLIGNNIQEVKGILNGTTNYILTEMERGKTFEQALQDAQTLGYAEADPTSDVEGYDVLYKVVILANVMMGIPLKPSDVERVGISHLTPRDIKDAHSAGERWKLIGRVKKEGERTMATVRPERLPLTDPLANINGAINAITYECDISGPITLIGAGAGVKETGFALLIDLLHVNRLGE

SEQ ID NO: 17249 - protein, 482 aa, Bacillus halodurans
MHTQVVQERMLISDQWQHGQQSIEVIDPGTNHVIATVPAATEADAKAAIEAAKEGAEIARQMPIHERAAILKRTAEIVTRDRELFAQTIAKEGSKTIREARSEVRRCIETLTLSGEEAKRLHGETIPFSQMPGHERRVGYFYRFPIGIIVAITPFNDPLNLVAHKIGPAIAAGNSLIIKPSSFTPLSALRLVKALEEAGLPKKIVQVITGHGSVIGPTLTKHRDVRLISFTGGYETGEKIARSAGVKKLAMELGSNSPTIVLQDAELMEAVASCVSGAFCAAGQNCIGVQRIYVEQSVFNSFIQSFVAQTKQLRLGDKQSEETDIGPMISEKEAKRIERWVEEAKEEGARVLTGGRRTGAYFEPTVLTNVSPSSRLAKEEAFAPIVIIEGVHSLTEAIARANDVDFGLQAGLFTNNLTAAFSAIEKLEVGGIMVNDSSDVRIDAMPFGGIKKSGLGREGVRYAIEEMTEQKVVAFHLPEHKI

SEQ ID NO: 17250 - protein, 295 aa, Bacillus halodurans
MNIGRIVTAMVTPFNEQDQVNLEATCQLVNELIANGSDALVVGGTTGESPTLTTDEKMALFHTVVEAAGGRVPVIAGTGSNNTRASIELSKKVEDLGVDGIMLVTPYYNKPSQEGLFQHFKAISESTSLPIMLYNIPGRSGVNLDAETTLRLAELRNIVSIKEASGNLDQIAEIIEHSPADFSVYSGDDSLTLPLLSIGGTGVVSVASHIIGNEMQEMVQLFLSGQVERAAAIHRKLLPLMKTLFMTPNPTAVKAALELKGLPVGHVRLPLVPLTAEEQRQLELAINPQFNMFVS

SEQ ID NO: 17251 - protein, 337 aa, Bacillus halodurans
MKTVEQTSPTMTSEKARWIYQKMVEIRMFEDRVHDIFSKGEIPGFVHLYAGEEAIAVGLCAHLDHNDYITSTHRGHGHCIAKGCELDGMMAEIYGKSTGLCKGKGGSMHIADLDRGMLGANGIVGGGFTLAAGAALTAKFKQTGGVAVCFFGDGANNQGTFHEGINLAAIWDLPVVFVAENNGYGEATPFHYASACEQITDRAKGYNIPGVKVDGKDVVAVYEVAREAVERARRGEGPTLIECITYRNYGHFEGDAQTYKTGREKEEHTEERDAITLFEKYALSNNLLTEEAIQTVRHEVEQSVDRAVDFANASDYPQPEELLTDVYVSYDHEGRNG

SEQ ID NO: 17252 - protein, 344 aa, Bacillus halodurans
MTRKISMSNAINEAMQLAMRQDEHVILLGEDVAGGAEVDHLQDDEAWGGVFGVTKGLVQEFGRDRVLDTPISEAGYVGAAMAAAATGLRPIAELMFNDFIGSCLDQVLNQGAKLRYMFGGKAQVPVTIRTMHGAGFRAAAQHSQSLYAMFTAMPGIKVVVPSTPYDAKGLLLSAIEDNDPVIFFEDKTLYNTMGEVPEGHYTIPLGKADIKRRGDDLSVVAIGKQVHTALTAADLLAKKGIEVEVIDPRSLSPLDSETILTSVEKTNRLIVIDEANPRCSMATDIAALVADEGFDFLDAPIKRITAPHTPVPFSPPLEDLYLPTPENVIQAVSELLGNSSLQSV

SEQ ID NO: 17253 - protein, 410 aa, Bacillus halodurans
MAVEVVMPKLGMSMKEGTISVWNKKEGDMVAKGEAIVSIQSEKIETEIEAPADGTLLKVVVQEDQSVPPGTVIGYIGEPNEQLDQSKSLEKQQADSHAEKATEGAVFDVEKPSSKGATVSSSPVARKMALKAGINLENIVGTGPGGRITKADVEKAIAEQRVEPSEAKRSNSDVTEKGMQDGAKITPASAMRQVIATRMHGSLMQSAQLTMNMKADVTDLMALREEVNHTVQTRYGMKLTVTDFIARAVVLALQEHSNMNSAYIDEHIVTYEYVHLGMAVSLTQGLVVPVVQHAEALSVVELSKQIKSLSEQARTGKLQSDQLTGSTFTVTNLGVYGVDHFTPILNPPEAGILGVGAATDAPVFQGGDWQTRAMLPLSLTFDHRIVDGAPAAEFLQTIKQFLEKPTHLLL

SEQ ID NO: 17254 - protein, 459 aa, Bacillus halodurans
MDRVAIVGGGPAGYVAAITAAHRGKQVTLIEQKKLGGTCLNEGCMPTKSLLESAATYDKVKHASDYGIKGPVDEMRIEWGQVQARKNQIVHQLVKGIDYLLKKHKIELLEGTASFQSAHELLVQTERGQQTIEANRIIIATGSEPTPLPFAPFDREWVISSEQAMSLPIQPESMIIVGGGVIGCEFASIYGRMGTKVTIIEMADRLLFGEDHDICKVLMEELKRQGVEIYPSTVIKEMQRDRKQVVVERDGQVEVLTGDYVLVAIGRKPRLQEIGLERIGVDFTSRGITVNEHMQTTIPHIYACGDVIGGIQLAHVAFHEGSVAAKHLCGEPIQVRYEAVPRCIYTSPEIATVGLTETQARENYGHVRIGEYPFAANGKALIVNETIGKVKVVVEPEYEAIVGLTIVGPHATELIAQGTLMVHNELTLDSLESFIAAHPTVSEAVHEAVLQALGQAVHV

SEQ ID NO: 17255 - protein, 764 aa, Bacillus halodurans
MNSLKVAVTGIGILTSIGHNKEEVFQNMLDNQTGIGPIQSFDVQEFISQIGAEISSFQPSDHFTPEEQKGLDRCAQYAVVSIKEALEEARVDQTVEKTIGLAFGTCNGGLNSLEEQRALQELDLEKTRNYLFYQQGDAVAKYFGLTGPVITLNTACAASGNAIGYACDMIRHGFADVMIAGGSDSMSTSVYAGFNALKALNDQPCSPYNEQYGLSLGEGSAFLVLEPLEKALARDAKVYTVVEGYGLSSDAYHETAPQPEGQGIRKAVEMAIEQGNISKDEIDYINTHGTGTKANDPAELRGLRAYFGKQFDNIYVSSSKAYFGHNLGAAAAIEYATTLLALEQGLLPATLHFSQAREGCNHQKLVTNEMKSYKPKYFLCNNSAFGGHNSSILSKNVYHPAFSPATITTSSAEEKKRIGVYGYGTIHRLADHDGTLLSNLHQDSPTTFQLDFSLKEYNRSLYERRMNPLTQYSIAACDLALKNTSLSNIDNEQIGLVYGTSRGSLKSAEKYLGSILERGAGNASSVYFPDMVLNSTAGKLAKKFGIKGFSSSHSSGGIDGLQAILYGMTSILDGKQSTVLVGAGDERSGLSDEIDRAMNLQNSSYEIGEGSTFLLLADTKVAEEKGLDPIATIEGFGQAFSGQNDMDQTIQHAVEQCLQNANLSEDEIDFIFYHNNNVTDIDAFLQLKERLGHIPVYTLNHLCGYMESNGSLFHAQVALELLALPKEEQQSMIHAFGWPKNDLRTGLIITTSINGNSMAMAIRK

SEQ ID NO: 17256 - protein, 247 aa, Bacillus halodurans
MLLRDKVAIVTGATRGIGKEIVKTFVEQGAFVYGIYASNHEAAREIEKTLNQGEKCVSYVSGSVDDQLFIHSLFKSVVDKHNRLDILVNNAGITRDQFLFQMDDQSWQQVLQVNFGGTYTCCHAALPYMERKKQGKIVNVVSVTGVVGREAQTNYGASKGAIIGLTRLLARKYSEKGISINAIAPGMIETEMIKQVPEEKLKNFLRFTNAKKLGSTKEVARNVLYLSSDLSDYVTDTVLKVDGGFLR

SEQ ID NO: 17257 - protein, 237 aa, Bacillus halodurans
MNILVSNGEEHVNQTIASFFHQRGDRPILLFTEKEKHLEYVAGHPEQEAVLCTTYEEETLAAMVKEAFEEEAIDVLVHGNEMVNEAELLERDPSSLNEVVQKALYHLFLLNKVVVRDMVKRKQGKIIFPLFYDPLYYAGYASSPILNQAKLSLMKCMSRELGAFKINVNSITFGYYNDQFTREEKKATKSQVEIFCLKPKLPEIEEYVHSIGLLVDPSASLIGGENLHVGAGIETGI

SEQ ID NO: 17258 - protein, 369 aa, Bacillus halodurans
MLVQELKPESKATVSPRIIGFGECLPGEPVTNEQMEQLLSIRKEWLETMIGNRSRHFAVNFSSRTIDYGLADLCTEAAVEAIDDAGINAEELDLIVLSTATPDHLMPATVNIVADRLGLERVKTYQIQAGCSGALQALDVARHMLVGSHRYALVIGGDVCNKYMDLSRDFSKLRSSELINYALFGDGAGAVVLTNENQDGLQISYIENRFEGKGRAPGQIMNWFGTVPENVQELSKRELRKQFQSAKEDYKAIEQHVPIMTEQAIEELLGQMKWTKEEVSYYLPPQLGWNMTKKIIDLLGLPLDSTINCVQETGNNGNALPYLQLKRLNGILKPNDKVVGVAIESSKWMKTGITLEYKKGEALDGTRDS

SEQ ID NO: 17259 - protein, 498 aa, Bacillus halodurans
MGRRPKKSSYDVVVIGAGMGGLSAATFLAQEGYSVLVLERHYRAGGYAHSFRRRKFIFDSAVRIAAGAMDGGLLEELLQEAGVSQDVEFLHLEDIYTAYYPNRKITVKGSVEGLIEAYCEEFPHECHNIRALVQEMEKLYEVTLMLLHSGDPLKVLSNPLMLKYRDKSFHDLTSSFLQDPQAIHSFAALWAYYGTPPTQGSAMFFAYAIMSYFKEDIYYAKGSFQSLADAFVKRIESLGGEVCLRNEVQRVEVEDRQIKGVHLQTGEYVEAEKVVCNGDFLKLVQHLVGEEHFPARYLKRISKLKPSISAFEVFLGVDLPLEKQGLSHETFIYNDYDYDLFMEKHQSLGEIGASGLSGLAISIPSLVDSSLAPEGMHTAILTTLVPYDIGCDWKEKKEDYQDQLIKMAERAIPNLGRHAVHVESGTPLTMERYTNNSFGSIYGWEQTKNQMTGRPQHETPIKGLYLSGQWTDPGGGIVSAILSGYKLRKKIMKEQVVM

SEQ ID NO: 17260 - protein, 319 aa, Bacillus halodurans
MNRGVICLGEALIDFIPMDSTNEIYQKSPGGAPANVAVGLAKLGAKSTFVGKVGDDLLGRFLKETLTKANVNTEHMLFSKEVRTGATFVTLAANGERSFDFYINPSADRFLEKGEIAPTLFEEHGVLHFGSISLISEPARTATRHAVSLAKKNGLMISYDPNLRLNLWEDEEQARLLITSMLGEADVLKISEEELAFITGEQTIEAGLDQLVAYNIPLVFVTLGEKGSIVSYNGIQRKIPAMAVQTVDTTGAGDAFVSAILFKLQEERKQVAELSIKEVEQMARFASVSGGLAAATKGAMTALPTLEKVNDILRNEQME

SEQ ID NO: 17261 - protein, 487 aa, Bacillus halodurans
MTNRDQELRQKAKETIKRYERLVERDPYRLVYHLMPPVGLLNDPNGFIDWDGTYHLFYQWHPFEAAHGPKFWGHFVSGDLVFWEEKEPALTPSDWFDKNGCYSGSAVADNGKLKLFYTGNVKNENDERESYQCVAESEDGLTFTKKGVILHVPDGYTAHFRDPKVWKRDGIWYLVIGAQTKQIDGHVLLFRSDDLKEWQFAGIVTGSNVRSMGDFGYMWECPDLFHLDGEDVLLVSPQGLEKQGYLYHNVHNTGYFIGRLDYETGELVHGPFKELDRGFEFYAPQTTIDRYGRRILFGWMGVPDQGEEKHPTVKHQWIHAMTLPRELKLVDGKIYQRPVEELKQLRKNEVSRPSVKISEHPQRFEEISGEAFELLLDVEENQAEVFELTIRDNVRVIFNRGLKRLTLERVSFVDGLTESRHCELAELSSLHLYVDTSAVELFVNEGEEVFTARYFADPANRSIQFKTLHGSLTASLKKWALDSIMKK

SEQ ID NO: 17262 - protein, 500 aa, Bacillus halodurans
MTLTATMVVDKSFKIGEIDKRIYGSFIEHLGRAVYEGIYEPGHPDGDEQGFRKDVIRLVQELQVPLVRYPGGNFVSGYNWEDGVGPVSERPKRLDLAWRTTETNEIGTNEFVDWAKKVGAEVNMAVNLGSRGVDAARNLVEYCNHPSGSYWSDLRISHGYKDPHNIKTWCLGNEMDGPWQIGQKTAEEYGRVAAEAGKVMKLVDPSIELVACGSSNSKMATFADWEATVLDHTYDYVDYISLHTYYGNRDDDLANYLAQSMDMDEFIRSVIAIADYVKAKKRSKKTIHLSFDEWNVWFHSNEADRQITPWSVAPPLLEDIYTFEDALLVGSMLITLLKHADRVKIACLAQLVNVIAPIMTEKGGPAWKQTIFYPYMHASVYGRGVALQAQISSPKYDSKDFTDVPYLDAAVVHLEEAEEVTIFAVNKHQTESLNLQCDMRSFEGYHVLEHIVLEHENMKATNQGREQVTPHHNGDSAIDQGRLTANLAKLSWNVIRLGKK

SEQ ID NO: 17263 - protein, 399 aa, Bacillus halodurans
MNHLLKQAKRVASECECGHEHQWIEMDELQLGRNAINYLPEYLHEKGLLHVTIVADANTYAVAGQLVAQLLKGRGIDVENCILKEQGALTLLADEHGLGQLVIGAAKETDVFLAVGAGTIHDLTRIASYKFGKPFIAIPTAPSVDGFTSMGAPVIRDGVKITFQTQAPIALFADLDFLTQAPRSMVAAGFGDMLGKSTSLVDWQVSHMLNDEPFCPAVFHMTKSALTMCMEHADEIAACNEQGIRLLTEALIMSGLAMLIFGHSHPASGAEHHLSHYWEMAFLRSGGTQPLHGAKVGYATMLISALYKNEARKKIETFQGEGSPLVNSIHKHRERLLMLIDTIPESSDIQRLLESVGGAVKSADLALADSLEDEALEKAHKLRERCTLLYCLNEHLKTS

SEQ ID NO: 17264 - protein, 432 aa, Bacillus halodurans
MEVNRLSALTPPMGWNSWDCYGASVTEEEVLGNAEYMANHLKKYGWEYIVVDIQWYEPTANSSAYNPFAPLCMDEYGRLLPATNRFPSAKNGAGFKPLSDAIHDLGLKFGIHIMRGIPRQAVYENSPVLGSTKTAREIAHTNSICPWNTDMYGVDPTKEGAQSYYNSLFELYAQWGVDFVKVDDIAASRLYDTHLEEIKMIQRAIQACGRPMVLSLSPGPAPIKYAHHFKTNANMWRITDDFWDDWSLLYQMFERCEVWEKHIGTGHWPDCDMLPLGHIGIRSVDGPGGDRWTRFTKDEQLTMMNLWAICRSPLMFGGELRDNDEWTLSLLTNEGILSINQKSVLNRFVYREEDKVAWAANGRNGEAYVALFNLHDQQKTLQFRLDMVGIMETVQLFNVWDRSFLQSLAPSESFQIELKPHQSMMLKLSPDR

SEQ ID NO: 17265 - protein, 563 aa, Bacillus halodurans
MTTKYTIGVDYGTESGRAVLIDLSNGQELADHVTPYRHGVIDQYLPNTNIKLGHEWALQHPLDYVEVLTTSVPAVMKESGVDADDVIGIGVDFTACTMLPVDEEGQPLCLLAQYKDNPHSWVKLWKHHAAQDKANAINEMAEKRGEAFLPRYGGKISSEWMIAKVWQILDEAEDVYNRTDQFLEATDWIVSQMTGKIVKNSCTAGYKAIWHKREGYPSNEFFKALDPRLEHLTTTKLRGDIVPLGERAGGLLPEMAEKMGLNPGIAVAVGNVDAHAAVPAVGVTTPGKLVMAMGTSICHMLLGEKEQEVEGMCGVVEDGIIPGYLGYEAGQSAVGDIFAWFVKHGVSAATFDEAQEKGVNVHALLEEKASQLRPGESGLLALDWWNGNRSILVDTELSGMLLGYTLQTKPEEIYRALLEATAFGTRAIVDAFHGRGVEVHELYACGGLPQKNHLLMQIFADVTNREIKVAASKQTPALGAAMFASVAAGSEVGGYDSIEEAAKKMGRVKDETFKPIPEHVAIYEKLYQEYVTLHDYFGRGANDVMKRLKALKSIQHRPSSLLT

SEQ ID NO: 17266 - protein, 497 aa, Bacillus halodurans
MLQTKPYTFWFITGSQHLYGEDAIEQVRQHSQTMVEKLNKIGELPYTIELKEVLTTPDAIRKMVIAANSDDDCAGMITWMHTFSPAKMWINGLKQLKKPLLHLHTQFNREIPYDDIDMDFMNLNQSAHGDREYGHIGARLNISRKVIVGHWQNNDVQERLGAWMRTAAAFVDGHHLKVARFGDNMREVAVTEGDKVEAQIQFGWSITAFGIGDLVEKMKAVSEDEVRRLFDEYQELYRLSPSILEQDEVKAAVLEQAKMELALKEFLEEGGYTAFTTNFEDLHGMKQLPGLAVQRLMAEGYGFGGEGDWKTAALLRMMKIIADGKGTSFMEDYTYHLAEGNELVLGSHMLEICPTIAANQPEIQVHPLGIGGKEDPARLVFDGADGPALNASLIDLGHRFRLVVNEVEAIKPERDMPKLPVAKVLWKCKPSLSEATEAWIHAGGAHHTVFSFEVTPEQLYDWATLADIEVVFINDKTDVLQFQQQLQWNEAFRRLFK

SEQ ID NO: 17267 - protein, 498 aa, Bacillus halodurans
MKQSIKVYTDLEHGKISKHIYGHFSEHLGRCIYEGLWVGEDSPIPNTEGIRNDVLGALQELNIPVLRWPGGCFADEYHWKDGVGPRENRKRMVNTHWGGVVENNHFGTHEFMRLCELLGAEPYICGNVGSGTVQEMQEWVEYMTFDGESPMANWRTENGREEPWALKYFGVGNENWGCGGHMRPEYYADLYRRYQTYVRNYGDNKIYKIAGGANVDDYRWTEVLMREAAHLMDGLSLHYYTVPGDFWENKGSALDDRESEWFKTLKKSFRMDELLTKHSTIMDRYDPEKRVGLIVDEWGTWFDVEPGTNPGFLYQQNTIRDALVAGVHFHIFHEHNDRVHMANIAQMVNVLQAMVLTEGEQMLLTPTYHVFNMYKVHQDATRLEVNADVGTYKFGDDELPAVTVSASKDNEGAIHVSVCHLDPHRDTDLTLKLNGLNKSLSASSVSGELLTANELNAHNTFERPNEVEPVPYEPASVSGHEMELKVPASSVLRVTIRP

SEQ ID NO: 17268 - protein, 773 aa, Bacillus halodurans
MKFSDGQWLTRQEYTIIGAVQVHEIIQGEASMTVLASPKPIVDRYGQLDTPLLEITFSAPRREMIRVQIDHHKGGRKRGPVFTTKHDHKHQASFTETETTAILTSGDLSVTVHKEGDWLITFSYQGKTITSSGSKSIAHILAQDGKAYMREQLSLQPDEMIYALGERFTPLIRNGQVVDIWNKDGGTNTEQSYKNVPFYLSNKGYGVFVNHPEWVSFEVGSESVSKSQFSVEGHRLDYYVMAGPSMKKVIEAYTDLTGKPALPPAWSFGLWLSTSFTTNYDEATVTQFIDGMNERDLPVHVFHFDCFWMKEFEWCNFEWYRRVFPEPEKMLQRLKEKGLKLSVWINPYIAQRSPLFQEAAANGYLLKKENGDVWQWDLWQPGMGVVDFTNPDARIWYQDHLRRLLEMGVDCFKTDFGERIPTDVVYHDGSDPEKMHNYYTFLYNQTVFDVLKQVKGNHEAVLFARSATAGSQQFPVHWGGDCAATYSSMAESLRGGLSLGMSGFGYWSHDIGGFESQSTADLYKRWTAFGLLSSHSRLHGNKSYRVPWVYDEEATDVLRQFTKWKCRLMPYLYAKACEARTTGLPLMRAMVLEFQDDPTCAFLDRQYMLGDQLLVAPIFNEEGLAHYYVPDGRWTNLLTGKTVEGGSWKKEHHDHLSIPLLVRPNSIVPIGSVDDRPDYDYTDNVAFHVFALENYATTSIYTVEGEEALTLSATRSTTTVTFDISDGSKPWTVHLHDVTEVSSVEGADFEISDGSVILHPILDVKQVVVHLGV

SEQ ID NO: 17269 - protein, 447 aa, Bacillus halodurans
MSIIQFPKEMKWGVATASYQIEGAINAGGRGASIWDVFAKTPGKVKNGDNGDVACDSYHRYEEDIEIMKDLGVDMYRFSVAWPRIFPNGTGEVSREGLDYYHRLVDRLTENGIQPMCTLYHWDLPQALQEKGGWDNRDTIDAFVRYAEVMFKEFGDKINHWITFNELWCVSFLSNYIGVHAPGNTDLQLATNVAHHLLVAHGKAVQSYRKMGLDGQIGYAPNVEWNEPFSNQMEDAEACKRGNGWFIEWFMDPVFKGAYPSFLVEWFEKKGITVPIEAGDMETIQQPIDFLGINYYTGSVARYKENEGLFDLEKVDAGYEKTDIGWNIYPEGFYKVLYYITEQYGQIPIYITENGSCYNDEPVNGQVKDEGRIRYLSQHLTALKRSMESGVNIKGYMAWSLLDNFEWAEGYSMRFGIVHVNYRTLERTKKDSFYWYKQMIANQFFEL

SEQ ID NO: 17270 - protein, 538 aa, Bacillus halodurans
MMNSPLLLSHFIERAERYFPTKQVISRTLNGKKSLTYQQIGERTRRLASALAQFGIKKGDRVGTFAWNTHRHLEAYFAIPGIGAVLHTINLRLSQDHIAYVINHAEDRVLFVDADVWPLIAQLRDQLSSVEAFVLMSDGELPEVDWPNVFSYEEFIAKGDPSFEFVQSIDETSPAGICYTSATTGKPKGVVYSHRGIYLHSMALGLADTAGLSEKDVLMPVVPMFHVNAWGLPFAATWFGTTQVMPGPQFTPQVLAELIDEEKVTLAAGVPTIWLGLLRELETGVYQTEHLRAILCGGSAAPAAMIQTFEQKYNVPFLHAYGMTETSPLVTVSMVKSYQADLNEEETLELRAKQGLVVPGLEVKVVGPNGEVKPDGAEMGELLIRGPWIADHYYKAEEVSDAFADGWLHTGDVATIDEEGFIKLVDRTKDLIKSGGEWISSVDLENAIMAHEDVFEAAVVSVPDPKWQERPVACVVLKDPNKGSVAEADIRRFLEGKFPSWWLPDRVIFMDELPKTSVGKFLKRALREQVKEQMEANR

SEQ ID NO: 17271 - protein, 408 aa, Bacillus halodurans
MKAIQFDLSIPKYALSKAMGKMNSSLYVESPFSCLQLRDVEKPALPNDHWVEIKVKYGGICGSDLNLIFLNDSPATSPFVSFPFTLGHEMVGTISKARKSVTNLQVGQRVVIDPLLSCEVRGITPVCSECANGNYNLCHHMNDGDIAPGLLTGTCKDTGGSWGRYLVAHQSQVISLPSSVDDDNGVLVEPFACALHAVLQNRPKPSDTVFVIGSGVIGICVIAAIRALEIPCKIVTLAKHPFQAELAKQFGADEIVFLSRKRDYVTAVAESFNANVLHPVFGEPIVHGGADIVYECVGNRKSLHDSLRFARKGGKVVLIGLASFIDNLDMTMIWLNELEVKGSFTYGMEDWQGGKKRTLQIAVDLIADGKVDLSPLITHRFPLEAYREALATAANKKKGQTMKVVFEP

SEQ ID NO: 17272 - protein, 374 aa, Bacillus halodurans
MERGPLIFSASIGNGHNQAAKALQVEFQNKGYQPEIIDTFYSLSPALHKFMLTSYVNLLKVGPRIWQKIYFQAEKYPLFLFLDQFATFFVESLHATVKSNRCSFLVSTHPFVTAFLVRLKSKKQLNLPLYTVITDFVLHPAYLRPEIDGYFTSDPNFTDFAKLNNVSDDRFFPTGIPIPNLESIDQPKWKVRNDLGLDPQRKVLIIAGGGIGLTNYAQVIRALECLPEPIQLLCMIGHNYQVKEKISRIKSKHELKVIEFTDKFLLYLKASDAILSKAGGLTMAESLVCETPIIIHQPVPGHEEHNAKFLIDAGAALRVKGSKEIPTTIKRVLYEEACFGPMIENARKLKKPNAANEIVEQMLLLVKEQQHAFR

SEQ ID NO: 17273 - protein, 711 aa, Bacillus halodurans
MDKDQQGTESSENKKNEQLEPFKVDHKNTKLTTNQGVRVSDTDDSLKAGDRGPTLMEDFHFREKMTHFDHERIPERVVHARGFGAHGYFQVYEPMTEYTKASFLQDPNVKTPVFVRFSTVVGSRGSADTVRDVRGFATKFYTEDGNYDLVANNIPIFFIQDAIKFPDVVHALKPEPHNEIPQASAAHDTFWDFVVSNTETAHMIMWLLSDRAIPRSFRMMEGFGVNTFRFVNEQGKARFVKFHWKPKLGVHSLVWDEAQKLAGKDPDFHRRDLWEAINMGEYPEYELGVQMIEEEDEFSFDFDILDPTKFWPEEMVPVKLIGKMTLNRNQDNFFAETEQVAFHAGNVVPGIDFSNDPLLQGRLFSYLDTQLLRLSGPNFHEIPINRPIAPVNNNQRDGFHRMTIDKGAVSYSPNTLRNNSPEPASDQEHGYVHYMEKVEGQKIRRRSESFNDHFSQATLFWNSLSTAEKQHLIKAFHFEVGSVKDKNLKQRVVEMFNQVDGKLAAEIAKGIGVNPPTTPGGTGVTASSPAVSQENTIKLARTRKVAVLIDHGFAFDEVSQVVTALQSAGLGVDLVSKQLGMISSAEGEQLEANKSFATTGAIMYDALYIGGGAQSISSLNLYSESKTFVDEAFKHAKTIGATNEGIELLIAAQVQGITFAGPDSNDHVVNDLGIITIQTDKDFKAFTDEMIHAIAQHRHWMREFKDGKLSG

SEQ ID NO: 17274 - protein, 511 aa, Bacillus halodurans
MTNLKLLDGRSLSLHDLHRIIYEGETVGASDESMEKVKQSRKAVEQIVADEKIIYGITTGFGKFSDIFIDPDDVENLQHNLIYSHACGVGSPFPETVSRTMLVLRANALLKGFSGVRPLVIERLLALVNANIHPVIPQQGSLGASGDLAPLSHLALVLLGEGEVFYKGTKTKASFALKEEEIEPITLTAKEGLALINGTQAMTAMGVIAYLEAEKLAFQSEIIASLTMEGLRGIIDAFDEQIHFARGYVEQVDVARRMESYLQDSQLTTRQGELRVQDAYSLRCIPQVHGATWQTLRYVKEKLEIEMNAATDNPLIFDNGQKVISGGNFHGQQIALAMDFLGIAMAELANISERRIERLVNPQLNDLPPFLSAAPGVQSGVMILQYCAASLVSENKTLAHPASVDSIPSSANQEDHVSMGTIGSRHAYQIIQNVRNVLAIELICAMQAVDIRGREKMASFTKKILEKGREHVPYIDQDRMFAKDIERAAKWLKDGSWDFTKMREKERTNHY

SEQ ID NO: 17275 - protein, 319 aa, Bacillus halodurans
MKGYPFLDKANAPFVDRHVTKAGEIFYPWDGKRIDGFGLIGAPLSKSSISHSGASFAPTVIRKCLHAFSTYSVEEDLDLAQLKLTDLGDITMHVTDIVGSQARIEETMTKLLENEQNWQPIVLGGDHSISFPSIKAFASAKGTIGVIQFDAHHDLRNLEDGGPCNGTPFRSLLETGSLVGEHLVQIGIRDFSNSYPYRKYAEKHGVKVYTMKDVNARGLLTILDEAVAKLKRSVDVIYVSVDMDVLDQAHAPGCPAIGPGGMDSTTLLQGIFHLGKDSLVQGMDIVEVDPTLDFREMTSRAAAHVILNYLKGKCIKSIG

SEQ ID NO: 17276 - protein, 287 aa, Bacillus halodurans
MTIHTVGVVGAGTMGSGIANLAAMSGLQVVLLDLDDNQLDIAWQKINTFMEKSVAKGKMSEAEKEAALGRIKSTTTYEELAEADLVIEAVIENLDVKKEVFHTLDTCLANDTIIATNTSSMSITEIAAATNRPDRVVGMHFFNPAQLMKLVEVVRGYQTSDDTVETVKQFARQLKKEPIEVKKDTPGFIVNRIMIPQFIEAIKLLEEGVASAEDIDKAVTLGLNYPMGPFTLQDYAGVDIGLHVMEYFQQEFNDPRFTPPLLLKQLVRAGRLGKKVGAGFYDYDNER

SEQ ID NO: 17277 - protein, 392 aa, Bacillus halodurans
MKDVVILDGARTPFTSFGGSFREVSAIELGVAAAKEAIKRANVDPEEVDQTIVGNVIQSSSDAILMGRHVGLKAGVRTETTGLTINRLCGSGLQSILTAAESIRLGNSEVALAGGAENMSQIPHVIRGARWGLPLGQAKMEDYLWEALYDPYCDCTMAITAENLAEQYQITREEVDMFALRSHRLALESMRDGTFAKEIVAVNVKTKKGERMIDKDEHPRETTLEKLRNLVPRFKESGVVTPGNASGINDGAAMMIVSSMDYAERRNLKPLARLVSYAVVGVEPSIMGIGPAPAIQEALRQASMKIEDLDLVEINEAFAAQYLACQQELDFNPDIGNVNGGAIALGHPLGASGARITLSLIYELARRNKKYGVSAVCIGGGQGIAAIWERLH

SEQ ID NO: 17278 - protein, 513 aa, Bacillus halodurans
MLEKDYSVFPLLYQAVQANPKKEALYDLNERITYEQLLERVNELAAIFIEMGVVKGDRIGVCLPNWNETVIIFFAAAKLGATVVPFNPNYREYEIAYIVANAAPKLLFVCEKVEENVGLAALVADQRQLISVRFKSPFAIPFEQLKRTNKSAIDVSIVPSHERYCILYTSGTTGLPKGVMITHSSVVQSGLALARSLKCTKDDVFIVPAPLFHIFGMACNLMAAVSCQAKVILQEKFKPDHTLALIEQEKVTIHQAVPTMFILELNHPDFSTFDLSSLRAGMVGAAPCPKETVQEIRKRMGFHLCISYGMTEVGAATITPYEDEDESSLDTVGKPMEGVEITIVNEDREPLPVGDIGEIAIRGFGNMIGYYKLPEQTNEVLGDNGWFYTGDLGSLDEEGYLRFIGRKKELIIRGGYNIYPQEIEAILSEHEKVQESAVIGLPDEVLGELVCAGIKLKQGAHSSEQELLAYLSKRIAHYKVPSKIVFVEELPVTASGKVQKSQLREQIIETIKS

SEQ ID NO: 17279 - protein, 485 aa, Bacillus halodurans
MEAIYTRQFLAGEWIEGASTQTITNYNPYTGEKIHEIKGASLDDLDQAYRAAKNAQKEWEQTLPAQKQEVLEKAAALLAERKDEVIERLVNEAGSSIIKASIEWGATLQTIKVAATFPLRMEGKILPSNIPGKENRIYRSAKGVIGVISPFNFPLVLAMRSVAPALATGNAVVLKCSSDAPITSGLLIAELFEEAGLPKGVLNVVVGKAAEIGDAFVTHPIPKLISFTGSTEVGRHIAQLAARELKETALELGGNNVMIVLDDADIEKAAEKAAVGKFLHQGQICMALNRIIVDASIYDSFVEVFKEKVSQLQTGNPAEPATLIGPLINYKQIGRIQQLVKESVAQGAVKVLEGHVQGNLMSPTILSEVTNDMPVAKEEIFGPIAPIIKAKDEAEAIAIANDSPYGLSGSIFTGSLHRGVQVAKQIDTGMIHVNDQPVNEEAHISFGGEKDSGIGRFGGEWVLDKFTTVKWISIQEKERVYPFWG

SEQ ID NO: 17280 - protein, 689 aa, Bacillus halodurans
MSIHGKTFVTKAKHMLHGGDYNPDQWLDRPDILADDLHLMKLSHTNTFSVGIFAWSTLEPEEGVYHFEWLDDIFENIHKIGGNIILATPSGARPAWLSQKYPEVLRVDENRVKQLHGGRHNHCFTSEVYRKKTQQINRLLAERYGNHPALLMWHISNEYSGECHCEKCQEAFRDWLKSTYNNDLDALNKAWWTSFWSHTYTEWSQIESPSPIGEKGVHGLNLDWRRFVTDQTISFFENEIVPLKELTPEIPITTNFMADTSDLIPFQALDYSKFAKHLDVISWDAYPAWHNDWESTADLAMKVGFINDLYRSLKQQPFLLMESTPSKVNWHDVNKAKRPGMHLLSSMQMIAHGSDSILYFQWRKSRGSSEKFHGAVVDHDNSPNNRVFQDVTEVGETLEKLAPVVGTNRTSEVAILFDWENHWALGDAQGFGMKSKRYPQTLQQHYRTFWERDIPVDVITKEQNFSAYRLLIVPMLYLANEETVARLKSYVANGGTLVMTYISGIVNEYDLTYTGGWPKDFQDIFGMRPLETDTLYPSDRNYVTYQDKTYPIKDYATIIDLESAQAEGLYKEDFYAKLPAVTSHSYKGGKAYYIGARLDDEFHRDFYSRLMTDLSLTSVLLVNHGPGVSVQARRDTVTDYVFVMNFTEEKQTVTIQSEVQDLVTKENVPAEFTLKPYEVKILVHSKSNK

SEQ ID NO: 17281 - protein, 394 aa, Bacillus halodurans
MTEEVVIASGVRTPIGRFGGHLKDLKAPTLGALVISEALHRAGVLNEQVDEVIMGNVLQAGLGQNPARQAALQAGLPETVPAMTINKVCGSGLKAVHLASQAIACGDAEIVVAGGMENMSQAPYLAVGARNGYRMGHHQLIDSMIHDGLWCAFNDYHMGITAENLCEQYGLSRTELDEFSAWSQEKAVQAIESGRFKDEIVPVDIPQRKGEPIQFDTDEYVKRGTTTETLGALRPAFKKDGKVTAGNASGINDGAAAVVVMSKEKAVELGIKPLVTVRANATAGVEPRIMGIGPVPATKKALTKAGLTMDDIDLIEANEAFAAQSLAVAKELSFAEDRLNVNGGAIALGHPIGASGTRIFVTLLHELLRRGETYGLATLCIGGGQGVATIIERA

SEQ ID NO: 17282 - protein, 657 aa, Bacillus halodurans
MFKIDGSRLVREYDSEKLWIEPWGKDALRVRASYTAIEDTDWALLPVKEMEADISLTEETATIVNGKIKAEVKRNGQITFYNQKGDVLLKETENTYQLKYGGRELTPYPGSSDYRLTLRLESNPKEKLFGMGQYQQPFLNLKGCMLELTHRNSQSSVPFVLSSLGYGFLWHNPAIGRVNFNLNVTEWMAPSTKQLDYWITAGDTPAEIEETYASVTGTVPMMPEFAMGFWQSKLRYQTQEELLEVAREYKRRELPISVIVIDFFHWPNQGDWKFDPEYWPDPASMVKELNEMGIEVMVSVWPTVQTESENYQEMIGKGYLVRSDRGVRTQFQFLGQNALFDATNPDGREYLWKKIKKNYYDKGIKVFWLDEAEPEFTVYDHDIYRYHLGSSLQIGNIYPSKYSQTFYDGMIASGQSEIINLVRAAWAGSQRYGALVWSGDIHSSFEVLAIQVRAGLNMAIAGIPWWTTDIGGFHGGNPEDPSFQECIIRWFQYGVFCPVFRLHGDRLPSQKPIGTTGGGQCPSGAANEVWSYGEEAYEIIKDLLHVRERLRPYITGLMKEAHVKGTPPMRPLFYDFHEDEHAWEVDDQYMFGPDILVAPILKEGERSRPVYLPKGADWSNPYSGQSFEGGQQITVDAPLKQIPLFLKNGADLPIVHR

SEQ ID NO: 17283 - protein, 310 aa, Bacillus halodurans
MLETINLCKTFKGQPAVQEVNMYLNSGESVGLLGPNGAGKSTTISMISTLIKPTSGEIKLNGINIISHPGDIRKILGVVPQELALYQELSAYENLKFFGSTYKMKGKHLENRIQHALEIVGLKDRQKDLVKTFSGGMKRRINIAAALLHEPKILILDEPTVGIDPQSRNHILETVRTLNENEGTTVLYTSHYMEEVEQLCDRLYIMDHGEIIAAGTKEELLSILSTEDTIKVELSKIDETFVQNVKMIEGVRKVEASHSQLKMIAKKGSHLIRELVHLTDQHQIQMIHFHTETPSLEDVFLHLTGRTLRD

SEQ ID NO: 17284 - protein, 458 aa, Bacillus halodurans
MTTLVREKQTYDVQYYVQHVYETVKRRNPNEHEFHQAVKEVFDSLLPVLVKHPQYVKQAILERIVEPERVISFRVPWVDDQGNVQVNRGFRVQFNSALGPYKGGLRFHPSVNASIIKFLGFEQIFKNALTGQPIGGGKGGSDFDPKGKSDGEIMRFSQSFMSELSNYIGPDIDVPAGDIGVGAKEIGYMFGQYKKMRGGFEAGVLTGKGIGYGGSLARKEATGYGTVYFVEEMIKDHGFSFAGSTVVVSGSGNVSIYAMEKAMQLGAKVVACSDSGGYVYDKNGIDLQTVKRLKEVERKRISEYVNEHPHAHYVQGCSGIWSVPCDIALPCATQNELDEAAATMLIANGVKAVGEGANMPSTLQAVHTFQEHGVLFAPAKAANAGGVSVSALEMAQNSTRLAWTFEEVDAKLYEIMKNIYRESIKAAELYEASGNLVVGANIAGFVKVADAMISHGVV

SEQ ID NO: 17285 - protein, 396 aa, Bacillus halodurans
MITLFRKPFVAGLAISLLVGGGIGNVAAAQGGPPKSGVFGENEKRNDQPFAWQVASLSERYQEQFDIGAAVEPYQLEGRQAQILKHHYNSLVAENAMKPESLQPREGEWNWEGADKIVEFARKHNMELRFHTLVWHSQVPEWFFIDEDGNRMVDETDPDKREANKQLLLERMENHIKTVVERYKDDVTSWDVVNEVIDDGGGLRESEWYQITGTDYIKVAFETARKYGGEEAKLYINDYNTEVPSKRDDLYNLVKDLLEQGVPIDGVGHQSHIQIGWPSIEDTRASFEKFTSLGLDNQVTELDMSLYGWPPTGAYTSYDDIPAELLQAQADRYDQLFELYEELAADISSVTFWGIADNHTWLDGRAREYNNGVGIDAPFVFDHNYRVKPAYWRIID

SEQ ID NO: 17286 - protein, 374 aa, Bacillus halodurans
MIGRKRKYEDPHIRSFHELLSGHNPVLYKKEDLLAYDCDGFTIHKHLPKAVVFPENTREVASIVRYCHDHNLPFLARGAGTGLSGGAIPINGEVIISLVRMKRLLEVDLKNRRAIVEPGYVNLKLTQSIEDKGYYYAPDPSSQYCCTIGGNVAENAGGAHCLKYGVTTNHILGMEVVLPNGDIVEIGKAGILDEPGYDLLGLMTGSEGTLGIVTKITVRILKHPEAKQTVLAYFDKVSDASHTVSDIISEGIVPAALEMMDRIAMEGVEAAAFPIGHLLDAEAVLLIEVDGISAGMDQQIERILTVCRKHHVREVKDEMVGEPKNRLWCHGCHLTRLPRTRWSDPADKASGRAFNDSKNQRNIRATNRKYFSRR

SEQ ID NO: 17287 - protein, 441 aa, Bacillus halodurans
MIVSNAHAKLVKQLNNSQVVQRDRMNDPYGNTGLLEIIPTTERELADVLTLASEEEHLVTVEGAGTKRGFAGTLLETEWVVSLQQFTGIVDHSIGDMTVTVKAGTPLRKLQKELAIFKQALPFDMPCDEAATIGGMIATNESGPKRLRHGAARDHVIGLRVVYPDGRIIRTGGKVVKNVAGYDMNKLFIGSMGTLGVMTEVTLKLRPLPKDERVIIAFFNENQLTLIEDVVASLLDSYMEPVALEIMNSTWTEAVTGEVALGLLISFEDIPSSVHYQEQYVLSQLPKGTNAAIFQREDANRFWDQWRKRESSQTLDQSNQQTAVKLKVAVKNFDLFSVLQECKRLTVQYHVSTSFHGGVGHGLGVIILTGDEQDICLAIADLRQVIAGASGHLVLTHAPLTIRQTVDVWGEPPAYMELLQGIKQAIDPQRILNRTRFVGGI

SEQ ID NO: 17288 - protein, 257 aa, Bacillus halodurans
MKNQTIIVTGGSNGMGKAMAARFASLGANVVITGRDQERLETAKSEVAQDSGRVLTVQMDVRNPDDVERMVKDTLSEFGAIDGLVNNAAGNFLCAAEDLSLNGWKSVIDIVLNGTWHCTQAVGKEWIKDGRKGHILNMVATYAWTAGAGVVHSASAKAGVLAMTRTLAVEWGTKYGIRLNAIAPGPIEGTGGAEKLILNETFQKAVLQTVPLKRFGTLEEIAGLAAYLFSEEATYMNGECISLDGGQWLRGTLFPFS

SEQ ID NO: 17289 - protein, 276 aa, Bacillus halodurans
MANNLQATTTLHNGVKMPWFGLGVFKVSEGDEVIQSVKDAIRAGYKSIDTAAVYGNEEGVGKAIAESGVPREELFITSKVWNADQGFDSTISAFNTSLKKLGLDYLDLYLVHWPVKGKYVETWKALEKLYQDGLVRAIGVSNFQVHHLKDVLEAGSIVPMVNQVEYHPHLTQTELHDFCKQNKIQLEAWSPLKQGQLLNDPTIVAIAEAHQKTPAQIILRWDLQNEVVTIPKSVKKDRIISNADIFDFQLTEEDMQKINELNKNERVGPDPDNFDF

SEQ ID NO: 17290 - protein, 250 aa, Bacillus halodurans
MQLFSLEGKIALVTGASRGLGQGMAVGLAEAGADVIGAGISDMSETRQQIESLGRTFYELKADLFEEGAGKQLIADAIEKAGRIDILVNNAGIIRRNEAEAFTDKDWNDVINVNLNAVFQMCREAGNHMIENGFGRIINIASMLSFQGGLRVPAYTASKHAIAGLTKSLANEWSKKGVNVNAIAPGYMVTDNTAALRADEVRNAYITSRIPKGEWGTPADLKGPVVFLASEASSYVNGHILCVDGGWMSS

SEQ ID NO: 17291 - protein, 455 aa, Bacillus halodurans
MKASQAESEKMLKWWELSLLGVGCIIGTGFFLGSSIAIQMAGPSVLLAFILAGIGTYIVFDALAQMTSADPEKGSFRSYAKKAYGRWAGFTSGWVYWASEMLIMGSQLTALSIFSRFWFPDVPLWIFASGFAVLGIIVILTGSKGFDRIENLFAVMKVAAIVMFIALAILALFGVFRAGPEGAGIPRTWNGLFPEGFLGLWPALIFGFYAFGGIEIMGLLANRLEEKGDAAKSGRAMLLLLTFLYVVSVGLALILVPLNRFNTETSPFITALKPYGLPIVSHLFNGVLIIAGFSTMVASLFAVTSILVTLAADKDAPNLFAKKVKNKIALPAIGLTAIGMALSVVLSLLIPGRIYEYFTTAAGLMLLYNWLFIIASSGKLIQYRLTKRWIGTLFILLAVIGTLFHRTSRPGFLFSLGFLVVIGIVTLMMKKRWKQEEGDGKKRPSIFVKLKPNSE

SEQ ID NO: 17292 - protein, 204 aa, Bacillus halodurans
MKHIFRKGADPNAPTLLLLHGTGGNEHDLVPLAEMISPGSSILGVRGNVLENGMPRFFRRIAEGVFDEEDLVIRTKELHEFLDDAVREHAINRNRLVAIGYSNGANIAASLLYHYEQPLMGAILFKAMVPLRNRTVPDLQQMPIFIGAGKYDPLIPQTETKELINTLTNAGANVYEQWIDVGHQLTREEVERAKEWFNEQFLEA

SEQ ID NO: 17293 - protein, 383 aa, Bacillus halodurans
MDLLTCETEAQRLTVTKKVASAFQEGARIHDQESTFPFAHIEALKKIGYPSLALPRTFGGLEITLLEMMKHQETIARFDGATALSIGWHVGQIFQWRATAQWKKPEYRLICEQIQNKQILLNSAATEKATGSPARGGKPTTTATKSGEEWVIQGRKTFTSMAPALDYALVTATIAGENEVGQFLVPMNARGVTIDETWNMVGMRATSSHDLVLDHVRLPLEALMERIEPGMKKAAGWLLHIPACYLGISQAAYDEAIRFAKQYSPNTLDGTISTLPHVQQKIGEMAMLLMQSRTILHSVARQWDESSDLEREEMKRELAMAKVTVINNGLSVVDIAMRIVGAHSLHMDHDLQRYYRDMRAGLHNPPSEDMTIAMLAKEALRDE

SEQ ID NO: 17294 - protein, 711 aa, Bacillus halodurans
MKCQQCQTNEATVTLHVKINQSSQQLHVCSSCYQQIEQPFGFSDFSSFDNMFKQWIGSTSSSMNGSDQPVSSIAMKSKTNHSGGGFLDQHGRNVTAEAKAGQIDPVIGRDQEVERLIQILCRRTKNNPVLIGEAGVGKTAIVEGFARRIAEGNVPAKMKNKEVYELELSSLVAGTSYRGQFEEKMEQLVRELEARDDVILFIDEIHMVVGAGATSEGSMDAGNILKPALARGQLQIIGATTLNEYRKIEKDPALERRFQPITVKEPTLEAAVEILKGVRPIYEAYHHVSYPDDVLEACVRLSDRYIQDRFLPDKAIDLMDEIGSALTLTSGPTTLDELKERLAEITKEKQQATAQEDYERAAKLRDEENLLHKQMNENRAEKTEVTVADIQGLIEKRTGIPVRKLQKAEQTKMKDLHNRLARQVIGQAEAVEKVAKAIKRSRAGLKPKNRPISFMFVGPTGVGKTELTKTLAQELFGSKEAMIRLDMSEFMEKHSVSKLIGSPPGYVGHDEGGQLTEQVRRKPYSIILLDEIEKAHPDVQHMFLQILEDGRLTDSQGRAVSFKDTVIIMTSNAGVGVKKITVGFEKNVETQNKAGILEQINQYFKPEFLNRLDAIIEFNHLTEQDLMRIVDLMLQDLGDRLAEQDISLTVSEKAKAQLVKIGSDRAFGARPLRRAIQDHVEDSITEKLIDEESINAIHVDYDVVQQSFTFA

SEQ ID NO: 17295 - protein, 403 aa, Bacillus halodurans
MNERISKGSAYMIAKEIEQNLTQSSWIRKMFEEGQRLKSIHGTENVFDFSLGNPIIDPPASYFEQLRAYANAPIQGGHSYIPNQGLPEARQKVAEHMNGRFNTNITAQTVTMTSGAAGALNVALKSIMNPGDEVIIFTPYFAEYKFYVGNANGVAVYCPLAEDFTFDFNELEKAISPKTKAIILNNPHNPTGQLIPQSDLERLNQYLVAKEQEWGTEIHVLYDDPYSQLIYDGNVPNPFAAIERLFYISSFSKDLGLAGERLGYLAIRPDFPSVEQYMAAFVFANRTLGFGNATVTVQRMISKMDTLTQEQHEYKKRRDAMVQVLEDAGFEFVYPKGGFFIFPKSPIADDTKFCQVAAEEFQLLVVPGIGFGRAGHFRLSYSVSMEQIERSAPVLKKLKSYFS

SEQ ID NO: 17296 - protein, 411 aa, Bacillus halodurans
MIEIKVPELAESITEGTIAQWLKKVGDHVSQGEYIAELETDKVNVEITAEHSGVIQELKREEGDTVEVGEVIAVLAEGDSPTASTEQAEAPKEEKKVSTVASEEAAPAPGNRPVASPAARKLAREKGIDLEAVPTADPLGRLRKQDVASYEEKPAASAPAKAPEKKAAPAAANVESPGKPVERIKMSRRRQTIAKRLVEAQQTAAMLTTFNEVDMSAVMELRKRRKDQFFEKHDVKLGFMSFFTKAVIGALKEFPLLNAEIQGDEILLKKYYDIGIAVSTDEGLVVPVVRDADRLGFAGIEREIMHLGKKARENKLSLSELQGGTFTITNGGVFGSLWSTPILNAPQVGILGMHKIQWRPVAIDEENFENRPMMYIALSYDHRIVDGKEAVSFLVRVKEMLEDPESLLLDS

SEQ ID NO: 17297 - protein, 945 aa, Bacillus halodurans
MSSKEHTSEEPWQGFYGPNLGVAVELYEEYQKDPNAVDDELREAFEKWGPPPATAPERTQSTFTAASITDPDVIKKFVGAVKLADHIRAFGHLAADIQPILKEQRREDMFDLDRFGLTESDIRSVPVDLLCPYAPAHVKNGLDAINHLKEVYTKTIAFEFVHVTDEEERKWLNRMIESGLYLPNLSTEQRKSLLKRLTDVEGFEKFLHRTFVGQKRFSIEGLDTLVPMLDEVVREAVHEGTTNVMIGMAHRGRLNVLAHVLNKPYEMIFAEFLHSLNKDLFPSEGSIGINYGWTGDVKYHLGADRQIRDENTAEARLTLANNPSHLEFVSPIVEGYARAAQEDRTSPGAPEQDIMKAYSILIHGDAAFPGQGVVTETLNLSRLTGYQTGGSLHIIANNNIGFTTETFDSRSTLYSSDPAKGFEIPIVHVNADDPEACLAAVHLAFQYRKRFKKDFLIDLIGYRRFGHNEMDEPAVTQPGVYQIIRKHPTVRELYSKQLVKKGLIDEQTVKQLDDEVQDKLQSVYEETLRNRTDEHLPDTPPVEVVNGLPKLDTGVQSETLKAINNELLEWPESFSVNPKLEKILKRRLNVFDGDGKVDWALAETLAFATILHDGTPIRLTGQDSERGTFAHRHLVLHDSRTNDVHSPLQSFRHANASFAVHNSPLSEMAIVGFEYGYNVFAPETLVLWEAQFGDFANGAQVMFDQWVSAGRAKWGQKSGLVCLLPHGYEGQGPEHSSARLERFLVLAAENNWTIANCTSAAQYFHILRRQAAILNTDSVRPLIMMTPKSLLRNQKVASSVEELTTGRFKTVLEQPNLGESHEKVERIVLCSGKIAIDLQDRIEKEADKDWDWVHIVRVEQLYPFPKEPLQEIFARYPNVKEIVWSQEEPRNMGAWPFVQSKIRRAAPNGINVRYEGRTYRSSPAEGDPIIHKQEQERIVTETLTR

SEQ ID NO: 17298 - protein, 244 aa, Bacillus halodurans
MNDTKVVMITGASKGLGKALALTFARNHWSLALCARNEQALEAVKQEALESGAESVLAIQADGAVEKDMDRFVSLTESTFGHIDVLIVNASIFGPGPAWLLDYDLSSFQDVLLTNVLHPFMITKRVLPGMLQRKKGTILHVTSEAGKTGFAEWGAYGISKFALEGLAETWANELTETDIALSWIDPGEMDTDMHAIAVPDCDYPLAKPEDVANVFFAIASRKREEVHGKRFEAQALMTKGGVSL

SEQ ID NO: 17299 - protein, 748 aa, Bacillus halodurans
MPIFYTEQTKEFHLQTKGSSYIFTVLDNQQLGHLYYGKKIEHRDSFTHLLRFQRRATSSCVFEGNLEFSLDLIKQEFPSYGTTDYREPAFQILQENGSRITNFEYKNHVISSGKKPLKGLPATYVESEEEAATLEVFLYDSLIDVELVLTYTVFAETNVITRHARFINHHSSPVQLMRALSMSVDLPDADFQMLQLSGSWSRERYVKERALVPGIHQISSTRGASSSQQNPFIALKRPQTTEFHGEVYGFSLVYSGNFLAQVEVDQYDVSRVQMGIHPFDFQWLLEAGESFQTPEVVMVYTDQGLNHLSQLYHSLYRSRLVRGNWRDRPRPILLNSWEATYFDFTEDSLVEFAKEGKKLGVELFVLDDGWFGTRNDDTTSLGDWFVNSEKLPNGIEGLAEKIEALGLAFGLWFEPEMVNKESELFKKHPDWIIHVEGRSQSHGRNQYVLDFSRAEVVDAIYEMMAELLRKAPISYIKWDMNRHLTEIGSPAWPKERQQEIAHRYILGVYDLYERLVSEFPDVLFESCASGGCRFDPGMLYYAPQTWTSDDTDAIERLKIQYGTSMVYPLSSIGAHVSAVPNHQVRRVTSLETRGNVAFFGAFGYELDVTQLTDEEKENMKKQIAFYKEHRELIMFGTFYRLRSPFVGDGNVTSWIVVSEDQSEALVGYYQTLAKVNAGFRQLKLTGLQECGLYQIDGMIGTYGGDELMHSGLQLPNEFSGASALREDEQSGDFQSYVFKLKRIESDRH

SEQ ID NO: 17300 - protein, 434 aa, Bacillus halodurans
MGKITFLGAGSTIFAKNVLGDCMLTPSLQEFEFALFDIDLDRLHDSETMLKHLKETLQANVKIEAYTDRKEALRGAKYVVNAIQVGGYDPCTITDFEIPKKYGLRQTIADTVGIGGIFRSLRTIPVMLDFATDMEEVCPDAWLLNYTNPMATLTGTMLRYTGVKTVGLCHSVQVCAPELLDRLGMEKDNIQWKIAGINHMAWLLEITREGEDLYPEIKRRAKEKQQNERHDDMVRFELMFRFGYYVTESSEHNAEYFPYFIKEKYPELIERLNIPLDEYPRRCINQIEDWKKMRKDLVNNKHITHERTHEYASYIMEAMETNKPFQIGGNVLNKGRLIANLPENACVEVPCLVDRNGIQPTYVGELPEQLAALNRTNINTQLLTIEAAMKRKKEAIYQAAMLDPHTSSELSIDDIVSLCDDLIEAHGSWLQSFK

SEQ ID NO: 17301 - protein, 481 aa, Bacillus halodurans
MALQTEQFNANILRNGEWVESRTGERISISAPASGVALGSIPALSQEEVNDAIQGAKDAQKIWKIRPIHERVDLLYAWADLLEERKEIIGELIMHEVAKPKKSAIGEVSRTADIIRHTADEALRLNGETLKGDQFKGGSSKKIALVEREPLGVVLAISPFNYPVNLAAAKIAPALVTGNTVVFKPATQGSLSGIKMVEALADAGAPEGIIQVVTGRGSVIGDHLVEHPGIDMITFTGGTTTGERISEKAKMIPVVLELGGKDPAIVLDDADLKLTASQIVSGAFSYSGQRCTAIKRVFVQDSVADQLVANIKELVEQLTVGSPEDDADITPVIDEKSAAFIQGLIDDALENGATLLSGNKRQGNLLSPTLLDDVTPAMRVAWEEPFGPVLPIIRVKDANEAISLSNQSDYGLQASIFTKDTDRAINIGKHLEVGTVHINAKTERGPDHFPFLGVKKSGLGVQGIKPSLLSMTRERVTVLNL

SEQ ID NO: 17302 - protein, 176 aa, Bacillus halodurans
MEKRLERAMFAGGCFWCMVQPFDKQPGIESVVSGYAGGTVENPTYEQVKTGTTGHYEVVHITYVPELFPFEKLLSLYWPQIDPTDPDGQFHDRGPQYRTAIFYENEEQRALAERSREALEKSGKFKKPIVTSILPMATFYPAEEEHQQFYKKNPMAYKEDREKSGRDEFIYKHWGK

SEQ ID NO: 17303 - protein, 445 aa, Bacillus halodurans
MAKDESYLIKPLLDRNYPCVSYGKGAALYDMDGKRYLDACSGAVTASIGHGVDEVVQAMYEQARKVSFVYRSQFTNEPAERLAMKLAEQLPGQLNHSFFVNSGSEATETAIKISIQYWQERGRPEKTLILSRWMSYHGITQGALSLSGHYERRQRFEGMLDRLPFLSPPYPYRQVREMSGVDYAEELDHLIEQIGPHRIAAFIAEPIVGAAGTALVPGEWYYEALKQVLDQHDILFICDEVMTGMGRTGKDLAIEHWDATPDIVTLGKGLSAGYAPLAATVVADHVLEPIQAGSNLIMSGHTFSANPLSCAAGLAVLHYVKKHDLVKRAATIGEKLIEDLQEIQTASAIVGDVRGKGLLIGLEFVKNKATKAPFPKDAQVAAVIVNEAQRQGLLLYPSAAGLKGEGAGCLIAPPFTLTKEERCELLGKLARTLERVEKQLLGAEK

SEQ ID NO: 17304 - protein, 310 aa, Bacillus halodurans
MRIFDAHCDALLKLWEDPAREYTDDPAIEANAVRLMEGGVRAQCFAIFVGPNIPFDQKFQVALQQAELFHEKILKKHPQFSFIERWDDLLTLDADQIGAILTLEGADPFGDDPTKLKTLYRLGVRSLGLTWNQANLCADGVGEPRGGGLTEWGKAVVSLNNEHHVLTDVSHLSERGFWDVIEYAQFPVATHSNAKAICKHRRNLTDAQLKALIEAGGFIGIVFHPHFLTGTDDASIDDVMKHIEHICSLGGQKHVGFGSDFDGIPCFVDGLEHAGRFQWFMDELLKRYDEELVRGFAWDNFLKATPISYV

SEQ ID NO: 17305 - protein, 144 aa, Bacillus halodurans
MSREESGKSKLPNVYQDFLRSIDDFFSKSFQHLHDNGMFAPSIPIRQYEKGEQFIIEAELPGVSKNQIQLDVFPQYVRIRIHEEEVLEMREDEKGIYSKSISSQARERVIPFPYPVQEGDIKARLRNGLLTIAIPNHRKRINIE

SEQ ID NO: 17306 - protein, 273 aa, Bacillus halodurans
MEIKKAIIPAAGYGTRCLPITKVVPKEMFPINGKAALHYIVEEAVAAGIEEIFIILSRNRTLIMDYFDRSIELETFLKKMNKQHLLEKLALPDVTIQFIRQPHANGLGDAIRLGERFVNGEPFAVLLPDDLFISPKHTSVLAELVNVYKQYNKSIIGLQEVESELLKRYGVIAGHPLSSDEYKIENVVEKPQTNPPSNLAIVGRYIFEPAIFQKLKNIGIGKGGEVQLTDAIKALLISHTVIGKIIEGCRYDIGIEEDYQRLIQEFSEKKSST

SEQ ID NO: 17307 - protein, 485 aa, Bacillus halodurans
MANLATGEKLKNFIGGQWVESDSGKTEAVPNPATGEILAHVPISNREDLDRAVSVAKEAFKTWGKTPVPRRARVLFKYQQLLVENWEELARLVTLENGKSYKEAYGEVQRGIECVEFAAGAPSLMMGKQLPDIATNIESGMYRYPIGVVGGITPFNFPMMVPCWMFPLAIACGNTFVLKPSERTPLLANRLAELFTEAGLPEGVLNIVHGAHDVVNGLLEHPDVKAISFVGSQPVAEYVYKTASQHGKRVQALAGAKNHSIVMPDADLDGAVNQIVNAAYGSAGERCMAAAVVVAVGEVAEPLMEKLQKAVNEITIGNGLDDDVFLGPVIRESHKQKTENYIELGEKEGATLVRDGRKDNVSKDGYFLGPTLFDNVTTEMTIWKEEIFAPVLSVVRVESLDEAIQLTNQSEFANGACLYTTNGSSVRKFREEIDAGMLGINLGVPAPMAFFPFSGWKNSFYGDLHANGTDGVEFYTRKKMITARW

SEQ ID NO: 17308 - protein, 331 aa, Bacillus halodurans
MTYELSTDREFDLIAIGRACIDLNAVEYNRPMEETMTFSKYVGGSPANIVIGSSKLGLKAGFIGKIADDQHGRFIESYMRGVGVDTSNLVVDQEGHKTGLAFTEIKSPEECSILMYRQDVADLYLSPEEVNEAYIRRSKLLLVSGTALSKSPSREAVLKAIRLAKRNDVKVVFELDYRPYSWETPEETAVYYSLVAEQSDIVIGTREEFDVLENRTEKGDNDETIRYLFKHSPELIVIKHGVEGSFAYTKAGEAYRGYAYKTKVLKTFGAGDSYASAFLYALISGKGIETALKYGSASASIVVSKHSSSDAMPSVEEIEALIEKDETITIA

SEQ ID NO: 17309 - protein, 599 aa, Bacillus halodurans
MIDHKDRVLSSKEQRTVFKRLLSYAAHYKGQLMVAFLLLFIATGAQLLGPIIVKIFIDDYLTPRYFPTDVLFLLGAGYLVLHLTAVIIDYYQLFLFQKVALSIVQRLRIDVFSSVQRLGLSFFDQTPAGGLVSRITNDTESIKELYVTVLATFVQNIIFLIGIFAAMFYLNVTLAIYCLVLLPLIFALMQVYRKYSSRFYADMSEKLSLLNGRINESIQGMAIIQMFRQERRMRKEFSAINDEHFLAGMKSMKLDGLLLRPAVDVLSILALMLILSYFGIMSMDTAVEIGVVYAFVNYLDRFFEPVNQMMMRLSMFQQAIVSAGRVFKLMDHRELAPDREGNEHPAIIGEGNVEFRNVSFSYDGKTNVLKNISFTVKKGETVALVGHTGSGKTSIINVLMRFYPLQDGEILIDGKPLTSFENNELRAKVGLVLQDPFLYTGTIASNIRLYDQAISDDRIKRAASFVRADGFIERLSHGYETKVTERGATFSSGQRQLLSFARTMVREPAILILDEATASVDTETEEAIQEALERMKQGRTTIAIAHRLSTIKDADQILVLHQGEIVERGTHDELIAKKGLYQKMYVLQKGDEQGEALLS

SEQ ID NO: 17310 - protein, 585 aa, Bacillus halodurans
MKVFVDLWWFFKQEKKSYGFGIVMLAIVSLLTLVPPRVVGIIVDHIYEGTLTMPVLLQWIGVLAALALIVYVARYLWRVMIFGASLRLARLLRNQLYTHFTNMAAPFYQKHRTGDLMAHATNDIRAIQATAGQGVLTLVDSLTMGGFVILTMAITISWELTLISLLPMPLMALLTSYYGSLLHKRFHHAQAAFSSLNDKVQESVTGVRVTKAFGQEEQDIEAFRKQSDDVVKKNVAVARVDALFDPTISLIVGLSYFLAIVFGARFVIAEQLTIGQLTSFTIYLGLLIWPMLAFGFLFNIVERGRASYNRVSQLLQAKQEITDSRARIHVPPTGHVDVAIDQFVYPNQKEPALADVQFELSEGETLGIVGKTGAGKTTLLRLLQREYDIKQGTIILDGRPIEHYTLDALKAAFGTVPQDHFLFSATIADNIAFAKPDATISEIIQVSQLAHIHDDIIQFEQGYDTVVGERGVTLSGGQKQRVSIARALLANPNILILDDSLSAVDAKTEEAILSSLRAERKGKTTIITAHRLSAIKHADHILVMDDGRIVERGTHETLMEAGGWYRNMYERQQLETLVEKGGRSS

SEQ ID NO: 17311 - protein, 637 aa, Bacillus halodurans
MAKIIKLDDHLSNKIAAGEVVERPASVVKELVENALDANSRKITIEVEAGGLDRIRVIDDGDGIEREDVETAFFRHATSKIKTDKDLFQIATLGFRGEALPSIASVSHVQIKTSTGGDGGTEMVLEGGVIKKIGSTAMGKGTDLTVTQLFYNTPARLKYVKTVHTELGNISDVVNRLALAHPYVSFQLFHNGKNVLRTSGNGDQLQVIAAIYGRTVAKQMVPLSGETIDFTVSGFAAKPEVTRASRQYMSLLVNGRYIRNVALSKAIQQGFHTLLPIGRYPIAIVNIELDPQLIDVNVHPSKLEVRVSKEEELCRLVTETIERAFKKEQLIPEATKPTGGKQKSEQLSFTLDDFTSAKPSEDRGSTSSNEENEQRSSIDKNVLFQEERKLSNDLPSINMVREASASVEPALEKEPPAAELTAGAKGAMEQASMEEETSNSLPANRVPTMYPIGQMHGTYILAQNDQGLYIIDQHAAQERMKYEYFREKVGEVTNELQELIVPITVECTLQEAAYIEEHLEDLKQVGLFFEEFGPQTFMIRQHPTWFPKGLEEETIREMIDQLMEKRKVDIKKLREEVAILMSCKAAIKANRHLRHDEMYALLEALRKSSDPFTCPHGRPIIVQITTYEMEKMFKRVM

SEQ ID NO: 17312 - protein, 865 aa, Bacillus halodurans
MALQTPMMKQYLEIKAQYKDAFLFFRLGDFYELFLDDAVKAAQELEITLTGRGKGEERIPMCGVPYHSADHYISRLLEKGYKIAICEQVEDPKNAKGVVKREVIKLITPGTIMDGKLIVEKENNFLCAVTRFEDQSYGIARADLTTGESRVSLVSEQDDLFHELASSSIKEVVLSPGWTEEDAHRLRQSLSVTLSEEEAEDLPKGYESLCENVEQPKLLRAFGRLLQYLLRTQKRSLEHLQPVQYDPPNEVMKIDLHSRRNLELVETLREKKKKGSLLWAVDETVTAMGGRLLKQWVERPLLSKKEIERRQGLVQSFLDHYFEREELRDELRHVYDLERLVGKVAYGNVNARELVQLRKSLQRIPAIFALVEKIGNQDVNERLQTIDRCESLVDLLEHSLVDDPPVSIKEGGMIRDGFHKELDTYRDASRNGKSWIAELEQKEREATGIKSLKIGYNKVFGYYIEVTKANIHLLEEGRYERKQTLTNAERYVTPELKEKEALILNAEESIVQLEYDLFLQVREQVKDYIRPLQALAQMISELDVIQGFATVSETHHYVRPALQEDRAIAIKGGRHPVVERVIPNGEYVANDVDMKDGRSILLITGPNMAGKSTYMRQLALIAIMGQIGCFVPADEARLPIFDQVFTRIGAADDLASGQSTFMVEMLETKYALQKATQNSLILLDEIGRGTSTYDGMALAQAIIEYIHDEIRAKTLFSTHYHELTALEKELSDVKNVHVSAVEEQGTVVFLHKVVDGQADRSYGIYVAELAGLPNVVTERAETLLAELEGEKEIVASEKEVASTNEPTQLSLFEPEPLEAYKPKGNKQPLSDEEKTVLHDLQSVDVLNTTPLEAIRLLNQWQQKLR

SEQ ID NO: 17313 - protein, 539 aa, Bacillus halodurans
MNEAMIKFNELQIGEEIKKAIIEMGFEEPSPIQAKAIPAILAGGDVIGQAQTGTGKTAAFGIPVVEKVSTGRHVQALILTPTRELAIQVSGEIQKLSKHKKIRTLPIYGGQSIVHQIKALKQGVQVVIGTPGRIIDHLRRKTLILDHVNTVILDEADEMLDMGFIDDIESILRQVKNERQTLLFSATMPPAIKKLSRKYMNDPQTVSINRREVTAPSIDQFYYKVLERNKLDSLCRIIDSEQIDLGILFCRTKKGVAELTEALQARGYIADGLHGDLTQSQRDAVMRKFRDSSIEFLIATDVAARGIDVGNVSHVINYDIPQDPESYVHRIGRTGRAGRKGLALTLVTPREMKHLRSIEQEIKMSIPSQEVPTIEDVVEKQKESWKKQIAHRIEKGSNQKHLFEQMTEELMAEYDSKEVISALLQLNYAMDTAPEDAGYSFGETGGAKGMVRFFINVGRNVNMSPKILVEEIAELVGIPGKAIGRIDIFEKFTFVEVPEEVAPFVYEALRYSRINGARVNLEPAKPRPKRESQRRTFQK

SEQ ID NO: 17314 - protein, 242 aa, Bacillus halodurans
MKQRRVLVTGASGGIGAAISKALAAPHTTLYLHYYQNERSIDDVRLACEQLQAEVVTVKADLSHAAGVEELLTQCGSAIDVFVHSAGQSVEKLFLDTSTSDIMRTFQQHLFSFMELSRGFLPHMLRNRYGKIVAVSSVWGETGAAYEVVYSAAKSGMNGFVKALAKEMAPNGIQVNGVAPGAINTSMLSSYTEEEVLALTEEIPAGRLGTPMEVAETVAFLCSERATYIHGHVLSVNGGWYC

SEQ ID NO: 17315 - protein, 292 aa, Bacillus halodurans
MDFGHVLTAMVTPFDAKGNVDLEKVERLVEFLLANGTEGLVVAGTTGESPTLREEEKLALFEKVVTVVNKRVPVIAGTGSNNTYVSAQLTKKATALGVDGIMAVTPYYNKPSQEGMYAHFAAIAEATHLPVMLYNIPSRSVVNLSAETIVKLSYIPNITSLKEANGDLDHMVSVIEQTPDTFHLYSGDDSLTLPALSIGAKGVVSVASHIIGPEMQQMMMAFRGGDVEHAANLHRKLLPIMKGLFTAPNPTCVKAALQIKGFDTGGVRLPLVPPTSEQRQHLQFLIEQLKVS

SEQ ID NO: 17316 - protein, 411 aa, Bacillus halodurans
MKIIIQKFGGTSVKTAEVREMAAKHVEKAVEGGYKVVVVVSAMGRSGDPYATDTLLQLVDTKTIAKREQDLLVSCGEIISSVVFTELLLKKGIQATAMTGAQAGFRTNEEFTNAKIVDMKVDRLKKTLVHQDVVVVAGFQGQSPTGETTTLGRGGSDTSATALGAALDAEWVDIFTDVEGIMTADPRIVSEARPLDTMTYNEVCNMAYQGAKVIHPRAVEIAMQAKIPIHIRSTYSDGKGTLVTSMLTEAGARDVQDRIITGIAHMSGVTQIKVHAKDGEFDLQEKVFRAMAAEKISVDFININLTGVVYTVMDEVADRAIEVLRELGFDPEVKRHCAKVSAVGAGMTGVPGVTAKIVAALSQENIRILQSADSHTTIWVLVSEDDLTKAVNALHRMFHLEQSEQTKQKQV

SEQ ID NO: 17317 - protein, 349 aa, Bacillus halodurans
MTNQQTFSVAVVGATGAVGQQMLKTLEERNFPVGQLKLLSSKRSAGKTITFKGEPYTVEEATPEAFEGVQIALFSAGGSVSKKLVPEAIKRGAICVDNTSAFRMDPEVPLVVPEVNEEDVKSHNGVIANPNCSTIQMVVALEPIRQKYGLKKVIVSTYQAVSGAGLEAIEEMKTQTKEVLEGNEVNPEILPVGGDKKHYQIAFNAIPQIDLFQDNGFTFEEMKMINETKKIMHMPELEVAATCVRLPVETGHSESVYFETEQGGASVSELKGLLETAPGITVQDNPSEQLYPMAIHAVGKPDVFVGRLRRDLDRDNGYHMWVVSDNLLKGAAWNSVQIAESLVKLGLVK

SEQ ID NO: 17318 - protein, 413 aa, Bacillus halodurans
MINTMTLDNGVRIITEKMSTVRSVSIGIWVGTGSRYESAEENGISHFLEHMFFKGTNTRSAQEIAEFFDSIGGQVNAFTSKEYTCYYAKVLDDHAGQAIDTLSDMFFHSTFQKEELEKERKVVFEEIKMVDDTPDDIVHDLLSSATYGKHSLGYPILGTVETLNSFNEGMLRHYMDRFYTGDYVVISVAGNVHDELIDKIKETFSQVKPTTYNYQGEKPMFLPNRIVRKKETEQAHLCLGYPGLPIGDKDVYALVLLNNVLGGSMSSRLFQDIREKRGLCYSVFSYHSSFRDSGMLTIYAGTGHDQLDDLVYSIQETTSALAEKGLTEKELENGKEQLKGSLMLSLESTNSRMSRNGKNELLLKKHRSLDEMIEQINAVQKQDVSRLAKILLSASPSISLINANGELPKALIH

SEQ ID NO: 17319 - protein, 437 aa, Bacillus halodurans
MDARSLISLIPSLSAYKWYGKVTRVIGLTIEAKGPQASIGELCYILVGKQGTKVMAEVVGFKEERVLLMPLNGTAEIAPGSLVEGTGRPLQVKVGYSLIGHVIDGCGRPLTGEALPNGLTPYPTDNPPPNPISRPRIKEAMHLGVRAIDGLLTVGKGQRVGIFAGSGVGKSTLLAMLAKNAAADLNIIALIGERGREVKDFIERDLGEDGLRRSIIVVATSDQPALMRIKGAMTATALAEYFRDQGLHVNLMMDSVTRFAMAQREIGLAVGEPPTTKGYTPSVFALLPKLLERAGTNGKGSITGFYTVLVDGDDLNEPISDTVRGILDGHFVLDRELANKGHYPAINILKSVSRVMNDIVTDEQKRAAEHVRSLLSVYKESEDLINIGAYKRGSSKQIDEAIERQPEVISFLRQNTDEVAIAEHSIQQLIQAFGKGD

SEQ ID NO: 17320 - protein, 690 aa, Bacillus halodurans
MADYLVIVESPAKAKTIGKYLGKKYTVKASMGHVRDLPKSQMGVDIEDEYSPRYITIRGKGPVLKELKSAAKKVKRVYLAADPDREGEAIAWHLAHSLDIDETSECRVVFNEITKQAIKDAFKSPRPINMDLVDAQQARRVLDRLVGYNISPLLWKKVKKGLSAGRVQSVAVKMIIDREKEIQAFEPEEYWSIQGTFALDGEPFEAKFYGTNGKKVELKSEDDVNNVLAKLKGDQFHVDSVQKKERKRNPVSPFTTSSLQQEAARKLNFRAKKTMMLAQQLYEGIDLGKEGTVGLITYMRTDSTRISDTAKAETKEYIESKFGKEYAQNGTKAVKKDKKSQDAHEAIRPTSVERDPKSLKEYLSRDQLRLYKLIWERLVASQMAPAIMDTMTVDLSNEGVLFRATGSKVKFPGFMKVYIEGNDEGKKEEDRLLPNLQEGQTVTKEEIEPSQHFTQPPPRYTEARLVKTMEELGIGRPSTYAPTLDTIQKRGYVALDERRFVPTELGEIVLELMTEFFPEILDVEFTAKMEDDLDSIEEGKQQWIKIIDDFYKGFEERLKVAEEEMKEVEIKDEPTGEMCEKCGHEMVYKMGRYGKFMACSNFPDCRNTKPIVKEIGVKCPKCEKGEIVERKSKKRRVFYGCNQYPECDFVSWDKPIARSCPKCSSYLVEKRTKKQVQVQCSSCDYKEEAN

SEQ ID NO: 17321 - protein, 302 aa, Bacillus halodurans
MSILINKDTKVIVQGITGATGLFHTKQAVEYGTNIVGGVTPGKGGTEVEGIPVFDTVSQAVEATGANASVIYVPPAFAADAIMEAVDAELDLAICITEGIPVMDMVKVKRYMEGKKTRLVGPNCPGVITPEECKIGIMPGYIHKKGHVGVVSRSGTLTYEAVHQLSTAGIGQSTAVGIGGDPVNGTNFIDVLKLFNEDPDTYAVIMIGEIGGTAEEEAAEWIKANMTKPVVGFIGGQTAPPGKRMGHAGAIISGGKGTAAEKIKTLESCGVKVAETPSVMGETLISVLKEQGLLEKCTTHQV

SEQ ID NO: 17322 - protein, 386 aa, Bacillus halodurans
MNIHEYQGKELLRQYGVAVPNGKVAFSVDEAVEAAKELGSNVCVVKAQIHAGGRGKAGGVKVAKNLDEVRTYADEILGKTLVTHQTGPEGKEVKRLLIEEGCDIQKEYYVGLVLDRATSRVVMMASEEGGTEIEEVAEKTPEKIFKEIIDPVVGLQGFQARRLAFNINIPKELVGQAVKFMLGLYKVFVEKDCSIAEINPLVTTGDGKVMALDAKLNFDSNALYRQKAILEFRDLDEEDPKEIEASKYDLSYISLDGNIGCMVNGAGLAMATMDIIKHYNGEPANFLDVGGGATAEKVTEAFKIILSDESVKGIFVNIFGGIMKCDVIAEGVIQATKEVGLSIPLVVRLEGTNVDLGKKKLEESGLNITAADSMADGAQKIVSLVK

SEQ ID NO: 17323 - protein, 1188 aa, Bacillus halodurans
MFLKRLEIVGFKSFAEQMTVEFVKGVTAVVGPNGSGKSNISDGIRWVLGEQSAKSLRGSKMQDIIFAGSDTRKPLNFAEISLVLDNEDQHIPIDYSEVSVTRRVYRSGESEYLLNRQPCRLKDIVDLFMDSGLGREAYSIIGQGKVEEILSSKAEDRRVIFEEAAGVLKYKTRKQQAEKRLDDTQENLNRVEDILHELEGQVEPLKIQASVAKDYLEKKKELEQVEIAVLVYDIDRIHTEWNKAKEALDLLKEQHRALEQQISEKEQSVQGLKQQIAQLDEEAQIAQQQLLSASETLEKREGRRDVLKERLKNAAENREQLLQTIREGEEKVASLKVHLAKEEEAKQKAYEQMTALEAEIRNQEKALHGNEKELEETVDRLKSDYIELLNEQASLRNETRYLEEQLQQLQQKQERLIRENEAYFQKRKELEAQEEQERMQFEAKEKQLHRLVDEYRNQQRKVEQVTRVYEQKEKQLYEAYQLIQRLTSRKDVLEEMQADFSGFFQGVKEVLKARHSTLKGIVGAVAELVTVPKPYETAIEIALGGGAQHIVVESEQAARQAIQYLKQQRFGRATFLPLPVMKGRELPAASMQLIQEHDAFVGIASELVSFDQRFTPVIRNLLGHVIVAKSLEGANAIARLLQHRYRIVTLEGDVVNPGGSMTGGSVKQKQTPLLGRQRELEELTDKLKQLEKAAAKLEQEVKQQKNERTELQQLIEDLRLQGEAARAEVDGAKETWQAVTYEVKAMRERLSLVDREHESFTDEETRIRARLAELKQLLTSAEQEASKMQQTVAEIEGRLKQSQSSKEERQSQLTELKIQLATAKERYGNIEEQRARIAEQLAEEKEKLRERKETFQLLETELSQSTSGELSLDEQIEKSRQEKSELSEHVAHLQTKRKELGGQLEAEEQLLADLGRKRAYMSESSRDAEVKVNRLDVELDNRLNQLRDEYELSYDLAKVEYPLMMEIGEARTKVKLIKRAIEELGTVNLGAIEEYERVSERYEFLKDQQADLVEAKETLHNVIEEMDEEMTKRFHDSFTEIQAHFRVVFKELFGGGEADLVLTEPDQLLTTGVDIMARPPGKKRQHLGLLSGGERALTAIALLFSILRFRPVPFCVLDEVEAALDEANVSRFAKFLKDFSDQTQFIVITHRKGTMEEADVLYGVTMQESGVSRVISVKLEETKELIES

SEQ ID NO: 17324 - protein, 246 aa, Bacillus halodurans
MLQGKTAIVTGASRGIGRATAMELARHGANVVVNYAGNKEKAEKVVAEIKELGVEAIAIQADVADSESVQAMVKETIDTFGAVDILVNNAGITRDNLFMRMKEEDWDAVIDTNLKGVFHCSKAVTRPMMKQRFGRIINVSSVVGAIGNAGQANYVAAKAGVIGLTKTLARELANRNITVNAVAPGFIETDMTGELPEDVKAQMLGQIPLARLGQPEEVAKAVRFLASDDASYLTGQTIHVNGGMVM

SEQ ID NO: 17325 - protein, 313 aa, Bacillus halodurans
MAKVAFLFPGQGSQSVGMGSELLSEEKAKEIFDEADERLGYSLSSIMFEGPEEKLRRTENTQPALLTMSTAVLSLVREYGIKPDYTAGHSLGEYSALVASGSLTFADAVYAVHHRGLFMEEAVPFGEGAMAAILGMERDELEQVTKRVTEAGAVVELANLNCPGQIVISGSAEGVEQASEEAKEAGAKRVIPLQVSGPFHSSLMKPAAEKLEAVLADLAIADAAPPVIANVTADLVQKAADIRSSLIEQVYSPVRWEDTVRRMLELGVDTFVEIGSGNVLSGLVRKVQRRVNVFSVSDRASIEAMVKKLEQEA

SEQ ID NO: 17326 - protein, 249 aa, Bacillus halodurans
MNFSFLTDVGKVRPHNEDNGTIMEKNGQLLVVVADGMGGHQAGDVASKMATELLKEAWEEASLSPSSQESEGWLRNQVLHVNESLYHYAQKHEECQGMGTTLVAAIVDKERVTIAHIGDSRAYLLNEHGFSQKTRDHSLVNELVRTGQISDEEAEHHPRKNVLLRALGTELDIKLDLTTFSWEPDDVLLLCSDGLSNKLSNEDFARYMSGTKEVNETAREMVQLANDRGGEDNITVALIKNTGSSSEDR

SEQ ID NO: 17327 - protein, 902 aa, Bacillus halodurans
MKWYQMGEEEVKKATGVLGADGLPQREVDKRLKRVGFNKLDEGESVSALILFFMQFKDFMVLVLLAATLISGLLGEYIDAITIILIILLNGVLGFIQERKAEKSLSALKELSAPQMVVLRDGKWLKVPAATVVPGDVVKLTSGDRVGADIRLLETASLRIEESSLTGESLPVHKHGDRMEQTDLQLGDQANMAFMGTLVTEGQGIGIVVATGMKTEMGKIAHLLQTTETVITPLQRKLEQLGKVLIAVALLLTAMVVVIGVIQGHDAYTMFLAGVSLAVAAIPEGLPAIVTVALALGVQRMIKRRAIVRKLPAVETLGCASVICSDKTGTLTQNKMTVTQVWASGETWHVSGTGYEPHGLFTKGKKETDPKRHRSLHLLLSYGLLCNNSQLKQRTVKKGMLKTKESTAYHIEGDPTEGALLVAAMKAGFSREQLDRQFKRLKEFPFESTRKMMSVVVENEKGQRFVVAKGAPDVILQVSKKIRYRGEQEALTPKRREEVERTIQTMASQALRTIAVAYRPLRPNESVDEAYEAECDLTFIGLQGMIDPPREEVFDSIEECRQAGIKTVMITGDHRLTAAAIAKKLGILPAGGKVIDGTELNHLTDRRLTEMVDQIYVYARVSPEHKLKIVKAMQERGHIVAMTGDGVNDAPAIKAANIGIAMGITGTDVAKEASSLILSDDNFATIRAAIREGRNIYDNIRKFIRYMLASNVGEILVMLFAMLLGMPLPLVATQILWINLVTDGLPAMALGMDQPEGNVMKRPPRHPREGIFARGLAWKIVSRGFMIGVVTLAAFWLTLQANPDDLTRAQSVAFVTLVMAQLIHVFDCRSEYSVFHRNPFENKYLVLAVLSSVLLMLIVIYYPPLQQVFHTVPLTGREWLLIIGMAAIPTVVLGGFRLLKAK

SEQ ID NO: 17328 - protein, 419 aa, Bacillus halodurans
MKTTKNRWLIALAAVGIHISIGSVYAWSVFTNPLIEQFGWGLGEVSLTFSIAIAFLGVSAAFMGHFVEKHGPRKSGMVAASFFGLGTLGAGLAVSLESLWLLYFSYGVLGGFGLGVGYITPVSTLVKWFPDRRGLATGLAIMGFGFASLVFSPIMNAFITSVGIAATFFILGGLYMIIMFTAALYLEPPPQGWVPAGFKEAKTENGRLQKQDLSQLTANEAVKTKRFWFLWTMLFINVTCGIAILAVASPMAQEITGMTAATAATMVGLMGLFNGLGRIGWASISDYIGRPNVYTAFFLIQIVAFVMLPSITHVLLFQVVLFFIMTCYGGGFASIPAYIGDLFGTKQLGAIHGYILTAWALAGLVGPMIASYIRETTNSYAGTLYIFTGMFIVALAVSLFIRVDIRQLRAQSNKQGLVS

SEQ ID NO: 17329 - protein, 782 aa, Bacillus halodurans
MGKTKHAGPMKLDKKWDPSLWAGKVPLGLGKVKPKHIRDTLKVALENRDNLGYAYRILTQGVCDGCALGVSGLQDQTLAGPHLCTTRLNVLRLNTMPAIDPKWLDDVEELRKLDSTELRKLGRIPYPLSRKPGEKRFTRISWDDALNRIAAKIKAIDPKQLAFYLTARGITNEVYYTAAKVARFLGTNNIDNASRICHSPSKTALKRSLGIGASSCNYQDWIGTDVLVFWGSVAANNQPVSTKYMYAAKKAGTKIIMINPYREPAMENYWIPSIPESALFGTQIVDDVFQVNIGGDIAFMNGVMKHWFEMEKEQPGSAIDHAFIANHTNGFAELKEHVEQLNWNDIVKSAGLSKERILEFAKLLANSRSGVFIWSMGLTQHRFATDNISQVANLALLQGFIGRKHCGVMPIRGHSGVQGSGEMGADPFVLPGGDFEPEHKKRIEAIWGFHIPDWQGDTVGQMLENVLLPDDHERKVRLFYTSGGNFLETMPDPAFIQRVLENVELRVHQDIIFNTSTLVDAKEEVIVLPAMTRYEQPGGGTSTSTERMVYFSPEIKGPRIEEARAEWDIYVELAKRVDPERAHLIDFQTAQQIRDEIAVANPNYDGIQHLKNRGDVFQWGGAWLCEGGVCPTPDGRGNLLPIDLPEFRRTEGHFYVTSRRGKQFNSMVYSETDPFNGADRYDVIMNETDGKKLNIRNGESIVVYNQYGTFQGRACFGDTQTGNIAVYWPEGNMLLPKGVYETHAKIPEYNTTVIVEKAESFHAQKDRRYLEKRVEELELEAN

SEQ ID NO: 17330 - protein, 305 aa, Bacillus halodurans
MSRLAVELPGLSMKNPIMPASGCFGFGKEFAGFYDLNHLGAIAIKATTVEPRFGNPTPRVAETHSGMLNAIGLQNPGLNNVIDNELARLADVDVPIVANIAGSTVNDYVEVAEAISRVDNVHALELNISCPNVKEGGIAFGTVPDVAAQLTQEVKRVSTVPVYVKLSPNVSDIVEMAQAVERAGADGLSMINTLLGMRLDLKRRTPILANGTGGLSGPAIKPVAIRMIYQVSQAVSIPIIGMGGIQSADDVLEFMLAGADAVAVGTANFTDPYVCPTIIDELPKRMDELGIERIADIVGGSWKQS

SEQ ID NO: 17331 - protein, 1062 aa, Bacillus halodurans
MGKREDIKKILVIGSGPIVIGQAAEFDYAGTQACQALKEEGYEVILVNSNPATIMTDTTMADRVYIEPLTLEFVSRIIRMERPDGILPTLGGQTGLNMAVELDQAGILKEYNVELLGTKLDSIQQAEDRDLFRALMKELNEPVPDSEIIHTLEEAYTFVERVGYPIIVRPAYTLGGTGGGLVYNEEDLVEIVTSGLKYSPVTQCLVEKSIAGFKEIEYEVMRDGKDHAIVVCNMENIDPVGVHTGDSIVVAPSQTLSDREYQMLRNSSLKIIRALGIEGGCNVQFALDPDSFQYYIIEVNPRVSRSSALASKATGYPIAKIAAKIAVGYTLDELLNPITQTTYASFEPALDYVVSKIPRWPFDKFEAANRSLGTQMKATGEVMAIGRNLEESLLKAVRSLEAGVYHLDQPDVNDLDKESLEKKLTKPDDERLFALGEAIRRGYTIEELWALTKIDRFFLRSFARIIQLETQLKENVGDLELLKEAKERGFSDMIIADLWGTSEQEVYELRMNHGLSPVYKMVDTCAAEFASATPYFYGTYEEENESERTDKKSILVLGSGPIRIGQGIEFDYATVHTVWAIKEAGYEAIIVNNNPETVSTDFSTSDKLYFEPLTVEDVMHIVNLEQPEGVIVQFGGQTAINLASELAARGVKIIGTALEDMDRAEDRDKFEQTLVELNIPQPLGDTATSIEEARQIAERIGYPVLVRPSYVLGGRAMEIVYKEEELLNYMAHAVKVNPKHPVLIDRYLTGKELEVDAISDGENVYIPGIMEHIERAGVHSGDSIAVYPPQTVPESLKQKLIERTIELARGLRIVGLLNIQFVWHKDDVYVLEVNPRSSRTVPFLSKVTGVPMANVATKVMLGKTLPQLGYETGYHPEAKEVSVKVPVFSFAKLRRVDITLGPEMKSTGEVMGRDKTLEKALYKGLIASGMSIPTHGSVLFTIADKDKQEAISLAKRFYQIGFSILATEGTAHILHEEGIPVTTVNKISDEKPHLLDVIRAGDAQFVINTLTRGKQPARDGFRIRRESVENGVVCLTSLDTAEALLRVLESITFSAESMPVMQ

SEQ ID NO: 17332 - protein, 362 aa, Bacillus halodurans
MKRQLILEDGSVFVGKGFGSDREMSGEVVFNTGMTGYQEMLSDPSYCGQIVTLTYPLIGNYGINRDDFESMNPAIHGLIVKEACDIPSNWRSEESLDSLLKAKQIPGLSGIDTRKLTRLIRMHGTLKGQLCPLDVDVEQIVQELKATPTPTDQVSRVSTRDPYHVPGPGKRVVLVDYGMKHNILQELIRRNCEVFVVPYHTSAEEVLRLGPDGVLLSNGPGNPEDVSEGVEMIRNLLGKVPLFGICLGHQLFALACGAKTEKLRFGHRGSNHPVRERSTGLIEITAQNHGYTVTEGSLVNTDLIVTHEAVNDGTIEGLAHKVHPAFSVQYHPEASPGPEDSNVLFDRFIKLMESNKHRALTV

SEQ ID NO: 17333 - protein, 305 aa, Bacillus halodurans
MAVPFLQDHDTKHDLLTMSHLSLEEIEHILHDAQQFENGALWSPEEKLFVANLFFEPSTRTRVSFEVAEQRLGLHVVNVDGERSSVQKGETLYDTAKTLESIGVNALVIRHRQDRYFEELKDRINIPIINAGDGCGHHPTQSLLDLWTIQQEFGRFSNLITVISGDLRHSRVARSNAETLTRLGARVYISGPREWMEGYEGVYPYVTMDEAVELADVIMLLRVQHERHDGTVSFTQASYHEQFGLTVKREARMKPKSIVMHPAPVNRNVEIASELVECPRSRIFKQMKNGVAIRMAVLKRALTDE

SEQ ID NO: 17334 - protein, 180 aa, Bacillus halodurans
MSRLILDEQAIRRATTRIAHEIIERNKGVSDCLLVGIKTRGIYLANRLQERIETIEGIKLPVGEVDITLYRDDLTVKSTTEEPILQGTDVPVDVTGKKVILIDDVLYTGRTVRAALDALMDLGRPEQIQLAVLIDRGHRELPIRPDYVGKNVPTSKQEQIVAKLSEVDGIDEVTIEQKTS

SEQ ID NO: 17335 - protein, 430 aa, Bacillus halodurans
MNHENQWQLETKAVHSGQEIDPTTLSRAVPLYQTTSYGFKDTDHAANLFSLSEFGNIYTRLMNPTTDVFEKRVAALEGGAAALATASGQAAITYSILNIAEAGDEIVSASSLYGGTYNLFSITLPKLGVNVRFVDPSDPENFKAAITEKTKAIFAESIGNPKGDVLDIEAVAKVAHDHHLPLIVDNTFPSPYLLQPIKHGADIVVHSATKFIGGHGTSIGGIIVDGGTFDWAKTDRYPGLTTPDPSYHGVVYTDAVGPIAYIIKARVQLLRDMGAAISPFNSFLLLQGLETLHLRMERHSENAYKVAEFLEQHQAVESVSYSGLPSHPSYPLAKKYLPKGQGAILTFEVKGGVEAGKKLIHSVQLFSHLANVGDSKSLIIHPASTTHQQLSEAEQRDAGVTPGMIRLSVGTESIHDIITDLKQAIEASQA

SEQ ID NO: 17336 - protein, 508 aa, Bacillus halodurans
MTIDTNFSKWFLQPSKESAQMYETVMQRALTLVVEHMKEAANPFSGADRHSIQQAVKDAAFISYSGEPIDGVIRAIQEGVMKHSLWISHPSAMAHLHCPPLLPSLVAEVVINALNQSMDSWDQSPSATYVETELLRFFTRSIGYSDLGDGVFTSGGTQSNYMGMLLARNKICESAFATNVQEEGLPVDARKLRILCSQEAHFSVQKSAAQLGLGANAVVQVATNERQQLCVNETRQTINELRLKGLIPFMIVATAGTTDFGSIDKLREIAELAREQELWLHVDAAYGGALLFSRQYGHLLNGLHLADSITIDFHKFYYQSISCGAFFVKDRHEFERIRFHADYLNPEEDKEADIINLVEKSVQTTKRFDALKLLVTFKWMGTEQFGQMIDYTIQLAKETGELLRRYGFDVLNDPELNAVVFRYVPECHRDDQSYVDQLNLTLQRHFYERGDLIMAKTKQRGHVYLKFTMLNPLNTIENMKTQIQKVKKAGIEFEKTQGAIRHEHVIHS

SEQ ID NO: 17337 - protein, 454 aa, Bacillus halodurans
MDVIAQVTATNQQFLSQQEKRESSARSYPRRLPLAIQKAEGICVTDMNGKQFIDCLAGAGTLALGHNHPVIRQAIEGVLASYVPLHSLDLTTPVKEAFVDEVFASLPESFAKKAKIHFCGPTGADAVEAAVKLVKTATGNRAMLSFQGGYHGSTHGALSLTGTTDPKKRIHALIPDTHFLPYPYEYRCPFGIGKDGHRVNSTYLESLLDDPESGLVKPAGIIVEVVQGEGGSIPAPVEWLKELRRMTSERNIPLIIDEVQTGIGRTGKMFAFEHAGIEPDVLVLSKAIGGSLPLSVVLYDRKLDQWEPGAHIGTFRGNQMAMATGRATLQYIKENQVPKHVHELGQYVKDQLSSIQSSMRSIGDVRGRGLMIGVEIIDPRKQPNAIGSYPAYGELAKAIQRHCFERGLILEVGGRFSSVIRFLPPLIITREQLDDVLERFYDATVQAEIEFGIR

SEQ ID NO: 17338 - protein, 1150 aa, Bacillus halodurans
MDGLKNIKKVLVANRGEIAIRIFRACTELHIRTVAIYSKEDTGAYHRYKADEAYLVGEGKKPIEAYLDIEGIIEIAKRHGVDAIHPGYGFLSENIEFAKRCHEEGIIFIGPELEHLVMFGDKVQAREQAIKANLPVIPGSDGPVSSLEDVKAFADKHGYPFIIKAALGGGGRGMRIVRSENDVQESYERAKSEAKAAFGNDEVYVEKFIENPKHIEVQILADKHGNTLHLYERDCSVQRRHQKVVEVAPSVSLSEDVRERICQAAVQLAENVNYVNAGTVEFLVDREGNFYFIEVNPRIQVEHTITEMVTGIDIVQSQLFIADGEHLHGDRLGIPKQEEIVCHGYAIQSRVTTEDPSNGFLPDTGRINAYRSGGGFGVRLDAGNGFQGAVITPYYDSLLVKVSTWALTFEGAAAKMLRNLREFRIRGIKTNIAFLENVVQHRQFLSGEYNTSFIDQTPELFVFPKRKDRGTKMLSFIGETIVNGYPGLEKTKKPVFDKPPVPKLKLSEPIPDGTKQILDQHGPEGLAKWVKEQKHVLLTDTTFRDAHQSLLATRVRTHDLKQIAEPTARLLPNLFSMEMWGGATFDVAMRFLHEDPWERLLILRKKAPNVLFQMLLRASNAVGYKNYPDNLIREFVDKSANAGIDVFRIFDSLNWVEGMKLAIEAVGEANKIAEATICYTGDILDSSRPKYDLAYYKKLAKELEAAGAHILGIKDMAGLLKPEAAYQLVAELKDTVTIPVHLHTHDTSGNGIFTYARAIEAGVDIVDVAVSSMAGLTSQPSANSLYYALADSERQPNVNITALEQLAEFWEETRKFYAGFESGMNAPHTEVYEHEMPGGQYSNLQQQAKAVGLGHRWNEVKKMYRTVNDMFGDVVKVTPSSKVVGDMALYMVQNDLTEEEVYENGHKLDFPDSVVEFFEGQLGQPYQGFPKKLQEIILKGRKPITNRPGENMEPIQFEAIKEELYNKLDRQVTSHDILSYALYPKVFMEFERFRQTFGDVSVLDTPTFFYGLRPGEEIEVEIEQGKTLIVKFISLSKPQDDGNRIVYFELNGQPREVLIKDQSVKTSIISRPKADKSNPNHIGASMPGTVVKALVEKGDKVKQGDHLMITEAMKMETTVQAPFDGEVVALHVKDGDAIQTGDLLIEVKEL

SEQ ID NO: 17339 - protein, 469 aa, Bacillus halodurans
MVVGDFAKEVDTLVIGSGPGGYVAAIRAAQLGQSVTIVEKGTLGGVCLNVGCIPSKALISAGHRYHNALHSDDLGIKAENVTLDFSKVQEWKASVVNKLTGGVEGLLKGNKVEIIKGEAYFASEDSVRIMDEKNATTYKFKNCIIATGSRPIELPNFKYSKRIINSTGALALEEVPKKLVVIGGGYIGIELTGAYSNLGSDVVVLEGGKQILPGFEKQMAKLVERKLKKNGVSFHTEAMAKGVEETEDGVKVTAEIKGKEEVFEADYVLVTVGRKPNTDELGLEQIGVELTERGLIKVDKQCRTNLSNIYAIGDVIEGPALAHKASYEGKIAAEAIAGEKSEIDYLAIPAVVFSDPELATVGYTETEAKEAGYDVTAAKFPFAANGRALSLNDADGFMKLITRKEDGLVIGAQIAGPNASDMIAELGLAIETGMTAEDIALTIHAHPSLGEITMEAAEVALGTPIHIVK

SEQ ID NO: 17340 - protein, 426 aa, Bacillus halodurans
MAYEFKLPDIGEGIHEGEIVKWFVKPGDEVKEDDILLEVQNDKAVVEIPSPVDGKILEVKVEEGTVAIVGDVLVTIDAGEGVGAEETEEAPAPEEKAEEAAPAEPAPAKETAPEEDGDEDKRVIAMPSVRKYAREKGVNIKKVKGTGKNGRILREDIDAFLSGDTQAEASEEKAETAAPAAASNVEPTEIPVGEREERVPLKGIRKAIAKAMVNSKHTAPHVTHMDEVDVTALVAHRKQYKEIAAEQGTKLTYLPYVVKALTSALKKYPVLNASIDDVNEEIVYKHYFNIGIAADTEQGLVVPVIKDTDRKSIFELADNINELAIKARDGKLSAAEMKGGSCTISNLGSARGQWFTPIINHPEVAILGIGRIEEKPVVKDGEIVAAPVLALSISYDHRLIDGVTAQNALNHVKRLLNDPQLMLMEG

SEQ ID NO: 17341 - protein, 325 aa, Bacillus halodurans
MAQMTMIQAITDAMRNELKRDENVLVFGEDVGQNGGVFRATEGLQKEFGEDRVFDTPLAESGIGGLAIGLGLTGFRPVMEVQFFGFVFEVFDSVAGQMARMRYRSGGKYHSPITVRSPFGGGVKTPELHADNLEGLMAQTPGVKVVIPSTPYDAKGLLISAIRDNDPVIYLEHMKLYRSFRAEVPEEEYTIPLGKADVKREGKDVSIITYGAMVHSSLKAAEELEKEGISAEVIDLRTISPIDIDTILESVKKTSRVIVVQEAQKQAGIGAHVASEIQERAILHLEAPIMRVSAPDTVYPFAAAEDVWLPDFKDIVEKAKAVIEF

SEQ ID NO: 17342 - protein, 361 aa, Bacillus halodurans
MSTKTLEKVEGQFETFQILNEEGEVVNEAAMPDLSDEQLQELMKRMVYTRIWDQRAISLNRQGRLGFYAPVAGQEASMLGSQFALDKEDWILPGYRDIPQIVFHGLPLYQAFLYSRGHFEGGQIPDGVNVLMPQIIIGAQIVQAAGVAMGLKRKGKQNVAITYTGDGGASQGDFYEGMNFAGAYNSPAIFVVQNNRFAISVPVEKQSAAKTIAQKAVAAGIEGIQVDGMDVLAVYAATKQARERALAGDGPTLIETLCYRYGPHTMAGDDPTRYRSSDLDDEWEKKDPLVRFRKFLEGKGLWSEEQENEVVEKAKEDIKAAIKKADAAPKQKVTDLIGFMFEEAPQHLREQLEEYTAKESK

SEQ ID NO: 17343 - protein, 183 aa, Bacillus halodurans
MTDKRMVAKQAPRFEMDAVMPNKEFGKVSLEENMKNDKWTVLFFYPMDFTFVCPTEITSLSDRYDEFEDLDAEVIGVSTDTIHTHKAWINTSRDDNGLGDLKYPLAADTNHEVSREYGVLIEEEGIALRGLFIISPEGELMYSVVNHNNIGRDVDETLRVLQALQTGGLCPANWKPGQETLSV

SEQ ID NO: 17344 - protein, 298 aa, Bacillus halodurans
MEIGLIGLGRMGYNLGLNILDHEHQLVAYDVNREAVKEIGLAGAKEADSLEELVSKLSAPRKIWVMVPAGDITENVVSQLSSLLDEGDVVIDGGNANYKDTLRRAKQYEAKGLHFVDAGTSGGIDGAREGACLMVGGTKEVVESLAPLLKEIAVEDGYLYTGPVGSGHFLKMIHNGIEYGMMQAIAEGFDLLENSPFDYDYEAVAKVWNNGSVIRSWLMELTESAFSKDANLEKIRGVMHSSGEGKWTVETALDLQIEAPVIALSLMMRYRSLRDDTFSGKVVAALRNEFGGHAVVKS

SEQ ID NO: 17345 - protein, 500 aa, Bacillus halodurans
MNDRYVIGLDIGTTSTKAVLFHYDGAVIGELEVEYPILRPQADWAEQDPDEIVNASKQAIRLLMERTSVSPSAVTAVGISSAMHSIICLNEDKQPLSNAIIWADTRSSEQAAQLRLSLGSQFMKRTGTPFHPMTPFCKLTWMKQKKYPPFIEASSFASIKEYLCLLWFGEHVVDYATASSYGMFDIDACVWDVEALQLLQLSSEQFGKPVPPTYTLYGMSAALADELGLLPSTPFVVGATDGPLANLGVGATGEGDTVITIGTSGAIRQLSYRPMVDEHQRTFCYRVDDHLFVSGGATNNGGIVLHWLQKLFAINGLEKNASFTPSYDSLLRLAEQSPAGANGVLFLPYLNGERAPIWDGAARGSFVGLGMSHHQPDMIRAALEGTIFSLYHVGQTLREMSGRPTRLFANGGFSRSRLWLQIAADMFNQELLLPKSHQSAAWGAAWYSLYALGEVPSLAAIKNSVPMTNSILPVTEHSLVYEKNFTFYEKLATSLPMLRK

SEQ ID NO: 17346 - protein, 526 aa, Bacillus halodurans
MHKIISMPKRLLVKEQNVQTKTTGERLRLFLEELGPTFVKMGQMASTRPDLIPSELMEELEKLQDRVSPFSYEEVKAIVEHELGMAVDELFREFHETPLGAASIGQVHFAVLQSGEPVAVKVQRPNIEEIIKTDLEILQHLAEIAEHRLEWAANYQLVEIIEEFSKALLAELDYTVEGRNADRLAKLFEDDPTVQIPQVYWDYSTKKVLTMEYVEGTKLNEREELKQRGYDEKMLAQRITHAILKQILLEGFFHGDPHPGNISALPSEAIAFMDFGMVGRLSPQMKQHFASLVIAIMRRRSEGVLNAITKMGIVPDDVDMQLLQWDIDELREKFDDVPLSQVSLGEAVNDLFAIANRHRIQIPADLTLLGKTLLTMEQMVEKLDPELSIVKVAEPFGRQLLKERLSPKSVAEHVYNQWNEYGDVLTELPRTLKELTAITRKGKLPLELSLPKIERFLNKLDRISNRLSFSIVLLSFSIIMVGLIIGSALGGQSSLLWNIPAVEIGFVVALLMFIWLLYSILRSGRF

SEQ ID NO: 17347 - protein, 447 aa, Bacillus halodurans
MTRFDENARSPWTPLHDVKTVELFPLNQRLDGSITLPGSKSLTNRALIISALANSDSMLTGMLKSDDTYWCIQALKRLGVQINVQGETTSIRGIGGQWKSSSLYIGAAGTLARFLLGALAISRSGNWEIEASQSMSKRPIEPLVGVLRELGATIHYLRREGFYPLSIHGNGLAGGTVRLSGQMSSQYISGLLIAAPYADTPVTITVQGSIVQHAYVFLTLHLMKSFGAQVEYDQQLQTIVVHPTPYTCQDIDLEADASTACYFLALAALTKGRIRLNNLTASTTQPDLHMLTVFEKMGCTVTRGSSFIELEGVSQLKGGFQISMNEMSDQALTLAAIAPFADGPITITDVEHIRYHESDRIAVICEALTRLGIQVDEFEDGLTVYPGTPKPTLHPLSTYDDHRVAMSLSLIGTKVKGLRLNDPGCVAKTCPSYFQLLEQLGIQVHYQ

SEQ ID NO: 17348 - protein, 430 aa, Bacillus halodurans
MTILKEPQRTQVDEIKEITELSLLQSTQSVIKEALDLLGYSEATYELLKEPIRMLTVRIPVRMDDGNVNIFTGYRAQHNDAVGPTKGGVRFHPDVNENEVKALSLWMSLKCGIADLPYGGGKGGIICDPRTMSFGELERLSRGYVRAISQIVGPTKDIPAPDVFTNSQVMAWMMDEYSRIREFDSPGFITGKPIVLGGSLGRESATAKGVIICIEEAAKRNQLDLKGARVIIQGFGNAGSFLAKFLHDAGALIVGISDAYGALYDQAGLDIEYLLDKRDSFGTVTNLFKKTISNQELLISDCDILVPAAISNQITKENAHDIKAKVVVEAANGPTTLEATRILTERGIFLVPDVLASSGGVTVSYFEWVQNNQGYYWNEEEIDQKFRNMIVGSFEKVCTFSNQHQVDMRLAAYTVGVKRMAEASHFRGWV

SEQ ID NO: 17349 - protein, 1014 aa, Bacillus halodurans
MKTHSNVSWLRDVNVFAVNRLPAHSDHVYYETVEEAKKEPPMSMRHSLNGHWKFHYAINPNTRPKEFYQLGFDCKCWDDILVPGHIQLQGYGKPQYVNTMYPWDGHHHLRPPEIPEDDNPVGSYVKYFDIPNNMSNHPLFISFQGVETAFYVWLNGEFVGYSEDSFTPAEFDLTPYAVEGENKLCVEVYQRSTGSWLEDQDFWRFSGIFRDVYLYTIPNIHVYDMHVRADLDRSLQTGILETTLELKRSQEKEVMIVAELYDAEGAVVATADMKTNQDQATVSMSVDSPALWSAEDPYLYKLFLKLFDENGTLVEVVPQKIGFRRFELVNNIMTLNGKRIVFKGVNRHEFNGRTGRVVTKEDMLEDIKTMKKHNINAVRTSHYPNNSEWYQLCDEYGLYVIDEMNLETHGSWQKLGKVEPSWNIPGNHLEWEPIVMDRAVSMFERDKNHPSILIWSCGNESYAGEVILNVSRYFKSVDPSRLVHYEGVFHARAYDATSDMESRMYAKPKDIEDYLTNDPKKPYISCEYMHAMGNSLGGMHKYTELEQKYPMYQGGFIWDYIDQALLKKDRYGKEYFAYGGDFGDRPTDYSFCANGIVYADRKPSPKMQEVKFLYQNIKLVPDREGVLVKNENLFTDTSAYQLEYVLYWEGTELYRKKQDVFVAPQEEVYLPFDWLEQGMNESGEYCIHTMLTLKQDQLWAEKGHEVAFGQHVYRMGAIQKERNARGALKVVHGDVNIGIHGEDFSVLFSKAVGSLVSLHYAGKEMIEQPPMPLFWRATTDNDKGCSQLYHSGIWYAASLARKCVNMEVEEKPGHVSVLFTYHFAISDRVEVKVGYTVFPDGSLRVRSTYQASKGGETLPQLPMFALSFKLPADYEQLEWYALGPEENYADRATGARLCTFKNKVEDSLSQYVTPQESGNRTGVRTVKILDANGQGIEVCSVEEPIECQISPYTAFELEQASHPYELPNVHYTVVNVAGKQMGVGGDDSWGAPVHDEYVLKADQDLEFVFDINRV

SEQ ID NO: 17350 - protein, 470 aa, Bacillus halodurans
MLAKEVKEKLIKIVGLENVEDSPVERLVYSYDATPQFQALPDAVVSPRNTKEVAEIVKICNEYNIPIVPRGSGTNLCAGTCPTEGGIVLLFKHMNSILEIDEENLTVTVQPGVITLDMIRAVEEKGLFYPPDPSSLKISTMGGNINENSGGLRGLKYGVTGDYVLALEVVLANGEVIRTGGKLAKDVAGYDLTRLMVGSEGTLGIVTEATCKLIPKPESKQTMLALYQDIEAAAQTVSSIIANKVIPTTLEFLDQPTLKVVEAHAQIGLPTDVQAVLLIEQDGPSEVVKREMEKMHALCEQGQAISVQIAESEDEAEALRTARRSALSALARLKPTTILEDATVPRSEIANMVKVINEIAEKYELTICTFGHAGDGNLHPTCLTDIRNHEEIERVEKAFAEIFEKAIALGGTITGEHGVGVMKAPYLERKLGEAGMAAMKAIKEALDPNHIMNPGKVFAKDCRKRVVVSR

SEQ ID NO: 17351 - protein, 515 aa, Bacillus halodurans
MLQPYKHEPFTDFTVEANRKAFEEALGLVEKELGKEYPLIINGERVTTEDKIQSWNPARKDQLVGSVSKANQDLAEKAIQSADEAFQTWRNVNPEERANILVKAAAIIRRRKHEFSAWLVHEAGKPWKEADADTAEAIDFLEYYARQMIELNRGKEILSRPGEQNRYFYTPMGVTVTISPWNFALAIMVGTAVAPIVTGNTVVLKPASTTPVVAAKFVEVLEDAGLPKGVINYVPGSGAEVGDYLVDHPKTSLITFTGSKDVGVRLYERAAVVRPGQNHLKRVIVEMGGKDTVVVDRDADLDLAAESILVSAFGFSGQKCSAGSRAVIHKDVYDEVLEKTVALAKNLTVGDPTNRDNYMGPVIDEKAFEKIMSYIEIGKKEGRLMTGGEGDSSTGFFIQPTIIADLDPEAVIMQEEIFGPVVAFSKANDFDHALEIANNTEYGLTGAVITRNRAHIEQAKREFHVGNLYFNRNCTGAIVGYHPFGGFKMSGTDSKAGGPDYLALHMQAKTVSEMY

SEQ ID NO: 17352 - protein, 498 aa, Bacillus halodurans
MRYVLGVDLGTSAVKVLLVNERGEVCKQVTKSYPLYQDKPGYSEQDPEDWLNQTIEAISEVTSEASDPEAIDGISFSGQMHGLVLLDQEQRVLRPAILWNDTRTTNECREIEQTLGKETLLAIAKNPALEGFTLPKLLWVKKYEPDVFARANVFMLPKDYVRFRLTGKIHSEYSDAAGTLLFDVAKKEWSKDICSCFELPISLCPPVVPSSGEVGELLPEIAAKTGLKKDVRVFAGGADNACGAIGAGILKDGATLCSIGTSGVVLSYEQAADQDFAGKVHYFNHGEATAYYTMGVTLAAGYSLSWFKETFAPEEPFENIVKEIEKSPPGANGLLFTPYIVGERTPHADATIRGSFIGVHAGHKRHDFTRAVIEGITFSLNESIEIFRKNGKDISTVVSIGGGAKSPAWLQLQADIFQAKVIKQSSEQGPGLGAAMLAAYGLGWYDSLADCAEAWVKEQESYEPNAEKGKAYEELFTLYRHVYEQTYELNHGLSKFRE

SEQ ID NO: 17353 - protein, 426 aa, Bacillus halodurans
MATEITMPQLGESVTEGTISRWLVKPGDKVNKYDPLAEVLTDKVNAEIPSSFSGTIQELLVEEDETVAVGHVICTMNVEGEAVEAETNDTSVSSAETTESPTETQEQSTSAKKRYSPAVLRLAEEHDIDLTHVTGSGKGGRITRKDLQAIIEGGDIPKAAPMTEQKTAPVHETMPLTEKVQEPVQVPTVSGDVEIPVSGVRKAIAQNMVKSKHEAPHAWTMVEVDVTNLVQLRNQLKEGFKKKEGFNLTFLPFFIKAVVEALKAYPQLNSMWAGDKIIQKKDINISLAVATDDALFVPVIKHADEKTIKGLAREVNELAHKVRTGKVTSSDMQGGTFTVNNTGSFGSVLSTPIINHPQAAILSVESIVKRPVVIESEAGDMIAIRSMVNLCLSLDHRVLDGLICGRFLAKVKNILENMTIENTSIY

SEQ ID NO: 17354 - protein, 327 aa, Bacillus halodurans
MAVMSYIEAVTLALKEEMERDENVFVLGEDVGARGGVFRATNGLYEQFGEARVLDTPLAESAIAGVGIGAAMYGMRPVAEIQFADFIMPAVNQIVSEAAKIRYRSNNDWQCPITIRAPYGGGIHGALYHSQSVEAMFANTPGLKIVMPSTPYDVKGLLKAAIRSDDPVLFFEHKRAYRLIKGEVPENDYTLPIGKADVKREGDDVTVITYGLAVHFALQAAERLEKDGISTHILDLRTVYPLDKDAIIEAASKTGKILLVTEDNKEGSIMSEVAAIIAEHCLFDLDAPIQRLAGPDVPAMPYAPTMEKHFMINPDKVEKAIRELAEF

SEQ ID NO: 17355 - protein, 330 aa, Bacillus halodurans
MTEPRHKQLGLSDETVVHMYETMLLARKIDERMWLLNRAGKIPFVISCQGQEAAQVGAAFALDRTKDYILPYYRDMGVVLTFGMTAKDLMLSGFAKAEDPNSGGRQMPGHFGSKKLRIVTGSSPVTTQVPHAVGIALAGKMKGEDFITFTTFGEGSSNQGDFHEGANFAGVHKLPVIFMCENNKYAISVPIEKQLACEKVSDRAIGYGMPGVTVDGNDPLAVYEAVKQAADRARRGEGPSLIETVSYRLTPHSSDDDDRAYRSREEVEEAKKYDALITFAEYLLETGALTEEGKEAMDKRVSDMVNEATEYAERAPYADPEQALGHVYAE

SEQ ID NO: 17356 - protein, 474 aa, Bacillus halodurans
MAEEYDLVILGGGTGGYVAAIRATQLDLKVALVEKGKLGGTCLHKGCIPSKALLRSAEVFSTVQKADQFGVKIDGAALDFTSVQNRKEQIVTQLHRGVEMLMKKGKIDVYKGHGRILGPSIFSPTPGTISVEMNNGEDNMMLIPRNVIIATGSSPRVLPGMEIDGEAVLTSDEALKMEQLPKSMLIVGGGVIGIEWASMLNDFGVDVTVIEYGPRILPTEDADIAKEAERLLKKRGVTFKTNAKVLAETLEKGDNSVVIEAEVGGVSERFTAEKMLVSVGRTPNVNDIGLENTDIEVIDGAIAVNEWYQTKESHIYAIGDVIGGMQLAHVASHEGILAVEHMTDHKPEPLNYLTVARCVYSHPEMASIGLSEAEAKEKGYEVKVGTFPFQAIGKALVYGESDGFVKILSDKKTDDLLGVHMIGPHVTDMISEAALAKVLDAAHWEVAHTIHPHPTLSEVVGEAALAVDGKAIHF

SEQ ID NO: 17357 - protein, 629 aa, Bacillus halodurans
MDLEKLHDPSLIKSMTKQELEQLAEEIRQFLIEKLSITGGHLGPNLGVVELTLALHSLFDSPKDKLIWDVGHQAYVHKILTGRAGQFDQLRQYKGLCGFPKRDESEHDVWETGHSSTSLSAAMGMATARDLKGTDENVIAIIGDGALTGGMALEALNHIGHEQKDLIVVLNDNEMSIAPNVGALHNVLGRLRTAGKYQKAKEDLEMLIKKIPAFGGKLAQAAERVKDSLKYLLVSGIFFEEMGFTYLGPVDGHDLDDLMENLKYAKKTKGPVLIHVLTKKGKGYAPAENDEKGTWHGVGHYKIESGELVKKPAPPSYSGVFAETLKKIARNDPRIVALTAAMPGGTKLDQFAKEFPDRMFDVGIAEQHATTMAGGLATQGLKPVFAVYSTFLQRGYDQVVHDICRQNLNVFFAIDRAGLVGADGETHQGVFDIAYLRHLPNMKILMPKDENELQHMVYTAIQYEGGPIAVRYPRGNGYGIKMDEVLKEIPIGSWEVLQEGTDACILTFGTMIPVAEQASKELSQQGYSIRLINARSVKPLDEAMLHEIAKSGRPVLTLEETAVQGSFGSAVLEFFHDHGYHNVVTQRMGIPDRFIEHGSVSELLEEIGLTSSQVANQLSKLLPRKQKRA

SEQ ID NO: 17358 - protein, 294 aa, Bacillus halodurans
MSVQLLQFLDEIKDIIEERMPAHIERLNSPDMLKNSMLYSLKAGGKRIRPALLLATMKSFQKDISQGIDLACAIEMIHTYSLIHDDLPSMDDDDIRRGKPTNHKVFGEAHAILAGDALLTYSFEIVAKMKGVDPAKTLCLIEELARAAGPEGMVGGQVADIEGENQKLTVEGLEYIHHHKTGALLSFAIVAGARLADASEQDIENIRRFSRELGLLFQIKDDILDVEGDQAAIGKPVGSDDGNQKSTYPSLLTLEGAKEKLHLHTLLAKEYLYSVQMNHRLLEELTDYVVNRNH

SEQ ID NO: 17359 - protein, 279 aa, Bacillus halodurans
MSAVLLDGKALAAKKRDELKSEVTKLKERGITPGLAVILVGNDPASTVYVRSKQKACEQIGIYSVLKELPASTSEEELLTEIDRLNNDPTIHGILVQLPLPEQISEQAVIERISPAKDVDGFHPISVGRMMIGEDTFLPCTPFGVLVMLQEANVEIAGKHVVVVGRSNIVGKPVGQLMLNEHATVTYCHSRTKNLTEITKQADILIVAVGRARFIDASHVKEGAVVIDVGINRVDGKLCGDVDFESVREVASHLTPVPGGVGPMTITMLLANTIQAAKE

SEQ ID NO: 17360 - protein, 452 aa, Bacillus halodurans
MIKKLLVANRGEIAVRIIRACRELGIETVAVFSEADRDALHVRMADEAYCIGPTPSAKSYLNFTNIMSVATLTEVDAIHPGYGFLAENADFAEICGECNITFVGPSADAISKMGTKDVARETMKRAGVPIVPGSEGIIESVEDGLAVAEQIGYPVIIKATAGGGGKGIRVARNEEELRKGINITQQEAATAFGNPGVYLEKYIEDFRHVEIQVLADNHGHVIHLGERDCSIQRRLQKLLEETPSPAITEKKRKEMGEAAVAAAKAVNYSGAGTVEFIYDHNNGDFYFMEMNTRIQVEHPVTEMVTGIDLIKEQIKVASGKPLSYKQEDVTFNGWSIECRINAESPEKNFMPSPGKLKSYLAPGGLGVRVDSAAYPGYTIPPFYDSMIAKVITHGATRDEAIAKMKRALAEFEVEGIETTIPFHLRLLNHETFVSGDFNTKFLEIYNIMEESK

SEQ ID NO: 17361 - protein, 169 aa, Bacillus halodurans
MLKVQEIRELIRAVDQSDLDEFKLEQEGLKLVLKKSQGETVAYQQPVQSAPVPAPVVQAVQEPPKGQAVQAAPASEPVKEEAETKATDNLHKITSPMVGTFYVAPSPDSDPYVKVGDNVSENTVVCIVEAMKLMNEIEAEVKGKIVEVLAENGELVEYGQPLFVVEPQK

SEQ ID NO: 17362 - protein, 145 aa, Bacillus halodurans
METIMVINGPNLNRLGKREPDIYGRETLSDLHERLIKFAEARGYKADCRQSNHEGDIIDWIHEAEGRSSGVILNPGAFTHYSYAIRDAIASISVPVIEVHLSNVHARESFRHTSVTAPVTKGQIVGLGVIGYELAMLALLEGEKK

SEQ ID NO: 17363 - protein, 780 aa, Bacillus halodurans
MRIALHNGQHVDLAHCDRQDWQKLYMASVGQEIKCMHCGKPVRLRLTIQHEPTFVHRHPSELCLQKEVDYIEQKQQVKSNHTSSPTGTFVGSFRLPKQQKISNGSTEMIKKWKEPERMTSFPPFIPNEVNTNQSRSPFDERLKEQGIFLNDDQWQAITTTEGPLLIIAGAGSGKTRVLTTRAAYMISEQQIDPLSMLLVTFTQKAAREMQERMSTYFTLPTNRLKRLAIGTFHSIFYRIAAHATPEKWRMDKLLKWDWQRMQLLREHGQKKGLDEKEFAYDQALTQISWWKNHMLHPGDIQPKSTWEENCLYLYEGYERSRISQQWFDFDDMLIGAYETLTQNHELLARYQERFRYLFVDEYQDINKVQYELIRLLTQKEKNICVVGDDDQSIYSFRGSDPSYIQAFERDYEHAKQIVLKDNYRSSHPIVMCAQNVIHHNKQRIAKSVRAQYDSEKAPLLFYPYDEEEEATMILSDIQEKIASGTSPSAFAILYRTNVSVRAMFERLVASNVPFRMEQEGESFYQRSTVRKVLAYLRLSVNQDDPKAMEELLPALFLKKDTLQELKAITIFHDCSLLDALLHLKNVQPFQQKKLKKLLPYFQKLPHLSPTQAISMIEKHMGLTDFIKKRGNEGNVMDRGSDDLKDLIVAANSFATIPTFLDHVSHMIAKHHELKKAPAQEEAVQLMTIHRAKGLEFQHVYLLSAVEGSLPHDYALDAWREGDDRPLEEERRLMYVAMTRAQEQLFISVPSMRRGKNAQRSRFVREMLRNHRQHQRKGVEQ

SEQ ID NO: 17364 - protein, 260 aa, Bacillus halodurans
MIQLSLVDRTYVVMGVANKRSIAWGIAQSLANAGARLIFTYAGERLEKNVRGLVETLERDDHLVLECDVTSDEAVEATFASIKEQVGTIHGLAHCIAFANKEELEGEYLNTTRDGFLLAHNISAYSLTAVAKAARPLMNEGGSIVTLTYLGGEKVVRNYNVMGVAKASLDASVKYLANDLGKENIRVNAISAGPIRTLAAKGIGGFNDVLREIEERAPLRRTTTQEEVGDTALFLMSDLSRGITGEILHVDSGYNILSLS

SEQ ID NO: 17365 - protein, 614 aa, Bacillus halodurans
MLTPLIRTGEKGSGAFKPISWERALSIIVDRFEAIIASANPTAILPYSYSGTIGIIQNGSMDRRFFHRLGAATLERTICAAAGTEAFRYTMGASVGLQPEETRFANLVIVWGSNLVVTNVHQWLYILEARKRGAKVIVIDVERTETARQADWFIQIKPGTDLELALGIQHVLIEEELINGSFIERQTVGFRELAAHVATYSLDRVERMTGINKEDIQRLARMYGTEKRSFIRIGNGQQHHHSGGMSTRAILSLPALTGAWEAKGGGAIYFNLKHGEYSSDILHRPDLRTNEERRVNMNELGKVLLSQQEPILALFVYNSNPASVAPDQRKVLQGLARDNLFVVVHEQQLTDTAKFADIVLPATTFLEHDDVYRSYWHPYWQLGRRVISPIGQSKSNTELFRMLANAFHFQELCFRDNDETLMKQAIFGDSSVDSGVWEQFLSGKPIRWKPTHLSAQQIEPWKIGEYETPSGKIELYSEAMHEAGLPPLPEKIPYKQAAAPYQLIISPSRKGLNSQFIEYAKGKPVVQLSKEDAMREGIYDGDRVCLFNDHGQLTCTANVSEACQQGVIIARGVWWHHQHEQQGNFNTLTGGDLSDFGGGATFFSTYVQVKKSEA

SEQ ID NO: 17366 - protein, 411 aa, Bacillus halodurans
MNRRVVVTGIGAVTPLGNTAEETWEKAIAGQSGVGLLTRVEAADFPMKVAAEVKEFDPTTHIDRKEARKMDRFTQFAVASALMALKDADLEITEDIAPRVGVWIGSGIGGMETYENQFRMFIEKGYRRVSPFFVPMMIPDMASGQVSIITGARGINSCSVTACASGANSIGDAFKVIQRGDADVMITGGAEAPITNMAVAGFSMAKAISTSEDPNTASRPFDANRDGFVMGEGSGILILESLESAEKRGAKIYAEIVGYGATGDAYHVTQPAPEGEGAARAMKQAIEDAGLTPEDIQYMNAHGTSTYYNDKYETLAAKQVFGDHVNNLAISSTKSMTGHLLGAAGAVEAIFSVKAIEEGIIPPTINYETPDPDCDLDYVPNEARKQGVNAVLSNSLGFGGHNATLVFKKYQ

SEQ ID NO: 17367 - protein, 312 aa, Bacillus halodurans
MTRAGILGIGSYVGEHVVTNKDFEKRIDTSDEWIRTRTGIEERRFAPDNVDTSDMAYEASVKALKAAGVSAEEIDLILVATVTPDMPFPTVSTLVQQRLGAKKAAAMDISAACAGFIYGLATGQQFIENGGYKHVLVIGVEKLSKITDMTDRNTAVLFGDGAGAAVMGAVSEDRGILAYELGADGEGAMHINQKGEYIQMNGREVFKFAVRQMGESALSVLEKAGLSKEDVDFLIPHQANIRIMEASRERLELPVEKMSTTVKKYGNTSSASIPMAMVDELKDGKIKDGDLLVLVGFGAGLVWGSLALRWGR

SEQ ID NO: 17368 - protein, 319 aa, Bacillus halodurans
MNHLSEKVISLKGRDLLTLLDYTPEEVQQLLTQALELKQKAKNGEPTPYLTGKSLGMIFENASTRTRVSFEVGMTQLGGHALFLSPKDLQIGRGEPIKDTANVLSRYVDAIMIRTNSHESVEELAHYATVPVINALTDAYHPCQALADALTILEKKETLIGKKLAYIGDGNNVCHSLLAIGAKTGMDVTVATPKGYEVDQEIFQRATEAAKETGATLVQTTNPQVAAENADAIYTDVWASMGYEAEQSEREEVFQPYQVNDQLLTLAKKDVSFLHCLPAHRGEEVTASVIDGPHSAIYDQAENRLHAQKAVLTALLIGE

SEQ ID NO: 17369 - protein, 1047 aa, Bacillus halodurans
MPKRTDIQSVLVIGSGPIVIGQAAEFDYAGAQACLALREEGIQVILVNNNPATVMTDEACADVVYFEPLTVASVKNIIERERPDGLLATLGGQTGLNLAMKLEEAGILEAYNVELLGTPMESIKKGEDREAFRQLMHELHEPVPESEIVHSVAEAVDFANTVGYPIIVRPAYTLGGAGGGIAESEEALIRIVKGGLELSPIQQCLIEKSIAGFKEIEYEVMRDSNDTCITVCNMENIDPVGVHTGDSIVVAPSQTLTDQEYQMLRSASLKIIRTLGIVGGCNIQFALDPDSKQYYLIEVNPRVSRSSALASKATGYPIARMAAKLSLGYGLHELKNPVTEDTYASFEPSLDYVVVKFPRWPFDKLVHVNRELGTQMKATGEVMAIERNLEAGLQKAVRSLEIKTHGLSLPSLSQWEDSELWVIVKKADDRRFFAILELLRRGVTIEAIHEQTKIDRFFLTSFAKLMTLEKEIAGQSLDDITSDELSTYKKYGFSDEWLASSWGVGLADVRHTRKALGVVPSYKMVDTCAAEFEAKTPYYYSSWTGENDLLLPEKAKERVLIIGSGPIRIGQGIEFDYCSVHGAKSLRARNFEAIIINNNPETVSTDYETADRLYFEPLAVEDVLNVIEVENVDHVIVQLGGQTAIGLTKGLEEAGVSILGTTQDVIDQLEDRERFYEFMRSVEVPHIPGKTAETKEELLKAAQSIGYPILLRPSYVIGGQGMFIASNQEELAAFCEDKNHSVTFPILVDAYYPGVEFEVDVLTDGSDIFIPGMFEHVEKAGVHSGDSMAVTPPPTLEAKWKQQAINYTRQIAKGMAYKGLFNIQFVLYDEELYVIEVNPRASRTVPIFSKATSLPLITYTIDVLFGKTIAELGLSAGYRKESPYYTVKAPVFSYQKLAGLDPLLEAEMKSTGELIAISKDLPSAFRKAFAWGEEQTPALFRKKGSVFCQVDRAYDTEWQPLLRQLKEKGYSVVTEEAMSFSEWLASEDAICLVSVPAPGQKTGKQNREEALKQRVTVVSDLATFEKMIECLEVKDGEPFLLPDVVMN

SEQ ID NO: 17370 - protein, 359 aa, Bacillus halodurans
MKAYLVLATGETFAGEIANAKEDVYGEVVFFTGMTGYQEVLSDPSFKGQLVVFTYPLIGNYGINASDFESKEPQAAGLIVSEQSEEGHHYEATQSLQQFCDQHQLPLLTGIDTRAVVKRIREQGDMPAVITTDLSRVSFEEWVPLSERALVDEVSTKKVETFEGNGPHIVLIDYGFKQSILNSLLKRDCQVTIVPYDVSFEVVQELNPDGLLFSNGPGDPKQIEDRLPTIYRLASTYPSLGICLGHQLLALAFGADTEKLRFGHRGANQPVINLKSNRVYMTSQNHSYVVKEDSLQRTDWDATFKNINDGSIEGLTHKYLPIQTVQFHPEAHPGPSDSDEIFHSFIDDVAAKGREKTYA

SEQ ID NO: 17371 - protein, 384 aa, Bacillus halodurans
MSHLFPTYAKWDVTITSGKGTKLYDNQGNEYLDFVSGIAVCNLGHCHPKVVAAVEEQLHSFWHVSNLFHIPIQENVAALLTEQSGMDAVFFCNSGAEANEAAIKLARKATGKHEIVTFTQSFHGRTLGTMSATGQDKIKTGFGPMLETFHHVPFNDIAALKQVVNEQTAAIVLEVIQGEGGVNLIDPEFAASVNHVCQEHGILLIIDEIQTGIGRTGTAFAFQQYELTPDIITVAKGLGNGFPVGAMLGKQHLIDAFSAGSHGSTFGGNPLAMAAAQAVLTEVFQPNFLQAVQEKGKQLLSGLNEALSGLEIVKEIRGNGLLVGIELQEEGAPFIKQLREKGLLVLNAGPNVIRLLPPLVVTSEELHEAVTQLKEVLDQASVHA

SEQ ID NO: 17372 - protein, 260 aa, Bacillus halodurans
MGDIVVIKCGGSVLDSLSDSFFTSVRRLQAEGAKPIIVHGGGPAINGMLAKLEVETTFVDGLRKTTDSVLSVAEMVLCGQTNKKVVRKLQKAGVKSIGLSGSDGELVRVKAIDEAILGYVGEPVHVNGELLHMLVADGFVPVLAPIGVNDEFEPYNVNADTVAGAVATALQAKELIFVTDVAGILKDDELVPALTPEEVESLIEEGTIYGGMIPKVRSAIHSLTGTLEAVSIVNGNDVFFAESGKLIGTTIKKQVIHSQG

SEQ ID NO: 17373 - protein, 411 aa, Bacillus halodurans
MNVINETANVLKLETGSVTSAKGFSAVGIHTGVKRKRKDLGAIVCEVPASSAAVYTLNKVQAAPLKVTQESIAVEGKLQAMIVNSGIANACTGKRGLDDAYTMRAVGAETFHIPEHYVAVTSTGVIGEFLPMDVITNGIRQLKPEATIEGAHAFNEAILTTDTVEKHTCYQTIVNGKTVTVGGVAKGSGMIHPNMATMLSFVTTDANIDHGHLQGALSAITNETFNRITVDGDTSTNDMVVVMASGLAENEALTPEHPDWANFYKALQLACEDLAKQIARDGEGATKLIEVEVTGAANDQEAGMVAKQIVGSDLVKTAIYGADANWGRIICAIGYSGCEVNQETIDIAIGPIVTLKQSEPTGFSEEEATAYLKEADPVKISVNLHIGNGTGKAWGCDLTYDYVRINAGYRT

SEQ ID NO: 17374 - protein, 345 aa, Bacillus halodurans
MKVGIVGATGYGGLELIRLLSQHPNVEEIICYSSSQEGLPLDDMYPHLSGNVRWTLKAIDPEAIRADVDTVFLATPPGVSGELTPDLVKLGLKVIDLSGDLRINEPDVYEAWYKRQAAPVGTIRGAVYGLTEWQRDEIAAAQIIANPGCYPTAVLLGLAPLVQQKWIDPKRIIIDAKSGTSGAGRNPSQITHFSEMNENFKIYQVNQHKHTPEIEQQLRNWDESVGNVTFSTHLVPMVRGIMATIYAEANQAISEKELREHFAYVYETSPFVHVYSEGRYPATKEVFGSNRCHIGVTYDERTNRITVVSVIDNLVKGAAGQAIQNYNVMNGYEETLGLEGSPLYP

SEQ ID NO: 17375 - protein, 561 aa, Bacillus halodurans
MSTQWWKESVVYQIYPRSFQDYNGDGIGDIPGIISRLDYLKTLGVDVIWLSPVYDSPNDDNGYDIRDYKAIMDEFGTMADWETLLAEIHTRGMKLIMDLVVNHSSDEHAWFVESRKSKDNPYRDFYIWRPGKDGKEPNNWASNFSGSAWTYDETTGEYYLHLFSKKQPDLNWENPKLREKIYEMMTWWLDKGIDGFRMDVINFISKVDGLPDAEPQPGQPYVSGSNYFMNGPNIHTYLQEMHENVLQHYDLMTVGEMPGVTLELAQLYTGEERNELNMVFQFEHVGLDQGPNGKWDLKPLELKDLKASLSRWQKGLQDIGWNSLYWNNHDQPRIVSRFGDDQSYRVESAKMLATLLHCMKGTPFIYQGEEIGMTNVRFDSIEQYQDIETLNMYKEKRAQGVPHETLMASIHAKGRDNARTPMQWDETKHGGFTDGTPWLEVNPNYKEINVKQALKDPNSIFYHYQKLIQLRKEHAILVHGSYDLILEDDPEIFAYKRTYNGQTLLVVCNFYGRITDFECPAEVVLSEPTLLLSNYDEEENGSYTSFRLRPYEARVYLGKNE

SEQ ID NO: 17376 - protein, 578 aa, Bacillus halodurans
MKATIYHRPKSEDAYAYDKSTMHIRLRTGKNHVRKVNLIYGDPYDWTKNQWVTSKKEMTPTGSDAQHDFWFVEVTPPYRRLRYGFEIITKTETIYYGESGFLDTPSKDTSDYFCFPFMNPADLFSPPEWVKDTVWYQIFPERFANGDPSRNPEGTLPWGSAAPTPTNHFGGDLQGIIDHLDYLQELGINGIYLTPIFEASSNHKYDTIDYLKVDPHFGDKTTFKRLVDECHKRGIRIMLDAVFNHAGFYFPPFQDVLKNQQHSKYSDWFHLRDFPVRAEEPPNYDTFAFTPFMPKFNTENEEVREYLLNVATYWIKEFDIDGWRLDVANEVDHAFWREFRKRVKALKPDLYILGEVWHNSLPWLAGDQFDAVMNYPLTNAIIDFAGKQKIGQQRFEHVITQLTHMYPIHVQQVAFNLLGSHDTPRILTQTDNDVARVKLQFLLLFSQRGTPCIYYGDEIGMTGGQDPGCRKCMVWEEEEQNQELLSFVKRLIQLRKQEKAFGTEGDLTFVENDSSLLIYQKTYENQQLLFVINSTDQPDSVQLPVSWTNRNANDLLTGETFSLATEIVIPAKSAMVLK

SEQ ID NO: 17377 - protein, 461 aa, Bacillus halodurans
MAMVEDTRPEHTYAEQTPRSKSWIEQAKKVMPGGITANIKHFAPYPIVMKKGCGAFITDVDNHQYVDYLLAYGALMLGHGHPEVKQAIDEMFADSGTLLFGAPHPLEVTFGHEIQQLYPSMERLRYTNSGTEATLLAMRIAQAYTNKKRIAKFEGHYHGGYNDVLYSVSPTLSEAGPADAPIPVKESKGMHVTDGEEPLILPFNNLTACERLLRAQQDSIAAVMIEPLQGGFIPATDTFIAGLRELTEELGIVLIFDEVKTGFRIRLGGAQEWYGVSPDLTTLGKVIGAGFPFGIVGGRKDIMEVTSPTTGSDVFDQSQSTFSRAKDVVFHSGTYNGHPLILAAGLKTVDVLKRDIKDVFARTDMLKDELEALFVRKGVPMKAVGIGSIFSVVLTEEDIFNYRDLQASDLQTRKLIDLHLLNEGIYTKPLNRYSLSTAHTEREVERTISAYDRVLSRLFGG

SEQ ID NO: 17378 - protein, 258 aa, Bacillus halodurans
MIEFKNVSLVYPNGTQGLKDVNLKINEGEFVVIVGLSGAGKSTLIRSMNRLVTPTEGELLIDGENILPYSSRQLRKLRTKVGMIFQNYNLVKRSSVMKNVISGRLGHVGTFASLLNLYPKEDVALAYRSLQRVNIAEKVYQRADQLSGGQQQRVAIARVLTQQPKIILADEPVASLDPPTSHQVMTYLRKINKEDKITTIVNLHFIDMAMEYADRIIGMRAGEVVFDGPASDVSEETFEEIYGRKIREDDLVGGQDNE

SEQ ID NO: 17379 - protein, 300 aa, Bacillus halodurans
MDRKKIAVIGAPMDLGQNRRGVDMGPSALRYAGLIERLQSIGYHVDDMGDIPIDRPGEVSEEKTNLKNLGEVIKANELLCLHVEKAVANGYFPLVLGGDHSIAIGTLAGVAKRRHQLGVIWYDAHGDLNTAETSPSGNIHGMPLAVSLGIGHEKLTSIGGFAPKIKPENVVIIGARSLDEGEKAYIREHGMKIFTMHEVDRLGMTRVMEEAIAHVSNGTDGVHLSLDLDGLDPNDAPGVGTPVLGGISYRESHLAMEMLAEAEIVTSAEFVEVNPILDERNKTAEVAVELMGSLFGEKLL

SEQ ID NO: 17380 - protein, 430 aa, Bacillus halodurans
MQNERQAIEWIHSFLPFGIKPGLQRIEWMLEKLGHPEKELNVVHIGGTNGKGSTVSFMRCMLTEAGYNVGTFTSPYIEHFRERIAYKGEPISSEELVRSCLNIIDVVEELKRTDLGSPTEFEVITVIAFDFFARVNPDIVLLEVGLGGRLDSTNIVTPLLSIITSIGHDHMNVLGGTLESIAYEKAGIIKPDIPAIVHVKQPEAFRVIQDKANKVKAPLFAYGTDFHSLPKSVTMDKQFFSYQSQSGLTLSLETVMKGHHQIENASMAIQAIEQLRSMKHYELSNDHIVRGIRNTTWIGRFEKISEAPLTFVDGAHNEEGMKALAELLALHFPTYKYRFVMAVTKEKEMKALLAPYVDLPASFTFTTFEFERAQKAEQLYEQAPVYNKSICADWKVAIRRERESCKANEMVIICGSLYFISKVRAFLLER

SEQ ID NO: 17381 - protein, 429 aa, Bacillus halodurans
MKTFEKSSAAFNRAKPLMPGGVNSPVRAFKSVNMDPVFMERGKGANIYDIDGNEYIDYVLSWGPLILGHADDQVVEKLKETTEKGTSFGAPSELETKLAELVIERVPSIEVVRMVNSGTEATMSALRLARGYTGRNKILKFEGCYHGHGDSLLIKAGSGVATLGLPDSPGVPETVAQNTLTVPYNDLESVRYAFEQFGDDLAGVIVEPVAGNMGVVPPEPGFLEELRRLTEENGTLLIFDEVMTGFRVGYHCAQGAFGITPDLTCLGKVIGGGLPVGAYGGKREIMEQIAPSGPIYQAGTLSGNPLAMTAGYETLVQLTEANYEYFDRLGDRLAEGLSAVAKEYDIPHYTSRAGSMVGFFFTDKKVKNFADASSSDLEFFAKYFKEMLHLGVSLPPSQFEGMFLSTKHTEADIDFTVDAARQAFKRLKK

SEQ ID NO: 17382 - protein, 328 aa, Bacillus halodurans
MGQDLTFKRHRRLRQTAAIRNMVRETKLHIDDLIYPIFVKEGEGVRQEVPSMPNVYQLSLDQLDAEVDEIVSLGIPAIILFGVPAEKDAVGSAAYHEHGIVQQAIRQVKESYPDLTVIADTCLCQFTDHGHCGVIEEGKILNDPSLDLLARTAVSQAKAGADIIAPSNMMDGFVAAIRAGLDSAGFTDVPVMSYAVKYASAFYGPFRDAAHSSPVFGDRKTYQMDPANRLEALREARSDVEEGADFLIVKPALSYLDIIREVKNETGLPVVAYNVSGEYSMIKAASLQGWIDEKSTVLEKLISMKRAGADLILTYFAKDVARWLNEEK

SEQ ID NO: 17383 - protein, 253 aa, Bacillus halodurans
MIAPVLKGKGVLITRAKEQASSLSRLIEEAGGVPIEVPLLSFIKTMDVYEEVGASIQSYEWIVFTSANAVRFFFNTWPRQELKKLPSIAAVGSSTQRELSRYGISVDLMPNEYVAESLVETMVKRLKPCRVLFPKGNLARPTVKVGLETNGFIVDEMTVYETKRPLEAKVMLCEAFQKHRIEIITFTSPSAVDHFVTLLDREFILHEHLLYAYIGPIAAARAKQRGLPVHIVAKTYTGEGLVNAICDFVKEDG

SEQ ID NO: 17384 - protein, 311 aa, Bacillus halodurans
MRKIIIGSRRSQLALTQTEWVISKLKEAGAPFDFEIKKIITKGDQILDVTLSKVGGKGLFVKEIEQAMANKEIDIAVHSMKDVPSVLQEGFALGATTTRVDPRDALISNEGYTLAELPAGSIVGTSSLRRSAQILAKRPDLEVKWIRGNIETRLRKLKEEDFDAIILAAAGLERMGWSNEIVTEYLDPDLCVPAVGQGALGIECRADDDEVLEMLKTINDDTTAKTVLAERTFLHRMEGGCQVPIAGYATLTDEGEIELTALVGTPDGEQIFKEILRGKDPVQLGETMAQALMDQGAKEVLEQVKKGLESQ

SEQ ID NO: 17385 - protein, 459 aa, Bacillus halodurans
MHILMIGLNYKTAPVEIREKFSFQDSELPQALHQLRQMKSILECTIVSTCNRTELYVVADQLHTGRHFTKTFLADWFKLPKDEFTPFLTIRENDHAIEHLFRVVTGLDSMILGETQILGQVRNSFFIAQEEQVTGSIFNHLFKQAITLAKRAHSETDIGQNAVSVSYAAVELGKKIFDDFKGKQVLILGAGKMGELTAKHLHSNGAEQVTVINRTREKAAELAKRFLGVDRPYNELTEAIVEADILISSTGATGYVVTSDMVSHALKKRKGRPLFMVDIAVPRDLDPALASHDDVYLYDIDDLQNIVQTNLEERRTEAEKIELLIEEELVEFKQWLNTLGVVPIITALRTKALTVQGETMESIERKLPNLTEREKKVLRKHTKSIVNQLLRDPITRIKELANAPEREEALDLFTKIFALEEELAEQEKQEKVKQAEQEWLAKKRPITCMEKQSHVMVKS

SEQ ID NO: 17386 - protein, 774 aa, Bacillus halodurans
MAESVRRNIPLLPLRGLLVFPTMVLHLDVGRKKSVEALEHAMIDDHYILLAAQKEISIDEPIETDIYQIGTYAKVKQMLKLPNGTIRVLVEGLQRAKIEKYVANDAFIEVEMCTLPEDDEDNATENKALMRNVLQLFEQYIKLSKKVSAETLASVSDIAEPGRLADVIASHLPLKIVEKQQLLETTSVKERLLQVIDVLNNEKEVIGLEKKIGQRVKKSMERTQKEYYLREQMKAIQKELGDKEGKTGEVASLREQIDEANMPENVEEKALKELERYEKMPASSAESSVLRNYLDWLIQLPWVKETEDILDVNRAERILDEDHYGLEKVKERVIEYLAVQQLTKELKGPILCLAGPPGVGKTSLARSVARALNREFVRISLGGVRDEAEIRGHRRTYVGAMPGRIIQGMKKAGSVNPVFLLDEIDKMANDFRGDPAAALLEVLDPEQNHTFSDHYIEEPYDLSKVMFITTANNIMTIPGPLLDRMEIIQIAGYTEVEKQRIALDYLLPKQMKEHGLTKGTFQVKEEAILKVIRYYTREAGVRSLERQMATLCRKGAKMLVSGKKKRVVVTQNTIETMLGKKRFRYGLAEEQDQVGAATGLAYTTAGGDTLSIEVSVVPGKGKLILTGKLGDVMKESAQAAFSYIRSRSKELDIDPSFHEKNDIHIHVPEGATPKDGPSAGITMATALISALTGRVVKKEVGMTGEITLRGRVLPIGGLKEKSMSAHRAGLTTIIIPKENEKDLEDIPKSVREDLNYILVDHLDQVLKHALGEKK

SEQ ID NO: 17387 - protein, 572 aa, Bacillus halodurans
MHHKITGIAASSGVAIAKAFIHLEPNVDIEKTSITDVSTEIEKLTAALEKSKEELRAIKDQTEASMGADKAEIFAAHLLVLDDPELVDGIKGKIENEQMNAEYALKEVSDMFVSMFESMDNEYMKERAADIRDVSKRVLGHLIGVETGSLATIAEETVIIAEDLTPSDTAQLNKQFVKGFATDIGGRTSHSAIMSRSLEIPAVVGTKEVTEKIQHGDMVIVDGIEGIVIVNPTEEEVKAYEEKRAAFEKQKQEWAKLVGEPSTTKDGAHVELAANIGTPKDVDGVLANGGEGIGLYRTEFLYMDRDQLPTEEEQFEAYKEVVQRMDGKPVVIRTLDIGGDKELSYLQLPKELNPFLGFRAIRLCLEKQDIFRTQLRALLRASTYGNLKVMFPMIATLEELRQAKAIMQEEKDKLLSEGVDVSDSIEVGIMVEIPSTAVAANLFAKEVDFFSIGTNDLIQYTMAADRMNERVSYLYQPYHPAILRLVDMVIKAAHSEGKWVGMCGEMAGDEVAIPLLLGLGLDEFSMSATSILPARSQLLKLSKEELKPFAQKALMLDTAEEVEQLVKKTYLK

SEQ ID NO: 17388 - protein, 251 aa, Bacillus halodurans
MSENVVRFIITRQDDPDSSPYEEEFQVPYRQNMNVISALMEIRRNPVNSKGETSTPVAWEMNCLEEVCGACSMVINGKPRQSCTALVDQLEQPIRLEPMKTFPVVRDLVIDRSRMFDSLKKVKAWIPIDGTYDLGPGPRMAESKRQWAYELSKCMTCGVCLEACPNVNSKSEFIGPAPLSQVRLFNAHPTGEMNKEERLQAIMGDGGLANCGNSQNCVQSCPKGIPLTTSIAALNRSATLQSFKNFFGSTN

SEQ ID NO: 17389 - protein, 589 aa, Bacillus halodurans
MSKGKVIVVGGGLAGLMATIKVAEAGVPVELFSLVPVKRSHSVCAQGGINGAVNTKGEGDSPWEHFDDTVYGGDFLANQPPVKAMCDAAPGIIHLMDRMGVMFNRTAEGLLDFRRFGGTQHHRTAFAGATTGQQLLYALDEQVRRHETSGLVTKYEGWEFISAIIDDEGICRGITAQNLKTSEFQSFSADAVIMATGGPGIIFGKSTNSVINTGYAAAKLYEQGVYYANGEFIQIHPTAIPGDDKLRLMSESARGEGGRVWTYKDGKPWYFLEEKYPAYGNLVPRDIATREIFHVCVDLKLGINGENMVYLDLSHKDPKELDIKLGGIIEIYEKFMGDDPRKVPMKIFPAVHYSMGGMWIDYDQMTNIPGLFAAGECDYSQHGANRLGANSLLSAIFGGMVAGPKAVEYMNGLEKSAESMPSSLFEGELKKEQEKFDDILKMDGKENAYVLHKELGEWMTDNVTVVRYNDKLLKTDEKIQELMERYKNIDINDTAKWSNQGASFTRQLDGMLKLARVITLGAYNRNESRGAHYKPDFPERNDEEFLKTTKAKFNPETLAPEFEYEEVDVSLIEPRKRDYSQKKQGAVKS

SEQ ID NO: 17390 - protein, 412 aa, Bacillus halodurans
MSIIVQKYGGTSVGSVQRIEHVANRIIATAASGKKVVVVVSAMGKTTDELVGLASEITDEPRKREMDMLLATGEQVTIALLAMALHKRGQEATSLTGWQAGMITESHHGNARILEVERARMDELLDKVHVVIVAGFQGIDQQGEIMTLGRGGSDTSAVAIAAALKAERCEIYTDVTGVFTTDPRVVKQARKLQTISYDEMLEMANLGASVLHPRAVEFAKNYEIPLLVASSMVDEPGTMIEEEGTMEQNLLVRGIAFENDVTKVTVHGLPNEIHTLPTLFAHLSAAGINVDIIIQNQTDSGMAISFSITQSSLKETLARLEELKGELSFQGIDYEEELAKVSIVGSGMVSNPGVAAKMFEILAANDIAIKMVSTSEIKVSAVIDEELMVLAVEMLHEQFKLHEEEPAVAVKV

SEQ ID NO: 17391 - protein, 564 aa, Bacillus halodurans
MVDVENREWFNAYPKEVPHTIDYPNQTLHDLIKEAATTYPHHVALHFLGKTMTYQLFYEQVQRFAANLQQLGLQKGERVSIMLPNCPQAVIAYYGVLVAGGVVVQTNPLYVERELNHQLIDSGARFIVCLDVLYPRVIKSREGAPLEHVIVTAIKDYLPFPKNMIYPFIQKPKPKGKIGYGSHVHRFVPMAQSGSTNPTPVRIDPKEDLALLQYTGGTTGVAKGVMLTHYNLVANTIQCRKWMYKWRDGQERTLAVLPFFHVYGMTTSMNLTLMTGSELHIVPRFDPLQVLKMIDKKKITMFPGAPTMYIALINHPDLKKYDLSSIEACISGSSSLPAEVQQTFEQLTGGRLVEGYGLTEASPVTNCNLVWGERKDQSIGVPWPDTDVHIRSLETGESLPSGEIGEVVVRGPQVMKGYWNRPEETNATLQNGWLYTGDMGYKDEEGYFYIVDRKKDMIIAGGFNIYPREVEEVLYAHAKVQEAVVIGVPDEYRGETVKAFIVVKEGESVSEKELNDYCRTHLAAYKVPRKYEFRDDLPKTMVGKVLKRVLIEEETKKQGIKQSS

SEQ ID NO: 17392 - protein, 566 aa, Bacillus halodurans
MTIDRVWLKSYPKEIPHSIDYEERTLQSYLKQAAEEFPSHIAVQFLGKEMTYRELYEQAKQFGNQLKTLGISKGDRVAIMLANSPQSIISYYGALMIGAVVVQTNPLYVERELEHQLVDSGAKVIVCLDLVFPRVSKVRKATQLEYVIVTSIKDYLPFPKNVLYPFVQKKQTGMKIDITYNENTLSFKKFLQGGVTTEPSEDVSPTDDLALLQYTGGTTGPAKGVMLTHANLVANTIQGLHWMYKSKRAEEVILCVLPFFHVYGMSAGMNLAIMNAYKMVILPKFNPKDVLKAIEKHKVTLFPGAPTMYVGLINDPSIQDYNLTSVEACISGAAPLPLEVQQKFEQLTGGKLVEGYGLTETSPVAIATPIWGKRKQRSIGIPWPDTDVMIISAETGEPADVNEVGELAVRGPQVMKGYWNRPEETAQVFKDDWFLTGDMGYMDEDGYFYIVDRKKDMIIAGGFNIYPREIEEILYEHDAIKEAVVIGAPDAYRGETVKAFIVLKEGRSVSEEELDAFCRKHLAAYKVPRLYEFREELPKTLVGKILRRVLVEEEKKKAEQQKVSNE

SEQ ID NO: 17393 - protein, 344 aa, Bacillus halodurans
MREQLEALRDDAIKKIEQAQEKKVVQEIRVKYLGKKGPVTEVLRGMGKLSPEERPVIGQLANDVREAIGKAIESKMEALEQAEIHRKLQEETIDVTLPGRPVLKGGAHPLTATITEVEDLFIGLGFSVAEGPQIETDYYNFEALNLPKDHPARDMQDSFYFTDELLLRTQTSPVQARTMEKYKGKGPIKIICPGKVFRRDDDDATHSHQFMQIEGLYVDHGVRMSDLKGVLQAFAKSFFGEERSIRLRPSFFPFTEPSVEVDVSCGICHGDGCRVCKQTGWIEILGAGMVHPRVLEMSGFNPNEYSGFAFGMGVERLSMLKYGIDDIRHFYTNDRRFLAQFKRV

SEQ ID NO: 17394 - protein, 344 aa, Bacillus halodurans
MKVKVAINGFGRIGRMVFRKAVENKQFDVVAINASYPAETLAHLIKYDSVHGPFQGTVEIKNDALVVNGKEIKLVNSRDPRVLPWKDLEVDIVVEATGKFKTKETAGYHLEAGAKKVIITAPGKNEDVTVVVGVNENDYKPEEHHVLSNASCTTNCLAPVAKVLDEAFTIQSGMMTTVHAYTNDQKNIDNPHKDLRRARACGQSIIPTSTGAAKAISKVLPQLEGKLTGMALRVPTPNVSLVDLVVQVKEDVTPEKVNHVLKQAAAGSMKGILGFTEEPLVSIDFNGNEHSAIVDGLSTMVMEDTNQVKVLAWYDNEWGYSTRVVDLVELVAKELKKPAKVIAS

SEQ ID NO: 17395 - protein, 314 aa, Bacillus halodurans
MAIKRRKVSVIGAGFTGATTALMVAQKELGDVVLVDIPQMEGPTKGKALDMLESTPVQGVDVNITGTSSYEYTKDSDVVVITAGIARKPGMSRDDLVSTNAGIMKAVTKEVVKHSPNAYIIVLTNPADAMTYTVYKESGFPKNRVIGQSGVLDTARFRTFVAQELNLSVEDITGFVLGGHGDDMVPLIRYSYAGGIPLEKLLPQERIDAIVERTRKGGGEIVGLLGNGSAYYAPAASLAEMVEAILKDKKRVLPTIAYLEGEYGYEDIYVGVPTILGGDGIEKVIELDLTDEEKATFAKSIESVRNVMSALPKE

SEQ ID NO: 17396 - protein, 422 aa, Bacillus halodurans
MANGEKIKVSAGVLEVPNNPIIPFIEGDGTGPDIWAAAHRVIDAAVEKAYNGEKKIVWKEILAGEKAFNQTGQWLPDETLETIREYTIAIKGPLTTPVGGGIRSLNVALRQELDLYVCLRPVRYFNGVPSPVKRPEDTNMVIFRENSEDIYAGIEYQAGTDEVKKVINFLREEMGVKKIRFPETSGIGIKPVSQEGTDRLVRAAIQYAITEGRKSVTLVHKGNIMKFTEGAFKNWGYEVAEREFGDKVFTWAQYDKIVEEQGKEAADKAQAEAEAAGKIIVKDSIADIFLQQILTRPKEFDVVATMNLNGDYISDALAAQVGGIGIAPGANINYDTGHAIFEATHGTAPKYAGLDKVNPSSVLLSGELMLRHLGWNEAADLIMASMDKTIESKVVTYDFARLMDGATEVKCSEFANELIKNL

SEQ ID NO: 17397 - protein, 372 aa, Bacillus halodurans
MSVTRGLEGVVATTSSVSSIIESVLTYQGYDIDELAEHASFEEVIYLLWNGKLPNKVELKELADELANNAEIPQEVIEQMKAYPLDRVHPMGALRTAISSLGLYDEEADLMDEAANKRKALKLQAQVSTVVTAFSRIREGKEPVAPRTDLSFAANFLYMLTGEEPDEIAVDAFNKALVLHADHELNASTFTARVCVATLSDVYSGITAAIGALKGPLHGGANEQVMAMLTEIGDVENVEPYIRKALDNKQKIMGFGHRVYKNGDPRAKHLREMSKKLTSITGESKWYEMSVKIEEIVTNEKGLLPNVDFYSASVYHSLGIKHDLFTPIFAVSRMSGWLAHILEQYSNNRLIRPRAEYVGPNKRQYVRLEERN

SEQ ID NO: 17398 - protein, 584 aa, Bacillus halodurans
MRKTKIVCTIGPASESVEKLEQLMEAGMNVARLNFSHGDFEEHGARIKNIREAAKRIGKTVAILLDTKGPEIRTQTLEGGVAELKAGQELVISMKEVVGTSERISVTYPGLVHDVVPGAKILLDDGLIGLEVVEVRDQEILTKVLNSGTLKNKKGVNVPNVSVNLPGITEKDAADIKFGIEQGVDFIAASFVRRAQDVLEIRELLEQHGAEHIKIIPKIENQEGVDNIEEILEVSDGLMVARGDLGVEIPAEEVPLVQKSLIKKCNLVAKPVITATQMLDSMQRNPRPTRAEASDVANAIFDGTDAIMLSGETAAGDYPVEAVQTMSRIAERAEQALNYQEILSKHTKEARTTITSAISQSVGHTAFNLNASAILTATESGHTARVVAKYRPKSPIVAVTSNETVVRQLALVWGVYSILGEEAETTDDMLQVTVETALKSQLVKQGDLVVITAGVPVGETGTTNIMKVHVIGEVVAKGQGIGRDTVNGKVVIAANAEEANAKVEEGSILVTFSTDKDMMPAFEKAAAVITEEGGITSHAAVVGLSLNTPVIVGVQNASALFKDGEEITVDTSRGDIYRGQASVL

SEQ ID NO: 17399 - protein, 319 aa, Bacillus halodurans
MKRIGVLTSGGDSPGMNAAIRAVVRKAIYHGVEVYGIYQGYAGLISGDIRKMELGSVGDIIHRGGTILYTARCEEFKTLEGQKKGIEQLKKFGIEGLVVIGGDGSFAGAQKLTEHGFPTVGVPGTIDNDIPGTDFTIGFDTALNTVIDAIDKIRDTATSHDRTYVIEVMGRNAGDLALWSGLADGAETIVIPEADHDIDQIISRLQRGQERGKKHSIIVVAEGVGSGMDFGREISERTGAETRVTVLGHIQRGGSPTGFDRVLASRLGAKAVDLLLEGQAGVTVGIENNKLVHHDITEVLQRKHSIDLDMYRLSQELSI

SEQ ID NO: 17400 - protein, 252 aa, Bacillus halodurans
MRHALVTSGTKGLGVQVTKALLKKGYTVTVSYRTEDEAMKQLETTWGHLKDRIQLVQVDVTKKEDIYRLVDGAYDRFGRIDVVVNNAGPYIFERKKLFDYEEHEWQTMVNGNLSAAFYMFKKVLPIMRNQQFGRIILYGFQGANTAPAWLYRSAYAAAKVGLVSLMKTVAVEEAEYGITVNMVCPGNIVGEMKEATIEESRKQKDPDTPIGRSGTGEDIARTVAFLCEDDSDMVTGSVIEVTGAVDVLHRYR

SEQ ID NO: 17401 - protein, 458 aa, Bacillus halodurans
MTKLWGGRFTKTAEAWVDEFGASIGFDQQLVEEDIEGSLAHVTMLEKSGILANEEVEQIKKGLHILLEKAKKGELNYSVANEDIHLNIEKLLIDEIGPVGGKLHTGRSRNDQVATDMHLYLRKQTKEILQLVKNVQAALVEQAKQHVETLIPGYTHLQRAQPISFAHHLLAYFWMLERDYGRYEDSLKRLNVSPLGAGALAGTTFPIDREYTAELLGFDGIYENSLDAVSDRDFIVEFLSASSLLMTHLSRLCEELILWSSQEFQFVEMDDAFATGSSIMPQKKNPDMAELIRGKTGRVYGSLFSLLTVLKGLPLAYNKDMQEDKEGMFDAVKTVKGSLAIFAGMIQTMKVKEETMTKAVHQDFSNATELADYLATKGMPFREAHEVVGKLVLLCIQKGIYLLDLPLSDYKAASDLFDEDIYDVLQPKTVVARRTSAGGTGFTEVKKAIAKAEKILAN

SEQ ID NO: 17402 - protein, 409 aa, Bacillus halodurans
MSKKKVVLAYSGGLDTSVAIKWLSDKGYDVIAVGLDVGEGKDLEFVKEKALKVGAIESYTIDAKKEFAEEFVLPALQAHALYEQKYPLVSALSRPLISKKLVEIAEQTGAQAVAHGCTGKGNDQVRFEVSIQALNPNLEVLAPVREWAWSRDEEIEYAKKNNIPIPIDLDNPYSVDQNLWGRSNECGILEDPWATPPEGAYELTVAIEDAPDQPEIVEIGFEKGIPVTLNGKSYPVHELILELNQIAGKHGVGRIDHVENRLVGIKSREVYECPGAMTLIKAHKELEDLTLTKEVAHFKPVVEKKIAELIYEGLWFSPLQPALSAFLKETQSTVTGVVRVKLFKGHAIVEGRKSEYSLYNEKLATYTPDDEFDHNAAVGFISLWGLPTKVYSMVNKEMKEKQEKKEVTS

SEQ ID NO: 17403 - protein, 527 aa, Bacillus halodurans
MKVEHMAPEEYNLTEELDVFARDVNRLAIRFLDDKGHRKDISYAELMNTVHQYANALTKCGLKRGDKVLVVVPRIPEAYYCYLACLKAGIVIIPCSNMLRANDFVYRIQHSEAKAIIAHVQATDEIDSMSVPLPSLQYKWVISGTKSGWESLEDVARNESVSFEGVKTRRDEMAFLPYTSGTTGNPKGVVHTHGWAYAHLQTAAKHWLGVREGDLVWATAAPGWQKWVWSPFLSTIGLGATAFVYNGPFDPNEYLALLEKEDINVLCCTPTEYRFMAKVDNLNRYRFPHLHSAVSAGEPLNRKVIEMFRDTFGINVRDGYGQTENTLLVGTMIGMEQRPGSMGKPTLEGQVVIVNEDGQPVAPHEVGEIAVHKDAAALFKEYYREPERTAQAFRGDYYITGDLARMDEDGFFWFEGRSDDIIISSGYTIGPFEVEDALTKHPAVKECAVVASPDEDRGAVVKAYIVLKDSTNLDEEALSKELQDHVKAHTAPYKYPRKVEFVESLPKTISGKIRRIELRQQEQLRAQ

SEQ ID NO: 17404 - protein, 318 aa, Bacillus halodurans
MEEAIIKLNEITKRYDDHYAVDHLSLSIRKGEIFGLLGPNGAGKTTSILMMLGLSEPTSGTVQVAGIDSTKYPIEVKRKVGYLPDNVGFYPDMTGMENLLYTASLNGIQKIEAIERANTLLEKVGLTEAAKKKTGQYSRGMKQRLGLADVLMKGPEIIILDEPTLGIDPEGVRDFLHLIRNLNQNENLTVLLCSHHLHQVQQVCDRVGIFVDGKLLAYGDLDQLVKRLFKHESVVIHVAASPIDESLLNQLKTIEQVKNVDVIQEDRLDIYCREDASATISKLIVESGSNLYHLYKKHFGLDEIYHRYFEGREANEAG

SEQ ID NO: 17405 - protein, 571 aa, Bacillus halodurans
MNLQALPAKEGNHNLKDYNEAVSTFDWSSVEKQFSWYETGKVNLAYEAIDRHAESNRQDKVALYYSDATRDEQYTFADMKKYTDKAGNVLRDAGVSKGDRVFIFMPRSPELYFALLGAVKVGAIVGPLFEAFMEGAVRDRLEDSEAKVLITTPDLLQRVPVDQLPHLETVFIVGDHVEEEGPYRDFLSRLTQASDDLEIEWVDREDGLILHYTSGSTGKPKGVLHVHNAMIQHYQTGKWVLDLKEDDVYWCTADPGWVTGTSYGIFAPWLCGATNVIRGGRFSPADWYETLQKYKATVWYSAPTAFRMLMSAGDELVKKYDLSSLRHILSVGEPLNPEVVRWGMKVFDLRIHDTWWMTETGAQLICNYPSMDIRPGSMGKPLPGIKAAIIDDQGNELPPNRMGNLAIRKGWPSMMRAIWKNEEKYNSYFEIDGWYVSGDSAYMDEDGYFWFQGRIDDVIMTSGERVGPFEVESKLVEHPAVAEAGVIGKPDPVRGEIIKAFVSLRDGYELTDELKEDIRTFVKEGLAAHAAPREIEFKDKLPKTRSGKIMRRVLKAWELDLPTGDLSTMED

SEQ ID NO: 17406 - protein, 389 aa, Bacillus halodurans
MKKASFVYSENQLSYQFHSTHPFNHQRLRLTYDLLKSMDALDDSEIVAPRVATEAELRLIHDQAFIDAVKAAGNGTLSDGVALNYGLGTEDTPIFKNMHEAAALLVGGTLTAVDQVMEGHAEHACHLGGGLHHGFRGKASGFCVYNDSSIAIEYMRRKFGARVLYIDTDAHHGDGVQWAFYEEDDVCTLSIHETGRYLFPGTGNFNEKGQGEGYGYSINIPLDAFTEDDSFLFAYEQAVTNVVKFFKPDVILTQNGADAHFHDPLTHLCASMRTFRYIPQLAHALAHEYCEGRWIAVGGGGYDIWRVVPRAWAMIWLEMTDQLQKANGPLPERWLSKWTTYAQHPLPSHWEDENEELPTIPRRDEITEKNKKIVEKALYHIYTELKTQT

SEQ ID NO: 17407 - protein, 364 aa, Bacillus halodurans
MSNEQLDLLRDKLDEVNLKLLELINERAQLVQEIGQLKSKQGVNRFDPVRERNMLNHIAENNKGPFETSTLQHIFKEIFKASLELQEDDNRKALLVSRKKHPENTIVNVKGETVGDGEQRLIMGPCAVESYEQVAAVAKEVKARGLKLLRGGAYKPRTSPYDFQGLGLEGLKILKRVADEFDLAVISEIVTPADLEEAIDYIDVIQIGARNMQNFELLKAAGSVNKPVLLKRGLSATISEFIHAAEYIVSKGNGQIMLCERGIRTYEKATRNTLDISAVPILKQETHLPVLVDVTHSTGRRDLLLPTAKAALAIGADAVMAEVHPDPAVALSDSAQQMDIGQFHAFVDDLIASGLYKDATKTPQ

SEQ ID NO: 17408 - protein, 717 aa, Bacillus halodurans
MKQIEEQAVKCLFHSAEIVTLHTVMIHFTVTKEQVCPFVVEKEGTTVPFSIKSWQEWERGAIAFIQFDDPLELGVEYKLRQKNHEQTHLIKVGRVVRTEAFDQQYVYNGELGALYSHERTVFAVWTPVATEVSLLLYENWHTLEAIEYQMKRSPNGVWSVSLDGDLHQYCYLYRAKVNGKWKTTVDPYAKSVTVNGEKGVIFDLKRTDPASWPTVHPIPPEHTIIYELHIRDATVYPGSGHHKKGTYLSLAEQNTCGPWGESTGLSYIRELGVTHLELLPVADYGSVDEANREKEYNWGYDVVHYFAPEGSYASDPYDGVTRVKELKQLIAQCQRMDLRVILDVVFNHVYVMKESPFEKLVPGYYFRYDGEGNLADGTGVGNDIASERLMVRKFIVDCVTYWASEYRVDGFRFDLMGIIDQMTMKEVKRALAPINRQILLLGEGWDLETPLENDQKTTLAQARAVPFLHFFHDTFRDAVKGSTFDLNKGGFCAGNIELKETLIASMLGHEAQFDRPSQAIQYVEAHDNHTLWDKLQFVFPDEEEEVLRACHRLATAIVLTSQGIPFLHGGQEFFRTKHGEGNSYNSPDWINQLDWSRRAIYAADVEYVKGLIALRKAHRAFCFSTFSEVNTHMCPLKTPSEVIGFHYHHIAKWGPWDEMVVLHNGGGDKVDIRLPASGEWEVIVDGKKAGLVPLYTFNGHTVSVQSRSSMVLYRLNE

SEQ ID NO: 17409 - protein, 260 aa, Bacillus halodurans
MWKWEVAEPRGVVVVIHGAGEHHGRYQWLAKKFNSIGLSVVMGDLPGQGRTRGKRGHIQSFQQYIDVVLEWVEAAKLEHVPIFLFGHSMGGLVAVRTMIEGGTLPVRAVILSSPCFDLYQSPGKGKELASKMLHRVTPTFSHHSGIRSDLVTRNEEIREAYLKDELRVTKVSTKWYYELSKAMRDTRRYPEKFPNVPLLVMQAGEDYITDRKAAWEWFNSVQVTEKAYKEWNGLYHEIFNEPEREAVFQYTCFFIEQQLS

SEQ ID NO: 17410 - protein, 399 aa, Bacillus halodurans
MADTRSRRLFTSESVTEGHPDKICDQISDSILDEILKEDPNARVACETSVTTGLVLVAGEITTSTYVDIPKVVRDTIRNIGYTRAKYGFDSETCAVLTSIDEQSPDIAQGVNQALEAREGQMTDAEIEAIGAGDQGLMFGYANNETPELMPLPISLSHKLARRLSEARKGEILPYLRPDGKTQVTVEYDENDQSVRIDTIVISTQHHPEVTLEQIESDLKQHVIRSVVPEELIDEETKYFINPTGRFVIGGPQGDAGLTGRKIIVDTYGGYARHGGGAFSGKDPTKVDRSGAYAARYVAKNIVAAGLADKCEVQLAYAIGVAKPVSISIDTFGTGQVSEARLVELVREHFDLRPAGIIKMLDLRRPIYKQTAAYGHFGRTDVELPWEQTDKAEILRQQA

SEQ ID NO: 17411 - protein, 527 aa, Bacillus halodurans
MNTISTTTRLEQLLGDQHVLKNAPASTLVEKSLLRGEGRLTDTGALTVATGAYTGRSPKDKFIVDETSVHEKIEWGQVNQAIEKETFLHLYEKVLTYLADKDELFEFRGFAGADKTYRLPLQVVNEFAWHNLFAQQLFIQPTTEELTQHTPEFTIVSAPGFKADPSVDGTRSEAFVIISFEERIVLIGGTEYAGEMKKSIFSVMNYLLPEQDVLSMHCSANVGVEGDVALFFGLSGTGKTTLSADPNRKLIGDDEHGWSERGVFNIEGGCYAKCVNLSYEKEPQIWNAIRFGSVLENVIVDEKTGLPDYNDTSLTENTRAAYSLEAIPNSVIPSVAGHPNTIIFLTADAFGVLPPISKLTPEQAMYHFLSGYTSKLAGTERGVTSPEATFSTCFGAPFLPLPAARYAEMLGEKIAQYEVQVFLVNTGWSGGPYGVGQRMKLSYTRAMVQAALQGELNTVETITDSVFGLHIPTRCPGVPDFVLQPRNTWDDKEKYDKKAQELAKQFIENFKRFTNVSEAIQKAGPSI

SEQ ID NO: 17412 - protein, 475 aa, Bacillus halodurans
MFRGKLYIDGTWTGDLLDTFDVKNPATGEVVGVMPNGGKAEAAAAIEAAQRAFLKWRKYTAAERANFLMTWHDLLLQQKEEIAEMLTMEMGKPLAEARGEIEYSASFIRWFAEEGKRVYGRTVPASAENKRIHVQKQPVGVVAAITPWNFPAAMIVRKMAPALAAGCTFVGKPAELTPLTAVKIVELCEEAGFPKGVVNLVCGDAKEIGEEMTSHEHVRKLTFTGSTAVGKLLMKQSAGRMLNLSLELGGQAPMIICDDADLDKAVAGVVASKYRNAGQTCVCGNRIYVQETIVDEFVKRLTGKVVQLKVGNGLEEGVHIGPLIEKKGYEKVKAHVDDAVAKGARVVIGGKGQEGNDSYFYDPTILTDVHDEMLVMQEETFGPVAPIQTFATDEDVIEKANGTRYGLAAYFFTENYARGIRLSEALDFGIVGWNDGAPSIAQAPFGGMKESGLGREGGQEGIEAFLETKFVSIGL

SEQ ID NO: 17413 - protein, 463 aa, Bacillus halodurans
MKTAIILAAGKGKKMWPYNDYWPKAALPIGNQGNIVHLVNHLKSLAFERIIITTCYLSRRIKSLIYDVEGVEIIELSATEGTADTLEKVVYDLQDSNLFILYGDIFITRERLSSFIEAYEKQRETMDAVILSKPIENEHAQDWFGIKVGKDNRVENIFGHPRPHYVQERVMGAFALNTNVLKKMLNHNPGFMKSVPTGVMPQQEVELEQCLQWLVEVGYNVSSYPVTDGVIDMDKPWHLMQANHLAVSEMTHALNNNEIHETCEIDPTADIQGHVKLGKHVKIGKYVTIKGNAVIGDYTKIDNGVIIEGNVVIGSDCRIENYCRIGPDSVIGNKNRIGHCAEFRGVTFDNVSFIHFGEVFGIIGESTDIAAGVTVGITRFDDQPQTQIVNNRKEFPEEFGNAVYLGDFTRTGILSLYMPGIKVGSNCVIGSGVAVEKDVPSKTLLYNKQTLIEKNWGPHRYGW

SEQ ID NO: 17414 - protein, 387 aa, Bacillus halodurans
MNPFMFKNPTKLVFGVDQTNQLEHELTHVGKNVLLVYGGGSIKRNGLYDRVLEQLERAGKAVIELSGVEPNPRLTTVQKGIDLCKAQNIEFILAVGGGSVIDATKAIAAGAKYDGDVWDIITKKTTAEDALPFGTILTLAATGSEMNANSVITNWETNQKIGWSSSHVYPMFSILDPKNTVTVPKDQTIYGIVDMMSHVLESYFHPVSNTPLQDRMCEAVLQTVIETGPKLVNDLESLEYRETILYCGTMALNGVLSMGARGDWATHNIEHAVSAVYDIPHAGGLAILFPHWLTYSLDQKIDRHVQLATRVFGVDPSGKSEEAIAHEGIERLSAFWTELGAPNRLADYDIDDSQVERMAEIATEQGELGNFKLLKKQDVANILTAAL

SEQ ID NO: 17415 - protein, 389 aa, Bacillus halodurans
MNQFQQWPIGEPFLEALTNQGITEPTEIQQQVIPEALDGQNLIVHSQTGTGKTLAYLLPMLTKTEELPEQTQALILAPTQELAMQIVEVAKQLTATTSITVLPLIGGANIKRQVEKLKKKKPHVAVGTPGRILELMEMKKLKVPHVKMIVVDEADRMMEETSAWNAFENVAKRIGNEAQYLFVSATFASRFTELVAPYVPFIETVSAQGNTVQQAVNHWFIRCEKRERMDVVRKLIHHENIQRGIVFVNRLEHVAETTAKLQFKGIKAVALSSDQTKQERERALHQLKTSEAQVLIASDVAARGLDVDDVSHVIQLEPPTTSEAYVHRAGRTGRMGKEGTVITLTSEREMYKLEKIEKGLNLSFEERVLSHGKLHAKNNGLKGHNKRKK

SEQ ID NO: 17416 - protein, 393 aa, Bacillus halodurans
MTSSTSQRTRLSTRVQSIQPSGIRRFFDLASKMENIISLGVGEPDFVTPWNVREASISSMERGFTAYSANAGIIELREAISRYLYERFHIGYDPESEILVTVGASEAIDIGMRAIIDEGDEVIVVEPSFVSYAPLVTMAGGVPVPVGTHIDTDFQVTPAQIEAAITPRTKAIILCFPNNPTGSIMGKEELEAVAKVISGNDLIVFSDEIYAELTYDGTHVSLASMDGMRERTVLISGFSKAFAMTGWRLGYVCAPDDILSAMLKIHQYSLMCAPTMAQHGALEALETGMDDVHRMVQSYRQRRNFVVKTFTEIGLTCPMPGGAFYAFPSVKETGLTSEEFAERLLMEEHVAVVPGNVFGEGGEGHIRCSYATSMEHLETALERIGRFVQKCKQ

SEQ ID NO: 17417 - protein, 247 aa, Bacillus halodurans
MRKAVILAGGTGSRLSPITRVINKHLLPVGSYPMIYWSILKAKEAGLHEILILTSREHLAAFIQLLGDGKDLGVHLHYTIQDQADGIASALSLAEHFVGDEKFLVLLGDNLFADPLTAYVQQYEKQKEGAFVLLKEVRDPTRYGIAFLDETKQKIKKIVEKPNMQGSAYCVTGIYMYDRTVFSFIEQIAPSARGELEITDVNNFYIDQGTMGFNILPDWWIDAGTHESLFKANCYMNQTLDLAGGES

SEQ ID NO: 17418 - protein, 321 aa, Bacillus halodurans
MSKQILVTGGAGFIGSHFIEALLQHKPTYHITNVDVLTYAGKIENMSGFTKHPNYRFISADIGDADQLLGAFDRTYDVIVHFAAETHVDRSIHNPMVFLETNILGTHNLLLAVLKGYAKKILYISTDEVYGSLGMKDVPFTEQSPLAANNPYSASKAGGDLLARSFYKTYQAPVIITRCSNNYGPRQDKEKLIPKIIANALTNKKIPLYGDGLQIRDWLYVTDHCRALTTIMEHGEIGEIYNIGGGNERTNLEITKQILNILGKDHDLINHVEDRKGHDRRYAINWGKIHKQLGWRPMVAFEDGLAETVQWYKSRLAQGGH

SEQ ID NO: 17419 - protein, 249 aa, Bacillus halodurans
MGEKASKVLITSVPKCGTHLLKQVVLGAPFYKRGKWISLRESIREQIDNCHDQTIMVGHLEYSEEIVRYLNEKGIRRLFIYRDPRDMLISYVFYVKEIAPKHELRNYFLHVLGSDEERIMKLITGFHYQEENLTYGDLTLHYQPFLPWIEDKGTLALRFEDLVSSNECKEQTISKIADYLWHGSTFDQYNKAVLKKRMLENIRPSHSGTFRKGVSGDWKNYFTAQHKSVFKEVAGQLLIDLGYEKDMDW

SEQ ID NO: 17420 - protein, 208 aa, Bacillus halodurans
MKSNSQDAASIVWHPQLVTKQARNQSNGHKSRMIWFTGLSGSGKSTIANAVQAELFKRGIQVYVLDGDNLRHGLNADLSFSMEDRKENIRRTAEVGKLFVDAGLVVLAALISPVEEERQRARSRFAEDEFLEVYVSCTLQECEKRDPKGLYKKARKGEIPQFTGIHQPYEEPKNPDICIDTTDRTVEQSVQIILPIILEKIAWKEGEQ

SEQ ID NO: 17421 - protein, 379 aa, Bacillus halodurans
MTLSIPHGGSLIDRTKTSLDVSTLSAEIELDSIAFSDLELIANGAYSPLTGFMNKKDYESVVTTMRLADGTVWSLPITLPITEETAESLRIGDQVKLTYNQTVYGVLYLKELFVPDKTLEAMHVFQTTDHDHPGVQRLFKRGDVYAAGPIHLIQQPARNDQWTHYYRSPKETRAEFSRRQWNSVVGFQTRNPVHRAHEYIQKCALESVDGLLLHPLVGDTKKDDIPAAIRMESYDVLLKHYYAKDRVYLSVFPAAMRYAGPREAVFHAIVRKNYGCTHFIVGRDHAGVGDYYGTYDAQQVFTQFPQAELGIHILPFEHSFYCKKCGSMASAKTCPHKKEHHLHLSGTKVREMLRSGVKPPPEFSRPEVIDVLMKGLRNT

SEQ ID NO: 17422 - protein, 331 aa, Bacillus halodurans
MKKIMNGPEKIVDQMLQGFAFARADKVGYDPLHRVLYQKTFDPKSVPIISGGGSGHEPGHLGYVGEGMLAAAVHGDVFVPPSAQQVLAAIRQMDQGKGVLLIIKNFVADLATFLSAEVQARAEGRDVAHVIVNDDVSVESDASFEKRRRGVAGAVLVHKIIGAAAKEGYSLEALQEIGEQVVKNLATLGVALTHADLPERREPQFLLEEGEVYFGVGIHGEQGYRKEKLVSSELLAVELVNKLKSLYRWDKNDQYAVLINGLGGTPLIEQYVFANDVRRLLAIENLHVSFVKVGTQLTSLNMKGISLTMLKICDEQWVKWLYAPVDVAHWA

SEQ ID NO: 17423 - protein, 330 aa, Bacillus halodurans
MKKILNDPQNVLDEMLDGFVYANGHLVERVAGTGVIRRTYEDKGKVALVSGGGSGHEPSHAGFVGQGMLSAAVCGEVFTSPTPDQIFEGIKAADQGGGVLLIIKNYTGDVMNFEMAGEMAEAEGITVDHIIVNDDIAVEDSSFTAGRRGVAGTIIVHKIVGAAAEAGLSLQSLKVLGETVIENTKTIGVSILPATVPAVGKPGFELGDDEMEYGVGIHGEPGYRKEKLKSSKEIAEELILKLKEAFGWSKGDKYGVLVNGLGATPLMEQYVFMNDVANKLTEEGLNIQFKKVGSFMTSIDMAGVSLTLIKIVEEKWLDYWNHEVKTVDWM

SEQ ID NO: 17424 - protein, 286 aa, Bacillus halodurans
MKFTKMHGLGNSYIYVDCFKELLKEEELPALAVAVADKNKGIGSDGMILICPSDRAPVKMRVFNNDGSEAKNCGNGLRCVAKFAFEHGYVKETSFDVETLGGLVKATVHPNDNGLVDTVTVNMGEPRLGRAQIPMLGEEAAEVVAEPFTIGEKEYRLTAVSMGNPHAIMFIDTIEDAPVEQVGPLLEKHEAFPDWVNVEFVQVVSPTEIHFRVWERGSGITQACGTGACAAVVASVLNGFTQKGQEVTVHLLGGDLTISWLENGDVLMTGAAETICEGTYVKGLSY

SEQ ID NO: 17425 - protein, 431 aa, Bacillus halodurans
MSEVLKVGLLGLGTVGSGVVKLIENHQQELRHQIGLPVQVEKVLVRDRSKARDVVLSEESVTLYGEEIVENANIDVVIEVMGGITLAKEYIVRALKNGKHVVTANKDLMAVHGAELLSLAAENGCDLFYEASVAGGIPIIRSLTDGLAADRITKMMGIVNGTTNYILTKMTKEGLDYEEVLAQAQALGFAESDPTADVEGLDAARKMAILATLGFSMDVELDDVVVRGISSVTKTDLEYCEQLGYTMKLIGLADRDGDRVEVSVQPTLLPKEHPLAAVNDEYNAVYVYGEAVGETMFYGPGAGSLPTATAVVSDLVSVLKNMRYRVNGHDGAKPLHKKTLKADNEVFAKYFFRLKVLDKAGTFSAITSLFAEKDVSFEKLLQLPIKGEAAAEIIIITHTTDKETYEYLHRTLAALDVVQSVESSYRVEGGK

SEQ ID NO: 17426 - protein, 505 aa, Bacillus halodurans
MREQWGTRAGFILAAVGSAVGLGNIWRFPYVAYENGGGAFFIPYLFALLTAGIPLLIMEFTIGQKYRGSAPLSYARLNKKAEWIGWWQVAISFVIATYYAVIIAWAMSYSVFAINLSWGEDTGGFLFGEYLKLDVDPGQIGSLVPGVFIPLVLVWIVALGVLFAGVKKGIELANRIFIPTLVIMFLIIVIRAVTLEGAAIGLDAFFKPDWSEILSPGVWVAAYGQIFFSLSIAFAIMITYSSYLPRKADVNNNAFIAGFSNSGFELLAGIGVFAVLGFMATQAGTTVGEVAAGGIGLAFVVFPQIINSLPGLNGLFGFLFFASLVFAGLSSLISIVETFVSALQDKFKISRTKAVLFGGGLSALISLLFATQGGLFLLDAADHFINSFGVALAGLVSVVAVSWFFKQLNPLQKHGNEVSDLRTGTWWKVCLGVITPIVLGYMAVQNIINSISENYEGYPTSFLLYSGWGVAVGAIIVGFILSLTKWKAGDLEVPSEDQEKGADFS

SEQ ID NO: 17427 - protein, 163 aa, Bacillus halodurans
MISFIVAMDKHRLIGKENDLPWRLPADLAHFKRVTSGHTVIMGRKTYESIGKPLPNRRNVVVTRSQAYTAEGVDIVHSIDEAIRLTEHENETFVIGGSELFKAFWPHADRMYVTYIDEVFDGDTYFPEIDGQEWELVSVEAGTIDEKNVYPHEFRVYERQAKN

SEQ ID NO: 17428 - protein, 128 aa, Bacillus halodurans
MSNLPNELKYSEEHEWVKVEGDKVRIGITDFAQSELGDIVFVELPEVGDEVEADEPFGSVESVKTVSELYAPVSGKVVEVNEELDDNPEYVNESPYEKAWMIVVEPSDASQVEELMSADEYKEMISEE

SEQ ID NO: 17429 - protein, 594 aa, Bacillus halodurans
MGNTAEQTVKGGSFLLDEIDADKVFTPEDFTEEHEMIGKTTEEFVVNEVVPVLDEIENHQFDISRRLLTQAGELGLLGADVPEEYGGLGLDKISSSIITEKFSRAGGFSLSYGAHVGIGSLPIVFFGNEDQKKKYLPDLATGARIAAYALTEPSSGSDALGAKTTAVLNEAGTHYVLNGEKQWITNSAFADVFIVYAKIDGEHFSAFIVEKDFEGVSTGPEEKKMGIKGSSTRTLILEDALVPKENLLGEVGKGHVIAFNILNVGRYKLGVGCIGGSKRGIELAAKYANERKQFKQPIAKFTLIQEKLANMAVTTYAAESSIYRTGGLFEDRLGGLSEEQQKDGREVAKAIAEYAIECSLNKVVGSEALDFVADEAVQIHGGYGFMAEYEVERMYRDSRINRIFEGTNEINRLLVPGTILRKAMKGELPFLEKATALQEELMMLMPQEVGDEPLEQEKYLLSMAKKVFLMIAGTGAQTYGEKLQQEQELLANVADIVSDIFSMESVILRTEKAIRRNGLEKAEQKLALTQVFCQEAFNRIEAHAKESLVAMQSGDTLRTMTSILRKLTRHTPINVIAKKREIAGRILEAERYVV

SEQ ID NO: 17430 - protein, 393 aa, Bacillus halodurans
MREAVIVAGARTPVGKAKNGTLANVRPDDLGALTVKETLKRAGDFDPARIDDVIIGCAMPEAEQGMNMARNIAALAGMPHTVPAITINRYCSSGLQSIAYGAERIMLGQGEAIVAGGAESMSLIPMGGHVIAPNPTLVENQPEYYMGMGHTAEEVASRFGVSREDQDAFAVESHKRAAKAIEEGKFADEIVPVDVTLRHVDDNHKLVEKHVTFSVDEGVRPETNMETLSTLRPAFHAKGTVTAGNASQMSDGAAAVLLMDREVAEREGLTPVVKFRSFAVAGVAPEIMGVGPVEAIPKAVKMAGLDLSDIGLFELNEAFASQAIQVIRGLNLDHDKVNVNGGAIALGHPLGCTGTKLTLSLIHEMKRRGEQFGVVTMCIGGGMGAAGVFELIG

SEQ ID NO: 17431 - protein, 793 aa, Bacillus halodurans
MARQIRKVAVIGSGVMGSGIAAHLANVGIPSLLLDIVPNQLTEEEQRKGLTLEDRAVRNRLATLALKKLQKQKPAPLSRKSHVHYIQPGNLEDDVEKLAEVDWIIEVVVENLDVKKQLFEKVDQYRKQGTLVSSNTSGISIEAMAKGRSEDFQAHFLGTHFFNPPRYLKLLEIIPTKKTKPEVTAFMKAFAEDVLGKGVVEGKDTPNFIANRIGTYGLLVTVQKMLEGGYSVGEVDSVTGPLIGRPKSATFRTLDVVGLDTFLHVAKNVHDVVDGEEKDVFDPPVFMKKMAENGWIGSKSGQGFFLKQKGENGSEILELNPSTLEYEKRKKMKAPSIEQAKQAKSLNEKLSILIQANDRAGQLLWNLMKPVLIYSAEKVYEIAGDIKAVDDAMKWGFGWEQGPFEMWDAIGVASSVQRMEEEGATVPSWVKEMLTSGRERFYQDGTFYHHGEAKVIPINGKIIHLKALKPERVITKNSGASLIDLGDDVALLEFHSPNNSIGFDVVQMINKAVDEVEANYKGLVIGNQGKNFCVGANLMMILMEAQDDNFFEIDMVVRQFQQAMAKIRYSQKPVVSAPFAMTLGGGTEICLPTASIQASLETYMGLVEVGVGVIPGGGGNKELYLRHLERLPEGANIDLQSIANKTFETIAMAKVSTSAHEAMENGFLSERDGVVVNGDHLLYQAKQQVIHLHDAGYRPPARKKIPVVGETGYATMLLGAKSMKFGGMISEHDLKIAEKLAFVIAGGRVAKGTLVDEQYLLDLEREAFLSLVGEPKSQQRMQHMLMKGKPLRN

SEQ ID NO: 17432 - protein, 248 aa, Bacillus halodurans
MKLVAPKPFTFEGGTRAVLLLHGFTGTTADVRMLGRYLQEKGYTCHAPLYKGHGVPPEELIQTGPDDWWEDVEDGYQHLKEQGYEEIAVCGLSLGGVFSLKIGYTLPVKGIVPMCAPMRPKTDDAIYKGVLEYAEEYKRREKKSDEQIEEEMERFKSAPQTTLFGLKQLIEDVRDHLDHIYAPVFVVQARHDEMIDVESANVIHDTVESDEKSLKWYEDSTHVITLDKEKEQLHEDVYRFLEGLNWSE

SEQ ID NO: 17433 - protein, 429 aa, Bacillus halodurans [sequence omitted]

SEQ ID NO: 17434 - protein, 510 aa, Bacillus halodurans
MSKKPVALIILDGFAMRDEAKGNAVAQANKPNFDRYWNQYPHALLKADGEAVGLPEGQMGNSEVGHLNIGAGRIVYQSLTRVNLSIREGEFFENETFLNAMNHVKEKGSSLHIYGLVSDGGIHSHINHLYALLELAKREQVERVYIHGFLDGRDVGPTSAESYLVDLEAKMKELGVGELATLHGRYYAMDRDKRWDRVEKSYRAMVYGEGPAYSSALDVIKDSYENSIHDEFVIPSVITNEDGSPVATIEDDDAIIFFNFRPDRAIQMSQVFTNKDFRGFDRGEKLPQNVYYVCLTHFSETVQGDVAFKPTNLDNTLGEVLAQQNYKQLRIAETEKYPHVTFFFSGGREEPFPGEERILIDSPKVATYDLKPEMSAYEVTDALLNEIEADKHDVIILNFANPDMVGHSGMLEPTIKAVEAVDECLGKVVDAILAKGGAAVITADHGNADEVVTLEGKPMTAHTTNKVPVIVTEEGLNLREDGILADLSPTVLDLLGGKQPAEMTGKTLIK

SEQ ID NO: 17435 - protein, 251 aa, Bacillus halodurans
MRKPIIAGNWKMNKTVGEAKAFVEEVKGAIPSSDKVDSVVCSPALFLEGLVQKAEGTELRIGAQNMHFEESGAFTGEISPVALSDMKVDYVILGHSERRDMFAETDELVNKKTHAAFAHGLTPIVCVGETLEEREANQTYDVVKTQVEKGLEGLTDEQVKVTVIAYEPVWAIGTGKSSSAEDANDVCSYIRKVVTEKFSQEAADAVRIQYGGSVKPANIAEYMAQSDIDGALVGGASLDPQSFLQLLEAVK

SEQ ID NO: 17436 - protein, 394 aa, Bacillus halodurans
MNKQSVRDVELQGKKVFCRVDFNVPMKDGVVTDDTRIRAALPTIQLLAEKGARIILASHLGRPKGEVVEELRLDPVAARLQELLGKPVAKVNVAHGPEAEQAANELKDGDVLLLENVRFYPGEEKNDPELAKAFASLADVYVNDAFGAAHRAHASTEGIAHHVTAVAGLLMEKELEVLGKALSNPERPFTAIIGGAKVKDKIGVIENLLDKVDNLIIGGGLAYTFIKAQGHEIGKSLLEADKMDLALSFMEKAKEKGVNFYVPQDAIVADDFSNDANTKAVDIDQIPADWEALDIGPKTRETYRNVIQSSKLVIWNGPMGVFELDAFAGGTKAVAEALADANDTYSVIGGGDSAAAVEKFGLANQMSHISTGGGASLEFMEGKALPGVVALNDK

SEQ ID NO: 17437 - protein, 335 aa, Bacillus halodurans
MATKIGINGFGRIGRNVFRAALNNPNVEVVAINDLTDANMLAHLLKYDSVHGKLDAEVKVDGDSLVVNGHSVKVKAERDPAQLGWGDLGVEVVVESTGRFTNREDAAKHLEAGAKKVIISAPAKDEDITVVMGVNENKYDPANHHVLSNASCTTNCLAPFAKVLNDKFGIRRGMMTTVHSYTNDQQILDLPHKDYRRARAAAENIIPTTTGAAKAVALVLPELKGKLNGGAMRVPTPNVSLVDLVAELDKEVTAEEVNAALKEAAEGDLKGILAYSEEPLVSGDYNGNPASSTIDALSTMVMEGNMVKVISWYDNESGYSHRVVDLVDYIAKQGL

SEQ ID NO: 17438 - protein, 211 aa, Bacillus halodurans
MNVDDLTFDDKGLIPAVVQDAQSKEVVTVAYMNRESFEKTVETGETWFYSRSRQELWHKGATSGHTQKVVDIRYDCDGDALVVLVELKGPACHTGKYSCFFESVFGKKIYGASDRFGIIATLEALIAEREAEMPEGAYTTYLFEKGVDKILKKVGEEATEVVIAAKNRDAEELKWEVADLLYHLLVLLREQKLPVDEVLAVLEERHRPKEE

SEQ ID NO: 17439 - protein, 252 aa, Bacillus halodurans
MLTKRIIPCLDVKDGRVVKGVQFVDLRDAGDPVELAAFYDEQGADELVFLDISASHEGRETMIDVVEKVAGTLAIPFTVGGGINSLEDMKRVLRAGADKVSLNTAAVTRPELITEGADYFGSQCIVVAIDAKYDEALGSWRIYTHGGRTPTEWEVCDWAREAVRRGAGEILLTSMDQDGAKTGFDLALTTKVSEAVSVPVIASGGAGAKEDFVDVFMNAYADAALAASIFHYKETSVAEVKTHLREEGVAVR

SEQ ID NO: 17440 - protein, 194 aa, Bacillus halodurans
MRKATIERKTGETQISLTFAVDGEGQSNLTTGVPFMTHMLDLFTKHGHFNLTIDAKGDTEVDDHHTTEDLGICLGLALKEALADKKGIRRYGSAFVPMDETLAQVVVDLSNRPHLEFRADMPSEKVGTFDTELVHEFLWKLALEARMNLHVIVHYGENTHHIIEAIFKALARALDEATTIDPRVKGVPSTKGML

SEQ ID NO: 17441 - protein, 424 aa, Bacillus halodurans
MKIVTINDSVSLKRDLDTGTDMQQNAVHSIIAQVREQGDQALFTLTKQFDGADLTTLRVQQAEIEAAYREMEEPVLQAIGEAIENIRDFHERQKRNSWMTTKSDGTILGQKITPLDSVGLYVPGGKAAYPSSIMMNVIPAQVAGVQNIVIVSPPQKDGSIPAGVLVTAAELGVKTILKVGGAQAIAALAYGTESVPAVDKITGPGNIYVALAKRAVFGHVDIDMIAGPSEIVVLADERANPRYIAADLLSQAEHDERASAILVTPSRALAEEVAVEVDQQLTTLPKREIAAASIRDYGAIYVTETLEEAVSVVNELAPEHLEILAEEPMSFLGKIRHAGAIFLGPYSSEPVGDYFAGPNHVLPTNGTARFSSPLNVDDFVKKSSIISYSKAALLENGAKISALARLEGLEAHARAIDIRLEDER

SEQ ID NO: 17442 - protein, 215 aa, Bacillus halodurans
MEINTVLFDLDGTLINTNELIISSFLHTFETYYPGKYGRKDAIECIGPPLTDSFKRLDPERVEEMVATYRKHNHAHHDKLVEPYEGVYETVKTLHEQGFKLAIVTTKIRETAMKGLKLFGLDEFFDVIVALDDVENVKPNPEPLEKAMNALGAKKEETIMVGDNSHDILGGKNAGVKTAVVGYAIRGEDYVRQFDPDYVLRSMPDLLDIVGVKAR

SEQ ID NO: 17443 - protein, 329 aa, Bacillus halodurans
MPDVVLELDKLRTHFFTDQGEVPAVDGVSLRLHQGEIIGIVGESGCGKSVTSLSIMQLVPNPPGKIMSGHVYFKGEDLVQVSPKRMKQIRGNDIAMIFQEPMTSLNPLFTIGNQLIEAIRNHRKMTKQEARKQAVTMLERVGIPRADEIASEYPHQLSGGMRQRVMIAMAMCCDPKVLIADEPTTALDVTIQAQILDLMRHLNEAHDTAILLITHDLGVVAELCNRVVVMYAGQVVEEGDVRMILKHPKHPYTKGLLKSLPKIHEQSKRLYSIPGVVPKPGTVGHGCRFAARCEVAFERCKTTAPQLQQVATGHQCRCFLYEERGDEVG

SEQ ID NO: 17444 - protein, 297 aa, Bacillus halodurans
MHVKKAIIPAAGLGTRFLPATKAQPKEMLPIVDKPTIQYIIEEAIESGIEDIIVVTGRGKRAIEDHFDKSFELEETLEKKNKSKLLEEVKAISSMTNIHYIRQKEANGLGHAIWCARKFIGNEPFAVLLGDDIVQSDVPCLKQLIDVFDRYHSSVVGVQEVPNEDVSKYGIVSPKGSEIEANVIHAAGFVEKPKLEEAPSNYAIMGRYVLRPEIFDILENLPPGAGGEIQLTDAIKVLNESQVVLAYNFDGVRYDVGDKFGFIKATIDLALQRDDLSEDVAQYIKDIYEKQVGQLKQ

SEQ ID NO: 17445 - protein, 1072 aa, Bacillus halodurans
MRKNKASKVSVLFMIVLLVLSLFTPIMPMHEANADTEADTLRIHYQRSDQQFENLGLWLWGDVRYPSENWPSGGTPFEPEKMTDYGAYVDIELKENAENIGFLVLNTATGDKDGNDKHVQLLSPEMKEIWIKEGSDDVFLYEPVDLPDHTVRIHYERSDQSYHHWGLWTWKDVASPSEHWPSGANPFSDEQTSRYGAYLDVELADDANEIGFLVVNRENGDKDGDDKTFADLANHPQLFIRQGDDTVYTNPYYQTIEGLVSGELISLTEMELRFTSTIWLSEDDLAEQIHLTDTNGASVAFDHVTIHDEKTVILHGSFDAELAPYHVTFADKTVVARAGWRLIDALYGYDGELGAVLHEDGSSTLTFWSPLADHVSVVLYDKDDQYRIIKDDIDMTKGDQGVWQVTLHSENTGLDNLAGYYYHYKIERDGDTKLGLDPYAKSMAAWNNEGSYSIGKAAIVDPSSIGPELDFAEIEGFEKREDAIIYEVHVRDFTSDPGIEEELTAQFGTFASFVDKLDYIEDLGVTHIQLLPVMSYYWGDELANHERELAYSSSGNNYNWGYDPHSYFSLSGMYSENPEDPELRIKEFKHLIDEIHRRGMGVILDVVYNHTAAVEIFEDLMPNYYHFMDADGTPRTSFGGGRLGTTHKMSRRILVDSITYWVEEYKVDGFRFDMMGDHDAETIQIAYDRAKELNPNIVMIGEGWRTYVGDEHGGDIMPADQDWMQHTESVGVFSDEFRNELKSGFGSEGQPRFITGGARNIEQIFDNLTAQPHNFTATNPGDVVPYIEAHDNLTLHDVIAQSIRKDPEYHQEEIHKRIRLGNTMVLTAQGTAFLHAGQEFGRTKQFRADTGGQAPYKSTYMTDENGKPFVYPYFIHDSYDSSDAINKFDWGKATNKEKYPIHHLTRTYTAGLIELRRSTNAFTHGTLVDVQANVRLLDIPEISETDLVIGYRATSTDNTGTYYVFVNADTKERTLSLTDDLTEGVVIVDSDEAGIVAVSDPSGFDLTPNEITIDPLTAVIIRVGGDFQENPHDGHPGKGGGKAKGRPDHAGQPGPPPHAGEKGKPDHASKKK

SEQ ID NO: 17446 - protein, 672 aa, Bacillus halodurans
MINEKLPKIWYGGDYNPEQWEKEVWDEDIRMFKLAGIDVATLNVFSWALNQPDEETYDFTWLDEQIDRLYENGIYTCLATSTAAHPAWMAKKYPDVLRVDYQGRKRAFGGRHNSCPNSPTYRKYAERMADRLGERYKDHPGVLIWHVSNEYGGYCYCDNCAASFRKWLQQKYGTLQNVNKAWNTRFWGHTFYDWDEIVPPNALSEEWEGDSTNFQGISLDYRIFQSDSLLECFKLERDALKKHTPNLPVTTNLMGTYKELDYFKWGKEMDVVSWDNYPAYDTPVSFTAMAHDLMRGLKSGQPFMLMEQTPSQQNWQPYNSLKRPGVMRLWSYQAVARGADTVMFFQLRRSVGACEKYHGAVIEHVGHENTRVFRETAALGKELGNLSYALLDARVQAKVAIVFDWENRWATELSSGPSKALDYVKEVHNYYAALFDENIPVDMIGVDEDLSKYEIVIAPVLYMVKSGYADRVKEFVQNGGTFVTTFFSGIVNEHDLVTLGGYPGELRDLLGIWVEEIDALPPEEKNQIVITNDTGSLTGTYECRLLFDIIHSEGADVLAEYGSDFYAGTPVITRHAYGKGKAYYVGTCPDQAFLTDFMKTVCAEKEIAPLLNVPKGVEVTERRKDGASYFFIMNHNASTVELEIGEGTDLLTGKELTGATSLEAYGVMIVKR

SEQ ID NO: 17447 - protein, 388 aa, Bacillus halodurans
MNITIAGTGYVGLSNAVLLAQHNDVIAYDIVQEKVDMINNRKSPIVDREIEEFLATKELNLTATTDKEKAFKDAQFVVISTPTNYDPEKNYFDTSSVEAVISDVLSINPNAVMVIKSTIPVGYTREVNERFNTKNIIFSPEFLREGSALYDNLHPSRIVVGERTQRAKIFAALLVQGAIKENIDVLFTDSTEAEAIKLFANTYLAMRVAFFNELDSYAELKGLDAKQIIDGVGLDPRIGTHYNNPSFGYGGYCLPKDTKQLLANFEDVPNNIIGAIVDANDTRKDHVANMILKREPKVVGIYRLTMKTGSDNFRQSAILDVMTRLNNAGAEVVVYEPALDATEFDGSKVIEDFAEFKKMSDVIVANRLSDDLKEVAEKVYTRDLYTRD

SEQ ID NO: 17448 - protein, 293 aa, Bacillus halodurans
MKKIRKAIIPAAGLGTRFLPATKAMPKEMLPIVDKPTIQYIVEEAISSGIEDIIIVTGKGKRAIEDHFDHSFELEQTLAEKEKYDLLEKVNESTKVDIHYIRQKEPKGLGHAVWCARKFIGDEPFAVLLGDDIVQAETPCLKQLIDQYEQTESSVIGVQTVADHETHRYGIVDPIDQKGRTYTVKQFVEKPKPGTAPSNLAIMGRYVLTPEIFTFLGRHETGAGGEIQLTDAIERLNEIQHVYAYDFEGKRYDVGEKIGFVKTTVEFALHDEAIKDEFARFLEAILEQKKVNF

SEQ ID NO: 17449 - protein, 317 aa, Bacillus halodurans
MDVVTFGETMVVFEPVEMGALRYVDRFKKGVGGAESNVAIGVAKLGHSVGWVSKVGNDELGKYVISAIRGEGVDTSQVVLDDGAPTGLYLKEKLRDDFNRVYYYRAGSAASRLGVEDINWAYMKQAKIIHITGITPLLSDSCYELCHAVLDFAKENGIFASFDPNLRMKLLANVPDGKERLLALASKADLVMPGRDEAAFLFDTDELAQMFSRLLTGRTTSVVIKDGAKGAHFMEEGKEPQFVPSCPVDKVVDPVGAGDGFAAGVLASLLEGKSMEEAVSVGTQIGALVVMAKGDMEGLPEREQLEAFSQARSDVLR

SEQ ID NO: 17450 - protein, 294 aa, Bacillus halodurans
MKTPNITVVGSINMDMVTITDVVPVQGETVLGKDFRTVPGGKGANQAVAAARLGANVRMIGRVGDDPFGHVLTENLAKEGIITDSVKPVTDCTSGVATILLSDRDNRIIVTKGANEHVTPDYVAAFEQELAASDVVLLQLEIPLETVAYVLEFCAKHHVTTVLNPAPAQKLPDAAWTDATYISPNENECLQLFGDEPDANLRQKLIMTKGADGVQFYENDEQVQVESFRVEPVDTTGAGDTFNGAFAVALGGGTVKEAVRFANAAAALSVQSFGAQGGMPTKAQVQSFLQEQGG

SEQ ID NO: 17451 - protein, 140 aa, Bacillus halodurans
MLTIEDIKKIIPHRYPFLLIDRLEELEDGKRAVGIKNVTVNEDFFNGHFPDYPVMPGVLIVEALAQVGACAILNVEENKGKLAFFAGIDNCRFKEQVKPGDQLRLEVEIVRMKGPVGKGRGVASVNGKTVAETDLMFAIK

SEQ ID NO: 17452 - protein, 440 aa, Bacillus halodurans
MEKIIVRGGRQLSGSVKVEGAKNAVLPVIAASILASRGTSKIYDVPKLADVYTMKEVLRNLNINVEYENGEFVVNATNPLKTEAPFEYVRKMRASFLVMGPLLARVGHARIALPGGCAIGSRPIDQHLKGFEAMGATVEIGNGFIEAKVEGRLQGTKIYLDFPSVGATENIMMAAAMAEGTTILENAAEEPEIVCLANYLNAMGAKVRGAGTGVIRIEGVDELVGAEHTVISDRIEAGTFMVAAAITGGDVFIEGAVAEHLRPLIAKMHEMGVKTIEEDNGIRVIGPDELKPVDIKTMPHPGFPTDMQSQMMALLLRANGTSVITETVFENRFMHVEEFRRMNGNIKIEGRSAIISGPCQLQGAEVTATDLRAGAALVLAGLVADGHTRVVELKHVDRGYVDLAGKLARLGADIERVVETEHELENLDAPAPLKLNTNLV

SEQ ID NO: 17453 - protein, 470 aa, Bacillus halodurans
MNTGHITQVMGPVVDVRFQSGQLPELNNALRVEQKGADQNAVDVNVTLEVALHLGDDTVRTIAMGSTDGLVRGTEVVDTGAAISVPVGEVTLGRVFNVLGESIDLDEPIPADAERSPIHREAPKFEELSTKTEILETGIKVVDLLAPYIKGGKIGLFGGAGVGKTVLIQELINNIAQEHGGISVFAGVGERTREGNDLYHEMSDSGVIKKTAMVFGQMNEPPGARMRVALSGLTMAEYFRDKQGQDVLLFIDNIFRFTQAGSEVSALLGRMPSAVGYQPTLATEMGQLQERITSTKVGSVTSIQAIYVPADDYTDPAPATTFAHLDATTNLERKLSEMGIYPAVDPLASTSRALSPEIVGEEHYNVARQVQQTLQKYKELQDIIAILGMDELSEEDKLIVARARRIQFFLSQNFHVAEQFTGQPGSYVPVKETIKGFKEILEGKYDDLPEDAFRLVGRIEEVVERAKQMV

SEQ ID NO: 17454 - protein, 285 aa, Bacillus halodurans
MASLRDIKQRINSTKKTKQITKAMEMVSAAKLNRSQEKAQSFLPYTDKIREVVASIAASDTDVSHPMLEERPVKKTGYIVITSDRGLAGAYNSNLIRGLLYTINKRHKSKDEYGIFAIGRTGRDLLKKRQLPIISEMTGLSDQPTFNDIKDIAKQTVDMFADEVFDELYIWYNHFVSPIKQDVTEKKVLPLTDLSDTKVSTTYEYEPNEQVILEALLPQYAESLVYGALLDAKASEFAARMTAMSAATDNATNLIDELTLSYNRARQAAITQEITEIVGGAAALE

SEQ ID NO: 17455 - protein, 502 aa, Bacillus halodurans
MSIKPEEISSLIKQQIENFQSDVQVQDVGTVIRVGDGIALAHGLESVMAGELLEFSNGVMGMAQNLEENNVGIIILGPYSEIREGDEVKRTGRIMEVPVGEELLGRVVNPLGQPIDGRGPIETSKTRPIESPAPGVMDRKSVHEPLQTGIKSIDSMIPVGRGQRELIIGDRQTGKTSIAIDTIINQKDQDMICIYVAIGQKESTVAGVVETLRQHGALDYTIVVSASASEPAPLLFLAPYAGVSMGEEFMYNGKHVLVVYDDLTKQAAAYRELSLLLRRPPGREAYPGDVFYLHSRLLERAAKLSDAKGGGSITALPFIETQAGDVSAYIPTNVISITDGQIFLQSDLFYSGVRPAVNAGLSVSRVGGSAQIKAMKKVSGTLRLDLAAYRELEAFAQFGSDLDKATQAKLNRGQRTVEVLKQGLHEPLPVEKQVAIIYALINGFLDDIPVGDVRRFESELFTFLDHNKKELLDHIRTTGNLPDDSEFKAAITEFKQGFVTTK

SEQ ID NO: 17456 - protein, 183 aa, Bacillus halodurans
MSNHAVANRYAVALFELAQEKGLHESFVSELELIKAVFQDTPELMQFLTHPKTELTQKRELLEKTFKGKVNDTIFNTLVVLVERKRIDLIIPVVQKFKSLSYDAQKIAEAFVYSAKPLSEAEKDQLSVLFAKKVGKAKLLIENIVDPSIIGGLKIRIGDRIYDGSIKGQLDVLHRELVSGPRS

SEQ ID NO: 17457 - protein, 428 aa, Bacillus halodurans
MEKLMIEGGTPLEGTVQISGAKNSAVALIPAAILADSTVTIDNLPDISDVRLLGELLKEIGGEVELADQKMVIDPSKMFAMPLPNGRVKKLRASYYLMGAMLGKFKKAVIGLPGGCNLGPRPIDQHIKGFEALGAKVTNEQGAIYLRADELKGARIYLDVVSVGATINIMLAAVLAKGRTIIENAAKEPEIIDVATLLTSMGARIKGAGTNVIRIDGVESLHGCRHSIIPDRIEAGTYMILAAAIGQNVLIDNIIPLHVESLIAKLREMGVDVEVLDDQVRIRNHQEKKGVDIKTLVYPGFPTDLQQPATTLLTQAHGTSIVTDTIYNARFKHIDELRRMGADIKVEGRSAIINGKTKLQGAKVRASDLRAGASLVIAGLTAEGITELSGVEHIDRGYEDLEQKLIGLGAKIWREQMSDQEEEQVKSS

SEQ ID NO: 17458 - protein, 287 aa, Bacillus halodurans
MPLVSMTEMLNKAKAEGYAVGQFNLNNLEFTQAILQAAEEEKSPVICGVSEGAARYMGGFKTVVGMVKNLMQEYNVTVPVAIHLDHGSSFEKCVEAIHAGFTSVMIDGSHHPLEENIALTKRVVDVAHALGVSVEAELGRIGGQEDDLVVDEAEAAYAIPSECKELVEATGVDCFAPALGSVHGPYKGEPNLGFDRMKEINELVGIPLVLHGGTGIPTKDIQKAISLGHAKINVNTESQISSAKAVRQVLEEKPELYDPRKYLGPAREAIKDTVKGKMREFGSSNKA

SEQ ID NO: 17459 - protein, 380 aa, Bacillus halodurans
MNFLLTDEQQMIKKMVRDFAENEVAPTAEERDEEERFDREIFDQMAELGLTGIPWPEEYGGIGADYVSYVIAVEELSRVCASTGVTLSAHLSLASWPVYKFGTEEQKQQFLRPMAEGKKIGAYGLTEPGSGSDAANMKTTAVLEGDDYILNGSKIFITNGGIADIYIVFAVTEPEKRHKGVSAFIVEADTPGFSVGKKEKKLGIRSSPTTEIIFEDCRVPKENLLGKEGDGFKIAMMTLDGGRNGIAAQAVGIAQGALDAAVAYANERKQFGKPIGQQQGIAFKLADMATKVEASRLLTYQAAWRESEGLSYGKESAMSKLFAGDTAMDVTVEAVQVFGGYGYTKEYPVERYMRDAKITQIYEGTNEIQRLVISKMLLAD

SEQ ID NO: 17460 - protein, 379 aa, Bacillus halodurans
MNLRWTDEQEMMRKMVRDFAQERIAPFVEEMETNDTFPMHIVKEMGELGLMGIPIPEAYGGAEMDFTSYIIAIHELSKVSATVGVILSVHTSVGTNPILFFGTEEQKSRFIPKLAKGEYLGAFGLTEPSAGSDAANLKTTALKQGDHYRLNGSKVFITNGGAADTYVVFASTNPSAGRKGISAFIVEKETPGFTVGKKEKKMGLHGSNTTELIFEDALVPKENLLGVEGDGYKIAMANLEAGRIGIAAQSLGIAEAALEAATSYAKERKQFGKSIGQQQAIAFKLADLATQVEAAKLLTYRAAQLKQQGISCAKESSMAKLFASKTAMKAAIEAVQIFGGYGYTKEYPVERYFRDAKVCEIYEGTSEIQRIVIHKHISE

SEQ ID NO: 17461 - protein, 284 aa, Bacillus halodurans
MDIKQVMVIGAGQMGSGIAHVHALAGFEVMLYDLDQASIEKGIQTITKQFQRQVEKGRMTEGEMDITLSRIHQSTELQDAKKADFIVEAVVENMEVKTNLFAKLDDLAPADTILATNTSSLPITEIAAATNRPEKVIGMHFMNPVPVMKLVEIIRGLATADDVYETVEALTKKLNKTPVEVNDFPGFVSNRVLMPMINEAIYTVYEGVATPEAVDEVMKLGMNHPMGPLTLADFIGLDTCLYIMETLHEGFGDDKYRPCPLLRKYVKAGWLGKKTGRGFYVYHK

SEQ ID NO: 17462 - protein, 392 aa, Bacillus halodurans
MKTAIISGVRTPFGKFGGSLSTLTAAQLGGHAIRETLKRANWRGERVDDLIMGNVLQGGQGQLPSRQALKEADLPWDVRTETINKVCASGMRSVTLADQLIRSGSSKVVVAGGMESMSQAPYYVPKARWGARMGHVEMIDGMVFDGLTCAFTGVHMGTYGNGTAHELAISREAQDEWAYRSHQRAIAAIGAGRLEEEIVPVEVPQRKGEPLLVACDEAPRKDTSMESLKNLRPVFGKEGTITAGNAPGVNDGAAAMLLMSEEEAKSAGMAPLAIIEGHTALATEPKDFPKTPGLVIQKLLQDTGKTPAEIDLFEINEAFAAVALASQQIAEIDPEKVNVNGGAVALGHPIGASGARIILTLAYELRRRGGGLGIAAICSGGGQGDAVLIRVP

SEQ ID NO: 17463 - protein, 413 aa, Bacillus halodurans
MSLTKKIIIALVLGILVGLGMNKFAPDLFVPIDTYVFTPVGQLFLRLIMMLVVPLVLFSIILGTAGLGDPKKLGKLGSKTVGFYLLTTMIALVIGLSIAYVLQPGEPGLMGTVEEEFEATEAPPVMETILNIIPRNPIEALASGQMLQIIAFAVLVGLALGRLGEKTSGILKLVEQGNEVMMYLVSLAMKLAPYGAFGLIASALGKLGFDALGSMAMYVIAVLLALLLHAVITYGGFLAFVAKRNPLEFLRNFFPAMALAFGTSSSSAVLPVSMKTAQEKLGVSKPVSSFVQPLGATINMDGTAIMQAVATVFIAQVYAQQLSMGDLLTVVLTATLASIGTAGVPGVGLIMLAMVLQSIGLPVEGIALVLAVDRILDMSRTAINITGDATCAVVIDESEKRSKAKAASTSASA

SEQ ID NO: 17464 - protein, 278 aa, Bacillus halodurans
MIQSIQDRVKLANGVEMPWFGLGVYKAAEGEEVIGAVRAALKAGYRSIDTASLYQNEVGVGQAIRESGIPRDEIFVTTKVWNTEQGYDETLAAFERSRKRLGLEVIDLYLIHWPVREKFLDTWRALETLYKERKVRAIGVSNFNIHHLETVMNISDINPMVNQVEFHPFLTQKPLLTFCKAHDIQLEAWRPLTKGEIFTHPVVQALAKKYGKTPAQIVLRWNLEHRVVTIPKSVREERIQENANIFDFHLSPEDVEALDGLNEDRRLGQDPDSFSFDF

SEQ ID NO: 17465 - protein, 224 aa, Bacillus halodurans
MSILHNDWADVLEAEFQKPYYVQLREFLKQEYSTQTIYPSMYDIFNALHYTPLAEAKVVILGQDPYHGPNQAHGLSFSVKPGVPLPPSLQNIFKELREDLGCPIPNNGHLTPWAEQGVLLLNTVLTVRKGQAASHRGKGWESFTDRVITCLNEREKPVIFVLWGRHAQEKQALITNDRHYILTAPHPSPFSANRGFFGSRPFSTINRILQEQGESQIHWEIPNL

SEQ ID NO: 17466 - protein, 226 aa, Bacillus halodurans
MDCPFEAVIFDMDGVIADTVGLHYEANQHIAKKLSVTFSEEMNQSLQGLSREKTVRAICDLTGEEVSDEQVKQLSELRNEQYQRLIAELTPADALPGIYSFIRELKEKKVSIALASASTNAPRVLSRLQLIDAFDVIVDVQKVRRGKPDPEIFLTAAQLLGVSSNRCVAIEDGEAGLTGILQTDMFAVGVGTHSAMKKAHWQVASTEELSIKSLINAVEKTRNKDI

SEQ ID NO: 17467 - protein, 553 aa, Bacillus halodurans
MNRQWWKEAVAYQIYPRSFCDSNGDGIGDLQGVIEKLDYVKDLGIDVIWICPMYRSPNDDNGYDISDYQDIMDEFGTMEDFDQLLHEVHRRGMKLIIDLVINHTSDEHPWFIESRSSKVNPKRDWYIWRDPKEDGSEPNNWESIFNGSAWEYDQATGQYYMHIFSRKQPDLNWENRDVRKALYQMINWWLEKGIDGFRVDAISHIKKVKGLPDLPNPKGLDYVPSFEGHMNREGIHEYLQELKRETFDHFNIMTVGEANGVTVEQADDWVGEDHGAFNMIFQFEHLGLWDKGVNGTVDLAELKSIFTTWQKGLEGKGWNALFLENHDQPRSVSTWGNDKGYWKESAKALGTLFFFMQGTPFIYQGQEIGMTNVRFPSIEDYDDVGMKNFYRIETEKGRSHEEIMEIIWQKGRDNSRTPMQWNDQKHAGFSTATETWMGVNPNYKQINVEKQLKEEDSVLSYYKKMIELRKSSDLFVYGSYDLVLPEHKQIFAYKRTLEKESALILVNMFADEVSFQFPLKLIGEKERVLGNYKTQGAKDKLRPYEARVYRWQS

SEQ ID NO: 17468 - protein, 577 aa, Bacillus halodurans
MIARFFSYYKPYKGLFFLDFFCAVFVGILELAFPLAVNQVIDRLLPEGNWQIIFWACVGLLFVYLLNTVMQYVVTYWGHKLGINIESDMRKKLFEHMQKLSFGYYDNNKTGHSISRLTKDLEEIGEVAHHGPEDVFVAVMTLVGAFAIMLSIHWQLAVALFCVVPFIIIFAVYFNKKMTTTFRRMFQDVGDINARVEDSIGGIRVVQAFANERYEQAQFAKNNQRYRKTKLASYKIMAQNVMANYVLMRSITLLTLLVGTWFVISGSLTYGEFVAFILLSNILIQPVQKINAVIESYPKGIAGFKRYTEILDTEPDIEDAPGAKEWNIQGNIQYEGVRFGYDGMEDVLKNIDLTIRAGETVAFVGPSGAGKTTLCSLLPRFYEVKDGRIVVDGLDIREMKLESLRNQIGIVQQDVFLFSGTVKENIAYGNLQATDEEIMEAARKAKLDDFILSQPDGLETVIGERGVKLSGGQKQRLSIARMFLKNPPILILDEATSALDTETELAIQQSLSELSKGRTTLVIAHRLATIKNADRIIVVTKEGIAEQGSHEQLLQTGGIYARLHRAQFGEFLVRTQV

SEQ ID NO: 17469 - protein, 282 aa, Bacillus halodurans
MEHVIEVKHLRKTFDGKEALKDVSFSIKRGETFGFLGPSGAGKTTTIKILTGQVRSFDGEVALFGKPVHRLKRKTFMSQIGVLTDNSGLYERLTVQDNLSMYCKLYSVPERRIHDVLAEVGLRDERAKIVSKLSKGMKQRVILARAMLHKPDLLFLDEPTSALDPASSHMIHDSLRRLNREGTTIFLTTHDMLEAEKICDRVAFLDQGKIRVMDTPEQLRLTYADSTITLLLKGGRREIVENNLDGANTISQVMKNGELLSIHSNEPTLGDVFLRVTGKELM

SEQ ID NO: 17470 - protein, 246 aa, Bacillus halodurans
MRLNGKVAMITGAGRGIGAATAKKFAREGAKVIVCDVREEEVAKTVAEIQDGGGEALGSVVDVTQRKDVKNVINQVIERFETLDVVVNNAGITADAQLTNMTDAQWDDVIDVNLKGVFIVTQEVTTIMKEQKRGVILNASSVVGSYGNFGQTNYAASKWGVNGMTKTWAKELGRYNIRVNAVAPGFILTPMTEKMPEKVLKVMEEKAVLNRLGTVEEVANGYAFLASDEASFITGTILAIDGGVVI

SEQ ID NO: 17471 - protein, 395 aa, Bacillus halodurans
MNADWLHAIEEKLTRLKDRGSFRQLVPTSEAALPWLTRENCRLLNLASNNYLGIADSKEFIERTEQLASSYAIGSTASRLIIGNHPLYEEAEYELTKWKKTEAALIFGSGYMANVGIISSIVGRGDAVFSDKLNHASIVDGCQLSRADHLRFRHNDMDHLETLLQKSPHKQKLIVVDALFSMDGDHANLHDLVTLKERYGAILMVDEAHSGGVYGATGGGLVEELGLNDRVDIQMGTFSKALGSYGGYVAGAKPFIEYLLNHARSLIFTTALPPYIVASHLAALQIVQEQPWRREKVQVLGERLRNGLEQLGFSLCGSESYIVPVLIGDNHDLLLVSESLQAAGIAAIPVRPPTVPRGEGRIRLTVTASHTEKDIDWAIEQFQRLPLVGRRELTP

SEQ ID NO: 17472 - protein, 466 aa, Bacillus halodurans
MTKDTVTYRFPEGFWWGSATSATQTEGATHRDGKGKNIWDHWYEVEPSRFFQGVGPQDTSQFYERYKEDIQLMKEVGHNSFRFSISWSRLIPDGRGEVNPKGVEFYNNVIDELLGQGIEPFVNLFHFDMPMELQKIGGWANREVVDAYEAYAKTCFERFGDRVKKWFTHNEPIVPVEGGYLYDFHYPNEVDFEKAIQVGYHTVLSSAKAIRAYKQLNQGGKIGIILNLTPSYPRSNHPADLKAAKIADAFFNRSFLDPSVKGEFPEELVQILKEEGFMPIIEEEDLEIIRQHTVDLLGVNYYQPRRVKAKETLPNPDAPFMPERYFDHYAMPGRKMNVHRGWEIYEKGIYDILINLKEHYGNIECFISENGMGVEGEEKFRDENGVIHDDYRIEFIQDHLKWVHRAIQEGSNVKGYHLWTFMDNWSWANAYKNRYGLVSVNLDKNGERTIKKSGKWYKTLSENNGF

SEQ ID NO: 17473 - protein, 368 aa, Bacillus halodurans
MSIKQPFVPGLDRVIAAETAISFLDTEREKIIIRGHDLIDLSVSNDYLDIVHLLLDGTLPNASEKSALEDTLKKHYDIPSYVMEILSLLPETTHPMDGLRTGLSALSSVDKEIENRSTEANKARAYKLLGKLPAITVNSYRLINGLKTVQPVPTLSYSANFLYMITGKEPKPFEAKIFDRSLLLYSEHEMPNSTFTARVIASTHSDLYGALTGGVASLKGNLHGGANEAVMYMLQSVDSAAEFQQLIQKKLVNKEKVMGFGHRVYMKKMDPRALEMKESLKQLCEKKGDYSLLDRCEAGEKTMLEEKGLYPNLDYYAAPVYWMLGIPIELYTPIFFTARTAGLAAHVMEQHQNNRIFRPRVSYIGESY

SEQ ID NO: 17474 - protein, 310 aa, Bacillus halodurans
MAITKGNKIVLVGTGAVGSSYAYALMNQGISDELILVDLNEEKAKGDVLDLNHSIVYAPSPMEIKFGSYEDCKDAALVVICAGAAQKPGETRLDLVHKNVGIFESIVGNIMKSGFNGIFLVATNPVDILAYATWKFSGLPKERVIGSGTVLDTARFRYLLGEEMNAAPTSVHGYIIGEHGDSQLPVWSSATIAGTPIAPRLTDEKKQEIAENVRDAAYKIIEAKGATYYGIATGLARITRAILKNENVVLPVGTLLEGENGHDDVYIGVPAIINREGVRQVVELSLNDEEKEKFARSVETLKDIQAAIWS

SEQ ID NO: 17475 - protein, 515 aa, Bacillus halodurans
MLTPYKHEPFTDFSVEENRSAFEAALKNVEGELGKDYPLVINGERVTTDDKIVSVNPAMKEQVIGVVSKASREIVDDAFKSAETAFHTWKNVNPEERANILIRAAAIIRRRKHEFSAWLVKEAGKPWKEADADTAEAIDFLEYYARQMITLKDGKPVNSREGEHNRYFYTPIGVCVTISPWNFALAIMAGTTVAPIVTGNTVLLKPASTTPVVAAKFVEVLEEAGLPKGVVNFVPGSGTDIGDYLIDHPKTSLITFTGSRDVGVRLYERAAVVHPGQQHLKRVIVEMGGKDTVVVDKDADLDLAAQSIVTSAFGFSGQKCSAGSRAVIHQDVYDVVLEKAVALTKQLSVGEPTAPDVYMGPVVDQGAFSKIMSYIEVGKEEGRLMVGGEGDDSKGFFIQPTIFADVDPHARIMQEEIFGPVVAFSKARDFDHALEIANNTEYGLTGAVITTNRHHIEKAKRDFHVGNLYFNRNCTGAIVGYHPFGGFKMSGTDSKAGGPDYLALHMQAKTVSEMY

SEQ ID NO: 17476 - protein, 420 aa, Bacillus halodurans
MGAIAEKGKESSILSSTQDVIQQALGKLGYEEGMFELLKEPVRMLTVRIPVRMDDGTVKVFTGYRAQHNDAVGPTKGGVRFHPEVTADEVKALSLWMTLKCGIVNIPYGGGKGGIVCDPRTMSFPEIERLSRGYVRAISQIVGPSKDIPAPDVFTNSQIMAWMVDEYSRIREFDSPGFITGKPIVLGGSHGRETATAMGVTICIEEAAKLKQLDLREATVIIQGFGNAGGYLAKILSDRGAKIIGISDAYGALYDETGLDIEYLLDRRDSFGTVTTLFKNTITNEELLEKKCDILVPAAIANQITEANAREIKASIIVEAANGPTTTEATNILTERGVLIVPDVLASSGGVTVSYFEWVQNNLGYYWSEEEVSEKLRSKIVEAFHQVVETATRYNVDPRLAAYMVGVRKTAEASRFRGWI

SEQ ID NO: 17477 - protein, 400 aa, Bacillus halodurans
MKMQSSTSAVIEKTEKYGAKNYHPLPIVISEAKGVWVKDPEGRKYLDMLSAYSAVNQGHCHPKIIQALKDQADKITLTSRAFHNDQLAPFYEKVSKLTGKNMLLPMNTGAEAVETAVKAARRWAYDVKGVPDNQAEIIVCEDNFHGRTMTAVSLSSNDEYKRGFGPMLPGIKVIPYGDLEALKAAITSHTAAFLVEPIQGEAGIRIPQEGFLKEAYALCKRENVLFIADEIQSGLGRSGKWFACDWEDVKPDMYILGKALGGGVFPISVVCADRDILGVFEPGSHGSTFGGNPLACAVSIAALEVLEEEKLVERSYEYGNYLLTKLKEIDNPIIKDVRGRGLFIGVELHEPARKYCEQLKEEGLLCKETHETVIRFAPPLVISKEDLDWAIEKIYYVLKP

SEQ ID NO: 17478 - protein, 301 aa, Bacillus halodurans
MNKFQKVSIIGVPMDLGQKRRGVDMGPSAMRYAGLIEEIEALGFEVKDYGDIPINRPATSETQEGPLRNLDEVVKVSEELCKGVAAIEAEHSFPLILGGDHSISIGSIAGIRKSYNNLGVIWYDAHPDLNTEETSPSGNIHGMPLAVNLGIGHERLMNIGGITPKVKPEHIVIIGARSIDEGERQLIREQGIKVYTMHEVDRMGMTRVIEETIDYLSARTDGVHLSFDLDGIDPVDAPGVGTPVLGGISYRESHLALEMLAESELITSAEFVEINPILDNKNQTANVAVALVTSLLGKKLL

SEQ ID NO: 17479 - protein, 348 aa, Bacillus halodurans
MQALRWHGVKDVRVDDIAEPATLKGKVKIKVKWCGICGSDLHEYAAGPIFIPQNSPHSLTEEKAPIVMGHEFSGQVVEVGDGVTKCEEGDRVVVEPIFACGTCTACKQGKYNLCEQLGFLGLAGGGGGFSEYVTVDEHMVHKIPDTVSFEQGALVEPAAVALYAVRQSQFNVGDQAVVFGTGPIGLLVIEALKASGASKIYAVELSTERRQRAEQLGAIALNPAEVNVVEEIQRLTDGGADVSFEVTGVPIVLTQAIESTKLNGQTMIVSIFEKEASFQPNLVVMRERNIAGIIGYRDIFPAVISLMNQGYFSAETLVTKRIGLHDIVEQGFEALMKTNCNIKCDTTK

SEQ ID NO: 17480 - protein, 379 aa, Bacillus halodurans
MFVKMRFEELPTPCYVVDEALVEKNVKILNGIMKRTGAKIVLAQKAFSMSTMYPLIGKYLTGTTASGLYEARLGHEEMGKENHIFAPAYREDEIDEIVSICDHIIFNSFSQLEKFKQRALDAGSKVGLRINPECSTQVGHEIYDPCSPGSRFGVKQEDVRQELLDGVSGLHFHTLCQQNSDDLETTLDAVEEKFGQWLPQMEWINFGGGHHITRDDYDIPRLEACIKRMQDKYGLEVYLEPGEAIALNAGYLVTTVLDLHKNGIDIAILDTSATCHMPDVLEMPYRPPLFGSGEPGEKPFTYRLGGPTCLTGDVIGDYSFDQPLKSGDRLVFGDMAIYSMVKTNTFNGMPLPAIATKHQDGDCQVVRQFGYQDFKTRLA

SEQ ID NO: 17481 - protein, 257 aa, Bacillus halodurans
MSHTAISVKRLKKSFKNKDVLKGVDFAVQRGEIFALLGSNGAGKTTTVNILSTLLKPDEGEASICGFDVQRQPDHVRQSISLTGQFAALDGMLTGRENLMIIAKLRGVPNPSQVADHLLARFSLTDAANRRADQYSGGMKRRLDIAMSLIGKPAVIFLDEPTTGLDPEGRIEVWDAVKELAGGGTTILLTTQYLEEAEQLADRIAILHDGKIITTGTLAELKEMFPPAKVEYVEKQPTLEDIFLAIIGKKEEKVNEK

SEQ ID NO: 17482 - protein, 533 aa, Bacillus halodurans
MVLICTILFILASCESDKEFVSKDWEKSTTIKITSGFDHETRLFKDYSIEDEVFQSVDDIRRQIEIAELINYEYDKSLIYDSLNRLKDPALDNEFDVRENLIMYYLYQEVLEITDEDIDYVAVTNDIIKKKSNDEDEKYVDLDIVYIVVYYFSEQLKEDIKIKIIDWLETNWDTFEIDIGSTLSVLEISHILDKPLNIEFDREHYSKLLIDSTESTNDLLEVYYLVLINSFLENQIDKNAVRDTVLKFYSDVDGFSVSSDYYFDGNLGTFMGLKILKEVDYLELVKDEIYELFKYSEESYGGFVNKANIVSGSAIETIMAAYVLTEFNNDLDYDLSVLIEVSELSWFWSYQYIKIGKYSEKDLEQLKDDLKYFEHEVVNIKESDIEEILNISGLLNEIEYASKLAALIDYKFNEEYIDKMYTILAEANELSISEFTLDSFTQVVSMNEFFDFQLFSIEEVESYISKILKTKDELNFYDVYNILKVAKLYNFDEGEIEQLMQSYINENGGINTVPSVNSDTLHTTFLYIYIMSN

SEQ ID NO: 17483 - protein, 428 aa, Bacillus halodurans
MSSVVVVGTQWGDEGKGKITDYLSEKAEVVARYQGGNNAGHTIVFNGEKYKLHLIPSGIFYSDKVCVIGNGMVIDPKALVEELAYLHERNVDTSNLRISNRAHVILPYHLKLDIVEEERKGANKIGTTKKGIGPAYMDKAARIGIRIADLLDKEVFEEKLERNLVEKNRLFEKYYEVGGFNKEDILDEYYEYGQQIARYVCDTSVVLNDALDEGRRVLFEGAQGVMLDIDQGTYPFVTSSNPIAGGVTIGSGVGPSKIHHVVGVSKAYTTRVGDGPFPTELHDEIGDQIREVGNEYGTTTGRPRRVGWFDSVVVRHARRVSGITDLSLNSIDVLTGIKTLKICTAYKYRGEVVEEFPASLKVLAECEPVYEELPGWDEDITGVTSLDELPVNARHYIERVSQLTGIPLTIFSVGPDRKQTNLVRGVFA

SEQ ID NO: 17484 - protein, 707 aa, Bacillus halodurans
MADQATVEVKKTTYRVQGFSCANCANTFEKNVKDLHGVVEAQVNFGASKLTVYGDATVEDLERAGAFEHLKVRPENEKAIETKEPFWKAYGHVIVSALLLLVGVVSYFMKGERHLWTVSLFASSIVIGGYSLFKAGFYNLIRLRFDMKTLMTVAVIGAALIGEWLEGAVVVILFAISEALERFSMDRARQSIRSLVDMAPKEALVRRNGEELVIPVEAIEVGDIMLIKPGQKLAMDGIVRSGRSSMNEAAITGESVPVEKMVGDDVFAGTLNEEGFLEVEVTKRVEDTTLAKIIHLVEEAQGERAPSQAFVDMFAKYYTPAIMVIAALVATVPPLFFAGSWETWIYQGLAVLVVGCPCALVISTPVSIVTAIGNAARHGILVKGGIYLEEAARLRAVAFDKTGTLTKGKPAVTDYQVYDADTDGRELLAAVAALEYRSQHPLAAAVMKKADDEQLSYTDMEVSEFSSITGKGIAGTVNGIAINVGKPALFGELPPAIEADVARLQAAGKTIMLIGAEQKVLALLAVADEVREVSRTAVERLHALGITKTVMLTGDNRMTARAIGKQVGVAEVEAELLPEDKLGFVKGLKEEHGRVAMVGDGVNDAPALAASSVGVAMGGAGTDTALETADVALMGDDLRKLPFLIRLSRKALLIIKENIAFSLGIKLVALFLVAPGWLTLWIAILADMGATLLVTLNGLRLLRMKDE

SEQ ID NO: 17485 - protein, 319 aa, Xylella fastidiosa
MSGATASFLSIQTAMSDFDRVRDYLTALQDRICNVVETIDGQSHFHEDHWQRTEGGGGRTRLLRDGAVFEQAGIGFSDVCGTHLPPSASVRRPELAGANWRACGVSLVFHPKNPFVPTTHLNVRYFRAERDGKQVAAWFGGGFDLTPFYPFDEDVVHWHTVARDLCAPFGDERYAAHKRWCDEYFVLRHRNETRGVGGLFFDDLDKDFERDFAYQRAVGDGFLDAYFPIVTRRHDTPYGDRERAFQLYRRGRYVEFNLLFDRGTLFGLQSGGRAESILISLPPLVRWEYGYHPLPGSAEARLADYLLPRDWLNESRICE

SEQ ID NO: 17486 - protein, 380 aa, Xylella fastidiosa
MSPPLGLCLNVLRLHPMPPFTDDLRIRKIEPLTPPNQLLLQLPCDEQASLTVATSRNALHDILHGHNDRLAVVIGPCSIHDPIAAIDYAQRLHPLREMYKDALEIVMRVYFQKPRTTIGWKGLVNDPDLDGSFQINKGLHIARNLLRDINHLGLPAGVEFLDTISPQYLADLVAWGAIGARTTESQIHREMASGLSCPIGFKNSTSGDVKIAADAIKAASHPHHFLSVTKTGVAAVVATQGNPDCHVILRGGRVPNYDAINVEAASQTLLKSKLPVRLMIDASHANSGKNPNNQPKVIENIVEQLEAGERRIVGVMIESHIVGGRQELVLGNTLTYGQSITDACIDWDTSVAMLEQLAQAVRVRQTLPTTATTNKTSKTQ

SEQ ID NO: 17487 - protein, 400 aa, Xylella fastidiosa
MPLFTDVELVPGDPILSLNDTYNADTRTNKVNLGIGIYCDESGCIPLLRAVQQVEEQLAKHPKPRGYLPIDGLPAYIKATQQLLFGVDSPLLTAGRVATSQTIGGSGALRVTAEVLKQVLPHATVAISRPSWENHRALFTAAGFKIEDYTYFDTLGHAVDFTGMVADLAKLQPKTVVLLHGCCHNPTGADLSRDQWKQLVALFQERQLLPCIDLAYQGFNQGIDADAYAIRLLAEEGISNYVVANSYSKSFSLYGERVGGLSIVASNTEQAQAIQSQVKRIIRTIYSSPSAHGAYLVAGVLNSHELRTLWEQELTQMRERIHGLRAGLVARLTALGAPEFDFIQRQAGMFSYSGLSKIQVDRLRDEFGIYAVSSGRICVAALSQHKLEYVAQAVVKVHQG

SEQ ID NO: 17488 - protein, 155 aa, Xylella fastidiosa
MPLDSNSMAHLLLLHGPNLNLLGTREPEIYGRITLPQIDAALAERATAAGHGLSSLQSNAEHVLIERIHATPEDGTAFILINPGAFTHTSVALRDALLAVALPFVEIHLSNPYTREPFRHHSYLADKALGVVCGFGVDSYRIALEGVIARLGSDV

SEQ ID NO: 17489 - protein, 469 aa, Xylella fastidiosa
MAVALRTPYFGTFLMLDKVVIANRGEIALRILRACHTLGIRTVAVHSTVDRNLKHVAMADESVCIGSAPSAESYLNIPALIAAAEVTDAQAIHPGYGFLSENASFAERVEQSGFIFIGPRAETIRLMGDKVQAIHAMKAAGVPCVPGSDGPLGDDIVANVKIAREIGYPVIIKAAGGGGGRGMRVVHTEVGLKAAIETTQSEAKAAFGNGQVYMEKFLENPRHVEIQVLADGQGNAIHLGERDCSMQRRHQKVVEEAPAPGITEALRNEIGQVCVDACIRIGYRGAGTFEFLFENGRFYFIEMNTRIQVEHPVTERITGIDLVCEQLRIAAGQPLSIKQSDVVLRGHAIECRINAEDAETFLPNPGLITAFHPPGGPGVRMDTHIYSGYKVPPNYDSMIGKLIVHGPDRETAIARMHLALSEMVVDGIKTNIPLQQRIMCDKGFQFGGQNIHYLEKCLAERKNQTIGRT

SEQ ID NO: 17490 - protein, 728 aa, Xylella fastidiosa
MNVSHVLDHLNQNQREAVAAAPGHYLILAGAGSGKTRVLTHRIVWLNEVHGVPTHSMMAVTFTNKAAGEIQQRIDLQLRHGKRGMWIGTFHSLAHRLLRLHWNDATLPENFQVIDSDDQLRLVKRVIQSLGLNDTLFPPKQAMWWINTQKDEGRRPEHIQPESHDDWIETQRRIYAEYQERCNRAGLVDFAELLLRAHELLRDTPALLTHYRSRFREILIDEFQDTNAIQYAFVRILANETGHVIAVGDDDQAIYGWRGAKVEHVQHFLKDFPNVQTIRLEQNYRSSANILDAANAIIAHNPDRIGKRLWTESGVGESIDLYAAYNEIDEARYIVERACQWVRDGGSYGEIAVLYRSNAQSRAFEEVLQSEHIPYRVYGGMRFFERAEIKDALAYLRLLANRSDDAAFERVVNTPVRGIGERTLDEVRHLARTQGLALWDAAMACTQSTTLTARARNALASFLNLLQQLAVETSQMGLAERIDHMLLRSELREHWKKEARGSLDAESRQENLDELVSVASRFVLPQNDEDTPIMTELDAFLSYTCLESGDGQVQAGEEGVQLMTLHSAKGLEFPLVFLVGLENGLFPSARSLDEHGRLEEERRLAYVGITRARHKLILSYAEARRIHGKDNYNIPSRFLREIPRDLLHEVRPTIQVSRQTPLGAVQRPAHDERDAAPIKLGVNVMHPTFGCGVVVDYEGSGAHTRVQIKFDDVGTKWLVMAYAKLSVV

SEQ ID NO: 17491 - protein, 645 aa, Xylella fastidiosa
MRMNDLTKNVLLWVVVAVVLMVVFQSFSPRIGGVIGNEPITYTQFLNEVDSGRIKSVNYTDESGLTVNAIRFKRTDGSEGLVYGPRDDKLVDVLYSKNIEMTRQKPSTGPGFWSLVLNFLPVILIIGFWVFIMRQMQGGGAKGAMSFGKSRAKLQGDDQIKITFADVAGCDEAKEEVGELVDFLRDPTKFTKLGGKIPRGVLMVGPPGTGKTLLAKAIAGEAKVPFFSISGSDFVEMFVGVGASRVRDMFEQAKKHAPCIIFIDEIDAVGRHRGAGLGGGHDEREQTLNQLLVEMDGFEGGEGVIVIAATNRPDVLDPALLRPGRFDRQVVVALPDVKGREQILGVHMRKLLLANDVEPLVIARGTPGFSGADLANLCNEAALFAARSNEKEVRMNHFDAARDKILMGTERRSMAMSEEEKTLTAYHEAGHAIVGRLVPEHDPVYKVTIIPRGRALGVTMYLPEGDKYSINKVAIQSQLCSLYGGRVAEELIFGEDKVTTGASNDIERVTKMARNMVTKWGLSDELGPVAYGEEEDEVFLGRSVTQHKNVSDETARKIDEVVRSILDKAYARTKRILADNLDKLHAMSQLLLQYETIDAPQIDAIMEGREPPPPVGWGKPSDNGSDDDMSKPRPLTTIVVPAEQV

SEQ ID NO: 17492 - protein, 674 aa, Xylella fastidiosa
MSNPLLDFSDLPRFDAILPEHVGPAIEQLLAEAEAAVAHAEQVTPVTWENCVVPLDDATERLYRAWGQVAHLEAVVNTPALREAYNVTLPKVTRFSSTLGQNLALYAQYKALACAPEWDRDNAVRCKVVDNALRDFRLGGAELDAAGKARLAEIKQELSALSATFSQNVLDATEAWSYTTEDAAVLSGLPAETVATARATAEKKGVPGWTFTLQMPCYLSVQSDADDRTLRERSYHASAIRASEFGDAALDNSPHIHQILTLRSELAALLGFSCYAAYSVATKMAEDPAEVLSFLHDLAGRAKPHAQHDRRELETFAREALGLETLEAWDIAYASEKLKQARYSFSEQEVKQYFTEPKVLTGLFEVIHSLYGLRIEEDAAPVWHPDVRFYRLIDTNGQRVGQFYLDLYAREGKRGGAWMDDCRNRRDKGDEVQTPVVYLVCNFGRGSDGVLPTLRHQEVITLFHEMGHGLHQLLTRIGELGVAGINGVEWDAVELPSQFMENFCWEWERVQAMTAHVETGAPLPRSLFDRMVYARNFQSGMFTVRQLEFALFDMLLHSDFDPAQDSVLGLLERVRDEVAVNRLPDWNRFPHQFRHIFAGGYAAGYYSYKWAEVLSADAYAAFEEAPDQFAEIGARFLDEILSRGGSRSAAENFQAFRKRAPRIDALLKRNGMTE

SEQ ID NO: 17493 - protein, 609 aa, Xylella fastidiosa
MCGIVGAIAGRDVVPVLIEGLKRLEYRGYDSSGIAVLESGSIRRVRRTGRVAEMAVAATQEGFTASLGIGHTRWATHGGVTEANAHPHVSHGVVLVHNGIIENHEVQRERLSALGYVFQSQTDTEVIAHLIHYHMQQGDDLLGALQCAVKALTGIYALAVMSEAEPERFVCARMGCPLLIGIGDGEHLVASDISAVIQATRQVIFLEDGDTAEIRRDGISIFNAEQCPVERPLHLSNVSLSSLELGEFRHFMQKEIHEQPRVLADTMEAAIDAAGFPPMLFGAQAESVFRGITGIQILACGTSYYAGLTARYWIEAIAGLPCHVEIASEYRYRKAYVNPQHLVVTISQSGETLDTLEALKYAKALGHRHTLSICNAPDSAIPRISELICYTRAGPEIGVASTKAFTTQLVVLFQLAVALGVLRGAVDAEHEAAYLEQLRQLPCGVQQALNLEPQIAAWAECFASRHHALFLGRGLHYPIALEGALKLKEISYIHAEAYPAGELKHGPLALVDADMPVVVIAPNDSLLEKVKSNMQEVRARGGELFVFADQDSHFSESEGLHVIRTLRHTGVLSPLVHTIPVQLLAYHTALVRGTDVDKPRNLAKSVTVE

SEQ ID NO: 17494 - protein, 628 aa, Xylella fastidiosa
MTWSQDLAHKTYSILHWADGYFEVNDAGQMVVMPVGRDGVRISLPEVVDAARAAGAKLPLLLRFPDILGHRLGKLQAAFAQAQSEWEYAGGYTAVYPIKVNQHRGVAGVLASHQGDGFGLEAGSKPELMAVLALSRPGGLIVCNGYKDREYIRLALIGRKLGLKTFIVIEKPSELRMVLEEAKTLGVLPGLGVRVRLASLGAGKWQNSGGDKAKFGLSPRQVLDVWKVLRGTEYADCLNVMHFHMGSQISNVRDIAKGMREATRYFVELSRLGAKITHVDVGGGLGIDYEGTRSRSDCSINYGLQAYASHIVQPLASACEDYDLVPPRIVTECGRAMTAHHAVLIANVTEVEAVPEGRVPGVCDDEPAVVRHMREIYGELDARPAIELFYEAQHFHAEGLAAYTLGQIDLVHRARIDDLFYAISHGVRERLSHEEKSHRPVLDELNERLVDKYFVNFSVFESIPDVWAINQIFPIVPIERLNEAPTRRGVVCDLTCDSDGTVKQYVENESLDSALPLHVLRHGEAYRIGFFLVGAYQEILGDIHNLFGDTDAVEVAVDGRGYRIAQQRCGDTTDVMLDYVGYALDEVRRVYAQRITAAGMSAAESKALSDMLEAGLTGYPYLSDVPLE

SEQ ID NO: 17495 - protein, 251 aa, Xylella fastidiosa
MTKTILITGATSGFGRAAVHRFANAGWRVIATGRRIERLEALAAEWPPGHIHITAFDMRDSATLHTAIQTLPADFADIDVLVNNAGLALGTAPAQHTDLAQWREMIDTNITSLVTLTHHLLPTLIERKGMIINISSVAATYPYTGGNVYAGTKAFVKQFSLGLRSDLHGTGVRVTSIEPGMAETEFTLVRTGGNQTASDALYRGANPITAEDIAEQIFYIATLPPHLNINRLEIMSVNQSFAGFQVARQPQ

SEQ ID NO: 17496 - protein, 467 aa, Xylella fastidiosa
MEAVVQPSLFHEDDIHGVVPGELNPGVAKLIGQAIGSAIQVKGLSDIVIGRDDRVSSFELSAALSDGLRHAGCNVVDIGLVPIPVVYFAACHLGVGSCVAVTGGHHPHDYNGFKIVLGGESLSSEAMSDLYQCITNGRLYASVDSGNLSERDVVDDYIQRIADDVQLNRPLKIVADPGHGAAEEILSRLFKAIGADLVSLYGDIDGVSLHGHPDSDELGNLQKLIQRVEQADADLGLAFDGDAASLRVVTREGEVILSDSVLMLFATDVLQRNPGALVIYDAECTSKLSDCVLRNGGSPLMWKTGHASIKAKMRETGAELAGEMSGYFFFKERWYGFEDALYAAARLLEILAQREDNPSQVFAALPHAYFTAQMEQSVEGDAQACVQSFIEEVQRSVEGSVFDGARLFAFDGLRADFTDGWGLVRVSDTASALVLRFEADTQAGLERIQSAFRTHLQALLPGQILVF

SEQ ID NO: 17497 - protein, 266 aa, Xylella fastidiosa
MRISSFNANGLRSALSKGFFDWFSTQDIDVLCVQETKAQRQQLVGPDFFPAGYHVCFRDATTKKGYSGVAIYSRCEPDELRTTLGWAEFDEEGRYVEARFGNLSVVSFYIPSGSSGEQRQHYKFEVMRWLRPILCEWLLSGRDYVLCGDWNIVRSALDIRNWKSNQKNSGCLPLERDWLNGLCADSLHEVNAAQGRGWVDTYRVLYPQGEDYTWWSNRGAARVNNVGWRIDYQFVSPGLRERVSRCAIYREQRFSDHAPYTVEYVL

SEQ ID NO: 17498 - protein, 251 aa, Xylella fastidiosa
MEHVSMITDNSPRFRALVTGGSGHLGTAICRQLIADGAHVIVHANHHRSRADTLVECLCAEGGSAEVIVFDVTAAQASKTALENLLQTGPIQIIINNAGIHDDAPMAGMSSTQWHRVIDVSLHGFFNVTQPLLLPMARTRWGRIVCISSVTAVLGNRGQSNYAAAKAGLHGAARSLAREMANRGITVNVVAPGVIESEMVGKTFTPEMIKQLVPTGRPGRPEEVAALIGFLCSEKAGYINGQVIGINGGMG

SEQ ID NO: 17499 - protein, 144 aa, Xylella fastidiosa
MVKLSPPSRCTSSMSDIPGDLKFLKSHEWVRIEDNNRAIVGISDHAQNLLGDLVYVELPNIGDHLDAGTTAAVIESVKAASDIYSPVTGKVIEVNTTLSDKPETINEDPYGEGWIMVIEMQAPEEISDLLSPDDYTKVLESDEH

SEQ ID NO: 17500 - protein, 486 aa, Xylella fastidiosa
MMHHNVHQSEILADPCDLQRAERWLQRDLRVLWHPCTQMREHPDTLPLVPIVRGEGAWLVGHDGRRYLDAVSSWWTNLFGHADPRISAAIAAQARTLEQVMLAGFSHEPAVRLAEALLRLAPRQDGREPLSKVFYADNGSAGVEVALKMAFHYFRNRGEEQRTRFIALHNGYHGETIGALAVGDIPLYRRVYAPLLTEVLFAPSPDAYLAEPGQSAAEYALQAAEALEVLFKRYSGQICALILEPLLQCAGGMRMHHPVYLHRVRELCDAHGALLICDEIATGFGRTGTLFACEQACPVILTDTDDKQLGIMPDLLCLSKGLTGGFLPLAAVLTTQQLYEEFLDDSRERAFLHSHSYTGNPLACIAALTTLDIFENDCIIERNQVTAARMTQLAASLSGHPHVADVRQAGMVVAFELTRDGNKRTPFPLQARLGLHVYRAALARGVILRPLGDVVYWMPPYCVDEEQLHLLAETTRVAIDEAIACV

SEQ ID NO: 17501 - protein, 446 aa, Xylella fastidiosa
MNFETLGLLPSLLRALSEQGYEIPTPIQQQAIPLALAGHDLLAAAQTGTGKTAAFGLPVLQRLMAASSNVGAGKPRALVLTPTRELATQVYDSLRGYAKYQRVSSAVIYGGVGMGNQLDVLRRGVDLLIACPGRLIDHIERRSVDLSGVGILVLDEADRMLDMGFLPSIKRILGKLPRQNRQTLLFSATFAEPIKQLALEFMCRPREVMVASHNTVAETITHRVHPVDVSRKRELLLHLLAQDSREQTLVFVRTKHGSDKLATFLEKYGIKTAAIHGNKTQGQRLRALNSFKAGRVTVLVATDIAARGIDIDQLPKVINYDLPMVAEDYVHRIGRTGRNGVQGEAISLVTQEDAKLLRQIVRLLDRDMDIRDVPDFEPQVPIRWGNSAPGKSKQPAGQHPPRKSQHRRAFGKASVQTAHALTKQSGVQHSNGSRNRDGMFPVHQRG

SEQ ID NO: 17502 - protein, 502 aa, Xylella fastidiosa
MHNGFDALQLHANRLRGVTIPDLLAAELKRPEQYARQVGPLYFNFARQKYDCVALEALFALARNHNVAGAFQRMFCGEQVNVTEGRAVLHTALRGDLSGTSVAVAAYTAAAKVRERMYALIAGLDASEVTDIISVGIGGSDLGPRLVVDALRPISQGRFRVHFVSNVDGAAMRRTLDMLDPSRTAGILISKTFGTQETLLNGRILYDWLGGSERLYAVSANPERAAHAFDIVPTQVLPIWDWVGGRYSLWSAVGFPIALAIGSQRFEELLAGAAEFDAYALRVPLEENVAVLHGLTAVWNRNFLGCATYAVMAYDQRLALLPAYLQQLVMESLGKRVKCDGTPVDRDTVPVWWGGVGTDVQHSFFQALHQGTNIVPADFIGTIRNDDPYTENHFALNANLLAQIEVLANGQLSDDPHRVYPGGNPSTLILLDALTPQALGGLIAMYEHSVYVQSVIWGINAFDQFGVELGKHLAVQLLPALKGESVEVVDPVTRAVLVRLRG

SEQ ID NO: 17503 - protein, 892 aa, Xylella fastidiosa
MSQQTTIRKLAELVNTPVEKLLEQLAGAGMKFSGPDQVVTSTEKMKLLGFLRRTHGKSDVSVGAVREAPKKITLNRRRLQEVTVNAGRNKTTVNVEVRQKRTYVKTPESEYHTPTKPPIELGDAERVEILRKLEESRQRNLAEQQRLAEVDRQRVEEQERKRLEEEQAELERQKTESPVVEEVPVQSDSNSVKPVSKPISEDRTRALPRAVRPAPAARPSVSRSDDRNSNSGVRHKPRGSHVIVSDEDDSARRFAGQMHLTAAERARRGSNTRGKGGGSHRGATHRGNENSIRSSGAHGFERPTAAVVREVAVGDTITVADLAQKLALKSGDMVKALFKMGVMVTITQTIDHDTAVLVSEELGHKVTRASSSDFEDALLAHTEEVHGEPVPRPPVVTIMGHVDHGKTSLLDYIRRTKIAVGEAGGITQHIGAYHVETPRGVISFLDTPGHAAFTSMRARGAKITDIVVLVVAADDGVMPQTKEAVQHARAAGVPLIVAVSKIDKSTADPQRVKNELLTESVVAEEFGGDTQFVELSAKTGVGVDALLDAISIQAEVLELKAVIEGRATGTVIESSLDKGRGPVATVLVQQGRLKKGDYLVCGTHYGRVRALFDEVGHQPLAASPSIPVQVLGLSGVPDAGDDFVVVDDERLAKDVAQQREAKRRESRLVTSAGNRMEDILAQMGKGENQQVLNLLIKADVQGSLEALKQALVALSNDDIRINVIHVGVGGITESDANSAVTSKATVIGFNVRADASARKIIEANGVDLRYFSIIYDVIDQVKQVASGLLGVEIREEIIGVAEVRDVFRSSKFGAVAGCMIIEGVVKRSKPIRVLRDNTVVFEGELESLRRFKENVDEVRNSTECGIGVKAYNDVRVGDHIECFERIEVARTL

SEQ ID NO: 17504 - protein, 614 aa, Xylella fastidiosa
MLSGVLMSNPSSTPLLFADLGLSDAVMQAVTKIGYETPSPIQAATIPALLAGRDVLGQAQTGTGKTAAFALPLLTRTVLNQVKPQVLVLAPTRELAIQVAEAFQRYAASISGFRVLPVYGGQSYGQQLAALKRGVHVIVGTPGRVIDHLERGTLDLSELKTLVLDEADEMLRMGFIEDVEEVLRKLPASRQVALFSATMPPQIRRIAQTYLQDPIEVTIATKTTTAANIRQRYWWVSGLHKLDALTRILEVETFDAMIIFVRTKAATEELAEKLQARGLTAAAINGDMQQAQRERTIHQLKDGKLDILVATDVAARGLDVERISHVLNYDIPYDVESYVHRIGRTGRAGRSGEAILFVTPREKGMLRQIERATHQPIEAMQLPSVDAVNDTRVAKFFGRISNALVVGAEIDFYRKLLQRFESEHNVPAIEIAAALARLLQGDSPFLLSVPTRAQRERSEPPSEHVKRSSSFKQTERPNHTEHPKRPQRNAPARNTPEFGMESYRIEVGRIHGVKPANIVGAIANEAGLESRYIGRIDIRDDHSVLDLPAEMPHEILQHLKKVWVSGQQLQMRRIDTTETTATAREFKSKPGGAGKFPPKPHHNKSTKPKPPYSG

SEQ ID NO: 17505 - protein, 353 aa, Xylella fastidiosa
MGLATWLVTGGAGFIGGNFVLQAISLGHRVINLDALTYAGHLETLALLDGCAEHLFVRGDIGDRALVSCLLDTHRPDAVLNFAAESHVDRSIDAPAAFIQTNVVGTLLLLEAVCGYWKALPEAARAAFRFLHVSTDEVYGSLGETGAFTERTAYAPNSPYSASKAASDHLVRAFHHTYGLPVLTTHCSNNYGPYHFPEKLIPLVITKALAGEPLPVYGDGRHVRDWLFVGDHCTALCAVLAGGRVGETYNIGGQAERENLEVVRMICRLLDERRPRADGQSYQSQIVHVADRPGHDRRYAIDTSKLVSELGWAPVYRFEQGLALTVDWYLQHQDWVRAVLQGRDRVEGLLIAV

SEQ ID NO: 17506 - protein, 500 aa, Xylella fastidiosa
MSTPTSNPFSRLPLSLHTHKYCALRDSQQPVATPKQASSSYTSPSFSQELLMSLPAFKAYDIRGRVPDELNEDLARRIGVALATQLDRAAPVVLGHDVRLTSPSLQEALSAGLRASGREVINIGLCGTEEVYFQTQYRNAAGGVMVTASHNPMDYNGMKLVREQARPISSDTGLFTIRDAVAADIATITPPTAAEHQYLDKSAYITHLLSYVDSNALKPLKLVVNAGNGSAGLIVDLLAPHLPFEFVRVFHEPDGHFPNGIPNPLLPENRDATAQAVKHHGADLGIAWDGDFDRCFFFDHTGRFIEGYYLVGLLASVILSKHPGGKIVHDPRLIWNTVEMVEAAGGIPVLSKSGHAFIKEKMRKENAVYGGEMSAHHYFREFSYADSGMIPWLLIAELISRSGRSLADLVENRMQQFPCSGEINFKITDTNTATARIMDHYTAQSPTIDHTDGISADFGDWRFNLRSSNTEPLLRLNVETRNNAALLKQRTDEISALLRA

SEQ ID NO: 17507 - protein, 569 aa, Xylella fastidiosa
MSQTRPWLQHYPSGISTEIDTDAFRTIADVFDTSVIKYRHCPAYTNFGKTLTYGEVDLLTKQFASYLLNVLKLKKGDRIALMMLNCLQYPVATFGALCAGLTVVNVNPLYTARELKHQLVDAGSTVLVVMDNFCTTVQQIIADTPIKQVITTELGDLLDFPKRSLINFAVKHIKKLVPEYQLPRSIRFREALALGSKHSMPPIHIASDDLAFLQYTGGTTGTPKGAMLTHRNMVANMQQVSQWLQTSNSLKEGCETVLTALPLYHIFALTANSLVFMKIGGCNHLISNPRNMRTFVKELQRVRFTVITGVNTLFNKLLNTPGFDKLDFSSLKIALGGGMVIQRSVAEQWKQVTHVPLIEAYGLTEASPEACINPLNLQEHNGSIGMPIPSTDVCIKDDTNTALPIGEMGELCIKGPQVMKGYWQRPEETSEVLDADGWLHTGDIVKMDKQGFLYIIDRKKEIILVSGFNVYPKEIEEVIAMIPGVAEVAAVGVPDEQSGEVVKVVIVKKDPMLTAEEVKAHAATNLTRYKLPRIIEFRATLPKTDVGKILRRELRDAAPASTTFTAQPK

SEQ ID NO: 17508 - protein, 908 aa, Xylella fastidiosa
MRDSFSTHRQLHVGNQSYHYYSLTKLGEHFDISHLPYSMKILLENLLRHEDGGVTVSTAHIEAVAKWNPKAEPDTEIAFMPARVVLQDFTGVPCVVDLAAMRDAAIRLGGTAEQINPHIPSELVIDHSVQVDVFGKPEALERNGNIEFQRNKERYGFLRWGQKAFNNFKVVPPNTGIVHQVNLEHLARVVMTTEKEGATWAYPDTVFGTDSHTTMINGIGVLGWGVGGIEAEAAMLGQPSSMLIPQVVGFKLTGTLPEGATATDLVLTVTQMLRKHGVVGKFVEFYGDGLAHLPLADRATIGNMAPEYGATCGIFPIDTESLNYLRLSGRSESQIALVQAYAKAQGLWYAPNTPPPSYSTTLELNMDDIKPSLAGPKRPQDRVLLQDVQNNYREHVRALTAHRTTKANDHDTPPIKGQVDLDINGQTLQLKDGAVVIAAITSCTNTSNPAVMFGAGLLARNAVAKGLQRQPWVKTSLGPGSRVVTDYLEKAGLLNDLETLGFYVVGYGCTTCIGNSGPLPPEVSAGIAKGDLVAAAVLSGNRNFEGRIHPEVKMNYLASPALVVAYAIAGTVNSDLTSEPLGNGNDGQPVYLRDIWPSNKQIGDAIAATIGPEMFQQNYADVFKGDTRWNTIASPNGALYAWDTHSTYIKNPPYFDGMTMQTEPVKDVRGARVLGLFADSITTDHISPAGNIKQDSPAGRFLQAHGVQPADFNSYGSRRGHDDVMVRGTFANIRLKNLMLNGEEGGNTWYRPKAGGPPEKMSIYDAAMKYNTDGVPLVVIAGKEYGTGSSRDWAAKGTKLLGIKAVIAESFERIHRSNLVGMGVLPLQFLDGQNAQTLGLDGSEMFDVTGLEGTISKHATVSAKQSDGSIKQFQVKVLLLTPKEVDYFTHGGLLQYVLRHLINTGKPA

SEQ ID NO: 17509 - protein, 249 aa, Xylella fastidiosa
MRPKIVAGNWKLHGSHAFAQALVAQVAAGLPLLGVSVIILPPLLYLSDLAQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLALVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 17510 - protein, 744 aa, Xylella fastidiosa
MSNQSVNPEVRPDRVTIEIDGQNLVVPKGSMIIQAADNAGIPIPRFCYHEKLPIAANCRMCLVDVEKVPKPLPACATPVMEGMKVRTRSEKALQYQRSVMEFLLINHPLDCPICDQGGECELQDVSMGYGRSVSRFHERKRVVPDEDIGPLVATEMTRCIQCTRCVRFTADIAGTYELGGMYRGENLQIGTYDGKPLITELSGNVVDVCPVGALTNKVFQFRARPWELMAYQSLGYHDAMGSNLFLHVRQGEVLRTVPRDNEYVNECWLSDRDRYSHQGLYAADRAVKPLKKVGDQWLEVSWAEGVSAAAEILSAHRGDALGVLVHPATSNEEGALLARLAAGLGTGNLDHRIFNRDFSDVAVAEPFALPLAEIGNADLVVLFGSNIRQELPLLHARLRKAVTCNGAKVYAVNPVDFDFTFSLTGKSIVPPSQLANALTDAALLNAAKAAARVVIVVGALAENHPQGATLRAAARQFAEVTGAALCRIPQGANAIGLTQHGVLPTGRDAAAMLVESCQAYVLYGIEPGLDFADTATARQALHGAKVVAFSHFACASTRDVADVILPIGLLPEIDGTLTNLDGRTQAAKPGGKLPLEAREGWRVLRALGGELGLSGFGFLDLVGLRAQLRSHPVVPSTSAQPIATQEGLEVAATPAIYRTDAVVRRAAALQAHPLNVAPALALHPEQAKQLQVVAGQIVKVGTAAGKATLPVVLDTRVALGTVWIETGHGVTVPIGAGRVTMVAV

SEQ ID NO: 17511 - protein, 246 aa, Xylella fastidiosa
MTLRIAYVTSGMGSIGTAICQKLARNGHTVVAGCGPNSPRKANWLREQRELGFDFIASEGNAADWDSTVSAFAKVKAEVGEIDVLVNNAGNNRDMLFRQMGREDWNSVISSNLNSLFNITKQVIDAMTARNWGRIVNIGSVSAHKGQIGQVNYATAKAAMHGFTRALAQEVATRNVTVNTISPGYIASAAISSFPPDVLDRLANSVPMRRLGKAEEVAGLCAWLVSDEAAYVTGADYAVNGGLRME

SEQ ID NO: 17512 - protein, 461 aa, Xylella fastidiosa
MDTQLPDALITTLSTLLGSEGWRIDAISRRQYSEDDSQCFACADAVALPRDLNEVVAIVRACRQHRVPVIPRGTGTGTVGGAVPLHGGIVLSLARMNRIVALLPDDRCAVVQPGVINNDLQQALAPHGLFWPPDPSSTAMCSIGGNLATNAGGPRTVKYGATRDNVLGVVAVTGVGDVIRCGGAYTKNATGYDLAHLLIGSEGTLAIIVEATLKLAPQPQAIAGLRAFYQDTTAAAAAVSRLMSQPAIPATLEFMDHKAIELLYRNDSNIPMAGAMLLIEGDGNHDTLPYILQALAQAASGEGLIDLDVAMDGAARDQLWVARKSLSPMLRTIKPGKLNEDVVVPVSRIPDLVAGIEVLAAESGLPIVTFGHAGNGNLHVNIMYDDQDAEDITRAQATLPKLFKLVLTLGGTLSGEHGIGVAKRDFMTQAFDTPTLAAMRAVKAAFDPDGILNPGKVLPTV

SEQ ID NO: 17513 - protein, 317 aa, Xylella fastidiosa
MHSVVVVGSFSIDHVWRCDTLPTPGATIAGRYSRGPGGKGFNQAVAACRVGARTYFICALGNDTDGNMARDIATKDGFTLIGESSTEPTGTGGIYVDSHGHNTIVTGAGANAVLSTHFITEQRALITSAWIILAQLESPIETLETALSMAREAGRLTILNAAPANATATINLLKLADVLTLNETEFVALLSRHVGERISPDNVATTDGNTLHALCNKLLSDSTVVITLGSAGVFVSHSEENLRGDTQPYYRVAAEQAHTVDTTGAGDAFNGALAASLARQPNTAFIQHIRLANSYAARSTETEGGAVSMPILTTTPD

SEQ ID NO: 17514 - protein, 861 aa, Xylella fastidiosa
MRMDKLTSRFQNALADAQSLAVGRDHTIIEPVHVFSALLDQQGGSTRPLLMQAGVNVPLLRERLTEILEALPKVSGQTVNVSPSNELSRLFHRTDKLAQQHGDQFMASEWFVLAVVDDSGGLGQALRAAGAEKKKIEAAIDKLRGGETVQTENAEEQRQALEKYTIDLTARAESGKLDPVIGRDEEIRRTIQVLQRRTKNNPVLIGEPGVGKTAIVEGLAQRIVNGEVPEGLRSKRLLSLDLGALIAGAKFRGEFEERLKGVLNDLAKNEGRVILFIDELHTMVGAGKADGAMDAGNMLKPALARGELHCIGATTLDEYRKYIEKDAALERRFQKVFVGEPTVEDTIAILRGLKEKYALHHGVEITDPAIVAAATLSNRYITDRQLPDKAIDLMDEAASRIRMEIDSKPEELDRLERRLIQLKIQREMLKKEKDEASKQRLADLERDIEVLDREFSDLEEVWRSEKAALQGATKIKESIEQAKLDLEAAQRRQDYAKMSEIQYGVLPALEKQLVAASQAEQHDFTLVQEKVTAEEIAEVVSRWTGIPVSKMLEGERDKLLRMEADLGRRVVGQEEAIKVVSDAVRRSRTGLSDPNRPSGSFLFLGPTGVGKTELCKALAEFLFDSQDAMVRIDMSEFMEKHSVARLIGAPPGYVGYEEGGYLTELVRRRPYSLILLDEVEKAHSDVFNILLQVLDDGRLTDGQGRTVDFRNTVIVMTSNLGSHQIQELSGDDSPEVYTQMKAAVMEVVQAHFRPEFINRLDDIVVFHPLDKAQIKQIARIQLQGLEKRLAESELKLDLDDRALELLGNVGFDPVYGARPLKRAIQSQLENPLAQQILAEAFVSGDTVQVGVDGGKLVFAKV

SEQ ID NO: 17515 - protein, 403 aa, Xylella fastidiosa
MSSYLFTSESVSEGHPDKVADQISDAVLDAILVQDPRARVACETMVKTGVAIIAGEITTSAWVDLEALTRKVIVDIGYNSSDVGFDGATCGVLNLIGKQSPDINQGVDRKKAEEQGAGDQGLMFGYATNETDSYMPAAIHISHRLVEQQAKIRKKSNSPLPWLRPDAKAQITLRYEDGVASAIDAVVLSTQHDPGIKQKDLVEAVREEILKPVLPSKWLHKGTKFHINPTGKFVIGGPVGDCGLTGRKIIVDTYGGSARHGGGAFSGKDPSKVDRSASYAVRYVAKNVVAAGLADRCEVQVSYAIGVAEPISISVTTFGTGKISDDKIEKLIRQHFDLRPYGIIKMLDLIHPIYQPSASYGHFGRKPRELAYTNSNGERVVATAFSWEKIDKAEVLRADAKLK

SEQ ID NO: 17516 - protein, 509 aa, Xylella fastidiosa
MKQISILVRLFITPYVSYPCGFLHSSRPVMSFLPSFLKRKSIDLITVHEEGRRLVPTLSWPHLIALGIGAIVGTGIYTLIGVGAEKAGPAILLSFVIAGVICACAALAYAEMATMMPVAGSTYTYSYVALGEGIAWIVGWSLILEYSLVVSTVAVGWSGYMSGFLKSVGVDMPLALTAGPYAGGIINLPAVVITCVVAGLLIVGTKESTTLNAVLVVVKIIALSVFVVIALPHFDMAHLKPFMPYGFTKSIDTGGVERGVMAAAAIIFFAFYGFDAISTAAEETKNPSRDLSIGIIGSMIGCTLIYVLVALAAIGAMHYTVFGPSTEPLALILRQLDQGNTARLIGAAAIIALPTVLLAFLYGQSRILFVMSRDGLLPRGLSTVNARTGTPIATTLFTAILVATAAGLVPLGEIAALANAGTLTAFIAVALCLLVLRVREPQRVRAFRTPLAWVVGPIAIAGCLYLFWSLPKMTQSLFLLWNALGLCVYLVYGRHTSLLSKAVSIDTPR

SEQ ID NO: 17517 - protein, 440 aa, Xylella fastidiosa
MPEKSEELPIMGQSVVVLGAQWGDEGKGKIVDLLTEEIGAVVRFQGGHNAGHTLVINGKKTVLHLIPSGILRNGVLCLIGNGVVISPAALRKEIEELEDTGLEIRSRLKISPAAPLIMEYHIALDQAREKAAGGRAIGTTGRGIGPAYEDKVGRRGIRVADLHYPDQLAEKLRDALDYHNFVLTRYFGVDGMDFQRIYDEMLVFAEYVEPMKSDVAGILHDLRKQGKRVLFEGAQGTLLDIDHGTYPYVTSSSTTVGGALSGAGVGVQDIDYVLGIAKAYATRVGGGPFPTELDDEIGQGIRDRGVEYGASTGRPRRCGWMDIVALKRAVAINGITGLCITKLDVLDGMDKLKICIAYEYHDKRSEYAPLDAQGWEECTPVYLEFPGWNESTHGITSWEKLPPAARAYLCALEELAGCPIGIVSTGPDREHTIMLHDPFA

SEQ ID NO: 17518 - protein, 334 aa, Xylella fastidiosa
MAIKVGINGFGRIGRNILRSAVQNFGSNIDIVAINDLLEPDYLAYMLQYDSVHGRFKGEIAIEGTALILNGKKIRLTAERDPGNLQWADAGAEIVIESTGLFLTQESAGKHLAAGAKKVIISAPSKDETPMFVYGVNHNSYNGEPIVSNASCTTNCLAPLAKVINDKWGITRGLMTTVHAATATQKTVDGPSNKDWRGGRGILENIIPSSTGAAKAVGKVIPSLNGKFTGMSFRVPTSDVSVVDLTVQLNTPATYKEICTEVKQQSEGPLRGILGYTEDKVVATDFRGETCTCVFDADAGIALDPTFIKLIAWYDNEWGYSNKCLEIAKVIAAK

SEQ ID NO: 17519 - protein, 141 aa, Xylella fastidiosa
MVLERTLSIIKPDAVAKNVIGDIYSRFEKAGLKVVAAKYKQLSRREAEGFYAVHRDRPFFNALVEFMISGPVMIQVLESENAVARHRELLGATNPKDAALGTIRADFAESIEANAAHGSDSVENAAIEVAYFFAATEIILR

SEQ ID NO: 17520 - protein, 337 aa, Xylella fastidiosa
MPICMRQVRSRSVTIARMNHTSDTALLIVNLGTPEAPTAAAVRRYLGEFLSDRRVVSIPPLFWKPLLHMVILPIRGPRSASKYAKVWLQEGSPLSVYTRRIAEGLTQHLPDWRVAWAMRYGAPALTKALDALQAQQVRRIVILPLYPQYSTTTTASVQDVVEAWCKRTPQVQVECIQDYAEDSAWVAAVAASIRRHWQAHGRSEKLMFSFHGLPQRVANNGDPYPQRCQVSASLIAAALDLNESEWVLGYQSRFGAERWLQPYAEPTLWALAESGIRRFDLVCPGFSVDCLETLEEVALGFSETLAARGATMRYIPCLNDDPAHVQALAGLAQRALL

SEQ ID NO: 17521 - protein, 700 aa, Xylella fastidiosa
MPHKYQWLPLSLAVAMTLASCNRNAPAPVAIPTPNPTPKTNTNDIDLSTLPPVIRFTASDLDPTGNPCTDLHTYVNGNWLKANPVPSDRTSWGAFQMLDERSNAIQRQLIEHAAADPQSSGIKKILSDLWNTGMDEAKIETQGIDPLKTDLAAIDAITNQDTLVNYLRSTAAKGQGELFTLSASPDFKDPTRNIAYISQSGLGLPDPEYYTKPANKDKLLAYKAHIAKVLELSGMAAADATQHAEKVIAFETRLAKVSKTQQQLARDTALQYNPVTPTQANKLTPHWSWTEAFKAQGVPLPDMFSLAIPAFHKEVDRMLADTDVAIWRAYLRFHTVDNASPYLSRPFVDEHFAFWNNTMRGQKEIKPRWKRVLNTINEQTGEALGQLYVKAAFPTESKVKMEALVAQLRTALKARIEKLDWMSPATKSKALAKWESFTAKIGYPDQWRSWDNLHTSRDSYLGNVLTAQQFNYTWNLSKIGKPVDKSEWEMPPQMVNAYYDPQKNEIVFPAAILQPPFFDPDAPLESNYGGIVAVIGHEMTHGYDDQGSRFGPTGKFEQWWTKADAKAFSTRTAKLVAQFNSYRTEDGKQVNGLLTLGENIADLGGLNTAYDAMKTATAGQADPKTDGMTREQRFFYNWATVWRAQYTPEEQAMRLKTDPHAPPHFRTIGPPSNMPSFAEAFNCKPGDAMVRRSDQQVVIW

SEQ ID NO: 17522 - protein, 346 aa, Xylella fastidiosa
MCNKSAVITGITGQDGAYLAQLLLEMGYVVYGTYRRSSSLNFWRINELGIAQHPKLHLVEYDLTDLSSSVRLLELAAPKEVYNLAAQSFVGVSFDQPLTTTDITGVGAVNLLEAIRIVNPKIRFYQASTSEMFGKVQQTPQIEETPFYPRSPYGIAKLYAHWMTVNYRESYGIFAASGILFNHESPLRARDFVTRKITHAIAMIKLGKLDVLKLGNLDAKRDWGFAKEYVDGMWRMLQADEPDTFVLATNRTETVRDFVSLAASAVDIQLEWKGQAERECGVDVASGKTLVTINPKFYRPAEVDLLIGNPAKARTKLGWEPKTTLEELCHMMMEADVRRSERDFPF

SEQ ID NO: 17523 - protein, 295 aa, Xylella fastidiosa
MTGSSGFTGRYMLDELLRHGYEVIALGKSLPETQDDSVRWLQADLCDLDALTRSVADVRPDVVIHLAALAFVAHGSANDFYHVNVIGMRNLLTALTHGDATPECVLLASSANVYGNASEGELDESTKPAPTNDYAVSKLSMEYAASLWRERLPLVVTRPFNYTGIGQADTFLIPKIVAHFCRRSQHIELGNLDVQRDFSDVRSVVQAYRRLIETINAVGKTINVCSGVAYSLRDVIDFCRDITGHAIAVQINPAFMRTNEVRILRGNHSLLRQLIGPWSSPPLRETLEWMLKTAV

SEQ ID NO: 17524 - protein, 547 aa, Xylella fastidiosa
MAAKEIIFSEKARSRMVHGVNLLANAVKATLGPKGRHVVLDKSFGSPIITKDGVSVAKEIELADKFENMGAQMLKEVASKTNDHAGDGTTTATVLAQALIREGCKAVAAGMNPMDLKRGIDKAVIAAVTELKKISKPTSDDKAIAQVATISANSDESIGNIIAEAMKKVGKEGVITIEEGTTLENELDVVEGMQFDRGYSSPYFINNQQSQIVELDNPYILLHDKKISSVRDLLTVLDAVAKESKPLLIVAEEVEGEALATLVVNNIRGIIKVCAVKAPGFGDRRKAMLEDMAVLTGGTVISEEVGLSLEKATTSHLGKAKKVRVSKENTTIIDGIGDNDAINGRVKQIKTQIEETTSDYDREKLQERVAKLAGGVAVIKVGAATEVEMKEKKARVDDALLATRAAVEEGVIPGGGVALIRAITAISNLKGANEDQTHGIQIALRAMEAPLREIVANAGEEPSVILNKVKEGKDNFGYNAATGEFGDMVNLGILDPTKVTRSALQNAASIAGLMITTEAMVAEAPKKDEPTPPAAGGGMGGMGGMDF

SEQ ID NO: 17525 - protein, 282 aa, Xylella fastidiosa
MPVSRFAVFGHPIAHSLSPRIHTEFGRQMGVALNYLAFDVAPDAFRVSLERFVAEGGCGANVTLPLKEAAFEVCTTLSARARRAGAVNTLSRVDGVWHGENTDGTGLVRNLTERHGLDLRGRRALLLGAGGAARGVAPALLDAGITEMVIVNRSPERADMLCDALGEPGRVSARYWGDLGDLGNFELIVNATSIGNTSDMRTFSLPRSLLDSMTAAVDLNYGSAAVPFLAWAHAVETRYVIDGLGMLVEQAAESFSLWHGRRPDTDPVYTVLHSEYGAPGRS

SEQ ID NO: 17526 - protein, 437 aa, Xylella fastidiosa
MKLISAWLGIPFWQRVVAGFVLGALVGWVMGPAAKTWFGPLGTLYVTLIKMIAIPLVFFAVINAIAALHGQRSVAMLGGRTFLWFIVTAALAVCVGLGVGTLLKPGNGDFTVSVDAAWAPPEVPSPVHVLLDVVPSNPFYALTGIGTRSNSTGETTLAAGRGSILPVIFFAALLGLAIVKLGERVTEVRKLIGQMSEIMIQITRFVLEMTPLGTFGLIATLVGSYGFQKLLPFGHFVLALYLACAFHIVVVYSGLLLAHGLSPLKFFRGVAPGMQVAFVSSSSFAAMPVALRAITHNLGVNKDYAAFAVPLGSSIKMDGCGAIFPALCAVFIAQYTGVPLTANQYFVIFIASVLGSFGTAGVPGTAVVMATVVLSAAHLPLEVIGYLYAIDRVLDMMRTMTNVTGQMLVPVLVAKETGLLNTAVYEAASSNVGIGTS

SEQ ID NO: 17527 - protein, 291 aa, Xylella fastidiosa
MSEALFTRWRQRTDSYLERTLSIPTQAPQRLHAAMRYTVLSRGKRIRPLLVYAAGHLFHVDEPLLDVPAAAVELIHAYSLVHDDLPAMDDDLLRRGRPTVHIAFDEATAILTGDALQTLAFECLADAPSDTSLRIAWLQTLTHAAGVAGMCGGQAIDIDATGQSQTLKALEAMHALKSGTLMRAAVRMGALAGDPSAEDLHSLDTFAATLGLAFQVRDDILDIESSSEQLGKTAGKDAIQQKSTFPALLSVEGAKCYLQELAERLYTQLHPYGERAAPLTALARLAVERAH

SEQ ID NO: 17528 - protein, 317 aa, Xylella fastidiosa
MMPVTESAFAFVFPGQGSQSLGMLSEFAVLYPEILDTFAEASEGAGVDLWTLSQRGPEEMLSRTEYTQPALLAAGVALWRLWQARGGRAPDLLVGHSLGEYSALVAAGALSLKDGAYLVRLRGQLMQDAVPVGVGAMAAVLGAEDALVVEVCAQVAGSEIVVPANFNSPGQVVIGGHAAAVDRALVLLAERGVSKTVKLVVSVPSHTPLMRDAAHRLAEAMLGLVWKVPRIPVVQNVDGRVHDGVEAICEALVKQLYLPVQWTDCVRELVTCGVVRIAECGPGKVLMGLIRRIDKTLDVRSLATPTGFSDVLDEWGF

SEQ ID NO: 17529 - protein, 247 aa, Xylella fastidiosa
MNKPLQGEVALVTGASRGIGAAVADLLADHGATVIGTATSVSGAQLIGDRLALLAGHGRALDVNDTAAVGALVGEIAEQFGSVSILVNNAGITRDNLLMRMKDEDWESIVDTNLSSIFRTSRAVVRDMMKARKGRIINIASVVGVTGNAGQANYAAAKAGVIGFTKSLAKEVGPRGITVNVVAPGFIDTDMTRVLSEGVRNDILNRVPLGHLGDPVDIAHAVAFLAAPAARYITGETLHVNGGMYMP

SEQ ID NO: 17530 - protein, 85 aa, Xylella fastidiosa
MRSDKPMSDIEARVRKIVAEKLNVDEEKVTNTSTFVDELGADSLDTVELVMALEDEFQCEIGDEAAEKMTSVQHAIDYIKSNAKC

SEQ ID NO: 17531 - protein, 411 aa, Xylella fastidiosa
MNRRVVVTGMGMVSPLGNDLTTSWDGIVHGRSGIAPIVQIDASKLSTQIAGEIKGFDPMKFVSAKDAKKMDSFIYYGIGAAFMALDDAGLEINEINAERVGALIGSGIGGVFGIEEQTIKFYEGGVRKISPFYVPSTIINMLPGQLSVLKGLKGPTFSAVSACATSNHSIGMAMRMIQYGDADVMLAGGSERASSPTAIGGFCAMRAMSTRNDDPTGASRPWDKGRDGFVLGDGAGILVLEEYEYAKARGARIYAELAGFGATSDAFHMTMPVEDGEGAARCMRIALQDAKVTPEQIDYLNAHGTSTPLGDLCETNAIKTVLGDHAYKVMVSSTKSMTGHLLGAAGGVEAIFSVMALHTGIVPPTINLEEPDEGCDLDYVPHVAREAKLDVVVSNGFGFGGTNGTLVFKRI

SEQ ID NO: 17532 - protein, 333 aa, Xylella fastidiosa
MVINDIESLTDQALADVAAAQNLDHLEVLRVALLGKNGSITLQLKQLGKLPVEQRKAIGEKVNCVRDLISVALMDRKAALESAALSKRLIDERVDVTLPGRRGERGGLHPVTRTLERITEIFARLGYELVEGPEIEDDWHNFEALNFPLHHPARAMHDTFYFGDGRLLRTHTSGVQVRYMSDHRPPLRMIAAGKVYRSDSDQTHSPMFHQIEGLLIDKHATFVHLKGTLSEFLRAFFERDFEVRFRPSYFPFVEPGAEVDIAWQQSDSSVRWLEVLGCGMVHPNVLKNVGIDSECYTGFAFGLGVERFAMLRYGVDDLRAFFENDVRFLRQFS

SEQ ID NO: 17533 - protein, 619 aa, Xylella fastidiosa
MPIRQLPEILINQIAAGEVVQRPASVVKELVENAIDAGATRVDIELEAAGGRLIRIRDNGHGMAAQELPLAVLRHATSKIASLDDLEAVATLGFRGEALPSIVSVSRFTLMSRRAMDEHGAVLQIEGGTLGEVIPHAHAPGTTVEVRDLFYNVPARRKFLRAERTELGHIEEWARSLALAHPDLELRLSHNGKLSRRYKPGDWYSDARLIEILGEDFAHQALRVDHSGAGLRLHGCIVQPHYSRSNTDQQYLYVNGRAVRDRSVAHAVKQAYSDVLYQGRHPAYVLFLELDPARVDVNVHPAKQEVRFRDARLIHDFVYRTVQGTLAQTRAGTPPLAVGAGDVGGEGARPPVRHAVSFSGRRGGASHVLGSYSASTAPLMQSAPSVSVADAPAAYAALYAAPPTQVIDAVPQMQTGLPLAAGAGDVPPLGYAIAQLHGIYILAECADGLIVVDMHAAHERIGYERLKRAHDGIGLRTQPLLVPMTLMVAEREADVAECEAETLASLGFEVTRSGPGSLQVRSIPALLAQAEPEILLRDVLSDLSEHGHTRRVAEARDTLLATMACHGAVRAQRRLSISEMNALLRDMEATERSGQCNHGRPTWARFSLAEIDRWFLRGR

SEQ ID NO: 17534 - protein, 592 aa, Xylella fastidiosa
MSFSKHFGKLMLATCLSLSAAPVFSYSISHGKVIDDKGNQIQLKGGSWFGFETTNHVVHGLWTRNWKEFITQIQSMGLNAVRLPFCPASLNSNTSPSSIDYNRNPDLQGLSSLQIMDKVVKELSDRGIYVLMDHHTPDCAAISELWYTDSYSEKQWIDDLRFVAHRYANVPGVIGLDVKNEPHGRATWGTGDPKTDWNTAVEHAAAAILEAAPKWLIGVEGIGENPSCSSTIGHFWGENLEPMDCTPLKVPADHLLLIPHVYGPDVYVQPYFNSPDFPNNMAAIWDKHFGHFAKAGYAMAIGEFGGKYGEGDPRDVAWQNALVDYLISIGVTDTFYWSINANSSDTGGLFRDDWNHVREDKLTLLKKLWNGKDGSGGGGGSGGGSGSGGGSGSGGGSGSGGGSGSGGGSGSGGGSGSGGGSGSGGGSGSGGGGGSGGGSGSGGGSGSGGGSGSGGGSGSGGGSGSGGGGGSGGGGSGGGGGSGGGSGSGGGSGSGGGSGTGGGGSDPTKSKISVNTIVDSDWHTGYCERIQVTNISNSPTTWTVTISIRGNIQTLWSARWSVKGNALTASGMDWNKTLDPKGTTEFGFCSNY

SEQ ID NO: 17535 - protein, 467 aa, Xylella fastidiosa
MTCRTRFAPSPTGYLHIGGARTALYCWLEARRRNGQFLLRIEDTDRERSTQAAIDAILHAMDWLGLDYDAPPVYQTQRIERYNQVAARLLAEGKAYYAYDSKDTLNAMREAALRTGEKPRYNGAAREANLPYRDDPNRVIRFKNPHTGTVAFDDLIKGRIQIANSELDDMVILRPDGYPTYNFAVVVDDWDMNITEVIRGDDHINNTPRQINLYHALGAPLPTFAHLPMILDEQGAKLSKRTGAADVMQYRDAGYLPHALINYLVRLGWSHGDQELFNRQALIDLFQINDVNSKAARLDMAKLGWVNQHYLKTDDPATLAPPLVWHLEQRGIDVSAGPAPTDVILALRERVQTLKEMAEKAEIWYCPLQRYDEIAVAKHLKPGADTALLHARTLLAALPTWTVDNVDTALRTTATTLEIGMGKVAQPLRVAITGTQVSPDIAYTVYLTGRNEALKRIDAALIKISTA

SEQ ID NO: 17536 - protein, 500 aa, Xylella fastidiosa
MDGWVVVAVALMVPQARCMMSFACVGLGGEERRGIARDAGIFWCVARGITDTGGVSDGRLPVLAGVGTAWRCSQAVAVIGGRLVGWTLGVYLLPDEPGQWRFVSIKEIEMSIVRMTDLALSGKRVLIRQDLNVPIDQGRITSEQRIIASLPTIRVALERGAAVMVTSHLGRPKEGVWSEEDSLAPVAKRLSQLLGIEVPLRRDWVDGVQVAPGQLVLLENCRMNVGEAENDEALARKYAALCDVFVMDAFGTAHRAQASTHGVICCAAIAAGGPLLMAELDALSRGLEHPVKPLLAIVGGSKVSTKLELLSNLVNNVEQLITGGGIANTFLAAAGYSIGKSLYEGDLIETAREIITAAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARSG

SEQ ID NO: 17537 - protein, 501 aa, Xylella fastidiosa
MLLWLASVKEAFFMSERQRRTRILATLGPATDPPGVLDALFKAGVNVVRLNFSHGDASDQARRAAEVRAAAAHVGVEIGILADLPGPKIRIGRFTEGKVRLVADARFDLLADSNAPLGDATQVGVSYLGLPQDVAAGDVLLLDDGLMQLQVVQVQGARIVTTVLNDGVLSDRKGLNKQGGGLSLGALTDRDRELIGIVSRMGVDFIAVSFCRHAEEMHEARRIARECGCDAALVSKIERAEAIVNLAEIVAASDVVMVARGDLGVEIGDAQLPGLQKKIIKEALLQNKVVITATQMLQSMVESPMPTRAEVLDVANAVIDGTDAVMLSAETATGDYPVKAVEAMARICLGAEHQFEFDTDYEMAQRNLQRADHAIAMATMFLSEHICLGGVVALTESGTTPRFLSRFRSHVPIYAFTRHEDVRRRMVLMRGVFPMRFDSRGLTPREAARATIRLLVECGCMSPGDRVVFTSGEHMETLGATNTLRLLEVGADGGVSGLWEL

SEQ ID NO: 17538 - protein, 334 aa, Xylella fastidiosa
MSIEQLAETAQAMVASGKGIIAIDESAGTIAKRFSSVGIENIEENRRAYRELLLTTPKLSDYISGAILFDETIRQSTKAGVPFPKYMADHGIIPGIKVDKGAYPLAGCPGELVTEGLDGLRARLEEYYKLGARFAKWRAVINIGDDIPSGMCIDANVHALARYAALCQEQGLVPMVEPEVIMDGNHDISAAYEVTEATLRSLFNALYEQNVVLEGTILKASMVIPGTDCEEQASIDEVAESTVMCLKSTVPAILPGIVFLSGGQTDAQSTAHLNAMNQLDPLPWPLSFSYGRAMQQAALKLWSQDMKGNFAKAQQVVYERAKENGLAALGKWKG

SEQ ID NO: 17539 - protein, 612 aa, Xylella fastidiosa
MLRHLLTLPLIFVIALPIGVNAAPWPAFSTRGTQFIRDGRPYQLISGAIHFQRIPRAYWKDRLQKARAMGLNTVETYVFWNLVELREGQFDFTGNNDISAFVREAASQGLNVILRPGPYVCAEWEAGGFPAWLFADPTLRVRSQDPRFLDASQRYLEALGTQVRPLLNGNGGPIIAVQVENEYGSYGDDHGYLQAVRALFIKAGLGGALLFTADGAQMLGNGTLPDVLAAVNVAPGEAKQALDKLATFHPGQPQLVGEYWAGWFDQWGKPHAQTDAKQQADEIEWMLRQGHSINLYMFVGGTSFGFMNGANFQGGPSDHYSPQTTSYDYDAALDEAGRPMPKFVLFRDVITRVTGLQPPPLPAATRFIDLPNTPLRASASLWDNLPAAVATTADPQPMERYGQAYGYILYRTTLHGPRKGTLYLGEVRDDARVYVDRLFVGRAERRRQQVSVEVDIPSGAHRLDVLVENSGRVNYGPHLADGRAGLIDPVMLNHERVNNWETFLLPLQTPEAIHGWTTAPMQGPAFHRGTLLIRTPGDTFLDMAAFSKGVTWANGHLLGRYWDIGPQRALYFPGAWQRQGENTVLVFDVSDTAAAQVRGVQQQRWITPRTGK

SEQ ID NO: 17540 - protein, 405 aa, Xylella fastidiosa
MSIHDVHEGTCHVTTSAVRAGIDSDTAHGAVTPPIVLSSNFSFERFGHKRKYDYTRSANPTRDLLGEALAELEGGVGGVVTATGIAAIMLVLHALLRPGDRLVVPHDAYGGSWRLFNALAQKGHFELITVDLTDARSVVEALALPPKLVLIETPSNPLLRITDLGAVIEAAHRVGALTVVDNTFMSPVLQRPLEFGADLVLHSTTKYINGHSDVVGGVVVARDVAHYQQLVWWANALGLTGSPFDAFLTLRGVRTLDARLRVHQENAQMIAALLEGHGVVKHVHYPGLASHPGHVLAGRQQKGFGAMLSFELQGGEAAVRAFVSGLRYFTLAESLGGVESLIAHPASMTHAAMTPQARAKAGISDGLLRLSVGIEASEDLIVDLVAGLGRAQAVCDGAAREECNV

SEQ ID NO: 17541 - protein, 603 aa, Xylella fastidiosa
MTVIEIKVPDIGDYSKVPVIEVLVTVGDHVVKNQGILTLESDKATLEVPSMNNGVVKELKVNVGDLLSQGDVILLLETEDTTAPPSPSNTATSDTTSPPPPSPQPAASKPTAPDQQHADITCRMVVLGAGPGGYTAAFRAADLGLDTVLVERYPNLGGVCLNVGCIPSKALLHAAAVIDEAAHASTFGIDFGKPKITLDTLREYKQNVVNKLTAGLAGMAKQRKVRTVTGIAHFVSPNTLDITTADGSTQRLHFQQCIIATGSHPVKLPNFPWDDPRIMDSTDALELAEVPKKLLVVGGGIIGLEMATVYNALGSHVTIVEFMDQIIPGTDKDLVKPLADRMKKQGIEIHLNTKASHVKADKKGITVSFEAPTQGTQPALKTSTYDRVLVAVGRTPTGNNIGAEKAGVNVTERGFIPVDRQMRSNVPHIFAIGDIVGNPMLAHKATHEGKLAAEVAAAETESGKHREWVARVIPSVAYTNPEIAWIGMTETEAKAKSLNIGVAKFPWAASGRAIGIGRTEGFTKLIFDEDTHRIIGGAIVGVHAGDLLAEIGLAIEMGAEAEDISHTIHAHPTLSESIAMSAEVYDGTITDLYLPKKPATSAK

SEQ ID NO: 17542 - protein, 551 aa, Xylella fastidiosa
MTEIKEAFVPDIGDYSNVPVIEVLVAVGDTVSKGQSLITLESDKATMEVPSSTAGIIKEIKVKVGDTLSQGHVVALIEVSEETAGVTTPMTVNTPATRAHNAAPPEDGGSLIEVRVPDIGDYSNVPVIEVLVTVGDTVSKDQSLITLESDKATLEVPSSATGVIKQLKVNVGDTLSQGDIVVVLQSAESTPLTPATNKPALPPNSSPARDAISAPASPAGTPSTPPITFDANTVLPSKIPYASPAVRLLARQLGVDLSRIKGSEKNGRITREDVQKFVNATVGTGIPEGRTPSASITTNGGLNLLPWPNVDFSKFGEIETQPLSRIKKISGANLARNWAMIPHVTQFDQADITELEALRVQINKENAAPNKNGTGIKLTVLAFLIKASAAALKKFPTFNASLDATGETLTLKKYFHIGFAADTPNGLVVPVIRNVDQKGIVEIAQETSDLAKKARDGKLTPADMSGGCFSISSLGGIGGTAFTPIINAPEVAILGVSKSLIQPIWDGTQFAPKMLLPLSLSYDHRVIDGALAAHFTTYLSQILADMRRVLL

SEQ ID NO: 17543 - protein, 261 aa, Xylella fastidiosa
MRTMTQSRWRLDGRTALITGASTGIGLAVARELLGLGADVLLVARNADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDVYYYEQVIERTPMRRIGEPEEVAAAVAFLCLPASSYVTGECIAVDGGFMRYGF

SEQ ID NO: 17544 - protein, 318 aa, Xylella fastidiosa
MYFKAVVLINFKSITVLSLSGIITALVTPFDRDGAFDRDAWIRLLDLQLAGGVQGVVIAGSTGEAATLTDAEYDEMLCSAVVRVGGRVPVLAGTGLSGTAKTISQTKRAADNGAGYALVVTPPYIRPNQGGLKAHYLAVADQGGLPVVLYNVPSRTGCDLLPETVADLAGHPNIVGIKEACASRERVQALLALRRPGFTVFSGDDSSAARSMLDGADGLVSVASNVLPSAYRHLCDLARAGERGAIDLWNARLSDFHAFCGLDSNPIPIKALLQRIGIGYGLRLPLLPLSVCHHDIADHLADQVAALEALSSRKIVAA

SEQ ID NO: 17545 - protein, 490 aa, Xylella fastidiosa
MCRSLRRLVPIGYLHDYAILRELHHLKPALRGSVLSTGVCFMHLSSRANAPAPHKPYNPFYLQLYFWVIIAIILGALLGHCYPVVGQQLKPLGDAFIKLVKMIISPVIFLTIVTGIASVAHVGTVARVFGKAMVYFLFFSTLALLLGLVVAHVVHPGVGMNINPADLHQGEIASYVEKSHDLTLVGFLMDIIPKTLLSPFVGDNILQVLFVAVLFGIALALAGERGKPVLNLLDALTLPVFKLVQMLMKMAPIGAFGAIAFTIGKYGVDSLVNLGWLVGSFYLTSLLFVLVILGAVSWFSGFSILKLIRYLKSELLLVLGTSSSEAALPSLMEKMVQAGCKKSVVGLVVPTGYSFNLDGTNIYMTLAALFIAQATNTELTPAHQLALFLVAMLSSKGAAGVSGAGFITLAATLTVVPEVPIAGMALILGVDRFMSECRSLTNFIGNAVATLVVSRWENALNHEQLKIALDGSEPAYQSLHAKDAEPSVSR

SEQ ID NO: 17546 - protein, 637 aa, Xylella fastidiosa
MTLEADKQTHGFQTEVKQLLQLMIHSLYSNKEIFLRELISNAADAADKLRFEALSAPALLEEDPNLRIRVEFDKQAHTITIDDNGIGMSRDEAIAHLGTIAKSGTADFLKTLSGDQRKDANLIGQFGVGFYSAFIVADHVDVYSRRAGLTAAEGVHWSSKGEGNFEVATIDKPQRGTRVVLHLKENEQHFAEGWTLRSTLKKYSDHIGLPIEMVKEEHHGKEEEKDAPKEAEWEAVNKASALWTRPKNDIKDEEYQEFYKHISHDMTNPLAWSHNKVEGKLEYTSLLYVPTRAPFDLYHRNAAKGLKLYVQRVFIMDQAEQFLPLYLRFIKGVVDSADLSLNVSREILQSGPVVDSMKAALSKRALDMLEKLAKDAPEDYKTFWKNFGQVLKEGPAEDYSNREKVASLLRFASTYDTSGDPSVALADYIARMKEGQDKLYYLTGESYAQIKDSPYLEVFRKKGIEVLLLVDRIDEWLMNYLHEFDGKSFVDIARGDLDLGNLDSEADKKAQEEIAKTKEALASRIKATLGEDVAEVRVSHRLTDSPAVLAIGEGDLGLQMRQLLEASGQKVPETKPVFEFNPSHPLIEKLDAEQDMDRFADLSHILFDQAALAAGDSLKDPANYVRRLNKLLLELSA

SEQ ID NO: 17547 - protein, 336 aa, Xylella fastidiosa
MALKHFLNTQDWSCSELNALLTQARAFKHNKLGNGLKGKSIALVFFNASMRTRSSFELGAFQLGGHAIVLQPGKDAWPIEFDTGTVMEAETEEHICEVARVLGHYVDLIGVRAFPKFLDWTYDRQDIVLNGFAKYSPVPVINMETITHPCQELAHIMALQEHFGTTDLRGKKYVLTWTYHPKPLNTAVANSALTIATRLGMDVTLLCPTPDYVLDERYIDWAQQNIADTGSTFQVSHDIDNAYRGADVIYAKSWGALPFFGNWAMEKPIRDQYRHFIVDEAKMALTNNAVFSHCLPLRRNVKATDAVMDGPNCIAIHEAGNRLHVQKAIMAALASQ

SEQ ID NO: 17548 - protein, 401 aa, Xylella fastidiosa
MSKKNIVLAFSGGLDTSFCIPYLKEQGYAVHTVFADTGGVNEEERDFIEKRAAELGVASHLTVDGGPAIWDGFVKQLVWTGETYQGQYPLLVSDRYLIVDAVLQRADALGTCAVAHGCTGMGNDQVRFDLAIKAQGNYTIIAPIREIQKEHTQTRLYEQKYLEERGFGVRAKQKNYTINENLLGITLSGGEIDKWEAPGEGARGWCAPRSAWPADPLTVAIKFVEGEAVAVDGKPLSGPQILMKLNKLFASYGVGRGIYTGDTVIGLKGRIVYEAPGLTALLTAHRALEDAVLTKQQNRFKPHIARKWVELVYEGFFHDPLKTDLETFLKSSQANVNGEIVLETRGGRVDAVAVRSPHILTSKGVTYAQTADWGIEEAEGFIKLFGMSSTLYAQVNRSLRS

SEQ ID NO: 17549 - protein, 445 aa, Xylella fastidiosa
MDTPPMPSLLWHKPGVAIDANIQTFLAADDVLLDREFFLYDITASTAHAQALQRIGLLTPDELDNILRELQHLTDEYRNGTFLLDTQYEDGHSAIESRLTERLGETGRKIHTGRSRNDQILVATRLWLKDRLTQLSTLNRDIAHHALQRAAAEQHLPMPGYTHLQRAVVSSAGMWWAGWAESFIDNAVRAADTHALIDCNPLGTAAGYGVNLPLDRPHTTAALGFARLQVNPICAQLSRGKFELAALEALGSATLDLRRIAWDLSLFTTSEFAFITLPPEYSTGSSIMPNKRNPDVIELMRATHASVAAARTEIEQLLSLPSGYHRDLQNSKGAIVRGFKRGLAALELLPALLSRLQWRPDTLRAAIDPGMYATDAAIEAAIAGIPFRDAYQMAAKTADTAAQGRTPETSLTARRSPGAAADLCLETLRARWHTLTQPTSDPDPR

SEQ ID NO: 17550 - protein, 484 aa, Xylella fastidiosa
MHPLPTTTVDAPRLQNISHRLPSHPLSTSSTATTHPPHHLLTSQPLRCPVPHCQHPPPTPIPLHPRPYLMSHIRHLAQQCRDAARRLATLSTDAKRRLLETMATALNTDAATILAANAADLDAARTQQVGTAMLDRLALDPQRLAAMADALRDIAALPDPVGQVTRDDQRPNGIHVQKIRVPLGVIAMIYEARPNVTADAAALCIKAGNGIILRGGSEAIRSNIAIATALQRALRLASLPETALILVQDMARHTMLELLQLSDLIDLVIPRGGEGLIRFVAEHARIPVIKHYKGVCHQFVDASADIEMAIRLLIDGKTTRPAACNALETLLVHTDIAPRFLPAAAAALRPYGVQLRGDHATCTLLPDVVLATDADYAAEYLDLILAIRIVPNVDAALEHIRRYGSDHTEVIVTADPAHADTFVQQLYSAVVMVNASSRFSDGGALGLGAEIGISTTRLHAYGPMGLDALTVERFVVRGQGQVRH

SEQ ID NO: 17551 - protein, 870 aa, Xylella fastidiosa
MPKKNSPLLPKETTPTQSSVDTSGSSNLTWPVSEHTIRRPLWARLLGQILDPWLDLSIEPEHCVQYPEHCVQYNDGRPIIYVLEDYGLCNTLILDKACRKTKLPSPLIPLPGNPLQRKRAYLALSRRSSSNSLIPNQRGGKTHSDSLANLLQAHRIRDTLDVHLVPVSIFIGRTPDRQSGWFAVLFSENWALVGRFRRLLAVLLNGRNTIVCFAPPISVRQTLNEGLPPERTLRKLQRVLRAHFRRIRETVIGPDLSTRRLLVDNVLATEAVREAIASQAKRDGTDLSETWRKAQAYAWEIAADYSSPVIRSADFLFSHVWNRIYAGVLIHHVDSFKETAPGHEVVYVPSHRSHIDYLLLSYCLYQCGIVLPHIVAGINLNLPIVGTLLRKCGAFFIRRSIKGNMLYSIVLSEYVAQLVAGGYSLEYFIEGGRSRTGRLLQPKGGMIMMTLQAFLRQPRRPVLFQPIYIGYEKLIEGTSYLDELSGEPKKKESIWRLFWNIPKVLKQKYGQVVVNFGEPIALNDVLAELAPEWEGQALNENEKPAWLSNTVNHLARQIQTRINSAADVNPINLLALALLSTPKHAMGEADLIAQITLCKKILLELPYSNRVTVTPHTPERIIAHAEQINILTRVHHPLGDVLRVDGDNAVLLSYFRNNVLHLFTASAWVACCFKNNRRISRIALIRLGVGMYPFLQAELFLPWTEDQFAQHIQQVIELFVREGLLLSAGDEEEDPLTRNTSQTDEVFRLRAISHSLQQAFERYYITISILVKNGPGTLSASELESLCQLAAQRLSLLYASTAPEFFDKGLFRGFIQKLRELNLVWPDTYSKLLFDERLDTSAKDAQVILGRELRHTIERISPEATKPAPK

SEQ ID NO: 17552 - protein, 446 aa, Xylella fastidiosa
MPGLMSIRRKYASKQPLKGVRVTGSLHMTIQTAVLIETLKDIGADVRWASCNIFSTQDHAAAAIATSGTPVFAWKGETLEEYWDCTLQALTFTLSDGTLTGPELIVDDGGDATLLIHKGYELENGSTWVDEPSDSLEEQVIKRLLKRIAIERPGYWTRVVNDWKGVSEETTTGVHRLYQIAATGRLLVPAINVNDSVTKSKFDNLYGCRESLADGLKRAMDVMLAGKLAVVCGYGDVGKGSAHSLRAYGARVIVTEIDPICALQAAMEGFEVTTVEDTLGQADIYVTTTGNKDVIRIEHMTAMKDQVIVCNIGHFDNEIQVDALNALAGVQKINIKPQVDKFILPNGNTLFLLAEGRLVNLGCATGHPSFVMSNSFANQTLAQIDLWQNKDVYEKNVYRLPKKLDEEVARLHLEKIGVKLTTLTANQAAYLGISVEGPFKPEHYRY

SEQ ID NO: 17553 - protein, 160 aa, Xylella fastidiosa
MSDSPTTAHTRLELPIDIIKIQALLPHRYPFLLVDRILELDQKQKRIVAQKNVSINEPFFQGHFPEHPVMPGVLIIEALAQAGGVMTQLNLSHNGHSSLLFYMVRVDNARFNKQVVPGDILILDMTMKRRIRNMGCYYGEARVNGEVVACADIMCAGVKS

SEQ ID NO: 17554 - protein, 477 aa, Xylella fastidiosa
MHNTLLLFGATGDLAQRYLFPSLLHLFTDGLLPQDFRIRALALSPHNTTQFRDILRPRLEQALPIANTAHIQALLQRVDYLSVDLNDPTSIAEAVRDLTEHPCISYLAIPPGLYTNTALGLAQGGALQTPHRLMLEKPIGRDSINAREILNTIGTLIDEDRIFRVDHYLGKAAVQNLVALRFGNTLLEAVWNRNHIESVHILIAETEGVDGRNAYYARAGALRDMMQSHILQLLCLVAMEPPASLEADRIRDEKVKILRALRPLNAQNAAMHSVRGRYSAGTINSQPVPAYQPPEGSNVETFVGVTAYIDNWRWAGVPFHLCTGKRLAERSTQIVVTLKPVTHWLFERPDRNNAAPNRLCFKLQPQENIELNLMSSLAGPEWGTLELQPLELELSVPTGKHRHIAYERLFLDAFNGNPALFVRHDEVTAAWDWIDSVSNAWELSDLPLQPYPAGSWGPPQAHQFLPPLGIDGHGNDA

SEQ ID NO: 17555 - protein, 596 aa, Xylella fastidiosa
MSAYTITEHKYDMVVVGAGGAGLRATFGLAQKGLQTVCLTKVFPTRSHTVAAQGGISAALGNMGEDDWRYHFYDTIKGSDWLGDQDAIEYMCREAIPAVIELEHYGVPFSRTAQGKIYQRPFGGMTTRYGEGPRAERTCAAADRTGHAMLHTLYQQALAHDARFMIEYFALDLIFDNEGVCCGVLALDMAEGSLHLFRAHGVVLATGGYGRTYFSATSAHTCTGDGGGLVMRAGLPMQDMEFVQFHPTGIYGAGCLITEGVRGEGGILRNSNGERFMERYAPHYKDLASRDVVSRSMIIEIREGRGVGEHKDHILLDLTHLGPSMIQEKLPGIAESARIFAGVDVTKQPIPVLPTVHYNMGGIPTNYHGEVVRKIGNDPDAVVPGLYAVGEAACVSVHGANRLGSNSLLDLVVFGRAVANRCAETIKPNQPHKVLPSDSCDKALGLLDKLRHADGSTPTAVIRDRMQRTMQSDASVFRTSKTLQEGCEKMNEIFALFDDVKVSDRSLVWNSDLIETYELHNLLLNALATINSAEQRKESRGAHAHEDYPDRDDENWLKHTLVSVDEKGTCSFDYRPVHMYTLSKDVDVIPPKPRVY

SEQ ID NO: 17556 - protein, 261 aa, Xylella fastidiosa
MAEFTLPKNSKIGKGTHFPAKSGTKNARTFKVYRWNPDDDANPHTDTYEIDLDTCGPMVLDALIKIKNEIDPTLTFRRSCREGICGSCAMNIDGTNTLACTKAISACTISEIPIYPLPHMNVIKDLIPDLTHFYAQYASIKPWMRTQTPPPPDRERLQSPGDRKKLDGLYECILCACCSTSCPSYWWNGDRYLGPAILLQAYRWIIDSRDEDTGARLDDLEDPFKLYRCHTIMNCTRTCPKGLNPAQAIAEIKKLMMLRRA

SEQ ID NO: 17557 - protein, 589 aa, Xylella fastidiosa
MNVLSGAMRYATPWRTYRRLLSYAREYRWLLVVAACGALLEAVAGSTFLALMKPITNETFIERNREVALWLPLGIVGLFLLRGIAGYITDMAMGRAARSIARDFRVCVLTKYFRLPGSRFDGEPVASMLVRLGSDSEQVAHAVIDAMKVMVQQTLQVIGALVVMLWYSWTVTLAILLVAPLLAWVMQRVAKRYRRISHHIQESNAQLMQAADQALSNYQDVKVYAAQESELERYARLANINLGLAIKVESTRSLSSAAVQLLGAVGLAMLLLIAGHEALAGRLSPGDFVSLMTSMIAVIPALKQLTNVQNMLQSGIASAQRLFSVLDSPDELDTGRRPLGRARGFIEFRGITARYPGRSAPVLDSVSFVAAPGTVTAIVGRSGSGKSSLIKLIPRFYEPESGQILLDGHPLQDYLLADLRRQIALVGQQVMLFDGSIAENIAYGEMRQVVSEEIERVVVDANAQDFVNQLPEGLQFQVGVKGGRLSGGQRQRLAIARAMLKDAPILILDEATAALDNESERLVQDALQRLMPERTTLVIAHRLSTIKHADQVLVMDQGRIIESGTHVDLLARDGLYAYLYSMQFRERPT

SEQ ID NO: 17558 - protein, 237 aa, Xylella fastidiosa
MDSFLRLLIHGASGRMGQALLRLASEDPSFQVAAAVVGQAPDRHVSDGVPFFAAAELAAVPAFDVAIDFSLPQGFSSLLALCVARAVPLVSGTTGLDSRQHEALVMAGAQIPLVWGSNFSVGMAVLVNLVERAGDALSGWDCDIVESHHVHKQDAPSGSALTLGEAVACKGIAPRYTSLRAGDIVGDHLVQFTGLGERIELVHRATNRDVFARGALYVARRVVGRVPGCYRVRDLIM

SEQ ID NO: 17559 - protein, 399 aa, Xylella fastidiosa
MFELSCNLISGGGIGVPGSQSETPPVTEPAILVLEDGTVFEGDAVGANGLSVGEVVFNTSLTGYQEVLTDPSYAYQLVTLTYPHIGNTGCTDQDDEANKVWAAGLIVRDVPRRPSNWRSQISLSDWLAARGVVAIAGIDTRKLTRILREKGAQHGALMAGEIDVDRAQDAARQFTGIKGMDLAKVVSTKQAYSWYEGQLDLDRNEWKRAAPQYKVVAYDYGVKLNILRMLAERGCDLTVVPAQTPVDEVLALCPDGVFLSNGPGDPEPCDYAVAAIKTFIMRRVPIFGICLGHQLLAQTVGAKVVKMRHGHHGANHPVQDLRSGRVMITSQNHGFAVDEATLPSNVRVTHRSLFDGTNQGIELLDVPAFSFQGHPEASPGPHDVDVLFDRFITMMAAQS

SEQ ID NO: 17560 - protein, 1080 aa, Xylella fastidiosa
MPKRTDLRTILIIGAGPIVIGQACEFDYSGAQACKALRAEGFRVVLVNSNPATIMTDPDMADAVYIEPIHWRTVEKIIAKEKPDALLPTMGGQTALNCALDLADHGVLEKYGVELIGAKREAIRMAEDRELFRVAMQEIGLECPKAEVAKSLERALEIQAKVGFPTIIRPSFTLGGTGGGITYNRQEFEEIIKRGLELSPVHEVLVEESVLGWKEFEMEVVRDASDNCIIVCSIENLDPMGVHTGDSITVAPAQTLSDKEYQRLRDASIAVLRKIGVDTGGSNVQFGIDPQTGRVVVIEMNPRVSRSSALASKATGFPIAKIAAKLAVGYTLDELKNEITGGKMPASFEPSIDYVVTKIPRFAFEKFPQADARLTTQMKSVGEVMAMGRTFAESLQKAVRGLETGKVGLEPTGLDLSSEDDLVVLKRELKAPGAERLFYVADAFRAGFAVADVYALSYIDPWFLDQIEEIVAAEGRLVTDGLGSIDGARLRQLKRIGFSDARIAQLTGTNEVAVRALRRVLKVKPVYKRVDSCAGEFATGTAYLYSTYEEECEAAPSDRRKIMILGGGPNRIGQGIEFDYCCVHAALALREDGFETIMVNCNPETVSTDYDTSDRLYFEPLTLEDVLEIVEVEHPVGVIVQYGGQTPLKLAKALEANGVPVIGTSPESIDLAEDRERFQKLVQQLGLRQPPNCTARTAEEALVLAREIGYPLVVRPSYVLGGRAMEIVYGEADLARYVRDAVKVSNDSPVLLDRFLDNAVEVDVDIIADREGQVLIGGVMEHIEEAGVHSGDSSCSLPPYSLSAATQDDLRRQVIRLAQALNVIGLMNTQFAIQSNDDGSDIVYLLEVNPRASRTVPFVSKATGVPLAKIAARCMTGKTLVEQSVTCEVVPAYYAVKEAIFPFAKLQGVDPILGPEMRSTGEVMGVGRSFAAAFARAQEAGDIRAPQPGRAFVSVRDPDKKRVLPVVLALVERGFGVVATAGTYAWLQQNGVACEVVNKVAEGRPHVVDLIKNGEIVYIINTTEGRAAIADSFSIRREALQHCVTYSTTIAGAKALVNSLEFRGTGPVWSLQELHKELQV

SEQ ID NO: 17561 - protein, 662 aa, Xylella fastidiosa
MLLSDLGVSLALMLAIVMHPQISHVRRCIGIIADYTSLTVLMLLMGEAGSPLYVLCLWVTIGNGLRYGCAYLLVTTTLSALSFLMVILVSAYWKSNPFLAWGLLIGLIAIPWYFQSLLKALIQALKDARHANEAKSRFLANMSHEFRTPLNGLSGITEVLATTRLDAEQRECLKAIQASVHSVLSLIEEVLDISRIEAGKIRILHDTFSLQEVIGSVGLILQPQIRNKVLEYRVDVGLDVPEWLFGDAGYVRQVLLNIVGNAVKFTERGGITLCVSVLNRSRERSVVLRFEVADTGIGVPLGMRARLFDMFEQADVGLDRRYQGSGLGTAIAKGLIELMGGSIGFEENVPCGSLFWFELPFELGKEPVVAQELPEASQCTEASNVIAFSNPFLRHRARVKSLRVLVADDHETNRMVLSRILDKAGHKLLCVDGAEAVLDCLISMEFDVVIIDLHMPGMSGLEMLKQLRVMQSAGLPYTPVLVLSADAASDSIRCCKEAGARAFLSKPVLATKLLDVLAEIAEGDGGALPYAALSQSSVQQHQVFDPTGLDDLAELDMDDGFEERFIVQSLRDAEHCQQTMLSAAETNQWQEVREQAHALRGVLGHLGLMRASSLAAELMRIPDWQLQSEWCARVQVLYEELRSGRDALEARRQERRRSGILQ

SEQ ID NO: 17562 - protein, 868 aa, Xylella fastidiosa
MSASPTAERWIVLKFGGTSVSRRHRWDTIAMVVRKRLEEHGTRVLIVVSALSGVTNELTAIAQGVVDSAQRVAALEQRHRDFLAELGLDAQAVLGTRFTVLWDLLQDARAVTRSLDWQAELLGQGELLSSTLGAAYLGASGVDIGWMDARDWLTALPPQPNQSEWSQRLSVSCQWKSDVEWRTRFDAQRAQVLITQGFISRHQDGGTAILGRGGSDTSAAYFGALLGAACVEIWTDVPGMFSANPKEVPDARLLTRLDYYEAQEIATTGAKVLHPRSIKPCRDTGVPMLILDTERPDVLGTRIDAEVEPVLGVKAISRRDGIVLVSMEGIGMWQQVGFLADVFTLFKKHGLSVDLIGSAETNVTVSLDPSENLVNTDVLTALSTDLSQVCKVKIIVPCAAITLVGRGMRSLLHKLSEVWATFGKERVHMISQSSNDLNLTFVIDETDADGLLAVLHFKLIESGAMPVQERAVFGSPWREIIGHVRTRVMPWWHSARMRLLAMRDEEGIGPCYVYHLPTVRERARQLNAVAAVDQRYYAIKANPHPAILRTLIEEGFGLECVSLGELRHVFAVVPHLVPSRVLFTPSFASRVEYEQAFLLGVNVTLDNVEALRLWPEVFRDRTLWLRIDLGYGDGHHEKVTTGGKTSKFGLSVTRIDEFIDVAKTLNIIVTGLHAHLGSGVERGDHWSRMYDELAGFASRIGSVSTLDIGGGLPIPYRPDDEPFDVEAWGVSLAEVKALHPKLQLVIEPGRFLVAEAGVLLTRVTQVIEKDGIRRVGLEAGMHTLIRPALYDAWHDVENLSRLDEIPHVLCDVVGPICESSDVFGRCRHLPAATASGDLMLIADAGAYGFSMASTYNLRGLPAEVVLDA

SEQ ID NO: 17563 - protein, 352 aa, Xylella fastidiosa
MNVMGFAALSATGPLERFAFGRRAPRPDDVVIDILYCGVCHTDLHLARNHGGFTTYPIVPGHEIIGCVREIGKTVTRFKRGDLVGVGCMVDSCQHCQPCLKGWEQDCIEGSTFTYNSTDRRDGSITYGGYSDVIVVRDKFVLSLPDGLDPAGAAPLLCAGITTWSPLRRWNVGKDSKVAVVGLGGLGHMALKLAKALGADVTLFTRSSGKEGDAFRLGADRVVLSSDLEQMKAVYSRFDVIIDTVPYDHDVNPYMPTLVLEGVLVLVGYMGPLSMPVNAGGVVRGRRAISGSFIGGVPETQQMLDFCGQHGIVSDVEIIPIQKINEAYERMLKSDVKYRFVIDMTSLTSSGA

SEQ ID NO: 17564 - protein, 466 aa, Xylella fastidiosa
MNQGKIVQIIGAIVDVEFPRNNVPKVYNALKIDGTAIILEVQQQLGDGIVRTIALGSTDGLKRNLIATDTGHAITVPVGTGTLGRIMDVLGNPIDEAGPITYTDQWEIHRNAPSYEDQASTTELLETGIKVIDLMCPFAKGGKVGLFGGAGVGKTVNMMELINNIAKAHSGLSVFAGVGERTREGNDFYHEMKDSNVLDKVAMVYGQMNEPPGNRLRVALTGLTMAEYFRDEKDSSGKGKDVLLFIDNIYRYTLAGTEVSALLGRMPSAVGYQPTLAEEMGVLQERITSTANGSITSIQAVYVPADDLTDPSPATTFGHLDSTVTLSRSIAALGIYPAVDPLDSSSRQMDPLIIGEEHYNTTQRVQQTLQKYKDLKDIIAILGMDELSEDDKLAVSRARKIERFFSQPFHVAEVFTGAPGKYVPLKETIRGFKAIVDGEYDHLPEQAFYMVGNIEEVIEKANKMTA

SEQ ID NO: 17565 - protein, 287 aa, Xylella fastidiosa
MASGREIKSKIKSVQNTRKVTRALEMVSASKIRKAQEQMKISRPYAQAMKQMTGHLAQANTDYLHPFLIAHKQVKRIGYIVISSDRGLAGGLNNNLFRKMLGEMRQWQDKGAEVDIVTIGQKASVFFRRIKVNILGSVTHLGDTPRLEQLIGVIKVMLDAYTEEKLDRVYLVYNRFINTMVQKASFDQLLPLLAAKDKVAHHDWDYLYEPDAATVLEHVMRRYIESLVYQAMLENIASEHAARMVAMKAASDNANKLIGTLQLVYNKARQAAITQEISEIVGGAAAV

SEQ ID NO: 17566 - protein, 515 aa, Xylella fastidiosa
MATTLNPSEISELIKTRIEQVKLSAESRNEGTVTSVSDGIVRIFGLADAMQGEMIELPNKTYALALNLERDSVGAVVLGDYEHLREGDIAKTTGRILEVPVGKSLLGRVVNALGEPIDGKGALGPTQTAPVERVAPGVIWRKSVNQPVQTGYKSVDAMIPIGRGQRELIIGDRQTGKTAMAIDTVISQKDTGIKCVYVAIGQKASTIANIVRKLEENDALDHTIVVAATASESAALQYISAYAGCTMGEYFMDRGEDALIIYDDLSKQAVAYRQISLLLKRPPGREAYPGDVFYLHSRLLERAARVSEEYVEKFTQGEVKGKTGSLTALPIIETQAGDVSAFVPTNVISITDGQIFLETDLFNAGIRPAVNAGISVSRVGGSAQTKIIKKLSGGIRISLAQYRELAAFAQFASDLDETTRKQLERGQRVTELMKQKQYTSMSVANQALSIYAVNEGYLDDVPVDKVLTFEESLHAHFSNTQSALIDKINTSGDWDNNIEAAFKKHIEEFKTTGSW

SEQ ID NO: 17567 - protein, 275 aa, Xylella fastidiosa
MPLIKFKPTSPGRRSAARVVTPNIHKGSPHAALLEPQSKTGGRNHHGRITVRHIGGGCKQRYRVIDFKRDKEAIPARVERIEYDPNRTAHIALLCYVDGERCYIIAPKGLKEGDKIISGPNVPIKLGNSLPLRNIPVGTTVHAVELKPSKGAQMARSAGSSVQLVAREGVYATLRLRSGEMRRVLAECRATIGEVGNEEHNLRKLGKAGAKRWLGVRPTVRGAAMNPVDHPHGGGEAKSGQGNPHPVTPWGVPTKGYKTRKNKRTQQFIIRGRRG

SEQ ID NO: 17568 - protein, 433 aa, Xylella fastidiosa
MSSMVADKQGEPTLARIAVVGLGYVGLPLAVAFGRQRPTLGFDIDICRVQQLCAGHDITCEIELEELQAARHLRYSSDPRELSDCQIFIITVPTPIDVAEQPDLGPLRSASMLVASVLKPGDLVIYESTVYPGTTEEVCVPLLEVGSGLCFNVDFHCGYSPERINPGDRKRRLQDICKIISGSTPDITAVVDALYSQIIVAGTWCAPSIRVAEAAKVVENIQRDVNIALVNELALIFNRLGIDTLDVLEAAETKWNFLPFRPGLVGGHCIGVDPYYLLHKSESVGYYPDLIHTARRVNSRVSWHVVDRVVALLGELSVPMTRAVVLVLGVTFKEDCPDLRNSRALDLVRMFRTLGAQVDVCDPCADPQQALEHEAVTLCTEPKAGAYDAIVLAVAHAQYRMYDVATIAALGKPQAVVYDVKSVWPRAAVTDRL

SEQ ID NO: 17569 - protein, 848 aa, Xylella fastidiosa
MPEWPHNGAIGFSVAVNSMHYTGVLMTQSSQKTLDLQVLPLRDVVVFPYMVIPLFVGREKSMRALEKAMDADKRILLVAQKMADIDDPGAVDLHTIGTYAQVLQLLKLPDGTIKVLVEGLTRVSVDQVVEHDGALRGCGIEIASTQEREEREIEAIVRSLLSLFEQYVKTNRKLPPELLQTLSGIDDPGRLADTIAAHLSVRLAYKQRLLETIEIGDRLEILIGLVDGEIDVQQMEKRIRGRVKSQMEKSQREYYLNEQMKAIQKELGDFDDLPSELEELARKIAEIGMPKLVQSKAKSELNKLKQMSPMSAEAAVVRNYLDWLLGVPWKKCTKVRKDLKVAQSTLDDDHYGLDKVKERILEYLAVQSRVKQMRGPILCLVGPPGVGKTSLGQSIAKATNRKFVRMSLGGVRDEAEVRGHRRTYVGSMPGRVVQNLNKVGSKNPLFVLDEIDKMAMDFRGDPSAALLEVLDPEQNNAFNDHYLDVDLDLSEVMFVATSNSLNIPGPLLDRMEVIRIPGYTEDEKLNIATRYLVPKQIRANGLAVEELAIGEDAIRDIVRYYTRESGVRNLEREISKICRKIVKEIALVGVKPVAKKSTKSKVLFAVTSKNLEKYLGVRRFDFGRAEEANEIGLVTGLAWTEVGGDLLQIESTLVPGKGNLILTGQLGNVMKESASAALTVVRSRADRFCIDVDFLHNQDVHLHVPDGATPKDGPSAGIAMVTSLVSMLTKVPVRADVAMTGEITLRGRVSVIGGLKEKLLAALRGGIRTVLIPEGNRRDLADIPANVTRALTIVPVKWIDEVLDLALESPLAPKVAAQLGKSKPRKAHSRVSTVRGKSKGSSNARVRH

SEQ ID NO: 17570 - protein, 830 aa, Xylella fastidiosa
MIPKEQFAAAIADSLPNPGHVAGSVPPVALSVFHPDEPEDEVPIPRQTAMMHTRAVEEANVSTWITKEAGNRRMPFDCARLECAIDTIHQEFPQLDVAEYKRAVFGFVERKDSVNADDLVDLLIREAEARVDLTAPEWEYFAARLYLRRLYKRASRNRFYDASQKYGSFVGLQESLADRNIYSNDILRSYSKEELIEAGQMIDPERDKLFTYNGLYLLATRYLATDASRGVFELPQERWLTIALYLMQDEYGPGKGGRERRMQLVGEAYWALSNLYMTVATPTLGNAGKINGQLSSCFIDTVDDSLQGIYDSNTDIARVSKHGGGVGAYLGYVRSSGSMIRGVANSSGGVVPWIKQLNNTAVSVDQLGQRKGAIAVYLDIWHRDIEAFLDLRLNNGDQRLRAHDVFTSVCIPDLFMEAVERRGDWYLFDPYEVKCVKGWYLQDFYDEKRGDPNGSFRRKYEDVVADERISRKTVKAIDIFKRIMVSQLETGNPFMFYRDEVNRKNPNKHVGMVYSSNLCTEILQNMTPTRLIQEMISGNQIVTTKQAGDFVVCNLSSINLGRAITVQADLLGADVLERLIPIQVRMLDNVIDLNLLPVPQATITNQKYRAIGLGTFGWHHLLAQKAIHWNSPEAEQYSDALYERINYLTIRASMELAKEKGTYAVFPGSDWQTGEYFRARDYNSPQWLELAAQVAVNGVRNAYMVAVAPNMSTAQIAGSTASIDPIYSAFYYEEKKDYRRPVVAPGLSLDTWPYYEKGAYKLDQFASIRQNARRQRHVDQSLSFNFYVPSTIRASTLLDLHMTAWREGLKTTYYVRSNDIDISECEWCSS

SEQ ID NO: 17571 - protein, 346 aa, Xylella fastidiosa
MAISLDRIKILEPRNPNRSTGIINGKTSGILNWNDIPYPSFYRAYKELSTNFWIPDEVDMKIDKRQYGELSAREKNAYDAIIGLLATLDSPQTRFIYNVAEYITDPAAHANAAIIGQQEVIHNESYSYVLASITDLANQNRVFEIARTHPTILKRNAPIMQAYDDFMREKTAETLLYSLIQSSILEGINFYSGFAYFYNLVRQNRMTGTGKIISFINRDELAHTKFISEVIRAIVGENPELQTDALTDYVHQAFAHAIELETQWTGEVLDGIDGIDVEEMIRYVKYRANKMAGMLGIQTLYTETTDNVMPWIRAYADNFTETKTDFFEMRNASYKKTNVDNCFDDL

SEQ ID NO: 17572 - protein, 226 aa, Xylella fastidiosa
MTVSAPLSFMPEAVIFDMDGLMLDSERVSIECRCRAAFDLEQQIEPDYWLQMVGVSDIACHAQLSARIGAVPATALLARSDALYEAVVTKGVPHRPGIVTLLEWLFARGIPCAVGTSTRRPLALRKLNTAGLLWRFNAVCTASDVAQAKPAPDIYLLAAHTLGIVPGRCLVVEDSPIGVRAALAAGMTPIQVPDLLMPDAQVSALGHRIVASLTEVQSLLEACFDV

SEQ ID NO: 17573 - protein, 335 aa, Xylella fastidiosa
MSTGKHPMKSLVRVAVTGAAGQIGYSLLFRIAAGEMFGKDRPVILQMLELPDEKAQAALKGVMMELEDCAFPLLAGMVGTDNPDIAFKDADVALLVGSRPRGPGMERKDLLMENAKIFTAQGAALNKVARRDVKVLVVGNPANTNAYIAMKSAPDLNPKHFTAMLRLDHNRALSQLSTKLSKPVANIEKLIVWGNHSPTMYPDYRFATADGTPIIEAINDQAWNANSFIPTVSKRGAAIIEVRGLSSAASAANAAIDHMRDWLLGSNGKWITMGVPSDGSYGIPEGMIFGFPVTTTNGEYSIVKDLPIDTFSKTYIDKTLAELEEERASIAHLLR

SEQ ID NO: 17574 - protein, 707 aa, Xylella fastidiosa
MRPVLQSEVSECGLASLAMVANAHGKHLTLSQLRQRFPSSLKGAKLTHLVHIAQQLGFSTRPLRLDMEDLGKLKLPCILHWDLNHFVVLAKVGTTKVTVYDPAIGKRKLSLNEVSKYFTGIALELTTTTEFKQQKPPPSISARQLTGPIRGLWRALAQILLLSLALQVFVVLSPFYMQWVVDQVLVSADRDLLVVLGLGFGLVLLLQIAIGLFRSWSVIYLSSRLGLQWMGNVFAHLLKLPLEYFEKRHLGDLTSRMSSVQSIQKTLTTSFVEAIIDGLMTLVTLGLMLVYSWKLALVTLVAVALYMVIRAVSYWPVRDCTEQQLVVGAKQQTHLLESLRGIQSLKVACEESLRRSTYENLLNDTVNQEVRLARMSLGFSTASQLVFGLERIAVIWYGATLALSNVFSVGMLIAYLSYKDQFASRISSLIDKWVEFRMLRLHGERLADIVLTPPEEDYELPEMQLPKKEPDIEVEGLSFRYGEDEPWVLKDCSFKVAAGESVAIIGASGCGKTTLMKLLLGLLKPTAGTIRISGRDLHKFGTRNVRSIVGAVMQDDQLFAGSVADNISFFDPDFDLERIEAAAKLAAIHEDIAAMPMGYHALIGDMGSALSGGQKQRVILARALYRQPKLLFLDEATSHLDVMRERLVNDAVHQLKLTKVIVAHRPETIASTDRVVILDHGRIVQTVAMPEDRDDSIEIVHNTIQST

SEQ ID NO: 17575 - protein, 833 aa, Xylella fastidiosa
MNHHALPIDPLLPAITTSLSNHPRLILEAPPGAGKTTQVPLALLDAPWLNGRSIILLEPRRVAARNAALFMARQCGEEVGGLVGYHIRFESKVSARTRIQVVTEGILTRIIQDDPLLDGIGALLFDEFHERHLASDLGLALALDVQTQLREDLRIVVMSATLQGERLAQFLDAPRLTSEGRAYPVAITHFPARRDESLETHARRAIQHALDTHQGDVLTFLPGQREIARLQAILEKTLSPELHVMPLHGELPLKEQARVLEPDQHGRQRIVLATNVAESSITLPGISVVIDSGLAREPAYDPNTGFTRLDVVSITQASADQRAGRAGRLAPGWAYRLWPQSQRLEAQRRPEMIQTELSGLALELTAWGSSTLRFIDPPPAGALSAARELLQRLGAISNTSTLTPLGQRMLALGIHPRLAAMLLAPHDPQEQALACDLAALLDARDPLRGSGDALISRWRALAELRSSCLPHDTRRSTLRAIDAATHQWRRRIRCDTTPPDAIEAHTLGNLLTHAFPERIAARHSSDPLYYVLANGRRMRLFDNSALHGEPWIIASELHHGIKDIQLLCGAPLDERRLHADFPERFIQHDVIRWETDKRALVAQRESCFDRIVLDVRPAGRIDPVQAANVLTGAVRTLGLDTLSWTEHLRQWQARAVALRHWMPELELPDLSNTTLLATLDTWLTPAFAGKTRLDALDEAAFEQAVKSLLSWTQHALIDRHAPARIIVPSGMERHIDYGLADDGTPQPPVLAVKLQELFGLPDTPRIAKNRIPLTLHLLSPGGRPLQVTQDLKSFWTNTYPEVKKEMKGRYPKHPWPDDPWTATATHRTKSPGK

SEQ ID NO: 17576 - protein, 503 aa, Xylella fastidiosa
MAMIPRIALLSLLVSSSVPLAYATATPPKPDKETTTPATTLPALPANTQIRQSIRIGNRTLSYKAIIGALPVQDDKGKTIGEVMFTAYIMKGNNRPVTFALNGGPGASSVYLNMGAIGPKVVHFGTQGTSPSDPAILHDNPGTWLDFTDLVFIDPIGTGFSRARIEGEEAKKQFFNPKADVDYLSRTIYDWLVANGRLLSRKYLVGESYGGFRAPRIAHTLQTQMGIALNGLVLVSPYLNPTLDDNSDVSPLAWIMTLPSIAAAHLERQHQLSEAKMREVIEYTRGDYASTLMKGRSDPAATETMLQQVVHLTGLDPTYVRRAGGRLETQAYLREVFRDTGELGSRYDINVTALDPFPYDSEQRTNDPLLDSIIAPTTTAMVDFVTRTAGWKVHERYQALNYDVNRQWDWNEELRKGSVTQLRQSVAIDPKLRVLIAHGWNDLSCPFMGSVLTIDQIPKMGSDPTRIQVREYPGGHMFYNRPDSQSSFRQDVQAMYEHPQDTP

SEQ ID NO: 17577 - protein, 295 aa, Xylella fastidiosa
MRLSFFSVLLVIPKQSGDVMKLCGFEVGLNQPLFLIAGPCVIESLQLQLDTAGVLKEITSKLGLNFIFKSSFDKANRTSGSSFRGPGLEEGLKVLEAVKTQIGVPVLTDVHEYTPIDEVATVVDVLQTPAFLVRQTDFIRNVCAVGKPVNIKKGQFLSPWDMKPVVEKAKSTGNSQILVCERGASFGYNNLVSDMRSLAVMRETGCPVVFDATHSVQLPGAQGGRSGGQREFVPVLARAAVAVGISGLFAETHPDPPNALSDGPNAWPLHTMAMLLETLVELDAVTKKRGFLEQD

SEQ ID NO: 17578 - protein, 461 aa, Xylella fastidiosa
MGPELFCESRYRDDNPMVLWYCSLLWLLTGPMTAIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKVSLPVPMMNIINGGAHADNNVDFQEFMVLPVGFASFSEALRAGTEIFHALKSVLKGQGLSTAVGDEGGFAPDLRSNVEALDAILEAIGRAGYIAGEDVLLGLDVASSEFRDNGKYNLVGENKRLTSEQFVDFLDDWVTQYPIISIEDGLAEDDWAGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 17579 - protein, 354 aa, Xylella fastidiosa
MLKNDRLLRALQRDTVDRTPIWLMRQAGRYLPEYRAVRQHAGSFLKMAKTPELACEITLQPLHRFPLDAAILFSDILMIPDAMGLELHFIEGEGPRLGKPIRDAAAITQLAVPDMETELRYVMDAVRLIRKELDNSVPLIGFSGSPWTLACYMIEGGSSKEYAHIKAMAFNAPDVLHQLLNTVTNAVISYLAAQRAAGAQALQVFDTWGGILSPTMYRTFSLPYLTRIARELERGTGTERTPLVLFGKGNGPYIAELAMSGTEAVGVDWTIELEDAARRSNGQVALQGNLDPATLYGTPNNIAHEVQRTLDSYAAGNGGSREGHVFNLGHGMTPGMDPDHVSALVEAVQRLSRR

SEQ ID NO: 17580 - protein, 394 aa, Xylella fastidiosa
MTTLTPLRSVTVNNTYPYTIAIGPGLLHDPLRLAATIRGRHALILSDSEVAPRYAAQLQETLLRARPDLHLNVFTLPAGETSKSLENFSAAIAQLATLGATRDACLFALGGGVIGDLAGFTAACWMRGIDYVQVPTTLLAMVDSSVGGKTAVDIPQGKNMVGAFHPPRAVIADTDTLATLPLRELRAGLSEVIKYGAIRDPVFFHWLQTTREALLARDPAALAQAIARSCEHKADIVGRDPLEKGERVLLNLGHTFGHAIETAQGYSTPGSNNLNHGEAVAVGMVLAARLSNALSLAPAQDTETLKNLLDAYGLPTVLPSGLTPEMLLERMRLDKKNIAGRLRLVLWRGIGHAEAVSDVDEATVRQILANSTNQHTTYSPHQHATTKPPNRRPH

SEQ ID NO: 17581 - protein, 180 aa, Xylella fastidiosa
MNPAPNLVMIGPMGAGKSSIGRRIAKHFSLHFADTDHAIVERAGTNISAIFKYSGEPEFRRLEREVLHDLLNHENQLIATGGGTILDPENRRCMQERGFVVFLKINVNTQLERLAHDRYRPLLQQIDRKQVLSDLYATRQPLYQQIADMIVTTDHMSPNTATAQLILDLTAHWQKSSNAA

SEQ ID NO: 17582 - protein, 580 aa, Xylella fastidiosa
MSEITSTDARAQPEKKDFIRQIIREDLAHGTHTHIRTRFPPEPNGYLHIGHAKAICLDFGVAAEFGGHCTLRMDDTNPSKEDPAFAAAIQDDVSWLGFHWNALRHTSDYFEVLYLAAEKLITDGKAYVCDLNSEQVREYRGTLTEAGRPSPWRERSPDENLELFRQMRAGTFPDGTRTLRAKIDMASGNINLRDPALYRIKHVEHQNTGNTWPIYPMYDFAHALSDAIEGITHSLCTLEFEDHRPLYDWCVNHVDLPNNSHLLKPLLDKGFPQEPSQPRQIEFSRLNINYTVMSKRKLTALVDEKLVEGWDDPRMYTLQGLRRRGYTPAAMRLFVERIGISKQNSIIDFSVLENCLRENLDTIAPRRMATIAPLKLVLTNLPEDHEEQLIFPNHPKDDTQGTRTMPFSRELWIERDDFSEIPPKGWKRLVPGGEVRLRGAGIARVDEVVKNAAGDIIALHGWLDPTSRPGMEGAHRKVKGTIHWVSAPHAVAAEIRLYDRLFSVEKPDDNTDGKTYRDVLNPDSKRVVHGYIEPAAAQTAPEHAFQFERLGYFVTDRHDHDAAHPVFNRSVTLRDTWQRD

SEQ ID NO: 17583 - protein, 401 aa, Xylella fastidiosa
MIRPDLNERILSLRKLRLAQCRTRTRRTIERRNGVRLEINGSWLVEFCSNDYLGLAQHFEIIAALQDAAARDGIGATASHLICGHHAIHKALEYELAEWLGYPRALLFGNGFTANLAVQQALLTKENDICVQDRLNHASLIDATRLAGCRLRRYPHLDVDGAAHQLKNAPEGAAMLATDGIFSMDGDIAPLRALSLVARTQQALMYVDDAHGIGVTGPQGSGCVAAAWLSVEEVPLQLVTLSKALGGYGAALLGSATLIQHLAETARPYIYTTALPPAQAAAALTAIRIARRDEWRRQRLQELVERFRENSRRHGLEIMDSETPIQPLQCGDETTTMAMSAALEREGFLVNAIRPPTVPEGKSRLRVTLSALHTTEQIDTLVQALARSRDALATEAAPVQV

SEQ ID NO: 17584 - protein, 293 aa, Xylella fastidiosa
MNFVTTLTYLLPHRMLSSLARHVAYCQHPLIKQWLIDTVIAKFDVNLSEAAEPDAHAYPSFNAFFTRSLKTGIRLPDPNPDTLLMPADGRISQLGPIREGRIFQAKGQSFTATELLGDTAAAAAFTNGLFATVYLSPRDYHRVHMPCTGQLLKTVHVPGRLFSVGPDAVRQIPRLFARNERLACHFDTAFGPMVLVMVGALLVSGVETVWGGVEIPAYGDRITHKDYQGRNIAIERFAEMARFNYGSTVIVLLPPNVFTLAPHLTAESPVTLGQALAHRLSLNHSTQAPTQEK

SEQ ID NO: 17585 - protein, 374 aa, Xylella fastidiosa
MFMGANTFGKLLAVTTFGESHGPAIGCVIDGCPPGLELAAEEFAHDLQRRATGRSRHTSARREADEVEILSGVYEGRTTGTPIALLIRNTDQRSKDYATIARQFRPGHADYTYWQKYGIRDPRGGGRSSARETTMRVAAGVVAKKWLKQRYGVIVRGFLSQLGEIRPEGFAWDAVEDNPFFWPQAAQVPELEAYMDALRKSGNSVGARVDVVAEGVPPGWGEPIYGKLDGELAAALMSINAVKGVEIGAGFGSTVQKGTEHRDLMTPLGFLSNHAGGIIGGITTGQPIIVSIALKPTSSLRLPGETVDVDGHPVQVITKGRHDPCVGIRAPPIAEAMVALVLMDQALRHRAQCGDVGEMSPCILENVGFRNADD

SEQ ID NO: 17586 - protein, 344 aa, Xylella fastidiosa
MSSSKSDRCFNIAIVGATGAVGEAMLSILEERHFPVAKLIPLASARSAGSQITFKGESINVLELEHFDPHGVDIALFSAGSRVSEAYAPKFAAAGVVVIDNSSAFRYEEDVPLVVSEVNPHALKQRPRGIIANPNCSTMQLMPVLAPIHREYRIERINVATYQSVSGGGRSALEELGQQTAQLLAFKEINPQRFPVQIAFNLIPHIDDFQSNGYTKEEMKLIWETKKILEDSSIQVNPTAVRVPVFFGHSEAVNIETQKKVTPEQARALLASAPGVEVVDEWQPGGYPTPVTHASGKDPVFVGRIREDLSHPRGLNLWVVADNIRKGAALNAIQLAELVTGETI

SEQ ID NO: 17587 - protein, 229 aa, Xylella fastidiosa
MALAYGSECMNISPYRTRIKFCGMTRVGDVRLASELGVDAVGLIFASGSSRLLTVSAACAIRRTVAPMVNVVALFQNNSADEIHTVVRTVRPTLLQFHGEEEDAFCRTFNVPYLKAIPMAGAEAKRICTRTLYLKYPNAAGFIFDSHLKGGTGQTFDWSRLPIDLQHPFLLAGGITPENVFDAIAATVPWGVDVSSGIELQPGIKDGDKMRQFVEEVRRADGRRLFGVA

SEQ ID NO: 17588 - protein, 1478 aa, Xylella fastidiosa
MYCHAIFCNLRLMSVIEQNILGQLRQHRRAIDDAMTRDRGRLLGLWSRWQSQPRDHEARANFQRVLSASRAQRQVRENNQPVVTVDTRLPIAQEAERIVALMRAHPVVIIAGETGSGKTTQLPKLCLSAGRGIAGTIGCTQPRRIAARAVATRVAEELQTPLGMVVGFQVRFTEKVSDASRIKFMTDGILLAEVASDRWLSAYDTIIIDEAHERSLNIDFLLGYLKQLLKKRADLKVIVTSATIDTARFSKHFDDAPVIHVAGRTYPVEVRYRPLDAMWASDDRPGEPYGGTESPAVNRWVGGSGGDGALSKPIEVVPQEDQRTVNDAIVAVIDEITREDPHGDVLVFLPGEREIRELYRVLERRKYRETELLPLYARLSARDQDRVFNPGSGRRLVLTTNVAETSLTVPRIRYVIDPGYARVKRYSARQKLDRLYIEPISQASANQRAGRCGRIADGVCYRLYSEEDFLARSAFTDPEIRRSSLAGVILRMLQLGLGRIGGSAASLSEPVSGPEQQHTSWIIESFSFLEPPDERAVADGWQQLVELGAVDSQHALTAIGREMARLPVDVKLARMLVAARQHGCVYEMTVIAAFLGVQDPRERPPDAREAADNAHAKFADARSEFVGILRLWEAYRQIRGHMTQSKLRQWCQRHFLGFLHMREWCELQLQLSLLCAGEQAEQPRKGRVAAAFPKEGCLPSQRSKPGAEAGKVNELPSSATVLQALLAGQGTSTQSEHRGHTPSRGQLHRAARLARERSAVPKVTQNTQSVKAVAGQSVSHAGMQAQFAVPPNDAPHIGERERAAAYQALHRALLTGLPIQIGHRTEKGDFQAPRQRRFMLFPGSMLAKKPPPWVLAANLLDTQKVWGLTNAAIEPDWVIAELPHLLLRKHFNPYWSRTQGRVLVSEQISLFGLLLAPKKPMHYGRIDPVAAHDLFVRQGLVMGEINTRAGFVADNLKVLEQAHEEEAKLRRAGIVADEDWQARWYFDRVPSDIHTADALDSWWKGLPVEKRHGLYWSLIDLLPGEGGEEDRYPKYFALGDVRLPLHYSFDPGAVDDGVTLDVPLHLLNALDPVRLSWLVPGFVADKAAALIRSLPKALRRSYVPAPDFAHAFAQAFQQPSADEMRGELARFLSRITGVRVAAIDFDEQTLEPYLHLRVRLHDESGQVLAESRDFDALRARFGSHSGEAFVARAGRTLIMEELREFPAVSIPLQLTGEAGVPMYPALVDDGEMAVLRIFADPTEAAQVHPHGVRRLLEIALANKIKQARKQLPVSSKSGLLYAAIESKECLRDDLVKAALNAVLAHGLESIRDPVAFAQCRDVAAQQLFSEAMARLSLAEEILAAVAELKPLLEAPLMGWARGNLDDMERQLAQLVYPGFLRQTPADVLTQYPRYLKAMMMRSERAKRDPSRDQARMLELKPFLDALEVAMAQGVSDTPGWETLRWDVEELRVSLFAQELGVRSGISVKKLAQRLSTLR

SEQ ID NO: 17589 - protein, 332 aa, Xylella fastidiosa
MSIATTLHTALSLPQIQSFAASDMAAIDTLIHDRLTSDIVLINQIADHIICSGGKRLRPMLTMLAGHAIGPTGPHHHQLAAIIEFIHTATLLHDDVVDGSELRRSRSTANALWGNAPSVLVGDFLYSRSFQLMTELANLEVMQILAETTNRISEGEVLQLLHVHNPDTDETTYLRVIERKTAILFAAAAQLGALASHADTQTQTRMYEYGMQLGYAFQITDDVLDYTANNSQLGKNLGDDLAEGKATLPVIHAMTHSDAATCERLRMIISKGDRDAMPEVLNAIRTTGSLDYSRQRASAYAATAERALDGLLETEAVAALRGLARYAIQRTY

SEQ ID NO: 17590 - protein, 590 aa, Xylella fastidiosa
MPHSAHRPTPTLHTQMNVRLQGHGAARGAALGRAWVRQMNVMEIQDKYITDTNAELHSLYQAMSAARQEIQVLRERMHGTLSHEVGEFLDLHTLLIDDPELLRSPNELILTHNYSAEYALKIQRDRLTTEFEAMEDHYLKSRMDDLNHVLGRIHAFLKKHSPEPKDAAGEILICNNIAPSELAQVQAQGIIGIVIAAGNTLSHSAILAHSLHLPLIVGAGDLQLQKITNGDMLIIDGNSGEIIVNPSPQDLRHYHSRLRERAKEQRELEQLRSKHSRTRDNVDIVVQANAESPDDVSQAYALGAAGVGLYRTEFLFLQRNKLPDEEEQFQTYRDTVLRMNGRPVTIRTLDLGADKTDCTGLTLSNEENPAMGLRGIRLSMAHPAVANTQLRAILRTSTYGHVRILVPMISCREEIILLRKQIKALSIQLRTEGHDIAEQVPLGAMIEVPAAAIALNSFIKEIDFLSIGTNDLVQYLLAADRNNAAISEIYSPLHPGVLAVLAQIIVTAHTHATPVAICGEIAGDPHYVPMLLALGLTEFSLHPATLLEVRRAIRNSDLGALKTSATTLLHARDRKSIEEWMAAHANTTPT

SEQ ID NO: 17591 - protein, 425 aa, Xylella fastidiosa
MSKIVVAGGTPLCGDVRISGAKNAVLPILSATLLADAPVEISNVPYLHDVITMINLLRELGAGVTMNEGIEAKGRSITVDPRWVRQHMVPYDLVKTMRASVLLLGPLLACYGAAEVALPGGCAIGSRPVDQHIRGLQSLGAEITVENGYIKASVSQGRLKGGRFVFDVVSVTGTENLLMAAAVAQGTSVIENAAMEPEVVDLAECLIALGARIEGAGTPRIVVEGVERLKGGQYAVLPDRIETGTFLVATAMTGGRISMQQVRPQTLDAVLGKLTEAGACIEIGEDSIRLDMQGRRPCSVNLTTAPYPGFPTDMQAQFMALNCVAEGVGVIKETIFENRFMHVDELLRLGAKIQIEGHTAIVQGVERLSGAPVMATDLRASASLILAGLVAEGETIIDRIYHLDRGYENIEGKLGALGASIRRMT

SEQ ID NO: 17592 - protein, 411 aa, Xylella fastidiosa
MSAVSESVLSLSRYYLPVYRPCQVVLVRGQGSRVWDEQGRDYLDLAAGIAVCCLGHCDPDLVAALVEQAGRLWHTSNVFYSEPSLRLAQELVDVSRFAERVFLCSSGTEANEAAIKLVRKWAAAQGRLPEHRTIVTFHGSFHGRTLAAVTATAQPKYQEGYEPLPGGFRYVDFNHIEALEAAMVGGDVAAVMLEPIQGEGGVMPVVSGYLAQVRALCDRYGALLVLDEIQCGMGRTGTLFAYWQEEVVPDIVTLAKGLGGGFPIGAMLAGPKVAEVMQFGAHGTTFGGNPMAAAVARVALRKLASVEIAANVQRQSVALRAGLEEISEAFGGVFTQVRGRGLMLGAVLAPLYAGQASAILEVAVEHGVLLLQAGPDVLRFVPALNVSDEELADGLVRLRAALGDYVSRFGG

SEQ ID NO: 17593 - protein, 758 aa, Xylella fastidiosa
MFSKDLEQTIGQCYKRTREACHEFMTVEHLLLSLLDNPLAHAVLKACGADVARLKRDLEQAIEVSITRLDADDGRDTQPTLGFQRVLQRAVYHVQSSGKKEVTGANVLVAIFGEKDSHAVYFLNQQDISRLDIVNYLSHGITRMGDESDIGQAAENEAKGDSEANKGDALAEYAINLNEHARNGRIDPLVGRKDEIERTIQVLCRRRKNNPLYVGEAGVGKTAIAEGLAKRIVDRSVPEVLADAVIYSLDLGALVAGTKYRGDFEKRLKGVLSALRKTPNAVLFIDEIHTIIGAGSASGGTMDASNLIKPALASGELRCIGSTTFQEYRGIFEKDRALARRFQKIDIVEPTAGEAFEILQGLKPKYEAHHGVTYADDALRAAVDLSVKHIGDRLLPDKAIDVIDEAGARQRLLPEKERKELIDIEEIETIVTKMARVPAKQVSVSDKDVLKHLERNLKMVIFGQEPAIEMLSSAIKLARSGLGNPDKPIGNFLLAGPTGVGKTEVTKQLAHHLGIELVRFDMSEYMEPHSVSRLIGAPPGYVGFDQGGLLTEKIVKTPHCVLLLDEVEKAHMDVFNILLQVMDRGVLTDTNGREASFKNVILVMTTNAGASQSSRRTIGFTKQDHTSDAMEVICRSFSPEFRNRLDAIVQFQPLGFSHILRVVDKFIIELEMLLQEKRVVLSATPIARDWLAQHGFDPLMGARPMARVIQEKIKRPLADELLFGKLLNGGRVGIDVRDNELIVETYSEPERLFPATVE

SEQ ID NO: 17594 - protein, 245 aa, Xylella fastidiosa
MSDPSKVALITGGARRIGKAIVHHLHAHGYRVAVHAHQSGHELHAFLTELERTRPSSTLALLGDLHENAVPEMLIARCAGHFGRLDVLINNASNFYPTPLGEVTPAQWDDLFAINAKAPFFLAQAATPLLRKHRGAIINLTDLHGTQPLRRHAVYTAAKAALEMLTRSLALELAPQVRVNAIAPGAILWPTQGIAEAAKQALLARTPLARTGTVEEIAEAVLWLLESANFITGHTLRLDGGRTLT

SEQ ID NO: 17595 - protein, 448 aa, Xylella fastidiosa
MRVSRYFGTDGIRGRVGQGLISADFVLRLGNALGRVLAQGRDTRPMVLIGKDTRISGYMFESALEAGLVAAGADVQLIGPMPTPAIAFLTNTLRADAGVVISASHNPHDDNGIKFFSAMGEKLDDATEAAIEAAIEAPFLTVDSEYLGKVKRTRDAIGRYIEFSKASVPRGFTLRGLKLVLDCAHGATYHIAPMLFRELGAELVAIGVDPDGLNINAGVGSTHLETLAATVRESGADLGIAFDGDGDRVLMTDAQGRTVDGDDLLYVLARAWRASGRLKGTVVGTLMSNYGLEQALGTLGIPFIRAKVGDRYVHQALVESGGVLGGEASGHLLCLDRATTGDGIVSALQVLEVLRHEGLTLSQALLGLHKVPQKTVNVCWSGPARAAVEMPEVRQALVEAQAAVQGRGRVFLRPSGTEPVVRITVEADDVVLMQQTLDRLADVVRDAA

SEQ ID NO: 17596 - protein, 284 aa, Xylella fastidiosa
MGVESVRCPLHFTKMQGAGNDFVVLDLRDGTPPPDVALVAWLADRHFGIGCDQVIAIEPPRGVGVFAAYRIWNADGSAAQQCGNGARCVAAWLVRDGSVADEHFLIDSPVQAHLVRCIGKDEYAVEMGLPVFEPERIPLSGFPNACGEYVLSLQGEVLRCGAVSMGNPHAVVEVDLIDVAPVERIGSLLQQHVAFPESVNVGFVQVIDPGLVRLRVYERGAGETLACGSGACAAAVVLMQRGRVGRDVRVVLPGGTLRVQWPVSGGPVTLSGPAKCVFDGVWYG

SEQ ID NO: 17597 - protein, 671 aa, Xylella fastidiosa
MRANYTSGVESPVFPVSVLFMCLLIPRLFGLAAIVMVGCSNQPASMVPSPMSAHVVAVGKADTRRHDESSYAESDKVVIKHLALDLKLDFDKKTLAGTAAYSLDWKDKDAKQIVLDTRELSIEKIEADDGQGHLNQLKFALFPADKILGSKLVIETPAQPTQIRVTYRTAPSASGLQWMEPAMTEGKRLPFMFSQSQAIHARSWVPLQDTPGVRFTYTAHIVSRPDVMVLMSADNDPNAVRDGDYRFKMAEPIPSYLLAIAAGDLVFKPISARSGVWAEPMMVDKAAKEFEDTEKMIGTAETLYGQYRWGRYDMLVLPSSFPFGGMENPRLTFVTPTVIVGDKSLVSLIAHELAHSWSGNLVTNASWKDIWLNEGFTTYVQARITEALYGQTMADMERQVDQMDIFAALKDIPKADQTLVLSTLTKRDPDDALSPIAYVKGAWFLQFLEQRVGREVFDPFLRGWFDSHAFQSATSEDFVVYLKQHLLSKDPNAITAEELYSWLNAPGIPTIAQKVRSLSFANVDGARIAWSGSGLLPNSQVTDGWGTQQWVYFLSRMGETLKLEQLKQLDQAYHFTGTPNGEIAMRWYPLAIRSGYTAAWPEAGAFIGRVGRLKLILPIYAELSKTPKGLLFAKQIFAKFKSRYHPITIVSVESVLVREQVAQAAKASKGG

SEQ ID NO: 17598 - protein, 237 aa, Xylella fastidiosa
MTVLPALPPLDDLETLNVHLETLSAENRVCWALERGPDHPALSSSFGAQSAVMLHLLTRFAPDIPVILVDTGYLFPETYRFADTLTERLKLNLKVYQPLRSGAWTEARHGRLWEQGIDGINQYNTLHKVEPMRRALEELQVGTWFTGLRRGQSSTRTQTSIVQQRDERYKISPIADWTDRDIWEYMKHHDLPYHPLWEQGYVSIGDIHTTRPLEPGMREEDTRFFGFKRECGIHENI

SEQ ID NO: 17599 - protein, 586 aa, Xylella fastidiosa
MSPQTSLSILLHPGSPAPMSSSSIEDIKGKSHRLRGSLLESLANPTTGALHESDQTLIKYHGSYQQDDRDLREERRRQKLEPAYQFMIRTRTPGGVITPQQWLQLDAIATRYANHSLRVTTRQAFQFHGVIKRELKATMQAINAALIDTLAACGDVNRNVQVAANPLLSRAHADLYTDAAHLSEHLLPNTRAYYEIWLDEKKVAGAGEEEEPIYGPHYLPRKFKIGFAAPPINDVDVFANDLGFIAVIVDNTLLGYNVAIGGGMGTTHGDPDTWPRVGNIIGFITRADLIAISTAIVTTQRDFGNRTLRKRARFKYTIDDRGLDCIVGEIQQRAGITLQPARPFVFEHNGDRYGWIEGEDRHWHLTLSLPAGRIADTESSPLLSGFRAIAQLGIGQFRMTPNQNVVIAGISPGQRATIDALVTQYGLDTGNRAPTALARHAMACVALPTCGLAMAEAERYLPDFNVKLQPILEKYGLAEKPILLRISGCPNGCSRPYLAEIALVGKAPGRYNLMLGGDQRGQRLNTLYRENITETEILAALEPLLGRYQQKRLPGEGFGDFLHRTGIIALPPYPTHRHVISSTLQA

SEQ ID NO: 17600 - protein, 660 aa, Xylella fastidiosa
MIARMVNVKRAFDWSEASTSVDALPVPETVTYSDNKRMQSVIADLKQQEIKPLLRFITCGSVDDGKSTLIGHLLYDSQCLAEDQLADLMVDSQRYGTQGEHIDYALLLDGLAAEREQGITIDVAYRYFDTEKRKFIVADCPGHAQYTRNMATGASTADAAVVLVDARKGLLTQTRRHSYIVALLGIRHVVLAVNKMDLVGYDQETFEAIASDYLALAAKLGINQVQCIPLSALEGDNLSKRSARMPWYVGPSLLEYLEALEPADVDLAAAMCLPVQWVNRPDSQFRGFTGTLAAGRVRPGDAVVVLPSGCVSRVVRVFNGDTEVHEAVAGQAVTLTLADEIDISRGDVIAALDDPPEVADQVTAYVLWMDDTALLPGRRYWLKLGARMVAASVSDIKHRVDVNTQEQRVAQRLQLNEVGYCQLSLDAPVAFVPYARNRVLGSFILIDRHSNATVGAGTLDSGVHRASNVHWQPLDIDHVARARIKGQTPKVLWFTGLSGAGKSAIANIVDKRLHALGYHTFILDGDNVRHGLNRDLSFTVEDRVENIRRVAEVARLMVDAGLVVLVSFISPFRDERQLARERFAANEFVEVFVDVPLAVAEARDVKGLYAKARAGLITDFTGIDSPYEPPPHPELHLRADQGTPEQLASQVLSFLGVEAN

SEQ ID NO: 17601 - protein, 490 aa, Xylella fastidiosa
MTLQLNKNRKTAMSEHYDVVVIGAGPAGYHAAIRAAQLGLKVACVDAALGKDGKPALGGTCLRVGCIPSKALLDSSRQYWNMGHLFNEHGISFKDAKIDVATMIARKDKIVKQFTGGIAMLFKANKITPYYGFAQLQPGNVVKVKQHEGKNIELKGANVILAAGSDSVELPFATFDGETIVDNIGALDFIKVPKRLAVIGAGVIGLELGSVWKRLGAEVTILEAMPDFLAAVDADVAKTAAKEFKQQGLDIKLGAKVSRTEISSKNNKKEVIVTYTDASGKQTFTVDKLLVAVGRKAATKGLLADGTGVQLNERGQIVVDEHCHTGVDGVWAIGDCVRGPMLAHKGFEEGIAVAELIAGLPGHVNFETIPWVIYTEPEIAWVGKTEQELKANNIPYKAGSFPFAAVGRAVAMAEPSGFVKVLAHAETDRVLGLHLIGVNVSELVHEGVLAMEFSGSADDLARICHAHPTLSEAIHDAAMAVSKRAIHKAN

SEQ ID NO: 17602 - protein, 391 aa, Xylella fastidiosa
MTIEVKVPVLPESVSDATIASWHKKAGEIVKRDENIVDLETDKVVLEVPSPVDGVLKEIKFDTGSTVTSNQVLAIIEEGSIVAAPSPAPSPVIDQKPVAVSAPAAKSSVDSLPPGARFTATTEGIDPAQIEGSGRRGAVTKEDIINFAKQNGAARASGTRLEERVPMTRIRQRIAERLMQSKNSTAMLTTFNEINLAKVSNIRKELQEEFQKAHGIKLGFMSFFVKAAANALQRFPLVNASIDGTDIIYHGYSDISIAVSTDKGLVTPVLRNVERMSFADIEHHIADYAKKARDGKLSLEELQGGTFTVTNGGTFGSLLSTPIVNPPQSAILGMHTIKERPIAENGHIVIAPMMYVALSYDHRIIDGKDSVQFLVDIKNQLEAPGRMLFGL

SEQ ID NO: 17603 - protein, 967 aa, Xylella fastidiosa
MTLGRRLDISVHCRRSQSPSTRLSIVDNLIKQFTQSSPLAGGNAAYIEDLYEQYLVSPNSVDPKWKAYFDGFKGRDAGDIPHSAVIAHITDTAKQSVKAKSRQDASDERERNIGRLITAYRSRGHLSARIDPLGLTPPSNPPDLDLPFHHLSQADLDNEFSTGGIGGQPRMKLRNLLAHLKATYTDTIGTEFMHISEFEQRQWIYRRLENVGGKIASNATNRKRILERLTAAEGLERYLHTKYVGQKRFSLEGSDTLIPLMDTLVRQAGNNDVKDIVVGMAHRGRLNVLVNTLGKNPRKLFDEFEGKFEHAHHDRAHTGDVKYHMGFSADIAVGDGKQVHLALAFNPSHLEIVDPVVAGSVRSRQERFGDTERKTVLPILIHGDAAFAGQGVVMELLQMSQARGFAVGGTLHVIINNQIGFTTSARDDARSTPYCTDVAKMIGAPVFHVNGDDPDAVVFVAQLAYEFRQQFKKDVVIDLVCYRRWGHNEADEPAATQPVMYQTIRKHKTTRELYATKLEAEGVIAAGEAKAMVDDYRAKLDSGKFTTELASKHTDEFVIDWSKYLSGKLDDTVKTSVKRQTLNKLAALINTIPATVELHPRVAKIYEDRIKMAAGEQPGDWGFAENLAYATLLAEGHKLRLVGQDAGRGTFFHRHAILHDQKTDSYYLPLRQLVSNPDDATVIDSLLSEEAVMGFEYGYSTTDPNTLCIWEAQFGDFANGAQVVIDQFIAAGEVKWGRISGLSLFLPHGYEGQGPEHSSARLERFLQLCALENMLVCVPTTPAQAFHMIRRQMRMSTRKPLVVMTPKSLLRHKLAVSTLDELANGKFQHIIPDDAADPKHVKRIVMCAGKVYYDILENQQKRSQNDLAIIRIEQLYPFPRALLASELKRFNKATDVVWCQEEPQNQGAWYQIKHHLQAVLAHAQRLHYAGRSSSPSPAVGHMAEHMAEQESLVADALLNPFNDHLAE

SEQ ID NO: 17604 - protein, 473 aa, Xylella fastidiosa
MEMQMSNSDRYRIEHDSMGDLRVPIDALWGAQTQRAIENFPISGRSMPQGFIHALGFIKAAAAKVNAELGLLPKPMAKEIEAAALDVAAGRYDADFPVDIYQTGSGTSSNMNANEVIATLAMRATKEPIHPNDHVNLGQSSNDVVPTAIRISATLAVQGRLLPALKHLRKMINKRARGLGSVVKTGRTHLMDAMPLTFAQEFGAWSAQIVSAEARLNDTLKRLHRLPLGGTAIGTGINTDPHFGRNAVKVLSALTGIHFESANNKFEGLAAQDDLVELSGQFNALAVALMKIANDLRWMNAGPLAGLGEIELPALQPGSSIMPGKVNPVIPEAVVMVASQVIGHHTAVTVAGQSGNFQLNVTLPLIAYNLLESATLLGNVVMLLADKVIVGLKVRQDRVQEVLERNPILVTALNPIIGYEKAAVIAKRAYKEHRPVLEVACEESNLNPVELARLLDPTALTEGGIYVVGGGGG

SEQ ID NO: 17605 - protein, 450 aa, Xylella fastidiosa
MRVAIFGTGYVGLVTGTCLAEVGHEVLCVDINQAKVDGLNCGVIPIYEPGLEPMVKANHATGRLRFTTDSVAAIAHGEITFIAVGTPPDEDGAADLQYVLAVARTIGQCIDRSTIVVNKSTVPVGTADQVRAAIQHEMDVRGVDFKFEVVSNPEFLKEGDAVADCMRPDRIVIGARSRDAVVRMRRLYAPFNRNHDRIVEMDVRSAELTKYAANAMLATKISFMNEVANIAEYVGADIEYVRKGIGSDPRIGWYFIYPGVGYGGSCFPKDVKALARTAQQYGVDPKLLNAVEDVNHAQKGHLFELMLRHYGCSGESTVLAGKTFAVWGLAFKPNTDDMREAPSCRLLVQLWKAGAQVRAYDPEAMQEARRIFGERDDLVFCETAYAALQCADALIVVTEWKQFRSPDFFVIRDALKDAVIFDGRNLYDPQEIEEAGLAYYGIGRGRSLHA

SEQ ID NO: 17606 - protein, 338 aa, Xylella fastidiosa
MSVALSIDLSKKKTILCFGEALIDMLAQPPVKKGMPRAFLQCAGGAPANVAVAVARLGGAVQFVGMLGRDMFGDFLFDSFAEAGVVTDGIVRTSAAKTALAFVALDAHGERSFSFYRPPAADLLFRAEHFQDASFSDALIFHACSNSMTDADIAEVTFEGMRRAQAAGAIVSFDLNFRPMLWPNGENPASRLWKGLSLADVVKLSSEELDYLANTLAADANAVIQQLWQGRAQLLLVTDAAGPVHWYTRTARGQVPTFRVQVQDSNAAGDAFVGGMLYTFAQQFDDAAALIDFCHDPESIASMLRFAAAVGALAVTRHGAFTAMPMLSEVLSLIQEQS

SEQ ID NO: 17607 - protein, 224 aa, Xylella fastidiosa
MLETIEHETAPMPQWSVLWLHGLGADGHDFMPIIPELVRPHWPALRFVFPHASVRPITINNGVPMRAWYDLVSFDFNQRADQAGIEAAVAQVQALMMREQQRGIASERLFLAGFSQGGAVVLSIGLRCKASLAGLIALSTYLPDLNAVTTATGLLPGSNAQPLFIAHGHSDPVVPLVHGQCAAEALRKLGFAVDWYTYPMAHQVCQEEIQALADWLERRFAISS

SEQ ID NO: 17608 - protein, 305 aa, Xylella fastidiosa
MPLLRIATRKSLLAMWQSEYVAARLRMLRPDLDVVLVPMSTRGDEILDRSLAAIGGKGLFLKELELAMLRGDADCAVHSLKDVPMDLEPPFMLAAVLSRDDPADALISNVYLSLESLPIGARVATSSLRRQAQLRFYRPDLRLFDLRGNVNTRLAKLDNGDYDAIVLACAGLRRLGLEQRMTARLAPPEWLPAPGQGAIAVESLTEDARIGTLLAGLDDLPTRQCVVAERTMNRALHGSCHVPVGAYASYEVGGMRLQGLVGCVADGRLVRAELCSAKDEGDMLGRAVAQCLLDAGAAELLAATA

SEQ ID NO: 17609 - protein, 399 aa, Xylella fastidiosa
MPPIAITAFTATTAVGHGQAALNEALRTRRSGLRRNDFGVHPLKCWIGDVEGLETMTLPQALHPWECRNNRLAWLALQQDNFSEAVANARTRHGKTQMAVIMGTSTSSIGASEEAYTRLEYDAEGARFPDDLQRAVIHAPHSLGNFVQHATDLCGPCVTVATACSSSAKVFAQAARLITSGVVSAALVGGVDTLCGSVLFGFNALQLVSPEPCRPFDVHRAGLSLGEAGGFALLERLDLAPDADLLLCGYGESSDAYHMSAPHPEGLGARMAMQEALARANVDASEVGYLNLHGTASPANDSIEAVAIAALFPPTLHASSTKAWTGHTLGASGIVESTIALLALRGNILPGTMNSEQLDPVCGPQIRCENAHTPILYAMNNSFGFGGNNCALLFKRADA

SEQ ID NO: 17610 - protein, 255 aa, Xylella fastidiosa
MNPTYDFKGQVALVTGAAAGMGLATARGFAQGGASVVLADRDGERAAQEAAAIVAEGGTAIGLACDVSDEAQVAALVEKTVAEYGRLDFAFNNAGVMAKIAPFAEATSEEFDRVIGINLRGVWLCMKYELQQMQRQGSGVIVNNASVGALTGNVGIGAYIASKHGVLGLTRAAALEYCKKGIRVNAVNPGTIDTQIARDVVGGSDEAFAKLGASAPIGRAGRPEEIASAVLWLCSPGGSYVIGEGLTVDGGYVVP

SEQ ID NO: 17611 - protein, 291 aa, Xylella fastidiosa
MKLDASLSGQFAIGGDLTVNRLGFGAMRITGPDVWGEPEDHDEAIRVLKRLPEIGVDLIDTADSYGPFVSEQLIADALHPYGGIKIATKGSLVRYPGNSTNPSWPVIGDPAYLRQCVYMSLRRLKLEQIDLWQLHRIDPKVPRAEQFGAIREFIDEGLIRHAGLSQVSVEAIEEARKVFPVATVQNRYNLADRADEDVLDYCEANGIGFIPWFPLAAGDLAKPGGAVDALAKAKGATAGQIALAWLLKRSPVILPIPGTSKVAHLEENVAAAAITLSDEEFAELDAAAPRG

SEQ ID NO: 17612 - protein, 348 aa, Xylella fastidiosa
MNASGYAAYSPTEPLRPFSFERRAPRPDDVAIEILYCGVCHTDLHFARGHKGGTFPLVPGHEIVGRVTGVGSEVTRVQVGQVVGVGCMVDSCGHCAACDGGHEQHCLQGMTPTYNGTDRHDGSTTYGGYSDRIVVPEHFVLNVPDQLDLAGVAPLLCAGITTWSPLRRWKVGPGSRVAVVGLGGLGHMALKLAKAMGAEVTLFSRSPGKEADARRLGADHVVISTDAEQMAAIKGKYDLIVDTVPYDHDLNPYVPTLSFHGTLVLVGYMGPLDDKLNTLPVVFGGRAVAGSFIGGIPETQAMLDFCGEHGIVSDVELIRMQEIEDAYERMLRSDVKYRFVIDMASLKA

SEQ ID NO: 17613 - protein, 247 aa, Xylella fastidiosa
MIKDKVVIITGASSGIGEATAKLLASQGAKVVLGARRTDNLKRIADEIKQSGGQVAYQALDVTRQEDNDRIVKLAQDTFGRVDVIFLNAGLMPNSPLSALKTDDWHQMVDVNVKGVLNGVAAVLPAFTAQKSGHVITTSSVAGLKAYPGGAVYGGTKWFVRDFMEVLRMESAMEGTNIRTATIYPAAINTELLTTISDKTSREQMESTYDKYGISPDRIASIVAFAIDQPEDTTVNEFTVGPANQPW

SEQ ID NO: 17614 - protein, 349 aa, Xylella fastidiosa
MTVKAYGAYAADKPLESLDITRRAPGAHDVQIDIAYCGVCHSDLHQVRAEWAGTQFPCVPGHEIVGRVSAVGAHVSGFQPGDLVGIGCIVDSCKHCDDCAEGLENYCDEMVGTYNGPTPDAPGHTLGGYSQQIVVHERYVLRIRHDESQLAAVAPLLCAGITTYSPLRHWNAGPGKKVGVVGIGGLGHMGIKLAHAMGAHVVAFTTSESKRDAAMALGADEVVVSRNPGEMAAHGQSFDFILNTVAAPHDLNAFMTLLKRDGTMTPVGAPASPHPSPEVFNFILKRRSLAGSAIGGIPETQEMLDFCAEHNIVADIELIRAEEINDAYERMLKGDVKYRFVIDNASLAA

SEQ ID NO: 17615 - protein, 346 aa, Xylella fastidiosa
MIDSKQKIAVLGAGSWGTALAALVARHAYPTILWGRDVGVIQSIDIQRQNFRYLPSIMLPQTLRATTDLAAAVSGADWVLVAVPSYAFTETLRRLAPLLSTGVGVAWATKGFEPGSGRFLHEVAREILGGDAPLAVVTGPSFAKEVTLGLPTAVTVHGEYARFTQMVANAMHGPMFRAYTGNDVIGAELGGAMKNVLAVAIGVADGMQLGMNARAGLITRGLNEMLRLSAVIGARPETLMGLAGLGDLVLTCTGDLSRNRRLGFALGRGQSLSDAIREIGQVVESVQTSDEVMRQAEQHGVELPISEAVRAVLREEITPYAGMKALLAREQKPEYLDILFKANSSL

SEQ ID NO: 17616 - protein, 324 aa, Xylella fastidiosa
MSKRIYARIAGTGGYLPEKVLTNDDLAHIVDTSDEWIRTRTGIRERHIAAEGETTSDLAYEAAICALEAAEVRSADLDLIVVGTTTPDLIFPSTACLLQARLGAVGCGAFDVNAACSGFVYALSVAEKFVSSGCSKTVLVVGADTLTRIIDWSDRTTCVLFGDGAGAVVLKADEDTGILSTHLHADGSKKELLWDPVGVSVGFGEGKDCGALLMKGNEVFKYAVKALDRVVDETLEANHLDKHELDWLIPHQANLRIIEATARRLDMSMDQVVVTVDRHGNTSTASVPLALDEAIRSGRVQRGQLLLLEAFGGGFTWGSALLRY

SEQ ID NO: 17617 - protein, 332 aa, Xylella fastidiosa
MKILVTGGSGFLGEALCRGLLKRGYQVLSFQRSHYQALQALGVVQICGDLSDFHAVRHAVRGVDAVFHNAAKVGAWGSYTSYHQINVIGTQHVLDACRAENISKLVYTSSPSVIHRSNYPVEGLDADQVPYSNAVKVPYAATKAMAEQAVLAANSVDLTTVALRPRMIWGPGDPHLMPRLVARARAGRLRLIDDGRNLVDSTYIDNAAQAHFDAFEHLMPGAACAGKAYFISNGEPLQMRELINKLLAAANAPPVTQSLSFKTGYCIGAFCEMLWSLLPLLGEPLLTRFLVEQMSTPHWYSIEPAKRDFGYVPRVSIEEGLVRLLSETRVTG

SEQ ID NO: 17618 - protein, 249 aa, Xylella fastidiosa
MTRKLVLLRHGQSQWNSMNRFTGWVDIGLTEQGHQEATMAGHLMKEEGLEFDVAHTSLLKRAIHTLQDALKALDQDWLPIYKSWRLNERHYGALQGLDKIDTAAKHGEEQVNIWRRSYDIQPPPIDLDDPSHPMRDRRYAALDRKVLPVTESLKNTLERVLPYWNDAIAPQLNDNKTVLISAHGNSLRALYKYLNQESDEKILNVNIPTGIPLLFELSDTLQVVSYRYLGDPDAAQRASEMVANQGKAK

SEQ ID NO: 17619 - protein, 512 aa, Xylella fastidiosa
MAEIVDCFADRPIIVGSGLAGLIAALTMSPEPSVLVTRSALGAETSSAWAQGGMSVSLSPDDNPSLHLADTLAAGDGLCDAVAAESIILEALDAFHVLQHFGIHFDQDSNGHLALGLEAAHSRRRIVHVGGDRSGTAIVQALTACVLNDPSITVLEGLEARHILMADNVVCGLLLANPTSEIVLPSSRILLATGGIGGLYDATTNPVSNFGQGIAMAARAGAVLADMEFVQFHPTALHCHNRPLALVSEAVRGEGAVLINERGERFMADIPGAELAARNIVAQAISAEITRGGQVFLDARQALGARFSTRFPTITALCHKVGIDPVHMPIPVCPAAHYHMGGIAIDHQGRSSIPGLWVAGEAASTGLHGANRLASNSLLEAVVMGTRAARDITFHNTPHPLGTIPITPKKPDTTLIRPIVSQCLGVLRHAADMHRAIAALLPFVEGEEESSDPAIVALLIAIFAYLRTESRGAHARTDFPLKHDTTQRRHMTLEDVLEIAHSCVAQRKEKIS

SEQ ID NO: 17620 - protein, 264 aa, Xylella fastidiosa
MKMRIASWNVNSLNVRLSQLQQWLVEAAPDVLGLQETKLEDHQFPEAALAALGYVSVYAGQKTYNGVALLARVALEDVQVGIPGFEDVQRRVIAATVDGIRVVNLYVVNGQEVGTEKYAYKLSWLDAVYHWLAEELQRYPRLVVLGDFNIAPDARDVYDPQVWNEDHILTSTTERVALGKLLGLGLHDGFRLHHQDTGIFSWWDYRQASFRRNRGLRIDLTLVSEALRAQVVASGIDCVPRGWERPSDHAPAWIELALAVSSSP

SEQ ID NO: 17621 - protein, 666 aa, Xylella fastidiosa
MTKPTRRQLANAIRFLAADAVQAAHSGHPGMPMGMADIAEVLWNDFLRHNPNNPNWFNRDRFVLSNGHGSMLQYALLHLSGYDLPLDELKRFRQLHSKTAGHPERSETPGIETTTGPLGQGFANAVGFALAEKLLAQRYNRPEHLIVDHRTWVFMGDGCLMEGISHEAAALAGTWNLGKLICFWDDNNISIDGNTAGWFTEDTPARFEAYGWHVIRDIDGHDAEKIATAIQAAVAQENKPSLLCCRTVIGFGSPNKAGKESSHGAPLGAEELEATRKMLDWPYGPFEIPSEIYDGWRANGTGMLRQAEWEQGFDNYARQYPKEAAELTRRSHAELPTDFLSQLDAYIAKVHAAGPSIASRKASQMAIEAFAPFLPELIGGSADLAHSNLTLWKGSQTVVGDAPNANYAYYGVREFGMSAIANGLALHGGFIPFDATFLVFSDYARNAVRMSALIPAHVIHVYTHDSIGLGEDGPTHQPVEHLAALRYIPNNDVWRPCDAVESAVAWKAAITRKNGPSCLVFSRQNLPHQPRHDAQLEQIARGGYILVDAASSIPDIILIATGSEVSLAIEAKKTLDAMQLKTRVVSMPSTNVFERQDPTYRESVLPSKVHKRVAIEAGVTGFWWQYVGLHGAVIGLDTFGASAPADVLYKHFNITAEHVVEVAKAL

SEQ ID NO: 17622 - protein, 447 aa, Xylella fastidiosa
MLLSWLSSLPERLELMTSSAAASHSGLPMHWKMSIGFLGGLLIGLAAHYWVGADVVWVQHATHYLTTPFSKLFLNLIFMLIVPLMFSALVVGVAEMGDIRALGRIGWRTLGYTVVLSSVAVLVGLVLVNVLKPGVGVDPQLAQQLLSENAERSRQIVASTDTQIHGMDMLLSIVPSNVVAAASSNDAILSLMFFTIMFGIGMVLVPQEKVETLKRAIEGVFEVSMVLIGLVIRLAPYAVACFMFNLTSLFGLELLIRLAAYVGVVVLGLSLHMFVTYGLAVWWAGRSPLRFFRETQEATLMAFSTASSNATLPTALRVADEMKLPKQISRFVLTIGATANQNGTALFEGLTVIFLAQFFGVDLSFSQQAMVMAVCILGGIGTAGVPSGSLPVVALICAMVGIDPVGIGLILGVNHFLDMCRTALNVTGDLALTTLVCRGEPQPKGSV

SEQ ID NO: 17623 - protein, 216 aa, Xylella fastidiosa
MVLTIEALKHLWRLDESRVGRSEPLPLDNRHYVKGHPLCDAFTGLAQIQFGLGCFWGAERLFWQLPGVFSTAAGYAGGGVPYPTYREVCSGETGHAEVVLVVYDHTVISFEQLLQTFWESHDPTQGMRQGNDIGTQYRSVIHCTTSKQYAAASTSREVYQQQLNTAGYTAITTEILHPAPPFYYAENEHQQYLAKHPNGYCGLGGTGVTCPIRLQV

SEQ ID NO: 17624 - protein, 716 aa, Xylella fastidiosa
MAAAISLSLAGCSSKESSAIPEKTTTTPQVPVTTSNPLLTASSLPFQAPPFDKIKDSDYLPAFEEGMKQHLAEITKIAENPDAPTFENTIEMLEHSGTTLDRVSRVFFGLVHADTNDTRQKIQEEIAPKLAAHQDEIYLNPKLFTRIKSIYDQRDTLSLDPLQKRLVERDYEGFVHAGAQLPEADKTTLRKINVEESTLSTQFHAKLVAATAASAIVVDEKNKLDGLSEGDIAAAAEAAKARKLNDKYVLALQNTTQQPISASLKDRELRAQVLQASETRAEKGDANDTRQIVQRLTQLRAQKAKLLGFSNYAAYNLADQMAKTPEAALKLLNDTVPAATAKARKEAAEIQKLIDKQRVNTKANHFELVASDWDFYAEQVRKAKYNLDEEQIKPYFELDNVLQNGVFYAANQLYGITFKERKDIPTYHPDMKVYEVFDHDGSSLALFYTDYFKRDSKSGGAWMDVFVEQNAITGTKPVVYNVCNFTKPAPGQPALLSFKDVTTLFHEFGHALHGIFSKVKYPSLAGTSTSRDFVEFPSQFNEHWASDPKVFSHYAKHYQTGESMPQSLVDSIRKAKTFNQGYVTTEYLSAALLDLAWHTLPADAPLEDVEKFETDALKKYKVNLKEVPPRYRTSYFDHIWSGGYSASYYAYFWSEVLSDDAFEWFKQHGGLDRKNGDIFRDKILSRGNSIELGDLYRQFRGQNPSVQPLLDNRGLK

SEQ ID NO: 17625 - protein, 338 aa, Xylella fastidiosa
MLFNNVSIAGLAHIDAPCTLTSQEINARLQPMLERIGIKSDVFADIVGINARRLWNTNVQTSDVATMAARKALQDAGVAVDRIGLVVNTSVSRDYLEPSTASIVSGNLGVGEQCIAFDVANACLAFLNGMDIAGQMLERGDIDYALVVNAETANRVYEKTLERMSAPGVTEQEFREEMAALTLGCGAVAMVLARTALVPDAPQYKGGVTRSATEWNKLCCGNLDRMVTDTRLMLIEGIKLAKKTFVVAKQVLGWAVEELDQFVIHQVSRPHTEAFIKSFGIDPAKVMTIFREYGNIGPASVPIVLSKLKELGRLKKGDRIALLGIGSGLNCSMAEVVW

SEQ ID NO: 17626 - protein, 206 aa, Xylella fastidiosa
MLIMDHSKQQNASITQAQAEEAVRTLLRWAGEDPTREGLLDTPRRVVEAYGDWFSGYREDPHDYLQRTFEEISGYDELIVLRNITYESHCEHHMAPIIGKVHIGYLPNGKVVGISKLARVVESYARRFQIQEKMTAQIAACIQETLTPRGVGVVIEGAHACMTTRGIHKRGVSMVTSKMLGTFREDARTRAEFLQFIEVGTNVMDL

SEQ ID NO: 17627 - protein, 446 aa, Xylella fastidiosa
MNRIVKKHTGIAPAEYGRRRRQLMKMVGPQGIVVLPAAPERVRSRDTHYPYRQDSDFWYLCGFPEPDAVLVLVPGRCHGQVLLFCRERDPEREAWDGPRAGYDGAIEQYGMDDAYPIDDLDEILPGLLEGRSQVYYHFGRDVEFDLRLIGWVNRVRDQVRYAADSPHEFIDLGHLLHEQRLFKSYDEIVLLQCAADISVEAHLAALRYAHPGVSEYVLQAELERVFRAADSCPAYTSIVAAGANACVLHYRANAECSRDGDLVLIDAGAEYRGYAADITRTFPVNGRFSPAQRALYDLVGAAYNVALAQARPGLPYEAGHLAAVQTLTEGLLRLGLLHGTLEDNLADQSYKRFYRHKTGHWLGLDVHDVGDYRIDGESRLLEPGMVFTIEPGLYVLPDDTAVHPKWRGIGIRTEDDVLITEDGHCVLTGALPRSADEIEAEMAAVR

SEQ ID NO: 17628 - protein, 685 aa, Xylella fastidiosa
MRLFIAEKPSVAKAIAGELGVTGKGEGYIECGHDTITWCFGHMLEQAEPDAYISEDVPLNPKTGKKIWRVEELPIIPETWIMQPREDAKAQLEVIKRLLKKATEIVNAGDPDREGQLLVDEVLEYFDCHKSVQRFWVSAQDSVSVQRGLAALRSNTAYQGFANAARARSRADWLIGINFSRAYTLRAQRGGSRALLTIGRVQTPTLALVVMRDREIEAFKSIPYHTIRAAFKHEGGVFVAVWRAKEDQVGLDPEGRLVDTVIANTLVESITGHIGKVIEYKQEPKKKAQPRAYSLSDMTLLASNKFGYSAADVLEVCQSLYETHKLTSYPRTDCGYLPESQHADAPHVLEAIKHVYPEVAVLVDGANQNIKSKTWDDSKITAHHGIIPTMHKGSMANLSEKERNIYDLIVRVYLAQFYLQHEYLATTVTLEVAGERFDVGGKVVTRNGWRDVYIEAEEEAEGESESGSNNQALPNMQNGDVVSCVKATRIDAKTKAPSRFTEGTLTRAMENIHKYVTDAEHKKLLRDGDGIGTSATRASIISELKRRQFLEVKGKQIVSTTLGRSMIDALPEVVKSPVLTALYERMLLSIGEGRLEVDSFITKQEAFIREQIAKANDGALKLNGAKESPKVSETHKCMVCGKGLVRRIGKKTGTNFWSCSGYPTCSQTYPDAKGRPNYTIQHKET

SEQ ID NO: 17629 - protein, 645 aa, Xylella fastidiosa
MISLRHFAMRRGGRLLLSNVDITLHAGDRVGVVGRNGVGKSSLFAAIRGELEADKGNVELPGKLRIASVAQETPSLSDLALDFVLSGDDVVAEVLRVEAEANAREDWEAVAAAHQRLAEIGGYDAEARAGKLLHGLGFLTQTQRRAVSTFSGGWRVRLNLARALMMPSDLLLLDEPTNHLDMDAVFWLEQWLQKYPGTLLLISHDREFLDNVATHILHLHDGNAKLYVGGYTDFERQRAEQLRQQQIAFEKEQAERVHLQSFIDRFKAKASKAKQAQSRIKRLEKLAGTEAVRMEREFRITFAPPTKLPHSLITLRQVNCGYSVLSPSAPSDPPPVDTHAAAPSQQAVILHRVDFGLEAGDRIGLLGPNGAGKSTLVKTLVSDLAPLTGERIAHPDVRIGYFAQHTVESLHEGQSPIDHFRTLAPQAPIQSIRDFLGKWNFPGDRAFEPVDGFSGGERARLALSLIAWRQPNVLLLDEPTNHLDLEMREALAEALSDFDGAIVMVSHDRHLIGLVCDTFWRVADGVVEPFAGDLDQYAAWLRTRPAARGVRAKTEEANQPQAAVTAKSPASQLPVKKPVNQQKLLAAEKHVSELETLLAELDRKLADPANYANGEVMMRLGDEREQAARRLAEAEQAWLLLMDGG

SEQ ID NO: 17630 - protein, 258 aa, Xylella fastidiosa
MRLTPLPAFDNNYIWTLIAPDGRAIIVDPGQALPILEAHSKGLIPTAILLTHHHADHIGGVPELLERWPTLPIYAPHDTRIALNYHRIGEGDSLNILGLRFQVIHTPGHTHSHLTFIGNDLLFCGDTLFSLGCGQIFEGTPTQMLASLQRLAALPIQTRVCCGHEYTLSNAAFALHVDPTNTALQKRRQQANAMRLANLPTLPISLESELNTNPFLRTAAPTIHAATATHLQRTPIDEVEVFATLRHWKNNFPIKNIP

SEQ ID NO: 17631 - protein, 454 aa, Xylella fastidiosa
MHQTLPMLRLKTEPADLQHYGRDWTRRFTPAPLAIALPATVQEVQAIVRWANDAHIAIVPSGGRTGLSGGAMATNGELVLSLERMNKMLRFDPMDRTMTVQAGMPLEAVQAAARQHGLLYPVDFAARGSCSIGGTIATNAGGIRVVRYGNTREWIAGLNVVTGTGELLTLNHALIKNSSGYDFRHLMIGSEGTLGIVVEATLRLTDPPPPTKVMLLALPTFDVLMQVFAAFRAQLQIEAFEFFTQRALPHVLAHGAQAPFEHPYPYYVVTEFPCADATQETTALTVFETCMEQGWVLDGVISQSDAQAAQLWRLRESITESIAPYTPYKNDIAVRIAAMPAFLEQAQTLLSQAYPEFEVLWFGHIGDGNLHINVLKPHTVPQADFIHTCEHVTALLADLLQRFRGSISAEHGIGLIKKPYLHSTRSPAEIALMRQLKRAFDPKWILNPGKVFDP

SEQ ID NO: 17632 - protein, 483 aa, Xylella fastidiosa
MLKKHLFIVKPIEPTNHTGTGKGETQLKRSLTAGQLVMLGIGAVIGAGIFVLSGHAAAEYAGPAVVLSYILAGIACALAGLCYAEFAAMLPVSGSAYSYAYATLGEFTAWFIGWNLVLEYMFSASTVAVGWSGYLNSFLSSFGYGLPASLSSAPLDVVDGRLIYSGGLINLPAVAIVAAISGLCYVGITQSAFVNSITVAIKVSVIVLFIAFAARYVNPDNWVPFVPDNAAPGKYGMEGVIRGAAVVFFSYIGFDAVSTTAGEAKNPQRDMPIGILGSLAICTVIYIAFSGVLTGLMHYSQLDTPKPVATALETYPTLSWLKHVVEIGAIAGLSSTMLMMLMAQPRIFYAMSQDGLLPKLLSKVHPKFQTPHVGTLLVGACACTLAGLFPISLLGDLVSMGTLLAFATVCIGIVVLRRTRPDLPRPFRVPMYWVIAPAGAAACLYLFWQPFTEHWPLMVGWTVLGLVMYGLYGYHHSKLRRGG

SEQ ID NO: 17633 - protein, 477 aa, Xylella fastidiosa
MFKQLWATKLSQPSQDSAEGLSLQRVLGVWGLTALGIGAVIGGGIFVITGQAAANHAGPAIMLSFALAAICCTFCALAYAEFAAMVPVSGSAYTYTYATFGELAAWFIGWMLVLEYGVSAAAVAVSWSGYFLSLLQHLGIDLPAALVNAPLDGTLHATGAIANLPAATIVLLLTWLCYFGIRKSSKINIAMVALKSGLILLIIGVGWKYVNPDYWQPFIPPNQGPGKYGWDGVLHGASMVFFAYIGFEAVSVAAQESHRPQRDLPISMMSALAICTVLYIMMAAVMTGLVPYTQLGTDEPVVTAVAAHPQLGWLRVVVEIGALVGLSSVVLVMLIGQPRIFMIMAGDGLLPPIFSTIHSKHRTPHINTVITGLGIALLAAVFPLDVLGELTSMGTLIAFAAVCAGVLILRCTRPDLPRPFRMPAAWLFCSAGVLSCITLLSAMTRHNWMLMSVWTVLGFALYFGYGYRHSKLHREST

SEQ ID NO: 17634 - protein, 206 aa, Xylella fastidiosa
MCNEPATSDVALPDLDWAKGDGLLPVIVQDADTLRVLMLGYMNSQALEVTQRSRLVTFYSRSKQRLWTKGERSGHVLHLVAIDADCDADTLLVQARPRGPTCHLGRTSCFPAAPGQFLGALDALVAERERERPQDSYTTALFEQGVRRIAQKVGEEGVETALAGVVQVDDALLDESADLLYHLIVLLRARGLSLADAVTVLEARHR

SEQ ID NO: 17635 - protein, 257 aa, Xylella fastidiosa
MLSRRLIPCLDVRDGRVVKGVKFRDHVDMGDIVELALRYRDHGADELVFYDIGASPRGRSVDYRWVERVARLIDIPFCVAGGIGQVETARAVLHAGADKISINSPALRQPALISALAEAFGVQCVVVGIDSIREADGQWRVRCNTGDPDKTQALPLRTLDWIVEAQRLGAGEIVLNCMDSDGVRCGYDIAQLSQARALCQVPLVASGGAGNMQHFADVFHKADVDGALAASVFHSGAILIPGLKQFLREQQIEVRDV

SEQ ID NO: 17636 - protein, 375 aa, Xylella fastidiosa
MTPIVFIDRDGTLIEEPPDFQIDAYEKLRLVNGVIPALLKLRDAGYHFVIVTNQDGLGSPAYPQASFDGPNALMLQIFSSQGIVFRDVLIDRSWPTDNAPTRKPGIGLMVAYLQDRDIDWARSAMVGDRPTDLQFAENLNIRGFQLRTPQFGGDWDWDGIAHTLADAPRRAVVQRHTKETTIRVEIDLDGAPQARITTGLPFFDHMLEQIAKHAGISLQISAVGDLHIDEHHTIEDTGLALGQAVRQALGDKRGIGRYGFDPPQLPWQVSGAAAHGGFTLPMDETQASAVLDFSGRPYCVFEGTFVRERVGDMPTELVPHFFRSLCDASGMNLHLSVHGDNDHHKVEACFKALARALRQALQRHGHVLPSTKGAL

SEQ ID NO: 17637 - protein, 365 aa, Xylella fastidiosa
MNTQTPTVLDLVRQELRNFAGYSSARSVALTGDLWLNANESAWPNPADSHATMRRYPEPQPPKLRQMLAALYGCVPEQLLIGRGSDEGIDLLVRAVCEPGCDPVLVTPPVFGMYAVSAQLQNAPVIQVPLVDDAAGFHADVPAIITAAQTSRAKLVFLCSPSNPVGAAIPLQQIETILQTLAGTALVVVDEAYGEFSDVPSVVPLLARYPHLVVLRTLSKAHALAAVRIGSVIADAHLVAILRRCQAPYPLPTPCVSLAEQGLSAAALQVTAQRVAEIRAERERLGAALACLSGVRRVYPSQGNFLLVRFDDAEAALQALYAAGVVVRDQRAAPQLHDALRLTVGTPEQNTRLLAVLRDIQAVPA

SEQ ID NO: 17638 - protein, 431 aa, Xylella fastidiosa
MKIIDWNQLDTAAQAQTLTRPAQTIATQTREAVAALIEQVRRGGDTALRDITARLDGVDLATFEVTAAELAAAATAVAPELQHAMQTAAARIEAFHRAGMTNGYRVETAPGVVCERLVRPIARVGLYVPAGSAPLFSTALMLGVPARLAGCREVVLCTPPSKDGRANPAVLLAARLTGVTRVFTLGGAQAIAAMAYGTASVPTCDKVFGPGNSFVTEAKQQLAQAGVVAIDMPAGPSEVLVIADAAANPAFIAADLLSQAEHGPDSQVLLLSDSDALMTAVQTALALQLQQLSRAEIARQALAQSRLIKVATLETAFDISNRYAPEHLILALRQPRAWLHRVAAAGSVFLGDYTPEALGDYCSGTNHVLPTGGAARAYSGVSVSSFQNMISVQAASRSGIAEIGDCALTLARAEGLDAHANAVALRMGTVP

SEQ ID NO: 17639 - protein, 304 aa, Xylella fastidiosa
MSASTALPVRDRLRIAIQKSGRLTEPARRLLTACGLSWRQSRDKLFCYGESLPVDLLLVRDDDIPGLIAQGVCDLGIVGRNELDEQAASRRRNGLPVPYQTLRGLHFGQCRLMLAVPEEWEWQDISQLTGKRIATSYPAILTDWLQTHHIAAQIVELSGSVEIAPRLGTADLICDLVSSGATLAAHQLKPVIQIMESQAVLAGMIRQPADARAGLLAMLLRRMDGLLTLRDSNLLMFRAFQEHLDALTHLLPDADPLVQLPDDGSGTLRVQTMCHGTITWQRLEELERAGAQGLMVLTVERSLA

SEQ ID NO: 17640 - protein, 828 aa, Xylella fastidiosa
MSTVETPVYVPPTVVHKFGGTSVADADCYRHVARLLLAREETVQVTIVSAMKGVTDTLIALAEQAANHSPDWQALWQQTRTRHCDAAQALLGEHAGTLQNWLNTRFNELHEMLVALSVIRMLPSEVLDRLQGLGEVYSAQLLGQYLQAQGEDCVVLDARQVLVVSPGEFGAEVDWATSAQHLAHWRMQHPQRRVVVTGFVASDRTGRAITLGRNGSDYSGAIFAALFEADELHIWTDVDGVMSADPRVVPDAVQLDALSYDEACELAYFGAKVVHPQTMSPVMKRGVPIIIRNTFQPGHPGTRITADSVVSGSVKGLTLSPGLAVLNLEGTGLIGVPGTAERVFAALRNARLSVVMISQGSSEHSICCVVHQTEAERARDALLYAFAHELAIGHVQRVQLTNNISVLAAVGDGMAGHLGVAARLFESLRRAHVNILAIAQGSSERNISVAIDSQQATKALRAAHAAFWLSPQTFSIGVIGPGHVGEALLDQLCAAQQQLLSKANLDLRLRAIVSRRRMLLDERGLGSDWRHAFAAVPEAVDLDAFTAHLQAAHLPHAVIIDCSGSAEVADRYADWLAAGIHVVTPNKQAGSGPLHRYHAIRAAADASGARFRYEATVGAGLPVITTLRDLMDTGDSVTSIEGIFSGTLAWLFNKYDGSVPFSQLITQARAMGYTEPDPRDDLSGVDVARKLVILARDAGRDISLEDVAVESLVPETLCQLSVADFMARLNEVDATFAERLAAAKQRGCVLRYVAQLSPGHVPSVSLIELPSDHAFVNLRLTDNVVQFTTRRYSENPLVVQGPGAGPEVTAAGVFADLLRVAAGEGARL

SEQ ID NO: 17641 - protein, 322 aa, Xylella fastidiosa
MNLKAITLMQFDSNGRLRHLLTLEGLSRDTLLQLLDCAAQNCALGVDPMGKRNVLAGMAVCTLFFEPSTRTRHSFHLAAQRLGADVLNFDASMSSTSKGESACDTLKNLEAMGVRGFIVRHPEEIVIAQLAAVVGEGTVLINAGAGRSTHPTQALLDMLTLCQAKGNDFSKLKLLFVGDIKHSRVARSNLHALRTLGAGQIRVCGPTALLPHDGLLSGCVVSQDFDAMLEGVDVLMMLRLQRERMEEGLVPSLEHYHANYGLTAARLARAAPDAVVLHPGPINRGVEITDEVADGPQSWILRQASNGVMVRMAVLETLLGCA

SEQ ID NO: 17642 - protein, 781 aa, Xylella fastidiosa
MLYIYYLFKSLFFHTLFVFSIYKDCPYMRASSPETTSAVKCPFNKTAVEGTHNKDWWPNQLRVDLLHQHSNKSNPLGETFDYAKEFQKLDYAALKRDLHALMTDSQDWWPADFGHYGGLFIRMAWHSAGTYRIGDGRGGAGRGQQRFAPLNSWPDNVSLDKARRLLWPIKKKYGQQISWADLIVLSGNVALESMGFKTFGFAGGRVDTWEPDQDVYWGRETTWLGGDVRYGAVSEGVHHPDEHRGAKEKAAKNSDSRVLENPLAAVQMGLIYVNPEGPDGRPDPLASARDIRETFARMAMNDEETVALIAGGHTFGKTHGAAPADNVGPEPEAGELEQQGLGWHNRFGSGKAGDTITSGLEVTWTKTPTQWSNDFFEHLFGYEWELTKSPAGAYQWVAKNAAATIPHAHDPSKKLLPMMLTSDLALRFDPIYEKISRHFHAHPDQFADVFARAWFKLMHRDMGPRVRYLGPEVPVEELIWQDPVPKVSHVLVDAQDLLALKQKISASGLGISQLVSTAWASASTFRGSDKRGGANGGRLCLAPQSQWEVNQPQQLSVVLETLRRVQTEFNAQAGDKRISLADLIVLAGGVGVEQAAKRAGIVVEVPFVPGRTDALQEQTDVSSFAPLEPFADGFRNYVKGDEVVPSEHLLIDRAQLLTLTAPEMTVLIGGLRVLGANVGGVKHGVFTDRLGTLSNDFFINLLDMGTEWAPVSKERHVFEGRDRRTGVLKWTGTRVDLVFGSNALLRALAEFYAAVDAQEKFVRDFVAAWSKVMHLDRFDLV

SEQ ID NO: 17643 - protein, 293 aa, Xylella fastidiosa
MQFKDYYATLGVEPSAGEAEIKTAYRRLARKYHPDVSQEPGAEERFKAVNEAYEALRDPNKRAAYDQLRAQGYRPGEEFHAPPNFGGGHGFNFEEVFGNASGGHFSDFFESLFAGARAGGHHAGPGGGAKSQHGDTRAKLTVPLEAIYRGGSVRVTVNGRQLDVRVPKGIQPGKVIRLNGQGSYARHLLLEIEYAPHPQFEVDGHNILHTVQVTPWQAALGTSISVPTLGGSVELKVPPDSDAGRKLRLRGRGLPGPPPGDQIVELEITAPLATNETQRKAYRALAKAFGEKV

SEQ ID NO: 17644 - protein, 670 aa, Xylella fastidiosa
MRIRSVINVIFMLHRIACSGPLWGGQWCFRCNAKTMIDSTCYPRLSRIQIPEDLRTFQESELRAVADELRNYLIESVGLSGGHFAAGLGVVELTIALHYLYCTPIDHLVWDVGHQTYPHKILTGRRDKISTVKHQGGLAPFPKREESIYDTFGVGHSSTSISAALGMAIVAQRHGDERKVVAIIGDGAMTAGMAYEALNHAGGMSPAPNLLVILNDNRMSISEAVGGLTKMLGRATGSKALNAIREGGKRIFGDKKTNATARFLRRWEEHWKGMFVPSTLFEEMGFHYTGPIDGHDLPALLGALKTLRTLKGPQLLHVITTKGKGYELAEGDQIGYHAVAPFDPQKGLIKAGAKKQTYTDVFSEWLCDMAAVEPRLLAITPAMREGSGLVRFSQEYPQRYFDVAIAEQHAITLAAGMATQGAKPVVAIYSTFLQRGYDQLVHDVALQKLDVLFAVDRGGVVGPDGATHAGNLDLSFLRCVPNMMLMAPADEAECRKMLSTGFHYSGPVAVRYPRGTGPGVVPSAELDVLPVGVAQLRHSGTRIALLGFGVCVAPAEQVGRRLGLTVVNMRFIKPLDRTLLLELARTHEGFVTIEDNVVAGGAGSGVAELLNAEGIVLPIVHLGLPDAFQQHASREDLLAEAGIDAAGVYAALLSRWPDLAVQNHPLSAVS

SEQ ID NO: 17645 - protein, 647 aa, Xylella fastidiosa [sequence omitted]

SEQ ID NO: 17646 - protein, 333 aa, Bacillus subtilis
MKLLKREGLSLTEEKALWMYQKMLEIRGFEDKVHELFAQGVLPGFVHLYAGEEAVAVGVCAHLHDGDSITSTHRGHGHCIAKGCDLDGMMAEIFGKATGLCKGKGGSMHIADLDKGMLGANGIVGGGFTLACGSALTAKYKQTKNVSVCFFGDGANNQGTFHEGLNLAAVWNLPVVFVAENNGYGEATPFEYASACDSIADRAAAYNMPGVTVDGKDILAVYQAAEEAIERARNGGGPSLIECMTYRNYGHFEGDAQTYKTKDERVEHLEEKDAIQGFKNYLLKETDANKLSDIEQRVSESIEKAVSFSEDSPYPKDSELLTDVYVSYEKGGM

SEQ ID NO: 17647 - protein, 342 aa, Bacillus subtilis
MARVISMSDAINEAMKLAMRKDENVLLIGEDVAGGAAVDHLQDDEAWGGVLGVTKGLVQEFGRTRVLDTPISEAGYMGAAMAAASTGLRPIAELMFNDFIGTCFDQVINQGAKFRYMFGGKAQVPITVRTTYGAGFRAAAQHSQSLYGLFTSIPGLKTVVPSNPYDAKGLLLAAIEDNDPVFFFEDKTSYNMKGEVPEDYYTIPLGKADIKREGNDVTLFAVGKQVNTALEAAAQLSERGIEAEVLDPRSLSPLDEDAIFTSLEKTNRLIIIDEANPRCSIATDIAALVADKGFDLLDAPIKRITAPHTPVPFSPVLEDQYLPTPDKIVSVTLELLGEPALN

SEQ ID NO: 17648 - protein, 398 aa, Bacillus subtilis
MAVKVVMPKLGMAMKQGEVSIWNKKVGDPVEKGESIASIQSEKIEMEIEAPEKGTLIDIKVKEGEEVPPGTAICYIGDANESVQEEAGAPVAEDNMPQAVQPVKQENKPAASKKDRMKISPVARKIAEKAGLDLKQLKGTGPGGRIVKDDVTKALAEQKKDQAKPVSEQKAQEIPVTGMRKVIAARMQESLANSAQLTITMKADITKLATLQKQLSPTAEERYGTKLTITHFVSRAAVLALQAHPVLNSFYQNERIITHPHVHLGMAVALENGLVVPVIRHAEKLSLIELAQSISENAKKAREGRAGSEELQGSTFSITNLGAFGVEHFTPILNPPETGILGIGASYDTPVYQGEEIVRSTILPLSLTFDHRACDGAPAAAFLKAMKTYLEEPAALIL

SEQ ID NO: 17649 - protein, 458 aa, Bacillus subtilis
MTLAIIGGGPAGYAAAVSAAQQGRNVLLIDKGKLGGTCLNEGCIPTKSLLESANVLDKIKHADSFGIELPAGAISVDWSKMQSRKQQVVSQLVQGVQYLMKKNQIQVVKGTASFLSERKLLIEGENGKEIREADQVLIASGSEPIELPFAPFDGEWILDSKDALSLSEIPSSLVIVGGGVIGCEYAGLFARLGSQVTIIETADRLIPAEDEDIARLFQEKLEEDGVEVHTSSRLGRVDQTAKTAIWKSGQREFKTKADYVLVAIGRKPRLDGLQLEQAGVDFSPKGIPVNGHMQTNVPHIYACGDAIGGIQLAHAAFHEGIIAASHASGRDVKINEKHVPRCIYTSPEIACIGMTERQARSIYGDVKIGEFSFSANGKALIKQQAEGKVKIMAEPEFGEIVGVSMIGPDVTELIGQAAAIMNGEMTADMAEHFIAAHPTLSETLHEALLSTIGLAVHA

SEQ ID NO: 17650 - protein, 449 aa, Bacillus subtilis
MKKKSFSIVIAGGGSTFTPGIVLMLLDHLEEFPIRKLKLYDNDKERQDRIAGACDVFIREKAPDIEFAATTDPEEAFTDVDFVMAHIRVGKYAMRALDEQIPLKYGVVGQETCGPGGIAYGMRSIGGVLEILDYMEKYSPDAWMLNYSNPAAIVAEATRRLRPNSKILNICDMPVGIEDRMAQILGLSSRKEMKVRYYGLNHFGWWTSIQDQEGNDLMPKLKEHVSQYGYIPKTEAEAVEASWNDTFAKARDVQAADPDTLPNTYLQYYLFPDDMVKKSNPNHTRANEVMEGREAFIFSQCDMITREQSSENSEIKIDDHASYIVDLARAIAYNTGERMLLIVENNGAIANFDPTAMVEVPCIVGSNGPEPITVGTIPQFQKGLMEQQVSVEKLTVEAWAEKSFQKLWQALILSKTVPNARVARLILEDLVEANKDFWPELDQSPTRIS

SEQ ID NO: 17651 - protein, 604 aa, Bacillus subtilis
MLKDIRKPFQYPKLPIDKKEGAKKRAKAKDTKGTLRRIWSYLAERKGLLILVMLMVVISAIFGLLGPFVIGKAIDHFIVGKTVSGLIPVLLLLLAIYIIQSLSLWFQNYWMITISQGTVFRMRSELFTHLHELPIPFFDKQRHGELMSRVTNDIENVSSTLNTSVIQILSSVITFVGTIAVMLYMSPLLTLITLTIIPVMAASLKWITNRTGKLFKEQQKNLGDLNGYIEESVSGAKVIKAYSREKQITAEFLEKNAALKTSGFWAQTISGFIPKVMNSLNNLSFTMIAAIGGLFALKGWISIGSIVVFAEYSRQFTRPLNDLANQFNTMLSAIAGAERVFDVLDEKEEREDEKNAVHQPIQTGSIEFRDVSFGYDKGQQTLKHLQFTVPAGQSIAFVGPTGAGKTTVTNLLARFYEPNDGKILIDGTDIKTLTRASLRKNMGFVLQDSFLFQGTIRENIRYGRLDASDQEVEAAAKTANAHSFIERLPKGYDTVLTQNGSGISQGQKQLISIARAVLADPVLLILDEATSNIDTVTEVNIQEALARLMEGRTSVIIAHRLNTIQRADQIVVLKNGEMIEKGSHDELIRQKGFYSDLYESQFEK

SEQ ID NO: 17652 - protein, 482 aa, Bacillus subtilis
MSTKKKEAVIGKESLAHKGLLRTITLVSTFGGLLFGYDTGVINGALPFMATAGQLNLTPVTEGLVASSLLLGAAFGAMFGGRLSDRHGRRKTILYLALLFIAATLGCTFSPNASVMIAFRFLLGLAVGCASVTVPTFLAEISPAERRGRIVTQNELMIVIGQLLAYTFNAIIGSTMGESANVWRYMLVIATLPAVVLWFGMLIVPESPRWLAAKGRMGDALRVLRQIREDSQAQQEIKEIKHAIEGTAKKAGFHDFQEPWIRRILFIGIGIAIVQQITGVNSIMYYGTEILREAGFQTEAALIGNIANGVISVIAVIFGIWLLGKVRRRPMLIIGQIGTMTALLLIGILSIVLEGTPALPYVVLSLTILFLAFQQTAISTVTWLMLSEIFPMHVRGLGMGISTFCLWTANFLIGFTFPILLNHIGMSATFFIFVAMNILAILFVKKYVPETKGRSLEQLEHSFRQYGRRADQEIQNQTTHLS

SEQ ID NO: 17653 - protein, 250 aa, Bacillus subtilis
MEQNKCALVTGSSRGVGKAAAIRLAENGYNIVINYARSKKAALETAEEIEKLGVKVLVVKANVGQPAKIKEMFQQIDETFGRLDVFVNNAASGVLRPVMELEETHWDWTMNINAKALLFCAQEAAKLMEKNGGGHIVSISSLGSIRYLENYTTVGVSKAALEALTRYLAVELSPKQIIVNAVSGGAIDTDALKHFPNREDLLEDARQNTPAGRMVEIKDMVDTVEFLVSSKADMIRGQTIIVDGGRSLLV

SEQ ID NO: 17654 - protein, 589 aa, Bacillus subtilis
MIKREGESTVGVMKRYMQFVKPYKKQIFVTVLIGIVKFSIPLALPLLLKYVVDDIIQGGGTASDKTTSLFTIMAIMFALFLILRPPVEYYRQYFAQWTASKVLYDIRAKLFDHIQKLSLRFYANTRTGEVISRVINDVEQTKDFVITGLMNIWLDMLTILIVISIMLTLDVKLTLISIVLFPLYGISVKYFYGRLRKLTRERSQALAQVQGHLHERIQGMPVIRSFAIEDHEQAQFNEKNGHFLDKAIRHTNWNAKTFAVVNTITDLAPLIVIACAGYFVINGPLTVGTMVAFVGYIDRMYNPVRRLINSSTTLTQSIASMDRVFEFIDEPYELTDKPNAIKADQIRGGVEFQNVSFQYEKDKENILHDVSLKVNRGETVALVGMSGGGKSTLVSLIPRFYDVTSGRLLIDGTDIRDYEARSLRNQVGMVLQDTFLFSETIRENIAIGKPDATLEEIIEAAKAANAHEFIMSFPEGYETRVGERGVKLSGGQKQRISIARVFLKNPPLLILDEATSALDLESEHYIQEAMDKLAKDRTTFVVAHRLSTITHADKIVVMENGTIIEIGTHDELMDYESQYKHLFTIQNLN

SEQ ID NO: 17655 - protein, 392 aa, Bacillus subtilis
MEKASGAYFWDVDGNKYIDYLAAYGPIITGHAHPHITEAIKKAAENGVLYGTPTKHEVTFAKMLKEAIPAMDKVRFVNSGTEAVMTTIRVARAYTGRTKIIKFAGCYHGHSDLVLVAAGSGPSTLGTPDSAGVPKSIANEVITVPFNDIDSYKAALEKWGSEIAAVLVEPIVGNFGIVEPKEGFLEQVNELTHNAGALVIYDEVITAFRFMYGGAQDLLQVKPDLTALGKIIGGGLPIGAYGGKQEIMEQVAPLGPAYQAGTMAGNPASILSGIACLEVLKEKGVYEKLDHLGAMLEEGIMKHAETHGITITVNRLKGALTVYFSDEKVENYEQAERSDGETFSTFFKLMLERGINLAPSKYEAWFITTAHTEQDIKDTLTAVEDAFKHLKN

SEQ ID NO: 17656 - protein, 483 aa, Bacillus subtilis
MSSNKLTTSWGAPVGDNQNSMTAGSRGPTLIQDVHLLEKLAHFNRERVPERVVHAKGAGAHGYFEVTNDVTKYTKAAFLSEVGKRTPLFIRFSTVAGELGSADTVRDPRGFAVKFYTEEGNYDIVGNNTPVFFIRDAIKFPDFIHTQKRDPKTHLKNPTAVWDFWSLSPESLHQVTILMSDRGIPATLRHMHGFGSHTFKWTNAEGEGVWIKYHFKTEQGVKNLDVNTAAKIAGENPDYHTEDLFNAIENGDYPAWKLYVQIMPLEDANTYRFDPFDVTKVWSQKDYPLIEVGRMVLDRNPENYFAEVEQATFSPGTLVPGIDVSPDKMLQGRLFAYHDAHRYRVGANHQALPINRARNKVNNYQRDGQMRFGDNGGGSVYYEPNSFGGPKESPEDKQAAYPVQGIADSVSYDHYDHYTQAGDLYRLMSEDERTRLVENIVNAMKPVEKEEIKLRQIEHFYKADPEYGKRVAEGLGLPIKKDS

SEQ ID NO: 17657 - protein, 274 aa, Bacillus subtilis
MGAFLFFLKAGLAIKRGIKLAVTISIKEKAFVQEGRKNTVLENIELSIAPGEFLTLIGPSGCGKSTLLKIIAGLDSEYDGSVEINGRSVTAPGIQQGFIFQEHRLFPWLTVEQNIAADLNLKDPKVKQKVDELIEIVRLKGSEKAYPRELSGGMSQRVAITRALLREPEVLLLDEPFGALDAFTRKHLQDVLLDIWRKKKTTMILVTHDIDESVYLGNELAILKAKPGKIHKLMPIHLAYPRNRTTPDFQAIRQRVLSEFEKTEDLEYAEGSGI

SEQ ID NO: 17658 - protein, 220 aa, Bacillus subtilis
MIKALIFDFDGLILDTETHEYEVLQEIFEEHGSVLPLSVWGKVIGTAAGFRPFEYLEEQIGKKLNHEELTQLRRERFAKRMESEKARPGVEAYLNAAKDLGLKIGLASSSDYKWVSGHLKQIGLFDDFEVIQTADDVEEVKPNPELYLLAAKNLGVSPAECLAFEDSVNGSIAAKRAGMKCVIVPNKVTGTLMFEDYDHRLESMAEMELALLLDHLNSQN

SEQ ID NO: 17659 - protein, 450 aa, Bacillus subtilis
MEMMGMENIQQNQGLKQKDEQFVWHAMKGAHQADSLIAQKAEGAWVTDTDGRRYLDAMSGLWCVNIGYGRKELAEAAYEQLKELPYYPLTQSHAPAIQLAEKLNEWLGGDYVIFFSNSGSEANETAFKIARQYHLQNGDHSRYKFISRYRAYHGNTLGALSATGQAQRKYKYEPLSQGFLHAAPPDIYRNPDDADTLESANEIDRIMTWELSETIAGVIMEPIITGGGILMPPDGYMKKVEDICRRHGALLICDEVICGFGRTGEPFGFMHYGVKPDIITMAKGITSAYLPLSATAVKRDIFEAYQGEAPYDRFRHVNTFGGSPAACALALKNLQIMEDEQLIQRSRDLGAKLLGELQALREHPAVGDVRGKGLLIGIELVKDKLTKEPADAAKVNQVVAACKEKGLIIGKNGDTVAGYNNVIHVAPPFCLTEEDLSFIVKTVKESFQTI

SEQ ID NO: 17660 - protein, 496 aa, Bacillus subtilis
METYILSLDQGTTSSRAILFNKEGKIVHSAQKEFTQYFPHPGWVEHNANEIWGSVLAVIASVISESGISASQIAGIGITNQRETTVVWDKDTGSPVYNAIVWQSRQTSGICEELREKGYNDKFREKTGLLIDPYFSGTKVKWILDNVEGAREKAEKGELLFGTIDTWLIWKMSGGKAHVTDYSNASRTLMFNIYDLKWDDQLLDILGVPKSMLPEVKPSSHVYAETVDYHFFGKNIPIAGAAGDQQSALFGQACFEEGMGKNTYGTGCFMLMNTGEKAIKSEHGLLTTIAWGIDGKVNYALEGSIFVAGSAIQWLRDGLRMFQDSSLSESYAEKVDSTDGVYVVPAFVGLGTPYWDSDVRGSVFGLTRGTTKEHFIRATLESLAYQTKDVLDAMEADSNISLKTLRVDGGAVKNNFLMQFQGDLLNVPVERPEINETTALGAAYLAGIAVGFWKDRSEIANQWNLDKRFEPELEEEKRNELYKGWQKAVKAAMAFK

SEQ ID NO: 17661 - protein, 555 aa, Bacillus subtilis
MMNHQFSSLERDRMLTDMTKKTYDLFIIGGGITGAGTALDAASRGMKVALSEMQDFAAGTSSRSTKLVHGGLRYLKQFEVKMVAEVGKERAIVYENGPHVTTPEWMLLPFHKGGTFGSFTTSIGLRVYDFLAGVKKSERRSMLSAKETLQKEPLVKKDGLKGGGYYVEYRTDDARLTIEVMKEAVKFGAEPVNYSKVKELLYEKGKAVGVLIEDVLTKKEYKVYAKKIVNATGPWVDQLREKDHSKNGKHLQHTKGIHLVFDQSVFPLKQAVYFDTPDGRMVFAIPREGKTYVGTTDTVYKEALEHPRMTTEDRDYVIKSINYMFPELNITANDIESSWAGLRPLIHEEGKDPSEISRKDEIWTSDSGLITIAGGKLTGYRKMADDIVDLVRDRLKEEGEKDFGPCKTKNMPISGGHVGGSKNLMSFVTAKTKEGIAAGLSEKDAKQLAIRYGSNVDRVFDRVEALKDEAAKRNIPVHILAEAEYSIEEEMTATPADFFVRRTGRLFFDINWVRTYKDAVIDFMSERFQWDEQAKNKHTENLNKLLHDAVVPLEQ

SEQ ID NO: 17662 - protein, 565 aa, Bacillus subtilis
MTWRKSYERWKQTEHLDLELKERLIELEGDEQALEDCFYKDLEFGTGGMRGEIGAGTNRMNIYTVRKASAGFAAYISKQGEEAKKRGVVIAYDSRHKSPEFAMEAAKTLATQGIQTYVFDELRPTPELSFAVRQLNAYGGVVVTASHNPPEYNGYKVYGDDGGQLPPKEADIVIEQVNAIENELTITVVRYDKVYTEKLTSISVHPELSEEVDVKVVFTPLHGTANKPVRRGLEALGYKNVTVVKEQELPDSNFSTVTSPNPEEHAAFEYAIKLGEEQNADILIATDPDADRLGIAVKNDQGKYTVLTGNQTGALLLHYLLSEKKKQGILPDNGVVLKTIVTSEIGRAVASSFGLDTIDTLTGFKFIGEKIKEYEASGQYTFQFGYEESYGYLIGDFARDKDAIQAALLAVEVCAFYKKQGMSLYEALINLFNEYGFYREGLKSLTLKGKQGAEQIEAILASFRQNPPQKMAGKQVVTAEDYAVSKRTLLTESKEEAIDLPKSNVLKYFLEDGSWFCLRPSGTEPKVKFYFAVKGSSLEDSEKRLAVLSEDVMKTVDEIVESTAK

SEQ ID NO: 17663 - protein, 366 aa, Bacillus subtilis
MVHYGLKGITCVETSISHIDGEKGRLIYRGHHAKDIALNHSFEEAAYLILFGKLPSTEELQVFKDKLAAERNLPEHIERLIQSLPNNMDDMSVVRTVVSALGENTYTFHPKTEEAIRLIAITPSIIAYRKRWTRGEQAIAPSSQYGHVENYYYMLTGEQPSEAKKKALETYMILATEHGMNASTFSARVTLSTESDLVSAVTAALGTMKGPLHGGAPSAVTKMLEDIGEKEHAEAYLKEKLEKGERLMGFGHRVYKTKDPRAEALRQKAEEVAGNDRDLDLALHVEAEAIRLLEIYKPGRKLYTNVEFYAAAVMRAIDFDDELFTPTFSASRMVGWCAHVLEQAENNMIFRPSAQYTGAIPEEVLS

SEQ ID NO: 17664 - protein, 289 aa, Bacillus subtilis
MNPMDRQTEGQEPQHQDRQPGIESKMNPLPLSEDEDYRGSGKLKGKVAIITGGDSGIGRAAAIAFAKEGADISILYLDEHSDAEETRKRIEKENVRCLLIPGDVGDENHCEQAVQQTVDHFGKLDILVNNAAEQHPQDSILNISTEQLEKTFRTNIFSMFHMTKKALPHLQEGCAIINTTSITAYEGDTALIDYSSTKGAIVSFTRSMAKSLADKGIRVNAVAPGPIWTPLIPATFPEEKVKQHGLDTPMGRPGQPVEHAGAYVLLASDESSYMTGQTIHVNGGRFIST

SEQ ID NO: 17665 - protein, 465 aa, Bacillus subtilis
MKGSVFRKKSIQDLIAATSGEKSLKRELGAFDLTLLGIGAIIGTGIFVLTGTGAVTAGPGLTISFVVAALACLFAALSYAEFASSVPVSGSVYTFTYATLGELMAFIIGWDLILEYMLAVSAVSVGWSGYFQSFLSGLGIHLPVALTAAPGAVKGTFTLFNLPAFVIVMAITYLLYLGIKESKRVNNIMVILKILVVLLFIAVAAVYVKPHNWQPFMPMGFGGVFSAAALVFFAFIGFDAVSSAAEETKNPAKDLPKGIIFSLLVCTILYVTVSAIMTGVIPFAQFAGVDHPVSLVLQSAGQNWVAGIIDIGAVLGMTTVMLVMLYGQTRVMFAMSRDGLVPGSLSKVHPKHKTPYVATWFFGTMSALLGSLVPLDELAKLVNIGTLSAFVLISVAVIVLRKKQPDLPRAFKCPGVPVIPGLAILFCLFLILNLGWVTIVRFLVWLLIGLVIYFLYSRKHSKLNQ

SEQ ID NO: 17666 - protein, 331 aa, Bacillus subtilis
MEYTSIADTGIEASRIGLGTWAIGGTMWGGTDEKTSIETIRAALDQGITLIDTAPAYGFGQSEEIVGKAIKEYGKRDQVILATKTALDWKNNQLFRHANRARIVEEVENSLKRLQTDYIDLYQVHWPDPLVPIEETAEVMKELYDAGKIRAIGVSNFSIEQMDTFRAVAPLHTIQPPYNLFEREMEESVLPYAKDNKITTLLYGSLCRGLLTGKMTEEYTFEGDDLRNHDPKFQKPRFKEYLSAVNQLDKLAKTRYGKSVIHLAVRWILDQPGADIALWGARKPGQLEALSEITGWTLNSEDQKDINTILENTISDPVGPEFMAPPTREEI

SEQ ID NO: 17667 - protein, 585 aa, Bacillus subtilis
MFSVLKKLGWFFKAYWLRYTIAIVLLLAVNVIEMFPPKLLGNAIDDMKAGAFTAEGLLFYIGIFFVLTAAVYIMSYFWMHQLFGGANLMEKILRTKLMGHLLTMSPPFYEKNRTGDLMARGTNDLQAVSLTTGFGILTLVDSTMFMMTIFLTMGFLISWKLTFAAIIPLPVMAIAISLYGSKIHERFTEAQNAFGALNDRVLESVSGVRVIRAYVQETNDVRRFNEMTADVYQKNMKVAFIDSLFEPTVKLLVGASYLIGLGYGAFLVFRNELTLGELVSFNVYLGMMIWPMFAIGELINVMQRGNASLDRVNETLSYETDVTDPKQPADLKEPGDIVFSHVSFTYPSSTSDNLQDISFTVRKGQTVGIAGKTGSGKTTIIKQLLRQYPPGEGSITFSGVPIQQIPLDRLRGWIGYVPQDHLLFSRTVKENILYGKQDATDKEVQQAIAEAHFEKDLHMLPSGLETMVGEKGVALSGGQKQRISIARALMANPEILILDDSLSAVDAKTEAAIIKNIRENRKGKTTFILTHRLSAVEHADLILVMDGGVIAERGTHQELLANNGWYREQYERQQLFTAEEGGAGA

SEQ ID NO: 17668 - protein, 673 aa, Bacillus subtilis
MKIGKTLWRYALLYRKLLITAVLLLTVAVGAELTGPFIGKKMIDDHILGIEKTWYEAAEKDKNAVQFHGVSYVREDRLQEPVSKAKEAHIYQVGMAFYFVDQAVSFDGNRTVSDGKLTITNGDKSRAYAAEKLTKQELFQFYQPEIKGMVLLICLYGGLLVFSVFFQYGQHYLLQMSANRIIQKMRQDVFSHIQKMPIRYFDNLPAGKVVARITNDTEAIRDLYVTVLSTFVTSGIYMFGIFTALFLLDVKLAFVCLAIVPIIWLWSVIYRRYASYYNQKIRSINSDINAKMNESIQGMTIIQAFRHQKETMREFEELNESHFYFQNRMLNLNSLMSHNLVNVIRNLAFVCLIWHFGGASLNAAGIVSIGVLYAFVDYLNRLFQPITGIVNQFSKLELARVSAGRVFELLEEKNTEEAGEPAKERALGRVEFRDVSFAYQEGEEVLKHISFTAQKGETVALVGHTGSGKSSILNLLFRFYDAQKGDVLIDGKSIYNMSRQELRSHMGIVLQDPYLFSGTIGSNVSLDDERMTEEEIKNALRQVGAEPLLKKLPKGINEPVIEKGSTLSSGERQLISFARALAFDPAILILDEATAHIDTETEAVIQKALDVVKQGRTTFVIAHRLSTIRNADQILVLDKGEIVERGNHEELMALEGQYYQMYELQKGQKHSIA

SEQ ID NO: 17669 - protein, 298 aa, Bacillus subtilis
MLTIDHVTKTFGDYKAVDGLDLDIPEQQMFGLLGANGAGKTTTFRMILGLLSITEGSISWKGRPVNYHISNKIGYLPEERGLYPKMKVRDQLVYLARLKGMEKREAVKELGTWLERFNITDYENKKVEELAKGNQQKIQFISAVLHKPELLILDEPFSGLDPVNVELLKEAVISLKNSGVSILFSSHRMEHVEELCENLCILQKGKPVVQGKLKEIKRSFGKKNVTIHSDDDLRFLQSHEGILQWKETADGVKLQIANEDISQEIFAMLQGKGFIRKFELEEPSLHDIFIEKVGAVYE

SEQ ID NO: 17670 - protein, 359 aa, Bacillus subtilis
MERTTNFNAGPAALPLEVLQKAQKEFIDFNESGMSVMELSHRSKEYEAVHQKAKSLLIELMGIPEDYDILFLQGGASLQFSMLPMNFLTPEKTAHFVMTGAWSEKALAETKLFGNTSITATSETDNYSYIPEVDLTDVKDGAYLHITSNNTIFGTQWQEFPNSPIPLVADMSSDILSRKIDVSKFDVIYGGAQKNLGPSGVTVVIMKKSWLQNENANVPKILKYSTHVKADSLYNTPPTFAIYMLSLVLEWLKENGGVEAVEQRNEQKAQVLYSCIDESNGFYKGHARKDSRSRMNVTFTLRDDELTKTFVQKAKDAKMIGLGGHRSVGGCRASIYNAVSLEDCEKLAAFMKKFQQENE

SEQ ID NO: 17671 - protein, 353 aa, Bacillus subtilis
MSKRETFNETFLKAARGEKADHTPVWYMRQAGRSQPEYRKLKEKYGLFEITHQPELCAYVTRLPVEQYGVDAAILYKDIMTPLPSIGVDVEIKNGIGPVIDQPIRSLADIEKLGQIDPEQDVPYVLETIKLLVNEQLNVPLIGFSGAPFTLASYMIEGGPSKNYNKTKAFMYSMPDAWNLLMSKLADMIIVYVKAQIEAGAKAIQIFDSWVGALNQADYRTYIKPVMNRIFSELAKENVPLIMFGVGASHLAGDWHDLPLDVVGLDWRLGIDEARSKGITKTVQGNLDPSILLAPWEVIEQKTKEILDQGMESDGFIFNLGHGVFPDVSPEVLKKLTAFVHEYSQNKKMGQYS

SEQ ID NO: 17672 - protein, 310 aa, Bacillus subtilis
MSRKKMGLLVMAYGTPYKEEDIERYYTHIRRGRKPEPEMLQDLKDRYEAIGGISPLAQITEQQAHNLEQHLNEIQDEITFKAYIGLKHIEPFIEDAVAEMHKDGITEAVSIVLAPHFSTFSVQSYNKRAKEEAEKLGGLTITSVESWYDEPKFVTYWVDRVKETYASMPEDERENAMLIVSAHSLPEKIKEFGDPYPDQLHESAKLIAEGAGVSEYAVGWQSEGNTPDPWLGPDVQDLTRDLFEQKGYQAFVYVPVGFVADHLEVLYDNDYECKVVTDDIGASYYRPEMPNAKPEFIDALATVVLKKLGR

SEQ ID NO: 17673 - protein, 470 aa, Bacillus subtilis
MSDGKKHVVIIGGGITGLAAAFYMEKEIKEKNLPLELTLVEASPRVGGKIQTVKKDGYIIERGPDSFLERKKSAPQLVKDLGLEHLLVNNATGQSYVLVNRTLHPMPKGAVMGIPTKIAPFVSTGLFSLSGKARAAMDFILPASKTKDDQSLGEFFRRRVGDEVVENLIEPLLSGIYAGDIDKLSLMSTFPQFYQTEQKHRSLILGMKKTRPQGSGQQLTAKKQGQFQTLSTGLQTLVEEIEKQLKLTKVYKGTKVTKLSHSGSCYSLELDNGVTLDADSVIVTAPHKAAAGMLSELPAISHLKNMHSTSVANVALGFPEGSVQMEHEGTGFVISRNSDFAITACTWTNKKWPHAAPEGKTLLRAYVGKAGDESIVDLSDNDIINIVLEDLKKVMNINGEPEMTCVTRWHESMPQYHVGHKQRIKELREALASAYPGVYMTGASFEGVGIPDCIDQGKAAVSDALTYLFS

SEQ ID NO: 17674 - protein, 325 aa, Bacillus subtilis
MSKAKITAIGTYAPSRRLTNADLEKIVDTSDEWIVQRTGMRERRIADEHQFTSDLCIEAVKNLKSRYKGTLDDVDMILVATTTSDYAFPSTACRVQEYFGWESTGALDINATCAGLTYGLHLANGLITSGLHQKILVIAGETLSKVTDYTDRTTCVLFGDAAGALLVERDEETPGFLASVQGTSGNGGDILYRAGLRNEINGVQLVGSGKMVQNGREVYKWAARTVPGEFERLLHKAGLSSDDLDWFVPHSANLRMIESICEKTPFPIEKTLTSVEHYGNTSSVSIVLALDLAVKAGKLKKDQIVLLFGFGGGLTYTGLLIKWGM

SEQ ID NO: 17675 - protein, 429 aa, Bacillus subtilis
MKRIKFGLATQIFVGLILGVIVGVIWYGNPALPTYLQPIGDLFLRLIKMIVIPIVVSSLIIGVAGAGNGKQVGKLGFRTILYFEIITTFAIILGLALANIFHPGTGVNIHEAQKSDISQYVETEKEQSNKSVAETFLHIVPTNFFQSLVEGDLLAIICFTVLFALGISAIGERGKPVLAFFEGVSHAMFHVVNLVMKVAPFGVFALIGVTVSKFGLGSLISLGKLVGLVYVALAFFLIVIFGIVAKIAGISIFKFLAYMKDEILLAFSTSSSETVLPRIMEKMEKIGCPKGIVSFVIPIGYTFNLDGSVLYQSIAALFLAQVYGIDLTIWHQITLVLVLMVTSKGMAAVPGTSFVVLLATLGTIGVPAEGLAFIAGVDRIMDMARTVVNLTGNALAAVVMSKWEGMFNPAKAETVMSQSKTEQNATISG

SEQ ID NO: 17676 - protein, 513 aa, Bacillus subtilis
MNLVSKLEETASEKPDSIACRFKDHMMTYQELNEYIQRFADGLQEAGMEKGDHLALLLGNSPDFIIAFFGALKAGIVVVPINPLYTPTEIGYMLTNGDVKAIVGVSQLLPLYESMHESLPKVELVILCQTGEAEPEAADPEVRMKMTTFAKILRPTSAAKQNQEPVPDDTAVILYTSGTTGKPKGAMLTHQNLYSNANDVAGYLGMDERDNVVCALPMCHVFCLTVCMNAPLMSGATVLIEPQFSPASVFKLVKQQQATIFAGVPTMYNYLFQHENGKKDDFSSIRLCISGGASMPVALLTAFEEKFGVTILEGYGLSEASPVTCFNPFDRGRKPGSIGTSILHVENKVVDPLGRELPAHQVGELIVKGPNVMKGYYKMPMETEHALKDGWLYTGDLARRDEDGYFYIVDRKKDMIIVGGYNVYPREVEEVLYSHPDVKEAVVIGVPDPQSGEAVKGYVVPKRSGVTEEDIMQHCEKHLAKYKRPAAITFLDDIPKNATGKMLRRALRDILPQ

SEQ ID NO: 17677 - protein, 193 aa, Bacillus subtilis
MTAVCLVRHGETDWNLQQKCQGKTDIPLNATGERQARETGEYVKDFSWDIIVTSPLKRAKRTAEIINEYLHLPIVEMDDFKERDYGDAEGMPLEERTKRYPDNIYPNMETLEELTDRLMGGLAKVNQAYPNKKVLIVAHGAAIHALLTEISGGDPELQSTRLVNACLSNIEFAEEKWRIKDYNINSHLSGFIK

SEQ ID NO: 17678 - protein, 364 aa, Bacillus subtilis
MNAVIVDAKRTIFGNQNGLLKPFLPEDLAAPIIRCLSRKLEDQVDEVILGNATGRGGNLARLSALQAGLPLSVPGMTIDRQCGSGLEAVRYACSLIQAGAGTMYIAGGSESSSQSPFSERARFSPDAIGDPDMGIAAEYTAARYSISRSMQDEYALLSHQRSRNAHDEGFYREEVVALGELETDEAFLKTRPIEAIIPRAKPVFDTSSGTVTAANSSGIADGAAALLVMEEEKAAALGLKPVLRFIGSAVSGIHPNFPPAAPVVAIRQLLHTHDVTPDDIDLFEINEAFAVKICVCSQELGIPFSKINVRGGALALGHPYGASGAALVTRLFYEAKRRPDCQYAVAAIGSGGGIGLALLFEVLA

SEQ ID NO: 17679 - protein, 479 aa, Bacillus subtilis
MTITHTYSSTAETSPGRVAIQTESEQITYHDWDRLVSQTANWLRSQPSMPNRVAILLPNSLAFLQLFAGAAAAGCTAIPIDTRWSPAECKERLSISNADLVVTLAFFKNKLTDSQTPVVLLDNCMADISEAAADPLPTIDPEHPFYMGFTSGSTGKPKAFTRSHRSWMESFTCTETDFSISSDDKVLIPGALMSSHFLYGAVSTLFLGGTVCLLKKFSPAKAKEWLCRESISVLYTVPTMTDALARIEGFPDSPVKIISSGADWPAESKKKLAAAWPHLKLYDFYGTSELSFVTFSSPEDSKRKPHSAGRPFHNVRIEIRNAGGERCQPGEIGKIFVKSPMRFSGYVNGSTPDEWMTVDDMGYVDEEGFLYISGRENGMIVYGGLNIFPEEIERVLLACPEVESAAVVGIPDEYWGEIAVAVILGNANARTLKAWCKQKLASYKIPKKWVFADSLPETSSGKIARSRVKKWLEESVQYK

SEQ ID NO: 17680 - protein, 285 aa, Bacillus subtilis
MANQKKKTLPPQHQNQQPGFEYLMDPRPVFDKPKKAKKLEGKTAIITGGDSGIGRAVSVLFAKEGANVVIVYLNEHQDAEETKQYVEKEGVKCLLIAGDVGDEAFCNDVVGQASQVFPSIDILVNNAAEQHVQPSIEKITSHQLIRTFQTNIFSMFYLTKAVLPHLKKGSSIINTASITAYKGNKTLIDYSATKGAIVTFTRSLSQSLVQQGIRVNAVAPGPIWTPLIPASFAAKDVEVFGSDVPMERPGQPVEVAPSYLYLASDDSTYVTGQTIHVNGGTIVNG

SEQ ID NO: 17681 - protein, 299 aa, Bacillus subtilis
MSDSNLTNPIKAFFHDEFPEQYQEPPGLQKNMKPVPDCGEKSYKGSGKLTGRKALVTGGDSGIGRAAAIAYAREGADVAINYLPEEQPDAEEVKELIEAEGRKAVLIPGDLSDESFCQDLVKQSHHELGGLDVLALVAGKQQAVENIEDLPTEQIYKTFEVNVFSLYWVVKAALPYLPEGASIITTTSVEGYNPSPMLLDYAATKNAIIGFTVGLGKQLASKGIRVNSVAPGPIWTPLQISGGQPTENIPKFGQGTPPAPLNRAGQPVELADVYVFLASENSSYVTSQVYGITGGIPTA

SEQ ID NO: 17682 - protein, 168 aa, Bacillus subtilis
MKKRFWFLAGVVSVVLAIQVKNAVFIDYKVEGVSMNPTFQEGNELLVNKFSHRFKTIHRFDIVLFKGPDHKVLIKRVIGLPGETIKYKDDQLYVNGKQVAEPFLKHLKSVSAGSHVTGDFSLKDVTGTSKVPKGKYFVVGDNRIYSFDSRHFGPIREKNIVGVISDAE

SEQ ID NO: 17683 - protein, 1130 aa, Bacillus subtilis
MKPIALSIKGLHSFREEQTIDFEGLSGAGVFGIFGPTGSGKSSILDAMTLALYGKVERAANNTHGILNHAEDTLSVSFTFALQTNHQISYKVERVFKRTDEMKVKTALCRFIEIKDEHTVLADKASEVNKRVEELLGLTIDDFTRAVVLPQGKFAEFLSLKGAERRHMLQRLFNLEQYGDRLVKKLRRQAQEANARKNEMLAEQSGLGEASSEAVEQAEKVLEQAEVRLEAMRKNRDQAKERFTEHQEIWNVQKEKSTYEEEEKRLAEEQPHIDSMQKRLLEAETAAALKPYADRYAEAIQHEEQAEKEQTLAQKDLADRTAFFQQKHEEYEAWRQHKSEKEPELLAKQEQLSRLQEIEIKLSEAKQEEERKKADLRQKEEALQSVMNELETVTDRLTRGQNRQTELKQQLKSLQVTSDERKSCQQAAEMALRIRQTEEQIKKEKKRSEELNLVLQKMNEEKNTLVQKTEAEENNIIQAYEAVQTVYHLVCETERSLTRMTEEARKSQHTLHLQREKARVALLTKELAQKLTAGKPCPVCGSTDHDPSASVHETYEADSHLEEDIKRTDVLLTEAAALSQEILSAKIMLEEQSARFIEQCPFLQTIQAQNLEAAASFEHQPVYEAFETAKFEWKRIKQDILSVKTRMAQMIGAYQESLKKAEQLNEKIGFEKREADRIESIISELQSSMDSSLNMFKEAFQNQSVDEAEKWQQAIEEKDRAAEECEKRIEKSIAFLAEHEAQKEKLRESGHRLEREKLELHYAAERIKSVIADYEHELGDYAKGDSIPIQLRSVQQDLKLLKEKEQSLYEELQSAQMKLNQAKSRASASELTLQEAKGRLEKAKAAWLEHTKNTSITRTEEVEQSLIPADELEKMKTGIDQFMDKLKQNAANLKRVAEILAGRALSESEWNETVAALQEAEDAFGAAIEEKGAAAKALAVIRDHHKRFNEIEAELKKWQMHIDRLDKLQAVFKGNTFVEFLAEEQLESVARDASARLSMLTRQRYAIEVDSEGGFVMRDDANGGVRRPVSSLSGGETFLTSLSLALALSAQIQLRGEYPLQFFFLDEGFGTLDQDLLDTVVTALEKLQSDNLAVGVISHVQELRARLPKKLIVHPAEPSGRGTRVSLELM

SEQ ID NO: 17684 - protein, 199 aa, Bacillus subtilis
MTHNPNIIWHPAAISKSDRQSLNGHKSCVLWFTGLSGSGKSVLANAVDEKLYRKGIQSYVLDGDNIRHGLNKDLGFQTGDRIENIRRIGEVAKLFVDSGQMILTAFISPFREDRDMVRALFPKGEFFEIYVKCPLHVCEQRDPKGLYKKARNGEIKHFTGIDSPYEAPLSPDFIIESDQTSISDGADLIINALQNRGII

SEQ ID NO: 17685 - protein, 325 aa, Bacillus subtilis
MRLANGLPWSLPITLPVGEKTARQLSAGDHVKLVKDGVTYGMITVTDIYQPDKTQEALSVFKTNDPAHPGVKKLLARPDYYIGGPITVSSLPDKSFEQFYATPAETRAAFQKLGWKTIVGFQTRNPVHRAHEYIQKTALETVDGLLLHPLVGETKSDDIPSDIRMESYQALLNHYYPKDRVMLSVFPAAMRYAGPREAIFHALVRKNYGCTHFIVGRDHAGVGSYYGTYDAQNIFQSFTEEELGIKPLFFEHSFYCRKCGNMGTSKTCPHSPRDHIHLSGTKVRELLRQGKKPPKEFSRPEVAAVLIKGLHQQPVAIKQNSGELQ

SEQ ID NO: 17686 - protein, 196 aa, Bacillus subtilis
MYACSFGAEGMVLLDLISKINKNAHIIFLDTGLHFQETYELIETVKERYPGFAIQMLEPELSLTEQGTKYGGELWKHNPNLCCQLRKIEPLKKHLSGMTAWISGLRRDQSPTRKHIQYVNLDQKFELIKICPLIHWTWDDVWTYIRLHNLPYNKLHDQHYPSIGCEMCTLPSPDPNDERAGRWAGREKTECGLHQE

SEQ ID NO: 17687 - protein, 346 aa, Bacillus subtilis
MKIGIVGATGYGGTELVRILSHHPHAEECILYSSSGEGNVYSEGYPHLTGLADQQLKPIDMNTIKHEIDIMFLAAPPGVSSELTPKLADAGITVIDLSGDLRIKEPAEYEKWYKRTAAPKAVIQEAVYGLAELNQLQIQQAKLIANPGCFPTAVLLGLAPLAQKKLLDESFVIVDAKTGVSGAGRKASMGTHFSELNDNFKIYKVNEHQHTPEIEQALNEWQPGLGPITFSAHLVPMTRGIMATMYTRLTCDLTADDLHDLYSEFYQDSYFVRVRPKGQYPQTKEVYGSNFCDIAVTLDERTNRVTIVSVIDNLMKGAAGQAVQNFNLMNGWNEETGLTIITPIYP

SEQ ID NO: 17688 - protein, 406 aa, Bacillus subtilis
MIQLSEDQIVKVTGDVSSPKGFQAKGVHCGLRYSKKDLGVIISETPAVSAAVYTQSHFQAAPIKVTQDSLKHGPTLKAVIVNSAIANACTGEQGLKDAYTMRESFASQLGIEPELVAVSSTGVIGEHLDMEKIHAGIELLKETPAGSGDFEEAILTTDTVIKQTCYELAIGGKTVTIGGARKGSGMIHPNMATMLGFVTTDAAIEEKALQKALRETTDVSFNQITVDGETSTNDMVLVMANACAENECLTEDHPDWPVFKKALLLTCEDLAKEIARDGEGATKLIEAQVQGAKNNLDANVIAKKIVGSNLVKTAVYGTDANWGRIIGAIGHSAAQVTAEEVEVYLGGQCLFKNNEPQPFSESIAKEYLEGDEITIVIKMAEGDGNGRAWGCDLTYDYIKINASYRT

SEQ ID NO: 17689 - protein, 258 aa, Bacillus subtilis
MKKTIVFKCGGSVIRELSEEFYQNLKELRASGWKLAIVHGGGPEITNMLKRLNIKTEFSGGQRKTTKPVLEVAEMVLSGSVNKFFVAELAKHGLRAAGISGKDGGLLEADYLDPETYGEVGEIKKVDASMVNALMENGIIPVIAPLSMTSDCKTLNVNADLAASAVAGALEADKLMFVTDVDGIMKEKQRLDVLTPKEIQMLIKQEVITGGMIPKVNSALSALSDQVSEVMIVNGKGSFFAEQTFQGTKIVKAKEAVS

SEQ ID NO: 17690 - protein, 385 aa, Bacillus subtilis
MSSLFQTYGRWDIDIKKAKGTYVEDQNGKTYLDFIQGIAVSNLGHCHEAVTEAVKKQLDSVWHVSNLFQNSLQEQAAQKLAGHSAGDLVFFCNSGGQANEGAYKLARKATGKTKIITFLQSFHGRTYAGMAATGQDKIKTGFGPMLGGFHYLPYNDPSAFKALGEEGDIAAVMLETVQGEGGVNPASAEFLSAVQSFCKEKQALLIIDEIQTGIGRTGKGFAYEHFGLSPDIITVAKGLGNGFPVGAVIGKKQLGEAFTPGSHGTTFGGNMLAMAAVNATLQIVFQPDFLQEAADKGAFLKEQLEAELKSPFVKQIRGKGLMLGIECDGPVADIIAELQTLGLLVLPAGPERDSAAAPLTVTKDEIAEAVSKLKQAIAHHSAVNQ

SEQ ID NO: 17691 - protein, 353 aa, Bacillus subtilis
MEGYLVLEDGTSFSGELDGHENCTGEAVFFTGMTGYQEVLTDPSYKGQIIVFTYPLIGNYGINEKDFESKKPQVKAAVVYEACDHFSHYEAVYSLKEYLQKWNIPLLTHVDTRAVVKKIRANGTMGATVTASKEGAEIALQPENVAEQASAQEISTFGDGNKHIALIDFGYKKSIASSLVKRGCKVTVVPYQQMEAVYNIKPDGIVLSNGPGDPKAIQPYLGKIKSIISRFPTLGICLGHQLIALAFGGNTFKLPFGHRGANHPVIDRKTKRVFMTSQNHSYVVDEQSINEEELTIRFHHVNDTSVEGLAHKKLPVMSVQFHPEAHPGAAESEWIFDDYLKNVIPARREIAHA

SEQ ID NO: 17692 - protein, 1027 aa, Bacillus subtilis
MPKDTSISSILVIGSGPIIIGQAAEFDYSGTQGCIALKEEGYRVILVNSNPATIMTDEAFADEIYFEPLTAESLTAIIKKERPDGLLANLGGQTALNLAVELEETGVLKEHGVKLLGTSVETIQKGEDREKFRSLMNELKQPVPESEIVDNEADALHFAESIGFPVIIRPAYTLGGKGGGIAPDKEAFTAMIKQALLASPINQCLVEKSIAGFKEIEYEVMRDSNNTCITVCNMENIDPVGVHTGDSIVVAPSQTLTDEDYQMLRTASLTIISALDVVGGCNIQFALDPFSKQYYVIEVNPRVSRSSALASKATGYPIAKMAAKLAVGYTLDELKNPLTGSTYASFEPALDYVIVKFPRWPFDKFKNADRKLGTKMKATGEVMAIERNLEAAIQKAGASLELKNIGTHLPELSGLSIDTLWDLAITPDDRRFFVVMELLSRSVSIDDIHEKTKIDPFFLHTFDNIIKLENRLMEAGSDLSFELLKKAKEKGFSDATIASLISKTEEEVRRLRKEMGITPSFKIVDTCAAEFDAKTNYFYSTYFGETDGDISRKEKKRALIIGSGPIRIGQGVEFDYSAVHGVLTLQELGFETIMINNNPETVSTDYEIADRLYFEPMTTEHIVNVREQENIDFAIVQFGGQTAINAAEALEKAGITLLGTSFQTLDVLEDRDQFYQLLDELGLKHAKGEIAYTKEEAASKASEIGYPVLIRPSYVIGGMGMIIVDSQAQLSQLLNDEDSMPYPILIDQYVSGKEVEIDLISDGEEVFIPTYTEHIERAGVHSGDSFAILPGPSITSGLQQGMKDAAQKIARKLSFKGIMNIQFVIDNGNILVLEVNPRASRTVPVVSKVMGVPRATRLLAGASLKDLNPAVQNHHGVAVKFPVFSSHAIQDVDVKLGPEMKSTGEGMCVAYDSNSALKKIYTRVWSQKGSIYLQNVPEDVKELAENAGFTIHEGTFASWMEQEGNSLHINLSGSEEARKERLEAMTHGIPVFTEEETVRAFLQSGSGHPQPVSLKDLYKKEVASCTQ

SEQ ID NO: 17693 - protein, 319 aa, Bacillus subtilis
MHTVTQTSLYGKDLLTLKDLSEEDINALLAEAGELKQNKIQPIFHGKTLAMIFEKSSTRTRVSFEAGMAQLGGSALFLSQKDLQLGRGETVADTAKVLSGYVDAIMIRTFEHEKVEELAKEADIPVINGLTDKYHPCQALADLLTIKEIKGKLKGVKVAYIGDGNNVAHSLMIGCAKMGCDISIASPKGYEVLDEAAEAAKTYALQSGSSVTLTDDPIEAVKDADVIYSDVFTSMGQEAEEQERLAVFAPYQVNAALVSHAKPDYTFLHCLPAHREEEVTAEIIDGPNSAVFQQAENRLHVQKALLKAILYKGESSKNC

SEQ ID NO: 17694 - protein, 312 aa, Bacillus subtilis
MKAGILGVGRYIPEKVLTNHDLEKMVETSDEWIRTRTGIEERRIAADDVFSSHMAVAAAKNALEQAEVAAEDLDMILVATVTPDQSFPTVSCMIQEQLGAKKACAMDISAACAGFMYGVVTGKQFIESGTYKHVLVVGVEKLSSITDWEDRNTAVLFGDGAGAAVVGPVSDDRGILSFELGADGTGGQHLYLNEKRHTIMNGREVFKFAVRQMGESCVNVIEKAGLSKEDVDFLIPHQANIRIMEAARERLELPVEKMSKTVHKYGNTSAASIPISLVEELEAGKIKDGDVVVMVGFGGGLTWGAIAIRWGR

SEQ ID NO: 17695 - protein, 413 aa, Bacillus subtilis
MTKKRVVVTGLGALSPLGNDVDTSWNNAINGVSGIGPITRVDAEEYPAKVAAELKDFNVEDYMDKKEARKMDRFTQYAVVAAKMAVEDADLNITDEIAPRVGVWVGSGIGGLETLESQFEIFLTKGPRRVSPFFVPMMIPDMATGQISIALGAKGVNSCTVTACATGTNSIGDAFKVIQRGDADVMVTGGTEAPLTRMSFAGFSANKALSTNPDPKTASRPFDKNRDGFVMGEGAGIIVLEELEHALARGAKIYGEIVGYGSTGDAYHITAPAQDGEGGARAMQEAIKDAGIAPEEIDYINAHGTSTYYNDKYETMAIKTVFGEHAHKLAVSSTKSMTGHLLGAAGGIEAIFSILAIKEGVIPPTINIQTPDEECDLDYVPDEARRQELNYVLSNSLGFGGHNATLIFKKYQS

SEQ ID NO: 17696 - protein, 269 aa, Bacillus subtilis
MSLLNIGGFIHMNFSLEGRNIVVMGVANKRSIAWGIARSLHEAGARLIFTYAGERLEKSVHELAGTLDRNDSIILPCDVTNDAEIETCFASIKEQVGVIHGIAHCIAFANKEELVGEYLNTNRDGFLLAHNISSYSLTAVVKAARPMMTEGGSIVTLTYLGGELVMPNYNVMGVAKASLDASVKYLAADLGKENIRVNSISAGPIRTLSAKGISDFNSILKDIEERAPLRRTTTPEEVGDTAAFLFSDMSRGITGENLHVDSGFHITAR

SEQ ID NO: 17697 - protein, 759 aa, Bacillus subtilis
MKCARLNDRIIHLHTYSREHYQFLFEEGIKGHLFCSHCGKPVLLRLNIADPPEFIHRQPGDFPACEEACEPKPSKEGKKEDDQESGVIRLPKGKAIAADPSPAVTEWHRPRSIKPGTPFVPKTIEPDTSLFPSVGLNTDQLKAVTETEGPLLVLAGAGSGKTRVLTARAAHMIEHLGIPPENMLLVTFTTKAVAEMKERMANQYGLQPAKVRRIVTGTFHSLFYKILYHSNSAKWNGEHLLKMEWQREQYIKKALYEEGIDEKESPVDQALQQIGFWKNTYVPNERIPLKDEWEKQVYRLYEHYERQKKEHSQFDFDDMASACYELFIERPDLLEQYQSRFTYILIDEFQDINPVQYKIMQMLASPEQNLCCVGDDDQSIYAFRGSNPSFILDFQKDYPGAKTIYLTANYRSTHPIVSSADIVVKKNKNRYAKTLEAARDDIQVPVLFYPYDEEEEATMVVSDIKEKIQNGASPEDFAVLYRTNSGGRAIYERLHQSSIPYTADRGVQSFYSRRIVRQILAYLYASQNEDDTEAIKHLLPALFLKQSALNTLKALSITEDCTMIKALAKLPDLKPFQLDKIKKIVPFFASLRTMKPVEAITFAEGKMGFSEYLKKRGNEGNKLEKGSDDLRDIKVVAKKFKTIPDFLAHVDHMRAAEKNRTDEHGVQLMTIHRSKGLEFKTVYVLGTVDGSIPHDFSLETARKGDEAALEEERRLLYVAMTRAKQHLYLSCPANRRGKTANRSRFLYPLLQKARQPLHH

SEQ ID NO: 17698 - protein, 373 aa, Bacillus subtilis
MSQHVETKLAQIGNRSDEVTGTVSAPIYLSTAYRHRGIGESTGFDYVRTKNPTRQLVEDAIANLENGARGLAFSSGMAAIQTIMALFKSGDELIVSSDLYGGTYRLFENEWKKYGLTFHYDDFSDEDCLRSKITPNTKAVFVETPTNPLMQEADIEHIARITKEHGLLLIVDNTFYTPVLQRPLELGADIVIHSATKYLGGHNDLLAGLVVVKDERLGEEMFQHQNAIGAVLPPFDSWLLMRGMKTLSLRMRQHQANAQELAAFLEEQEEISDVLYPGKGGMLSFRLQKEEWVNPFLKALKTICFAESLGGVESFITYPATQTHMDIPEEIRIANGVCNRLLRFSVGIEHAEDLKEDLKQALCQVKEGAVSFE

SEQ ID NO: 17699 - protein, 390 aa, Bacillus subtilis
MSKHNWTLETQLVHNPFKTDGGTGAVSVPIQHASTFHQSSFEEFGAYDYSRSGTPTRTALEETIAALEGGTRGFAFSSGMAAISTAFLLLSQGDHVLVTEDVYGGTFRMVTEVLTRFGIEHTFVDMTDRNEVARSIKPNTKVIYMETPSNPTLGITDIKAVVQLAKENGCLTFLDNTFMTPALQRPLDLGVDIVLHSATKFLSGHSDVLSGLAAVKDEELGKQLYKLQNAFGAVLGVQDCWLVLRGLKTLQVRLEKASQTAQRLAEFFQKHPAVKRVYYPGLADHPGAETHKSQSTGAGAVLSFELESKEAVKKLVENVSLPVFAVSLGAVESILSYPATMSHAAMPKEEREKRGITDGLLRLSVGVEHADDLEHDFEQALKEIAPVSVR

SEQ ID NO: 17700 - protein, 251 aa, Bacillus subtilis
MSHSQEKIALITGASSQGDIGTAICRKLASQGIHIFFTHWNSDTAWIEEFQQEILRMGVRCEAMKIDLSDAHAAFTIHEKISDKLGYPSILINNAAHSASDNYVSLDAKSLDEHYAVNMRSNFLLCVEFARRFKKSNLISGRIINMTSGQDLGPLPGELAYAATKGAISAFTRSLSQELAPLGITVNAVNPGPTDSTWMTDEIRNFLSPKFPMGRIGTPDDAARMIAFLASDEAEWITGQIIHSEGGFIRG

SEQ ID NO: 17701 - protein, 985 aa, Bacillus subtilis
MAGKKTITINGVEMEASEEQTVLQLLNNSSIEVPQVCYHPSLGPIETCDTCIVSINGELKRSCSAELKDGDVIDTLSPDVKKAQVIGMDKILYNHELYCTVCDYNNGGCEIHNTVKEMKINHQSIPFDHKPYHKDESHPFYRYDPDQCILCGRCVEACQDVQVTETLTIDWERKRPRVIWDNDVPINESSCVSCGHCSTVCPCNAMMEKGMEGEAGYLTGINNETLRPMIEITKGVETGYGSILAISDMESAMRDERIKKTKTVCTYCGVGCSFDVWTKGRDILKVEPQEEAPANGISTCVKGKFGWDFVNSEERLTKPLIREGDHFREAEWEEALLLIASKFTELKEAFGPDSLAFITSSKCTNEESYLMQKLARGVIGTNNVDNCSRYCQSPATAGLFRTVGYGGDSGSITDIAQADLVLIIGSNTSESHPVLSTRIKRAHKLRGQKVIVADIRKHEMAERSDLFVQPRAGSDIVWLNAIAKYLIENGKADERFLRERVNGRDEYVKSLAPYTLEYAEEKTGIDQETLIQMAEMIGQADSVCALWAMGVTQHIGGSDTSTAISNLLLVTGNYGKPGAGSYPLRGHNNVQGASDFGSMPDRLPGYEKVTDEQVRQKYERVWGVPLPKEPGMTNHEMIEKIHSGQLKAMYVKGEEMGLVDSNINHVHAAYEKLDFFVVQDIFLSRTAEFADVVLPASPSLEKEGTFTNTERRIQRLYQVFEPLGESKPDWQIIMEVANKLGAGWLYEHPADIMEEAAKLSPIYAGVTYERLEGYNSLQWPVNADGKDSPLLFTERFPFPDGKAILYPVQWTEPKEFGEEYDIHVNNGRLLEHFHEGNLTYKSKGISEKTPEVFLEISPELAAERGIQDGTLVRLTSPFGNVKVKCLITDRVKGKEVYLPMNDSGEAAINLLTGSHADKDTDTPAYKETSAKMEILKHDGISPLPKINHRNGNPQPQIGVQVHKKWARKDYIFPGDAVKRGMGHNG

SEQ ID NO: 17702 - protein, 250 aa, Bacillus subtilis
MEANDQTQNIPAISFRSVRKSYKQDGQTYDVLQDVTGDIQQGAIVAVLGPSGSGKSTLLSMCNLMRTPDSGEVNIYGKEVREWNVNELRRTAALAFQSAPVLDGTVRDNLSLVQRLHQSQLYSPEKLASLAGLPPELLDRSARDLSGGQRQRLSLARTLSNPSSILLLDEITSALDPVSALEIEELIKRQHQEKKWTVMWVTHNMEQAKRIADTIWFMADGRLLEIAETDTFFSAPQHEAAKEFLKGGTR

SEQ ID NO: 17703 - protein, 337 aa, Bacillus subtilis
MKTITIAAEEAKELVWQKLDGAGLNERDAEKVADVLVHADLRNVHSHGVLHTEHYVNRLLAGGINPGAQPVFKETGPVTGVLDGDDGFGHVNCDMAMDHAIDMAKKKGVGMVTAVNSSHCGALSYFVQKAADEKLIGMAMTHTDSIVVPFGGRTPILGTNPIAYGVPAKHKKPFILDMATSKVAFGKILQAREEGKEIPEGWGVDENGEAVTDPDKVVSLSTFGGPKGYGLSIVVDVFSGLLAGAAFGPHIAKMYNGLDQKRKLGHYVCAINPSFFTDWDTFLEQMDAMIDELQQSPPAVGFERVYVPGEIEQLHEERNKKNGISIARSVYEFLKSR

SEQ ID NO: 17704 - protein, 339 aa, Bacillus subtilis
MKAVQVRKAYDLVTAEVKKPVLSKDDEVLVKVKRVGICGSDMHIYHGTNPLATLPRVIGHEVTGQVEAVGANVQSLKPGDHVVIEPISYCGSCYACRKGRPNVCAKLSVFGVHEDGGMREYIVLPERQLHAVSKDLPWEEAVMAEPYTIGAQAVWRGQVEKGDTVLIQGAGPIGICVLKMAKLAGAAVMMTDLNNERLAFAKENGADAVVNVQAEHVAERVLEWTGNEGANVVIDAVCLPETFALSIEAVSPAGHVVVLGFDERAAQISQLPITKKEVTITGSRLQTNQFPKVVELLNGGRLMHNGLVTHTFSVDDVHHAFQFIKEHPDQVRKAVITFD

SEQ ID NO: 17705 - protein, 278 aa, Bacillus subtilis
MIPLHENLAGKTAVITGGSGVLCSAMARELARHGMKVAILNRTAEKGQAVVKEITAAGGTACAVAADVLDRMSLERAKEDILGQFGAVDLLINGAGGNHPDAITDVETYEEAGEGQSFFDMDERGFLTVFSTNFTGAFLASQVFGKELLKADSPAIINLSSMSAYSPMTKVPAYSAAKASINNFTMWMAVHFAETGLRVNAIAPGFFLTKQNHDLLINQDGTFTSRSHKIIAGTPMKRFGKPEDLLGTLLWLADESYSGFVTGITVPVDGGFMAYSGV

SEQ ID NO: 17706 - protein, 272 aa, Bacillus subtilis
MEQIGLIGYGSMADMIARQLLKHEQIKENELFIETRTKGERLRALMSDYPNVSADPLENWANTCQLILICVPPLHVIETMRRLYPYVNRNTHIVSIAAGVPLRLLEAETEAGISRVIPAITSEAEAGISLVVHSEALAAEKKERLNELLSVFSRVREIKESNLDVASNLTSSAPGFIAAIFEELALSAVRNSSLSKEEAFDFLIHSLYGTGKMLIEKNMSFEETLERVATKGGITGEGAEVIHASVPDVFDEVFERTLRKYELLTEQVGKQT

SEQ ID NO: 17707 - protein, 415 aa, Bacillus subtilis [sequence omitted]

SEQ ID NO: 17708 - protein, 762 aa, Bacillus subtilis
MTTIKTSNLGFPRIDLNREWKKALEAYWKGSTDKDTFLKQIDELFLSAVKTQIDQQIDVVPVSDFTQYDHVLDTAVSFNWIPKRFRHLTDATDTYFAIARGIKDAVSSEMTKWFNTNYHYIVPEYDESIEFRLTRNKQLEDYRRIKQEYGVETKPVIVGPYTFVTLAKGYEPSEAKAIQKRLVPLYVQLLKELEEEGVKWVQIDEPALVTASSEDVRGAKELFESITSELSSLNVLLQTYFDSVDAYEELISYPVQGIGLDFVHDKGRNLEQLKTHGFPTDKVLAAGVIDGRNIWKADLEESLDAVLDVLSIAKVDELWIQPSSSLLDVPVAKHPDEHLEKDLLNGLSYAKEKLAELTALKEGLVSGKAAISEEIQQAKADIQALKQFATGANSEQKKELEQLTDKDFKRPIPFEERLALQNESLGLPLLPTTTIGSFPQSAEVRRARQKWRKAEWSDEQYQNFINAETKRWIDIQEELELDVLVHGEFERTDMVEYFGEKLAGFAFTKYAWVQSYGSRCVRPPVIYGDVEFIEPMTVKDTVYAQSLTSKHVKGMLTGPVTILNWSFPRNDISRKEIAFQIGLALRKEVKALEDAGIQIIQVDEPALREGLPLKTRDWDEYLTWAAEAFRLTTSSVKNETQIHTHMCYSNFEDIVDTINDLDADVITIEHSRSHGGFLDYLKNHPYLKGLGLGVYDIHSPRVPSTEEMYNIIVDALAVCPTDRFWVNPDCGLKTRQQEETVAALKNMVEAAKQARAQQTQLV

SEQ ID NO: 17709 - protein, 165 aa, Bacillus subtilis
MNYYTTAETPLGELIIAEEEDRITRLFLSQEDWVDWKETVQNTEHKETPNLAEAKQQLQEYFAGERKTFSLPLSQKGTPFQQKVWQALERIPYGESRSYADIAAAVGSPKAVRAVGQANKRNDLPIFVPCHRVIGKNSALTGYAGSKTEIKAFLLNIERISYKEK

SEQ ID NO: 17710 - protein, 699 aa, Bacillus subtilis
MRCQHCHQNEATIRLNMQINSVHKQMVLCETCYNELTRKPSMSMGPQSFGFPFEQAFQPKEQSAAKQSEKKGLLDELAQNITNGAKAGLIDPVIGRDDEVARVIEILNRRNKNNPVLIGEPGVGKTAIAEGLALKIAEGDVPNKLKNKELYLLDVASLVANTGIRGQFEERMKQLITELKERKNVILFIDEIHLLVGAGSAEGSMDAGNILKPALARGELQVIGATTLKEYRQIEKDAALERRFQPVMVQEPSIEQAILILQGIKDKYEAYHGVTFSDEAIKACVTLSSRYIQDRHLPDKAIDLLDEAGSKANLLIDELNDEDAAERLTAIEAEKTKALEEENYELAAKLRDEELALEKKLNSSSAHTAVTVEAEHIQEIVEQKTGIPVGKLQADEQTKMKELEAKLHERVIGQEAAVQKVAKAVRRSRAGLKSKNRPVGSFLFVGPTGVGKTELSKTLADELFGTKDAIIRLDMSEYMEKHAVSKIIGSPPGYVGHEEAGQLTEKVRRNPYSIVLLDEIEKAHPDVQHMFLQIMEDGRLTDSQGRTVSFKDTVIIMTSNAGAGEKQTKVGFQSDDSVIEEQTLIDSLSMFFKPEFLNRFDSIIEFRSLEKEHLVKIVSLLLGELEETLAERGISLNVTDEAKEKIAELGYHPSFGARPLRRTIQEWVEDEMTDLLLDNGEITSFHVILEDDKIKVRAK

SEQ ID NO: 17711 - protein, 248 aa, Bacillus subtilis
MGKFEGKIALVTGGTSGIGLATAQKFVNEGAYVYITGRRQNELDKAVNQIGKNVTGVQGDISKLEDLDKLYDIIKQEKGKLDILFANAGIGNFLPLGEITEEQVDRTFDINVKGTIFTVQKALSLFPDKVGSIIVTGSTAGSIGNPAFSVYGASKAALRALVRNWILDLKGTEIRVNVVSPGGILTPAYDELFGDALEEVLENSRNTVPAGKVGTPEEVANAVSFLASDESSYLTGVELFVDGGLAQV

SEQ ID NO: 17712 - protein, 637 aa, Bacillus subtilis
MNEQVIVQRDPHEPLKTDKREKNWAQHAELIAALVSGALILAGWLLSGYQVLSIILFLLAFVIGGFAKAKEGIEETLESKTLNVELLMIFAAIGSALIGYWAEGAILIFIFSLSGALETYTMNKSSRDLTSLMQLEPEEATLMVNGETKRVPVSDLQAGDMIVIKPGERVAADGIIESGSTSLDESALTGESMPVEKNTGDTVFTGTVNRNGSLTVRVTKANEDSLFRKIIKLVESAQNSVSPAQAFIERFENAYVKGVLIAVALLLFVPHFALGWSWSETFYRAMVFMVVASPCALVASIMPAALSLISNGARNGMLVKGSVFLEQLGSVQMIAFDKTGTVTKGQPAVETIRIAEGFSEAEVLEAVYAIETQSSHPLAQAITAYAESRGVNQSGYISIEETSGFGVMAEVSGAKWKVGKAGFIGEEMAAQFMKQTASDVIQSGHTIVFVKKDDQIAGCIALKDQIRPEAKEVMEELNRLGIKTAMLTGDHEDTAQAIAKEAGMTTVVAECLPDQKVNEIKRLKEEFGTIAMVGDGINDAPALKAADVGIAMGGGTDVALETADMVLMKNDLKKLVNMCRLSRKMNRIIKQNIVFSLAVICLLICANFLQAMELPFGVIGHEGSTILVILNGLRLLK

SEQ ID NO: 17713 - protein, 550 aa, Bacillus subtilis
MQELKGIGASAGIAIAKAYRLEEPDLTVEKKNISDSEAEVSRFDEAIARSKEELEKIKEHALKELGQPVKEKISTDSVNAEFALKETSSMFVTMFESMDNEYMKERAADIRDVTKRVTGHLLGVEIPNPSMISEEVIIVAEDLTPSDTAQLNREFVKGFTTDIGGRTSHSAIMARSLEIPAVVGTKAATGTIQNGVTVIVDGINGDVIIDPSAETVKEYEEKHNAYLAQKAEWAKLVNEPTVSKDGHHVELAANIGTPDDVKGVLENGGEAVGLYRTEFLYMGRDQLPTEDEQFDAYKTVLERMEGKSVVVRTLDIGGDKELPYLQLPKEMNPFLGYRAIRLCLEEQEIFRTQLRALLRASTYGNLKIMFPMIATVNEFKEAKAILLEEKEKLVKAGQAVSDDIEVGMMVEIPSTAVIADQFAKEVDFFSIGTNDLIQYTMAADRMNERVSYLYQPYNPAILRLITLVIEAAHKEGKWVGMCGEMAGDEIAIPILLGLGLDEFSMSATSILPARTQISKLSKQEAESFKEKILSMSTTEEVVAFVKETFK

SEQ ID NO: 17714 - protein, 392 aa, Bacillus subtilis
MEHLLNPKAREIEISGIRKFSNLVAQHEDVISLTIGQPDFFTPHHVKAAAKKAIDENVTSYTPNAGYLELRQAVQLYMKKKADFNYDAESEIIITTGAQAIDAAFRTILSPGDEVIMPGPIYPGYEPIINLCGAKPVIVDTTSHGFKLTARLIEDALTPNTKCVVLPYPSNPTGVTLSEEELKSIAALLKGRNVFVLSDEIYSELTYDRPHYSIATYLRDQTIVINGLSKSHSMTGWRIGFLFAPKDIAKHILKVHQYNVSCASSISQKAALEAVTNGFDDALIMREQYKKRLDYVYDRLVSMGLDVVKPSGAFYIFPSIKSFGMTSFDFSMALLEDAGVALVPGSSFSTYGEGYVRLSFACSMDTLREGLDRLELFVLKKREAMQTINNGV

SEQ ID NO: 17715 - protein, 254 aa, Bacillus subtilis
MEKKAVIITGGSSGMGKAMAKKQAELGWHVMVTGRNHEALEETKKEIQTFEGQVACFQMDVRSDSAASDMIKEAVKAFGRLDALINNAAGNFICPAEKLTPNGWKAVIEIVLNGTFFCSQAAARHWIDQKQQGVILNMAATYAWGAGAGVVHSAAAKAGVLSLTRTLAVEWGSKYGIRTNAIAPGPIERTGGAEKLFESEKAMARTMNSVPLGRLGTPEEIAALAAFLLSDEASYINGDCITMDGGQWLNPYPF

SEQ ID NO: 17716 - protein, 180 aa, Bacillus subtilis
MAERMVGKQAPRFEMEAVLASKEFGKVSLEENMKNDKWTVLFFYPMDFTFVCPTEITAMSDRYDEFEDLDAEVIGVSTDTIHTHLAWINTDRKENGLGQLKYPLAADTNHEVSREYGVLIEEEGVALRGLFIINPEGELQYQTVFHNNIGRDVDETLRVLQALQTGGLCPANWKPGQKTL

SEQ ID NO: 17717 - protein, 321 aa, Bacillus subtilis
MKRSGPFFHDVSQENLYLKSELSRCHKLISELEASYFHQKNNKLLKENTDMKEKLQQLSAELTHMSTKEKHASHTSQTLHQIRAELLDKIVVLQELLSAETYKRRAEIEEKHKLHIAKVKIEEENKNLHKRISELQASIEQEQNALLQAKQQAELIKAENGRLKEQMVEKEYQLKHIKIEVDHMKDRIIETKERLLDIEKTKEKLFHETIISYKRQLDESDAWIASHFADIDGGTKQKEKTEEEAPAAYAQPNHVETILEDVTKQIHVLQKQLAHAQSSDQAKSHTIEELKNRAAEEKPYQKWVYKLNLEKENKPSQKKPQ

SEQ ID NO: 17718 - protein, 585 aa, Bacillus subtilis
METFKRLKMYYWPYRKVFMWSLLAMLLMTAITVVYPIILQITIDEIVLGRQYQLAAWVSLGFIAVMVLKGMATFFHQYLGDMFGIKSVYRLRNGLYEKLQRLSFSYYDNAKTGDLMSRLTADVEGLRFFLSYGLAELIRFGLLVAISLSVMFYYSVPLTLVTIAVLPFLAVAVYRFDKRVHPAFRGIRKSFAKLNTKVQENISGINTVKSLSREDFQISTFNKANAEYRAQYLQTSSIWSAYFPLMEFIGNTCIVALLSYGGYLVMQNQLNPGELVAFFSLVNYMMWPIMNLGFVINMFSQAKASGERLLDILEKEEDITDHPHALHKQKLTGDVHFKNVSLAYGKEQTNALCNVSFEANSGKVIGLLGPTGSGKSSVTQLLTRFYSPVGGMITIDHKPITDYSLKTLRSNIGVVLQESFLFSSTIRSNISYGRPDASMEDVIEAAKRAQAHNFIMELPDGYDTMLGERGMGLSGGQKQRIAIARAICLNPSILILDDATSAVDMQTEHSIQLALKEVMKNRTTFIVAHRISSLKHADEILVFNKGRIRERGTHHELLEKGGYYKKIYDLQYRDVKMINEPHEVG

SEQ ID NO: 17719 - protein, 371 aa, Bacillus subtilis
MAAKTKKAIVDSKKQFDAIKKQFETFQILNEKGEVVNEAAMPDLTDDQLKELMRRMVFTRVLDQRSISLNRQGRLGFYAPTAGQEASQIATHFALEKEDFVLPGYRDVPQLIWHGLPLYQAFLFSRGHFRGNQMPDDVNALSPQIIIGAQYIQTAGVALGLKKRGKKAVAITYTGDGGASQGDFYEGINFAGAYKAPAIFVVQNNRYAISTPVEKQSAAETIAQKAVAAGIVGVQVDGMDPLAVYAATAEARERAINGEGPTLIETLTFRYGPHTMAGDDPTKYRTKEIENEWEQKDPLVRFRAFLENKGLWSEEEEAKVIEDAKEEIKQAIKKADAEPKQKVTDLMKIMYEKMPHNLEEQFEIYTQKESK

SEQ ID NO: 17720 - protein, 325 aa, Bacillus subtilis
MAQMTMIQAITDALRTELKNDENVLVFGEDVGVNGGVFRATEGLQKEFGEDRVFDTPLAESGIGGLALGLGLNGFRPVMEIQFFGFVYEVMDSVSGQMARMRYRSGGRWTSPVTIRSPFGGGVHTPELHADSLEGLVAQQPGIKVVIPSTPYDAKGLLISAIRDNDPVVFLEHMKLYRSFRQEVPEEEYTIELGKADVKREGTDLSIITYGAMVHESLKAADELEKDGISAEVVDLRTVSPLDIDTIIASVEKTGRAIVVQEAQKQAGIAANVVAEINDRAILSLEAPVLRVAAPDTVFPFSQAESVWLPNHKDVLETARKVLEF

SEQ ID NO: 17721 - protein, 442 aa, Bacillus subtilis
MAFEFKLPDIGEGIHEGEIVKWFVKPNDEVDEDDVLAEVQNDKAVVEIPSPVKGKVLELKVEEGTVATVGQTIITFDAPGYEDLQFKGSDESDDAKTEAQVQSTAEAGQDVAKEEQAQEPAKATGAGQQDQAEVDPNKRVIAMPSVRKYAREKGVDIRKVTGSGNNGRVVKEDIDSFVNGGAQEAAPQETAAPQETAAKPAAAPAPEGEFPETREKMSGIRKAIAKAMVNSKHTAPHVTLMDEVDVTNLVAHRKQFKQVAADQGIKLTYLPYVVKALTSALKKFPVLNTSIDDKTDEVIQKHYFNIGIAADTEKGLLVPVVKNADRKSVFEISDEINGLATKAREGKLAPAEMKGASCTITNIGSAGGQWFTPVINHPEVAILGIGRIAEKAIVRDGEIVAAPVLALSLSFDHRMIDGATAQNALNHIKRLLNDPQLILMEA

SEQ ID NO: 17722 - protein, 470 aa, Bacillus subtilis
MVVGDFPIETDTLVIGAGPGGYVAAIRAAQLGQKVTVVEKATLGGVCLNVGCIPSKALINAGHRYENAKHSDDMGITAENVTVDFTKVQEWKASVVNKLTGGVAGLLKGNKVDVVKGEAYFVDSNSVRVMDENSAQTYTFKNAIIATGSRPIELPNFKYSERVLNSTGALALKEIPKKLVVIGGGYIGTELGTAYANFGTELVILEGGDEILPGFEKQMSSLVTRRLKKKGNVEIHTNAMAKGVEERPDGVTVTFEVKGEEKTVDADYVLITVGRRPNTDELGLEQVGIEMTDRGIVKTDKQCRTNVPNIYAIGDIIEGPPLAHKASYEGKIAAEAIAGEPAEIDYLGIPAVVFSEPELASVGYTEAQAKEEGLDIVAAKFPFAANGRALSLNETDGFMKLITRKEDGLVIGAQIAGASASDMISELSLAIEGGMTAEDIAMTIHAHPTLGEITMEAAEVAIGSPIHIVK

SEQ ID NO: 17723 - protein, 490 aa, Bacillus subtilis
MSQHETPLYTGLKKHASRQPVQFHIPGHKKGAGMDPEFRQFIGENALSIDLINIEPLDDLHAPKGIIKQAQDLAAEAFGADHTFFSVQGTSGAIMTMVMAVCGPGDKIIIPRNVHKSIMTAIVFSGAVPIFIHPEIDNELGISHGITLESAKRALTEHPDAKGLLVINPTYFGVAADLKSIVELAHSFDVPVLVDEAHGVHIHFHDELPLSAMQAGADIAATSVHKLGGSLTQSSILNMREGLVSKDRVQSILSMLTTTSTSYLLLASLDVARKRLATEGRQLAEETLKLANQTRDRLNQIEGIYCVGSEILGSKAAYSYDPTKLIISVKSLGLTGHDVEKWLRESFNIEVELSDLYNILCIFTPGDSQNDADRLVEALTEIAQQMSEQDVTHQQTEVLLPEIPLLAMTPRDAFYANTEVIPLKEASGRIIAEFVMVYPPGIPIFIPGEIITEENISYIFKNLDAGLPVQGPEDSTLHMIRVIKEQKAIQ

SEQ ID NO: 17724 - protein, 507 aa, Xylella fastidiosa
MTIHNFDLLVVGGGINGTGIARDAAGRHLSVCLCEQHDLASHTSSASTKLIHGGLRYLEYYEFALVSKALAEREILLRQAPHIVRPLHFVLPHQPHLRPTWMIRAGLLLYDHLGFSRRTLPRSRRLNLAKHPTGQPLKQELHTGFMYCDAQVQDARLVVLNAMDAAQRGARILTRTRCVRTRRDGAHWLTELEDAQGRHEQIRTRAIVNATGPWAVTFLDHIAQQPHQHTLRLVKGSHIVVPRLFEHEHAYIFQQPDRRIVFAIPYEQHFTLIGTTDVDYVADPANPHIDAAETMYLCNAVNAYFRQQITPEDVLWSYSGVRPLLNDGHNNASKVTRDYQLEILGNSAPLLNVFGGKLTTYRKLSEEAVNQLCVALDHPYRAWTANGPPLPGGEHHDIAALQNTLRQHRPWLPTATAQRLIHNYGTCAETLLGSATNLHTLGIHFGADLYQAEVDYLRTHEWACSAEDILWRRSKLGLHLDAHGTQRLEDHLRSCSRIPDHADTTTQ

SEQ ID NO: 17725 - protein, 516 aa, Xylella fastidiosa
MRCTKTTHPVRIENTALMKKKYILAIDQGTTSSRAILFDQKGHIAGMAQREFTQIFPQPGWVEHNPRDIMTSVYTTITELLNNTQIDVRAIAGIGITNQRETTVIWDRQTGQPIYNAIVWQSRQTKDICDQLTTAGYQDLVHAKTGLLIDAYFSGTKVKWILDHVENAHTQATRGELAFGTIDTWIIWNLTGGQVHVTDYSNASRTLLYDIHALRWDPDLLTMLDIPAAILPDVRSSSDIYGLTQTPYFHGEQIPIAGIAGDQQAALFGQACFEPGMAKNTYGTGCFMLMHTGKKAVESKNGLLTTIAWGLNGEIEYALEGSIFVAGSVVQWLRDGLRMFGKASDSQAYADRVSDNGGVYVVPAFVGLGAPYWRSDVRGAVFGLTRSTTKEHFIRAALESMAYQTRDVLSAMQADAGMELKELRTDGAAITNDFMAQFQSDILAVPVLRSEIAETTALGAAYLAGLATGFWSSREEITQHWAINLCFKPQMDKQQREHLYAGWKQAVAATLGFRVA

SEQ ID NO: 17726 - protein, 758 aa, Xylella fastidiosa
MTIVTNLSFPRIGARRELKRALESHWRGETDATQLQHTARELRARHWQLQRDTGVDLPPSNDFSLYDHVLDTAFLFDAIPQRYRALADADPLAGYFAMARGRQADGIDLHALEMTKWFDTNYHYLVPELHRDQHFALRGNKPIAEFEEALALGITTRPVLLGPVSFLLLSKTVDGSNRLDLLERLLPVYTQLLRQLQASGAEWVQIDEPTLVLDLDAQTQQAFRKAYAALNQGPRPKLLLTSYFGPLGDNLELALQLPADGLHIDLVRGTEQLDAVLNTLPAGRVLSAGLVNGRNIWRTALDNALTLARYAQGRIGKDHVWLAPSCSLLHVPVDLEQEKNLDADVRNWLAFAKQKLSELRVLADALDNKPEAETALTQTRQALEARRQSPKVHRPEVAQRLAALTPDTTQRNTAYPQRSQAQQQTLNLPAYPTTTIGSFPQTLEVREARAQFKSGKLSESDYETFLKAETERCIRTQEEIGLDVLVHGEFERNDMVEYFGEQLDGFIFTKLGWVQSYGSRCVKPPIIYGDVVRPAPMTVTWSAYAQSLTDKPMKGMLTGPVTMLQWSFVRDDQERAQTCRQIALALRDEVQDLEKAGIKVIQIDEPAIREGLPLRRGEWADYLNWAVESFRIASSNVRDTTQIHTHMCYSEFNDIIEAVAALDADVISIETSRSRMELLDAFVKFRYPNAIGPGVYDIHSPRVPQEEEMVLLLKKARAVLPPEQLWVNPDCGLKTRGWKETRAALQTMVHAAQRLRAE

SEQ ID NO: 17727 - protein, 444 aa, Xylella fastidiosa
MNHSRSHTLFVQAQTRIPGGVNSPVRAFRSVGGEPFFVARADGPYLFDVDGHRYIDYVGSWGPMIVGHNHPAVREAVQVAISNGLSYGAPCAAEVTMAETIARLVPSCDMVRMVNSGTEATLSAIRLARGATGRNHIVKFEGCYHGHGDSFLVKGGSGMLTLGMPSSPGVPAELSKLTITLTYNDFDAATALFEEMGHHIAAVIVEPVIGNANCIPPRPGYLQHLRTLCTQYAVLLIFDEVMTGFRVALGGAQALYGVTPDLTTFGKIIGGGMPVGAYGGCRDLMQHIAPAGPIYQAGTLSGNPVAMAAGLAMLELIQAPDFYTHLSNAAAALCTGLQQAASQAGIAMTTQQIGGMFGLFFTDQQVETYAQATACNTDRFNRFFHAMLQRGVFFAPSAYEAGFISSAHSPDIIEATLEAARAAFQTIANEAAILSESEAPLKMP

SEQ ID NO: 17728 - protein, 334 aa, Xylella fastidiosa
MAYPHYRPRRMRRHPFIRRLIREYTLTVDDLIWPVFVHGLPGRTPIASMPGVERLSLDALLHEAEHALTLGIPLISLFPVIDPALKSLDAAEAWNPDGLVQHAVRALKTRFPEIGVMTDVALDPYTTHGQDGIINSQGYVLNDITVEALVKQSLSHAQAGADIISPSDMMDGRIGAIRKALDTHPNFVDTSIMAYSAKYASAFYNPFRDAVGSTTNLGKADKKTYQMDPANSDEALREIALDIEEGADMVIVKPGLLCLDVVCRVKETFRMPTYAYQVSGEYAMIKAAVSNGWLEERSSVLETLIAFKRAGADGILTYFAPQVASWLREGKSED

SEQ ID NO: 17729 - protein, 211 aa, Xylella fastidiosa
MKLTVPTWLTLLRIVMIPVLIVVFYLPYQWSNIVATGVFAIAAITDWLDGWIARRYAQHSLLGAFLDPVADKLMVAIALFLIVQGHPTPSMAFWAAVIVSREIAVSALREWMAEIGHRAKVRVAVLGKVKTTAQMIAVLCLLYSVTPEKKAIHQIWFGHLIFQVGYWTLLISALLTLWSGFQYLHAAWPSLRTGKPVVIKTHISKNRKINS

SEQ ID NO: 17730 - protein, 454 aa, Xylella fastidiosa
MYCRRSHLKKPSMSHRTHDYWIAHQGTPLHGVLSIPGDKSISHRAVMFAALADGTSRIDGFLEAEDTCSTAEILARLGVRIETPLSTQRIVHGVGVDGLQASHIPLDCGNAGTGMRLLAGLLVAQPFDSVLVGDASLSKRPMRRVTDPLSQMGARIDTSDDGTPPLRIYGGQLLHGIDFISPVASAQIKSAVLLAGLYARNETVVREPHPTRDYTERMLTAFGVDIDVSTGCARLRGGQRLCATDITIPADFSSAAFYLVAASVIPGSDITLRAVGLNPRRIGLLTVLRLMGANIVESNRHEQGGEPVVDLRVRYAPLQGTRVPEDLVADMIDEFPALFVAAAAAEGQTVVSGAAELRVKESDRLAAMVTGLRVLGVQVDETADGATIHGGPIGHGTINSHGDHRIAMAFSIAGQLSVSTVRIEDVANVATSFPDYETLARSAGFGLEVYCDPA

SEQ ID NO: 17731 - protein, 362 aa, Xylella fastidiosa
MTMRIFNFSPGPATLPEPVLRQAQDEMLEWNAVGASVMEISHRTVEFMELAKGIESDLRCLLGVPDDYAVLFLSGGATTQQALLPLNFAAPGQTADYVVTGHWSKTALKQASPYVNINVVADGERGGFQHIPSRAGWRLSKDAAYVHMTANETIHGVEFRQTPDVGDVPLFADFSSSIAADLIDVSKYDLIYAGAQKNLGPVGICVVIVRRTLLERTGQPRADIFTYASHAERDSMLNTPPTFNWYLLGLTVKWMLAEGGVQEFARRNQAKAQLVYQTIDQSGGFYRNGVAAAVRSRMNIPFFLPNVEQDARFAAEAKAAGLLSLKGHKALGGIRASLYNAMPLAGVQALVAFMHDFQQRYG

SEQ ID NO: 17732 - protein, 248 aa, Xylella fastidiosa
MITAEHLHKSFKTKKGLVNAVKDLSFHAADGRITGLLGPNGAGKTTTLRMLYTLLIPDQGCISIDGVDAVSDPMTVRRGLGVLPDACGIYKRLTARENIAYFGELHGLSRIDIAARLSILSKALDMDDILDRQAAGFSHGQRTKIAIARALVHDPRNIILDEPTNGLDVMTTRKLRDFLRQLRAEGRCIIFSSHIMQEVAALCDHIIVIANGTVVVAGSGDELRARTGKDNLEDAFIDAVGSDEGLHA

SEQ ID NO: 17733 - protein, 638 aa, Xylella fastidiosa
MGKIIGIDLGTTNSCLAIIEGGKGRVIENSEGDRTTPSIVAYTKDGEVLVGAAAKRQAVTNPKNTFYAVKRLIGRKFGDAEVQKDLDLVPYKITQHDNGDAWVATADAKKLAPQEISAKVLEKMKKTAEDFLGEKVTEAVITVPAYFNDSQRQATKDAGRIAGLDVKRIINEPTAAALAYGLDKKGGDRKIAVYDLGGGTFDVSIIEIAEVDGEKQFEVLATNGDTFLGGEDFDKRVIDYLVDEFNKDQGIDLRKDPLALQRLKDAAERAKIELSSSQQTEVNLPYITADASGPKHLNIKLTRAKLEALVDDLVRKSIEPCRIALNDAGLRTSDVQEVILVGGQTRMPKVQQAVADFFGKEPRKDVNPDEAVALGAAIQGGVLAGDVKDVLLLDVTPLSLGIETMGGVFTKIIEKNTTIPTKASQVFSTAEDGQSAVTVHVLQGEREQARFNKSLAKFDLAGIEPAPRGQPQIEVSFDIDANGILHVSAKDKKTNKEQKVEVKAGSGLSDSEIQQMVADAEAHREEDKKFQELVQARNHADGLIHSTRSAIKEHGSKVGGEVIGRVEASLAELEAAVKGDDKNQIEAKSKTLEEVAQSLHMAATAEQQSGSTGAGAGSSAKVDDVVDAEFTEVKGDKK

SEQ ID NO: 17734 - protein, 185 aa, Xylella fastidiosa
MMSNFTISQILARADLLVDRPSIDVAIAHIADDIAQDYQGDVPLFVTIMHGGLPFAGQLALELGQRGQDIELDSLHATRYRGEQTGGALVWSHYPVSAMSGRRVILVDDILDEGHTLSEIRQWCLKQGATDVSLVVLMVKCHDRCIPNMRADYYGVEVPDRYVFGFGMDIAGQLRGIPAIYAMRQ

SEQ ID NO: 17735 - protein, 349 aa, Xylella fastidiosa
MFINAYGAHAGDKPLESMQIARRVPGAHDVQIDIHYCGVCHSDIHQVRSEWAGTLFPCVPGHEIVGRVSAIGTHVKGFKTGDLVAVGCMVDSCKDCQECNAGLENYCDGMIGTYNFPTHDAPGHTLGGYSQKIVVDERYVLRIRHPEAQLAAVAPLLCAGITTYSPLRHWNAGPGKKVGIVGIGGLGHMGIKLAHAMGAHVVAFTTSESKRQDAKALGADEVVVSRDEESMAAHVKSFDLILNTVAASHSLDPFLTLLKRDGTLTLVGAPATPHPSPQIFNLIFKRRSIAGSLIGGIAETQEMLDFCAENGIVADIELIRADGINEAYERMMKGDVKYRFVIDNATLAA

SEQ ID NO: 17736 - protein, 425 aa, Xylella fastidiosa
MMSNSPQTPLATRQRLSEVRYEIRGELARRARELEAEGRKLIKLNIGNPGAFGFRAPEHLQRAIADDMGRTDPYTHQQGLPIAREAIAAAYVRRHYPDADADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAIAVKHHLLLLVDEIYDQILYDGAVFVPVAPLAGTHPCITFSGLSKVHRACGWRVGWALLSGSSIQIDNLRNAMDLLGALRLCANVPGQYAIDAAVNGPDTITPLCSPGGPLYETRRAVIEACVVSEHLSLVVPAGALYAFPSVVGPAARHFDDYAFALELMNDEGVLVVPGSSFNVPYRDHFRVTLLPDAALIREVFSRIDRALSRRAEVAEKVVPLKSRSAAA

SEQ ID NO: 17737 - protein, 720 aa, Xylella fastidiosa
MTYKSPLVTQQNQGASNPQPDSALHGLVLLAQFHGIAADPIQIAHDFGRSGELFDETTLLLAAKKLGLKAKVVTQPVTRIAMAALPALALIPGGTAFIVAKVTGNQILIHDLADQRPRTISHDEFTARYAGRLLQVASRASVLGNLAKFDFSWFIPAVVKYRKLLAEVFAVSLFIQIFALVTPLFYQVVMDKVLVHQALSTLEVIVVGLISLALFEVLLTTLRTHVFAHTTSKIDVELGARLFRHLLALPLAYFESRRVGDTIARVRELENIRHFLTGQALTSVLDLLFTVVFLSVMFWYSSWLTLIVVISLPLYALISAFITPVLRKRLDEKFARGADNQAFLVETVSGIGTVKAMAVDPRVTRTWDNQLAGYVGASFSVTKIATLGQQSVQLVQKLTNVAVLFWGAKLVIDGQLSLGQLIAFNMLSGQVTAPIIRLAQLWQDFQQVGLSVERLGEILNTRTELPGSRMTLPPIQGRITFERLIFRYRPDTPDVLAGIDLDIQPGEVIGIVGRSGSGKSTLTKLVQRMYVPERGRVLVDSHDLSLADPAWLRRQIGVVLQENFLFNRSVRENIAMADPGIPLERVIHAATLAGAHPFIAELPEGYDTKIGEHGTGLSGGQRQRIAIARALIGDPRILIFDEATSALDYESEHAVMQNMRAICKGRTVLIIAHRLSTVRNADRIVVIDKGKIVESGSHETLLNRNNGHYAHLYRLQQGTT

SEQ ID NO: 17738 - protein, 485 aa, Xylella fastidiosa
MLRILAEALTYDDVSLVPSHSTVLPKDVNLETRLTRNIRLKLPVLSAAMDTVTEARLAIVMAQLGGIGIIHKNLTIEQQVAEVTKVKKYESGVIRDPITVDPETSIRDVLALTRAKNISGVPVVDKGQLIGLVTHRDMRFESELDDPVRHIMTKKEALVTVKEGADSQEVLQLLHKHRIEKILVVNDAFELRGLITVKDIQKKSDYPNAAKDAVTRLLVGAAVGVGGETERRVETLAAAGVDVIIVDTAHGYSQGVLDRVAWIKRYFPQLQVIGGNIVTGDAALALMDAGADAVKVGVGPGSICTTRMVAGVGVPQITAVQMVSDALQDRIPLIADGGIRYSGDIGKALAAGASTVMIGGLFAGTEEAPGDVELFQGRTYKSYRGMGSLAAMEKGSKDRYFQEASDVDKLVPEGIEGRVPYRGSVSGIVHQLMGGLRATMGYVGCATIEEMRTKPQFVKITGAGQVESHVHDVQITKEPPNYRMR

SEQ ID NO: 17739 - protein, 295 aa, Xylella fastidiosa
MIVSMLAATDLARILDGRRIADDLLDALKTRVDARVAAGKLPPTLAVVLVGSDPASVVYVRNKRRAAEKVGIKAYDFDLPEATTEAELAALIDRLNADPKIHGILIQLPLPGIPDAHRLIQRVDPRKDVDGFHPQNVGHLALREFGLRPCTPRGIVTLLGHTDRPVRGRNATIVGVSNHVGRPMGLELLMAGCTVTSCHKFTPPQMLEAAVRQADILIVAVGRPGVIPGEWVKPGAVVIDVGINRLDDGRLVGDVGFESAVKRASWITPVPGGVGPMTVATLMQNTLEAAEAADC

SEQ ID NO: 17740 - protein, 296 aa, Xylella fastidiosa
MIKRIRKAVFPVAGLGTRFLPATKTIPKEMLPIIDKPLIQYAVDEAIQAGCDTLVFVTNRYKHAVADYFDKAYELEQKLERAGKYEQLELVRHVLPDGVRTVFVTQTEALGLGHAVLCAKPVVGDEPFAVLLPDDLMWSRNGGALKQMADVAEVSGSSVIAVEDVPVDKTVNYGIVGTDVFDGSKGRITQIVEKPKPDDAPSNLAVVGRYVLSGKIFEMLENTSIGTGGEIQLTDAIAELLKYERVDAYRFQGRRFDCGAHIGLIEATLHLALEHRKHGQAVREILRDTLLPVDKN

SEQ ID NO: 17741 - protein, 387 aa, Xylella fastidiosa
MNFHEYQAKQLFAEYGIPVPAGRIASSADEAVTAAKSLGNGPWMVKAQIHAGGRGKAGGVKFCKTTDEVKQAAAAMLGTKMATYQSAGVALPVNLVLVTEAGEITKELYLSVLVDRGTRSITYIASSEGGVDIEHVAAETPEKIQTLNVDFVEGLQPYQGRDIGFHLGLEAKQVNQLSKIMISLYQLFNDKDLSLIELNPLAILSNGDLYALDGKINSDDNATFRHKELAAMRDKTQEDETEVLASENDLNYVTMDGNIGCMVNGAGLAMATMDVIKLNGGEPANFLDVGGGATKERVTTAFKLILSSNKVKAIFVNIFGGIVRCDMIAEGIIAAVKEVGVKVPVIVRLEGTNVDAGKQLLATSGLAIIPADDINDGAKKAVAAVTV

SEQ ID NO: 17742 - protein, 290 aa, Xylella fastidiosa
MSVLVNKNTKVIVQGFTGQQGTFHATQMVEYGTQVVGGVTPGKGGNTHIDLPVFNTVREAVQNTGADASVIYVPPPFAADAILEAAAAGIKVIVAITEGIPVLDMLRVKNVLKASPEITLIGPNCPGVITPGECKIGIMPGHIHKPGHIGIVSRSGTLTYEAVKQTTDVGLGQSTCIGIGGDPINGLNFVDALKLFNNDPQTKGIIMVGEIGGDAEEAGAEYIKHHVKKPVVGFIAGASAPKGKRMGHAGAIASGGSGTAEGKFAAMEKAGIKTVRSPGDLGAAIASLVK

SEQ ID NO: 17743 - protein, 1167 aa, Xylella fastidiosa
MRLSTIKLSGFKSFVDPATLHLPTNMTCIVGPNGCGKSNIIDAVRWVMGESSASRLRGDSLTDVIFSGSSARKPVAQATVELIFDNSDHTISGEFAAFNEISVKRTVSRDGSSVYSLNGTKCRRRDITDLFLGTGLGPRSYSIIEQGMISQIIEARPEDLRIYLEEAAGISKYKERRKETESRIRHTQENLDRLNDLREEIGKQLEHLKRQARQAEQYQTLQEERRVKDAECKALQFRELDIRLQALRQALLQEETRLQQLLAEQREAEMRIETSRVRREESAEALATAQADVYQVGATLARIEQQIQHQREMSQRLHKARDEAQNQLIDLTRHMGDDAATLAVLREAVENNEPQLHVLREQNEFKQDALRDAEAALTDWQQRWESHNRETSEASRAGEVERTRVDYLDRQALDAERRRDLLLAERAGLDLDALAEAFEQIEVQYETQKAALDGLNDQLEQRKQTLADGQHQQRTAQTELADVRKHAQTARGRLSSLETLQQAALGQEQGAAMTWLQAHGLSSAARVGERIRVESGWENALESALGHMIEGVLVDDPRTLVEALSGLNEGHIALVADTQTQIQVAPTSLAAKVQGPVAIRRLLTHLHGAEDLVAARALQATLSEGDWVMTRNGECLGEGWLRVSRSGAAEQGALLRERDIQTLRAQIETLQEREAELEHRLTHFRDHLLMAEQHREDAQRQLYIAHRGVSELAGQRQAHHGKLEASRGRIQHIEAEIAQLLETLDTSRDQARTARATLDDAVTRMGDLESRRQALHAERQQLNVTRDQAREAARSVREAMHALALTLESQRTQMVSLSQTLQRMDNQRGQLDARLEELMIQLGEGDSPVEILEQQHQAALSERVRTEHLLGQARTHLDGIDAELRQFEHTRQQRDEQALSQRERISQCRLDQQALALGAEQRQAAVEKVGFVLQHLVDALPEAANPADWEAAIEQLDIRIRRLEPVNLAAIHEYNEAAQRVEYLQAQHEDLTVALQTLEEAISKIDRETRGRFKETFDRVNAGLQTLYPRLFGGGHAYLELTSEDLLDTGIAIMARPPGKRVSSISLLSGGEKAMTAVALVFAIFQLNPAPFCLLDEVDAPLDEANVGRLASMVKEMSEKVQFLFVSHNKSTMEAAQQLSGVTMREPGVSRLVSVDLAEAARLVDGS

SEQ ID NO: 17744 - protein, 246 aa, Xylella fastidiosa
MALIKFENVCVDFPIYNASSRSLKKQLIQAVTGGQLRKEESGRVVVSVLKGLTFTLQDGARVGLLGHNGAGKSTLLRLLNSVYFPSSGQALIEGTTGSLIDISLGTDPEATGRENIYLRGALLGMTKSEINRSVNEIIEFSELGNFIDMPLRTYSTGMHLRLAFSVSTIVYPKILLMDEWLSVGDEGFKQKAEKRLSELVQATNILVVASHSKQLILNTCNRVIWLEHGQIRMDGDAQEVCTAYFG

SEQ ID NO: 17745 - protein, 359 aa, Xylella fastidiosa
MPGANLSNMYSLFRPLLFTCDTERAHDISLCTLDIAYHSGALPLLTRHPRPLPTTAFGLNFPNPVGLAAGLDKNGTHIDALFALGFGFIEIGTTTPRPQPGNPKPRLFRLTQQQAVINRMGFNNLGVDALVRNVAGARQRNGPLGINIGKNKDTPNEQASNDYRYCLERVYALADYVTINLSSPNTAGLRALQEEQTLRRLIGELREAQETLAAKHGRHVPMLIKMAPDLSDSDIDAAARVLNEMSVDGVIATNTTVTRPLLRQHRLASETGGLSGAPLLGQSTLVLRRLRTHLPETIALIGVGGICCGADAVAKMAAGANLVQCYTGLIFKGPQLVGECVEAIRRRREASSSGRASTQ

SEQ ID NO: 17746 - protein, 564 aa, Xylella fastidiosa
MRRHLALFSGWLIALAVSSAATLTLPSAFKQMIDHGFSSEGQINRTFALLLLVAVILAVGTAARLFSVSLLGEKIITDLRSHLYAHLIGLDASFHDRNRSNELVSRLATDSELLRSIIGSTMSVATRSTVTAIGSLIMLFITSPRLASLSLVVIPLVILPIVLGAQHLQKAARTSQDRIADTNSFAAETLRALRTVQAYAREHYERTRFDRTLETSLQAARQRIHIQTWVTAASIVLIFSAIVGVLWAGAHDVIAGRMSAGTLGEFVLYALIGGGSIGALAEVWNELQRAAGGMGRIFELLKEKNTLTVPATPALLPQPLRGEIRFERVGFHYPQRPETPALDDIDLHIRPGETIAFVGPSGAGKSTLLSLLLRFYDPTHGRILIDGVDLRQTDPKVLRTHIALVQQQPTLFTASAMENIRYGRLDATTAEIEIASRSSEADGFIRALPQSYATELGEHGMSLSGGQQQRIAIARALLKEAPILLLDEATNALDAQNEQAVQQALERLMTGRTTLIIAHRLVTILKADRIVVMDQGRIVAQGTHSELIAAGGLYAKLARLQFIE

SEQ ID NO: 17747 - protein, 335 aa, Xylella fastidiosa
MTQTITVIRGDGIGPEIMDATLLVLNTLQANLNYEFADAGLNALEKHGDLLPEATLNSISKNKVALKSPLTTPVGEGFSSINVALRRKFDLYANVRPAKSFPNTKSRFSDNVDLITVRENTEGAYLSEGQTISPDGEVATSSARVTRKGSERIVRYAFDLARTTGRKKVTAVHKANIIKSTSGLFLKTARDVASQYPEIDFQEMIVDNACMQLVMRPEQFDIIVTTNLFGDILSDLCAGLVGGLGLAPGANIGNEQAIFEAVHGSAPDIAGQGKANPCALLLGAVQMLDHIGQPQNAERLRNAIVATLNAKDSLTPDLGGNGNTMEFAKAIASRL

SEQ ID NO: 17748 - protein, 173 aa, Xylella fastidiosa
MMSPLCYDIFDSPIGILTVVADTDALCRVMLPSNDHTTQEHKCWHYAPSTTLLKQARTQLLDYLHAELHTFSLPLRPQGTPFQCAVWHALAHISFGQTWSYAQLAAHIGRPSASRAVGAANARNPLPIVLPCHRVIGSNGALTGFNGGLHIKRSLLYLEGIKPTHTCKAIMTS

SEQ ID NO: 17749 - protein, 1388 aa, Xylella fastidiosa
MKDLMTSYSFTEKKRIRKDFGKHRSILKVPFLLAIQVDSYRAFLQGDVESSQRKDIGLHAALKSVFPIVSYSGNAALEYVGYKLGEPMFDERECRQRGMSYGAPLRVTVRLVIYDRESSTKAVKYIKEQEVYLGEIPLMTENGTFIVNGTERVIVSQLHRSPGVFFDHDRGKTHSSGKLLYSARIIPCRGSWLDFEFDPKDALFTRIDRRRKLPVSILLRALGYSNEEILGEFFEINTFHINPDKGVQLELVPERLRGEILSFNLTDGGGVIVEAGKRITARHVKQLEASGISALAVPDEYLIGRILSHDVIDATTGELLASANSEVNEDRIVAFRKAGIDSVGTLWVNDLDRGAYLSNTLRIDPTRTQLEAQVEIYRMMRPGEPPTKEAAQNLFHNLFFTFDRYDLSMVGRMKFNRRVGRKEVAGEPVLYDKKYFSDRNDEESRRLVSKLGETSDILDVIKGLCEIRNGRGVVDDIDHLGNRRVRSVGEMAENVFRVGLVRVERAVKERLSMAESEGLTPQELINAKPVAAAIKEFFGSSQLSQFMDQNNPLSEVTHKRRLSALGPGGLTRERAGFEVRDVHLSHYGCLCTIETPEGPNIGLINSLAVFARTNQYGFLETPYRKVVEGRVTDEVEYLSAIEENQYVIAQANTLTDDNGQLTESFVPCRFQGESLLKPPSYVHYMDVSPMQTVSVAAALVPFLEHDDANRALMGANMQRQAVPTLRAQKPLVGTGIERTVARDSGVTVNARRGGVIDQVDAGRIVVKVNESEIIGATDAGVDIYGLIKYTRSNQNTCINQRPLVNVGDIVTSGDVLADGPSTDIGELALGQNMLIAFMPWNGYNFEDSILLSERVVEEDRYTTIHIEELTCIARDTKLGSEEISADIPNVSEQALNRLDESGVVYIGAEVRAGDILVGKVTPKGESQLTPEEKLLRAIFGEKASDVKDSSLRVPPGMDGTVIDVQVFTRDGIEKDKRAHQIEEYEIKRVKKDFDDQFRILEGAIYARLRSQIVGKVVNSGVDIKKGEVITGAYLDGLKKSDWFALRMKDEVAVEAIDRAQKQIQAYQKEFDQRFSDKRSKITQGDDLAPGVLKMVKVFLAVKRCIQPGDKMAGRHGNKGVVSNVVPVEDMPFMEDGTPVDIVLNPLGVPSRMNIGQILEVHLGWAAKGLGHRIQRMLEANAAIADLRKFLNEIYNHDKSVVGERVDLSQFSDDELLNMAKNLTDGVPMASPVFDGASEQEIKRMLDLAELPTGGQTQLYDGHTGEPFDRKTTVGYMHYLKLNHLVDDKMHARSTGPYSLVTQQPLGGKAQFGGQRFGEMEVWALEAYGAAYTLQEMLTVKSDDVQGRNQMYKNIVDGDHQMVAGMPESFNVLVKEIRSLAINIELEDN

SEQ ID NO: 17750 - protein, 312 aa, Xylella fastidiosa
MVFSGNANKPLTQSICKELGVRMGKSLVSRFSDGEEQVEIEESVRRQEVFVVQPTCAPSAENLMELLVIIDALKRASVSSVTAVIPYFGYSRQDRRMRSLRVPITAKVAAKMISAIGADRVLTIDLHADQIQGFFDVPVDNVYASPLLLADIWRAYGTDNLIVVSPDVGGVVRARAMAKRLGDTDLAIIDKRRPRANVATVMNIIGEVNGKTCVLVDDLVDTAGTLCAAAVALKQNGATKVVAYITHPVLSGPAVDNINNSELDELVVTDTIPLSDAARECRKIRQLSVAELLAETIRRIAFGESVSSLYVD

SEQ ID NO: 17751 - protein, 298 aa, Xylella fastidiosa
MGRVDPVSVVVDDGVGWSAWPAPAKLNLFLQITGRRVDGYHELQTVFRLLDWGDTIHLRVREDGQIHRIGESVTGVVEADDLVVRAAYLLKYATNVHLGADIFVEKRIPVGGGFGGGSSDAATVLLVLNALWHTRLDVAVLAALGLRLGADVPVFVHGCNAWAEGVGECLTPMILPGAAYLLLDPGVCVPTRELFLDPDLTRDASPATIGDFIAGTAFGNAFEPVLRRRESAVAGALDVLSEVGFARVTGSGSGCFVEFSTRDEAECALERLPYGLCAWVADGASRSPLLDVLKTMEF

SEQ ID NO: 17752 - protein, 432 aa, Xylella fastidiosa
MTLWVLGLNHQTAPMELRERASFVGDALPRALDSLRNLPNVNEAALLSTCNRTELYAETTNAQILLNWLEQHRPGLQNHLYQYRDAAAVRHLFRVATGLDSMVLGESQILGQVKDSWSMARTHGTLGNTLDRLFQHGFSVAKHARTNTRIGANPVSIASTAVRLAQDAFSPLNESTVLLIGTGETIQLAAKHLSEGRVQRLLIANRTHAKAQMLASQHGGYALPLTELNLHLAEADIIFSATAAPTPIVTQSNVESALHIRKRKPMLLFDLAIPRDIETEVGTLTDAYLYTIDDLERAVEENRRSRREAAETAEAIIELQVKRYMDTLQAHAHQAPLRRLRTFGTTTRDELLTRARQQLANGRPAEEVLEQLAHGLTNRLLHPPTAALREAALANNTELVRAAEQLFPEKPGYHHPTLQTTIVKTDETDPAS

SEQ ID NO: 17753 - protein, 680 aa, Xylella fastidiosa
MSQANGLPYTDRYNTYPENVSLMHGLNSPQRAAVLYREGPLLVLAGAGSGKTHVIVEKIAYLITSDCYPAKRIAAITFTNKSAKEMRERVAKQIKSSRADGLTICTFHALGLKFLQIEHDAVGLKPGFSVFDADDADAQINDLLHGAKQDVIDDTKRRISRAKNAGLSPEQALAAARTTREMEVATLYARYQARLIAFNAVDFDDLIRLPVQILETSDQVAMAWRERIGYLLVDECQDTNDAQYRLLKVLASPRGNFTCVGDDDQSIYAWRGANAENLLQLERDYPQLKVIKLEQNYRCPNRVLRAANALIAHNPHAHLKTLWSDQKDGERIRIWECRDSEHEAEKIAGEISYLGDAKQVPWSDFCILFRGNFQSRPLEKALQLLRIPYHLTGGTAFLERQEVKNLLSWLRLLVNPDDDAAFLRAVQSPKREVGSTSLAKLAELAAAKQMPMSRAAESLGALQQLPARAANGLNKFTDILRELRQQVSRVSAAELVRRLAEVSGLLTELREQSNDEASYQRRKRNVEELAEWFEGGPFGASVGDLVSQLALLSRNDKDDGGNQVRMMTLHASKGLEFRYVFIAGCEDGVLPHEVSLEEGNVQEERRLLYVGITRAKEQLWMSYSKCARRFGERVRFKPSRFFDELPAEELQRDGADPVVDAERKQERAKAGLAAIQALLD

SEQ ID NO: 17754 - protein, 256 aa, Xylella fastidiosa
MNSMNEQGEAINNSAESRIQLESSWKAHVGNWLLRPEMRDLSAFLRARKVAGVSVYPPGSQIFAAFEATPFQRVKAVILGQDPYHGQGQAHGLCFSVRPGMPLPPSLLNIYKELEEDLGLLRPDHGCLLPWAKRGVLLLNAVLTVEDGRAGAHQGKGWEGFTDHVVDTLNREREGLVFMLWGSYAQAKGKVIDTRRHLVLKAAHPSPLSAHRGFLGCRHFSLCNQYLSQHGLGMVDWSLPPCIALDGAILNGRIAV

SEQ ID NO: 17755 - protein, 544 aa, Xylella fastidiosa
MMSDKPLTNLNFSSLDLHPALLTGLTRAGFTLCTPIQALTLPVALAGRDIAGQAQTGTGKTLAFLVVVVNRLLSRPGLVNRNPEDPRALILAPTRELAIQIYNDAVKFGGNLGLRFALIYGGVDYDKQREMLRKGADVVIATPGRLIDYLKQHEVVSLRVCEICVLDEADRMFDLGFIKDIRFILRRLPERCSRQTLLFSATLSHRVLELAYEYMNEPEKLVAETETVTTTRVRQRIYFPAEEEKIPLLLGLLSRSEGMRTMVFVNTKVFVEGVARALDEAGYRVGVLSGDVPQRKRETLLNRFQKGQLEILVATDVAARGLHIDGVNYVYNYDLPFDAEDYVHRIGRTARLGADGDAISFACERYAMSLPDIEAYIEQKIPVAAVTAELLAPLSRPERASNGNGDTVGDISPHSLDVLVAQEWRRGKPRGSPGERDGRPRVGKGPRSDGGGGRRRTKFRLETERDSSVDGAVTPVFGVSTGIVSAPGKEVGRNLGRRRRSRSMDSGESGHVVATTAQVAVKSGSQPSLLGRIGHRIRSLLNMF

SEQ ID NO: 17756 - protein, 356 aa, Xylella fastidiosa
MPISFLCPLCIPSCFLILLTALTTLTPASPSHATNILTYAGINLPGPEFSPSNKPGVLYKDYLYPSASDYAYVVKKGMNIVRLPVLWERVQPTLNDALDATQLKLIIKAVEQAKAQKLNIILDVHNYSEYNDELIGTDNVPISAFADLWKRLSLQFANDKAVIFGLMNEPHEITSTTWAQAAQAAINAIRSTGACNNLVLVPGTAYSGAHSWLSSYYGIPNGEALLNINDPAKHMAFEVHQYLNENSTGTTGECISTTIGAEKLEAFTNWLRTYHKTGFLGEFATGNNDTCNQALEGMLSYIEENADVWLGLTWWGSNPWFGPDYPFNLHPNSDGSDKPQMSILESHARKITKIHK

SEQ ID NO: 17757 - protein, 305 aa, Xylella fastidiosa
MQHRRWTRATATMIASFSSIAMPHVSLLPSPSPIAFIGGGNMARSMIAGMIRQGAPSTSICVIEPIAALRDALIADFNIKAVTTATEAATDTSTWVLAVKPQVMPDVCATLPLPVQPNTPLVISIAAGITTCKLKHWLGDTCAIVRAMPNTPALLGAGVTGLFATSHTTATQRTLAEELFNSVGKTLWITEEALMDAVTAVSGSGPAYAFLLAEAMEAAAIMQGLSTANARTLVQQTLLGAARMMTELGETPAALRHRVTSPHGTTEAAIATFQENDFQALVAKAIDAATRRARALGKANDTEPT

SEQ ID NO: 17758 - protein, 296 aa, Xylella fastidiosa
MQDLKKKVILVTGASDGIGKFTAATLAKQGHKLIIHGRNRQKTEAALAEIKRQSGNPDVAMFLADFLPLAGVKAFADAIKEKYDHIDVLINNAGAQFTEQREVTSEGHEKTMAINVFAPMLLTKLLMPLLVKSESARVVTVASDAHRMAGKPDLDDIELKQGYHMAKAYSLSKLYVIWVMHHFIGETKKAGIHNVTFNLVHPASTRTNLGREAVKSWKWKIIFFLWQIMLVSMDKAASSTLYAATAPELEGVSGRYFGPKGEEQPSAKYHSPENEQKVWDYALNAIRPYLPAGAQS

SEQ ID NO: 17759 - protein, 67 aa, SPHINGOMONAS
MPKRTDLKTILIIGAGPIVIGQACEFDYSGAQACKALRDEGYRVVLVNSNPATIMTDPNMADTVYID

SEQ ID NO: 17760 - protein, 119 aa, SPHINGOMONAS
PRKCERFLANTQLNRKSRVRDLSKGMIVQLHLALVMAIDARILVLDEPTLGLDILYRKQFYQRLLEDYFDEQKTIIVTTHQVEEIEHILTDVMFIRDGRIVLTADMEHVAERYTEVLVN

SEQ ID NO: 17761 - protein, 171 aa, SPHINGOMONAS
LQQEGIDCNLTLIFNGSQALACAEAGVFLISPFVGRILDFFVAKGQTPASIDEDPGVVFVPGVYDEFKRRGSSTVVMGASFRSTAQIEALAGCDRLTISPDLLEKLDADHGDLPRKLSPLNADNAAITPINSDSFATDLAADDMATEKLASGIDTFAKDLEALRKTIADKL

SEQ ID NO: 17762 - protein, 204 aa, SPHINGOMONAS
  unsure (1)..(204): unsure at all Xaa locations
QKGYRVFGHVHRTSSVNFWRIEELGIAAHPNLNLIEYDLTDLGSSIRMLESTGATEVYNLAAQSFVGVSFDQPTTTAQITGIGPVHLLXAIRQVNRDIRFYQASTSEMFGKVQTVPQIESTPFYPRSPYGVAKLYAHWMTVNYRESCDIFGCSGILFNHESPLRGSPFVTRKISDSVAKIKLGQLDCMELGNLDPKRDWGDARE

SEQ ID NO: 17763 - protein, 90 aa, SPHINGOMONAS
SHYVHKRDAPSGTALTLGEAATGFGAQPRFASVRAGDIVGEHSVQFTGLGERVELIHRATNRDIFARGALHAAKRLLGKPPGSYRVRDLV

SEQ ID NO: 17764 - protein, 405 aa, SPHINGOMONAS
MAKIKVATPVVEIDGDEMTRIIWEWIRERLILPYLDIDLKYYDLSVQKRDETNDQITIDSANAIKQYGVGVKCATITPDEQRVEEFSLKKMWKSPNGTIRNILGGVIFREPIVISNVPRLIPGWTKPIVVGRHAFGDQYKATDFKVPGKGKLTMKWEGENGETIEHEVFDFPQAGVAMGMYNLDESIRDFARASMNYALGRGWPLYLSTKNTILKAYDGRFKDIFAEVFETEFKDQFQSAGIVYEHRLIDDMVASALKWHGEFVWACKNYDGDVQSDQVAQGFGSLGLMTSVLMTPDGKTIEAEAAHGTVTRHYRQHQQGKATSTNPIASIFAWTGGLKYRGKFDGTPEVTRFAETLEKVCIETVESGKMTKDLALLIGPDQAWMTTEQFFEAIRVNLETAMGSW

SEQ ID NO: 17765 - protein, 296 aa, SPHINGOMONAS
DLTFVTLDEGTSVAGVMTTSKCPSPEVEWCRKALPLGKARALVVNAGNSNAFTGNRGRAAVEAIAARTAQHLGCDPSDVFVSSTGVIGVPLPIDKAEAGLDAAYVAEPCSWEQAAATIMTTDTFAKGAVTTAVVDGRTVTLAGIIKGSGMIAPDMATMLGYVFTDAAVDPVFLQRALSEANGTSFSCITVDGDTSTSDTVLAFATGKAGNAPLASDEDDGADAFRAALADLCRQLALLVVRDGEGAQKLIAITVEGAESDRSAHRIAMSIANSPLVKTAIAGEDANWGRVVMAVGK

SEQ ID NO: 17766 - protein, 367 aa, SPHINGOMONAS
RGWCPDAWRPMAAGDGLLVRVKPRLGRLTRAELALLADASARFGNGLVDLTNRANLQLRGVSDAGWPALLDLLTAHALVDPDRTRERRRTLIVAPDWEQGDDTHRIATDLLARIDALPALPGKTGFVIDAGPAPLLRDAPGDFRIERGEAGGLILRAEGRGTGMPLAPGDEAAALARLARWFVDSGGVAAGRMARHTAPLPDWALGTEPPAAPRTAILPGAHPMGSAVGAPFGQMTADSLAVLAGQPIAAVRVTPWRVLLAEGPLAADPRFLADPADPLLRTDACAGAPACPQASVETRSLARALAPQVDGRLHVSGCAKGCARALPADVTVTGRNGLLDLALDATAGAPPDHVGLEPAALLALLGK

SEQ ID NO: 17767 - protein, 571 aa, SPHINGOMONAS
YVAFYLWLRAQAIDALVQVGAHGTLEWLPGKAVALSDACWPEALAGDLPILYPFIVNDPGEAAQAKRRTGAVTIGHLPPPLKTAGSGAGLGRIEALLDEFSNAVGLDPARRDRLQVAIREEARAVGLDAELGLDTATSTAEAITRIDRFVCDVKEGQFGDGLHVFGRGQCGAAERDGLLAGLAGRRVPAGPSGSPFRGRRDVLPTGRNLYAIDPRAVPSRAAHAQGIVLADELIRRHLQDHGDYPKGLVVDLWGSATMRTAGEEFAMALHLLGAAPVWDSASERVTGVEILPLAMLDRPRIDVTLRISGLFRDAFPTLPQLFGQAVRALAARDEPADWNPFAGQVAGARVYGPQPGDYGLGMGATVDTYTEDARRAAGEAWLVASDHAFDLPEAQADPAGIRARVASADTFVHVQDLAETDLLLAADYAAHEAGFAAAKALGGGRAAALYHLDSHDPARAVARPLTEEVARVVRARAAHPGWISGMLRHGFRGAAEIAATLDHLGSFAHLAGAVPPQLFDLYHDATLGAPEVRAFLARENPAALAAMEARFAALHAAGLWPTRRNSILASL

SEQ ID NO: 17768 - protein, 464 aa, SPHINGOMONAS
LAESYDVLVLGSGPGGYVAAIRAAQLGLKTAIVERELLGGICLNWGCIPTKALLRSAEIFHYMQHAKDYGLIANQISADLDAVVKRSRGVAKQLNQGVTHLMKKNKIAVHMGTGVLTAKGKLTVTAADGKKTELEAKNIIVATGARARDLPFAKADGKRIWTYRHAMTPTEMPTKLLVIGSGAIGVEFASFYNDMGAKVTIVEMLDRIVPVEDKDVSAHLEKAFKKQGMTILTQTGVEKLDVTATGVKASIKDKDGKVTVEEFSHVIVAIGIVPNTENIGLETLGVKTERGHIVTDGACRTNVEGLWAIGDVTAPPWLAHKASHEGVIAVEAINGGHPHAMDPRNIPGCTYCHPQIASVGLTEAKAKEAGYEVKVGNFPFIGNGKAIALGEPEGFVKTVFDAKTGELLGAHMIGAEVTEMIQGYTIGKTGELTEAELMETVFPHPTISETMHEAVLGAYGKALH

SEQ ID NO: 17769 - protein, 528 aa, SPHINGOMONAS
RMSMLRKTLLAGAALLLAPLPALAQDGSNSIIVGLAAAKSGPTIDRHIFGQFAEHLGSGIYGGIWVGKESPIPNTRGIRKDVVAALRAIKVPVVRWPGGCFADEYHWRDGIGPQEKRRSSVNTNWGGAGEPNSFGTDEFMDFADQVGAEAYISVNVGSGTIQEAADWLAYMTADPSSTAGKERAANGHVAPYKVKWLGLGNESWGCGGSMRPDHYVDLMKRFARFTHNLDPKQGEKGPEPMQRIAVGPNDGDTTYTEAVMAAWKGHDWAWNIEGLSMHAYTTGGWPPSMPSVGFDETGYARLVKAALAMDGMIAKHSAIMDKYDPEKKVPLVIDEWGVWLAPLPGSNPGFLTQQNSLRDAIIAALHFNIFARHADRVKMTNIAQMINVLQAMILTDKEKMVLTPTYHVFRMYVPFQDAQAVPVSFDAGTYTQGDVTLPRVDAIAARGKDGKLWLAVTNLDAGKPARFDVKLAGLTAKTAKGEVLTAAKVDAVNSFEAPNAVVPKPISGKVAKGAVTLELTAKSVPVVD

SEQ ID NO: 17770 - protein, 470 aa, SPHINGOMONAS
  unsure (1)..(470): unsure at all Xaa locations
ATKTTTFDRLNPVTGAVASTSTAATPADAAAAVERADAAFPAWSGLGPTARRAALVRAADALEARADAFVEAMMGEIGATEGWARFNLMLAANMVREAAALTTQIGGEVIPSDKPGCIAMAVREPVGVLLGIAPWNAPIILGVRAVAVPLACGNTVVAQGQRAMSAHPXPDRRSVGTRRXCPDGAVSIVTNAQEDAAEVVGALIDHPKIRRINFTGSTHVGKIIAQRSAEHLKPVLLELGGKAPLIVLDDADLHEAVKAQGRRRFMNQGQICMSTERIIVLDAVADAFVEKFAAKVATLAVGDPREGKAPLGAVVDRKTVGHVQSLVADAVADGAVQVAGGPADGVLMPAHVVDRVTPAMRLFREESFGPVVGIIRAADEETAIALANDSEYGLSASVFTRDTARGLRVARRIQSGICHINGPTVHDEAQMPFGGVKASGHGRFGGKAGIDFFTELRWITIETQPGHYPI

SEQ ID NO: 17771 - protein, 242 aa, SPHINGOMONAS
MSPTLNRDMMEVLHALEFRDDVGVLVLTGEGAAWTAGMDLKEYFRETEAGGLGATRQAQRESYGWWRRLRWYQKPTIAMVNGWCFGGGYGPLFACDLAFAAEEAQFGLSEINWGILPGGGATKVAVELTSFRNAMYHAMMGENIDGKKAAEWGLVNEAHPLDQLKARVTEVANVLLKKNPVALKATKDAVRRVSIMSYDDAEDYLVRAQEAANSFDNEGRKEGIRQFIDEKSYKPGLGAYDK

SEQ ID NO: 17772 - protein, 714 aa, SPHINGOMONAS
VQSKLNAVVNIIGEALHSEVCSIYLLREGALELFATRGLKQEAVHVTKLGMGEGLVGTIAAHVETLNLDEATSHPNFVHNPETGEDRFHSFAGVPIIRRERAVGVLAVQHVDPRRYADIEIEALQTVAMVLSELIANAELIDAAGGASTRLQPTASGTIRGFRLVEGMARGVAVFHQPRIVIEHTVADDTEAERHRVYAAFDKMREQIERMTSQAEFGSGGEHEEILATYKMFAYDEGWSRRINEAIDSGLTAEAAIERVQQRTRQRMREIDDPLLRDRMHDLEDLSNRLLRIVSGQLGTAAQLGLRQDSILIARNLGPAELLEYDRRRLKGVVLEEGSLTAHVTIVARAMGVPVLGRVREIRREVAEGDLLLLDVGEESVFVRPSLAMEEAFEAKLALSQKRRAAFAQLKNVAPVTRDGHRVTVMVNAGLRDDVAALDLTGADGIGLFRTEFQFLVSATLPQREAQRRLYRDVLETAGDRPVIFRTVDIGGDKALPYLNHDEDGEEENPAMGWRALRLALDRDGLMKAQARALIEAAAGRTLNVMFPMVSEPWEFDQARALFEAQHAWLAARGRKMPTEIRYGAMLEVPALAEMLDMLLPKLQFLSIGTNDLTQFLFAADRAHPKLALRYDWLSPAILRFLKRVSDQARAAGVPVAVCGEMGGRPLEALALIGLGIDRLSITPAAVGPIKAMLRSLDRDAVMAAMTAMLAHPQ

SEQ ID NO: 17773 - protein, 427 aa, SPHINGOMONAS
  unsure (1)..(427): unsure at all Xaa locations
MARIVMKFGGTSMAGIERIRSVAARVKREWEAGNQVAVVVSAMAGETDRLVGFCREASSLYDPKEYDVVVSAGEQITSGLLAIALQAIGVPARSWLGWQLPVQTSDAFAKARIEDIGTDALLASMNAGEVAVVPGFQGVHEGRITTLGRGGSDTSAVAVAAAVKADRCDIYTDVDGVYTTDPRIVPRARKLKRVTYEEMLELASVGAKVLQTRSVGLAMKEGVRVQVLSSFTGDDAPMADTLPGTMIVGEEEIQDVERQLITGIAHDKNEAKITLTAVPDKPGAVASIFTPLADASINVDMIIQNIAHQSAGSASATDVTFTVPAADLARSLEILAQQKDAIGFSDISHDTRVAKVSVVGVGMRSHAGVAATMFQTLGARGINIQAITTSEIKVSVLIEEDYTELAVRVLHTAYGLDADEVAAXAGT

SEQ ID NO: 17774 - protein, 381 aa, SPHINGOMONAS
LMPVYPRCGVRPVRGEGCYLIGERGERYLDFAAGIAVNALGHGHPHLVKAIADQAATLMHVSNLYGSPQGEALATRILKHSFADTLFFTNSGVEAIECAIKVARRYHYVNGNPQRHKLITFKNAFHGRSLGAISATDQGKMRDGFEPLLPGFDYVPFNDLEGALAKIDGETAGFLVETIQGEGGMTAGKPEFIQGLRKACDEHGLLLILDEIQCGYGRTGKMWAYEHYGITPDIMTSAKGIGGGFPLGACLATEEAAKGMVAGTHGSTYGGNPLGMAAGMAVLDVMEEPGFLEHVTRMGERLRQAFEQMIPNHDHLFEEIRGKGLMLGIKMKDTVVSRDFVAHLRDHHGLLTVAAGENVFRVLPPLVIDESHIAEAVDKLS

SEQ ID NO: 17775 - protein, 262 aa, SPHINGOMONAS
LAGHVLAMIFEKNSTRTRVSFDMAIRQLGGTSIVMDAGSMQLGRGESIADTARVLSGYVDAIMIRTDDHQKVIDMAKYASVPVINGLTDASHPCQIMADLLTILESGKALPGLKVAWLGDGNNVLASIMEAAGLMQFDVVAACPQGYQPSDADLAKGKGRARVVGTAREAVEGADILVTDTWISMGQAHAETKLKAMMPFQVTQALMAAAKPDARFLHCLPAHRGEEVTDAVIDGPQSLIWPEAENRLHAQKSVLRWCFGQI

SEQ ID NO: 17776 - protein, 280 aa, SPHINGOMONAS
VPKVTLNNGVEMPILGFGVFQVPDPAECERSVRDAIDIGYRLLDTAASYGNEEAVGAAIRTHGIDREALFVTTKLWIQDASYEGAKAAFERSINKLGLDYLDLWLIHQPYGDVYGAWRAMEELHKAGRVRAIGVSNFYPDRLVDFVLHNEVKPAVNQIEIHPFHQQADAAKVLADYGVQAEAWGPFAEGKNGLFTNPVLQSIADRHGRSIAQVVLRWLTDRGIVAIPKSVRKERMAENVAIFDFDLDADDLKAIEGLDQAQSSFFDHRDPAMVKWLGTRK

SEQ ID NO: 17777 - protein, 258 aa, SPHINGOMONAS
GTGPLGLAIARRVGAGKHVLLADVHEETANTAAERLLDAGFDASAAVVDIASRASIEALVERATGLGAVTGLIHAAGVSPSMASAEVILKVDLYGTAVLLETFGDVIAPGGSGVVIASQSGHRLGALTAEEDAALATTPTEELLALPLLQDVTDTLHAYQLSKRANVLRVKGEAPRWGKRGARVNAISPGIVITPLARHELTGPRADYYNRMIQGSPVGRAGTPDEVGAVGALLMGPDGAFITGSDFLMDGGVTASWF

SEQ ID NO: 17778 - protein, 278 aa, SPHINGOMONAS
  unsure (1)..(278): unsure at all Xaa locations
VIVVIGAGGIGQAIARRQGFGRKVVLADWNAETLAKAADTMRDASYDVVTQQVDVTSHASVQALAKAAAALGPVMQVVNTAGLSPNMAPVEKILEVDLYGSAVVFEEFGAVIAPGGAGLIISSMAGHMMRQLPEEDEKQLAHTPVDQLLSLPCLQSDRIPNTLVAYMVAKRANFLRVQAEAIRWGERGARVNAISPDIIVTPLAAHELNSEIGDIYRGMVEASPSKRMAPPEEIAIAASFLLGPDAGFITGSDLLIDGGVIAAMRAGKLPTPAXSPPG

SEQ ID NO: 17779 - protein, 375 aa, SPHINGOMONAS
PELFDALLDTVRRFVAERLRPLEAAVEAADAIPEHIVEEMKALGLFGLSIDEEHGGLGLTMGEECRVAIELGRTTPAFRSAFGTNVGIGSQGLVIAGTPEQKAHWLPRIARGAIITSFALTEPDVGSDSGAVQTRAVRDGDVYRLSGTKRYITNADKAQLFTVMARTGAEAGGRGVSAFLVPRDLPGVSIGEPEKKMGQKGARVADVRFDDVAVPVANRLGAEGDGFRIAMQVLDRGRLHIAAVCVGVAERLIADCVAYAGERKQFGKPIAEHQLIQAMLADSKTEALAARALVLETATAKDAGANTTMEAAAAKYFASEMVGRVADRAVQIFGGAGYIADYGIERLYRDVRLFRIYEGTSQIQQLIIARETLKR

SEQ ID NO: 17780 - protein, 245 aa, SPHINGOMONAS
FRLDGRVALVTGGSRGIGRMIAEGFVASGAKVYVSSRKAGACEETAARAGSDCRAAPHDVSTVEGCRALAADLAAREARLDILVNNAGAAWGEPFESFPEQGWDKVMDLNVKSPFFLTQALHGLLKAGGSAERPAKVINITSIDGQRLNAWETYSYQASKAALIHLTRRMAARLVRDQIHVTSIAPGAFPSDMNKAARDHGGTVAQAIPARRIGVAEDMAGAAIFLAARAGDYLVGETVTVDGGL

SEQ ID NO: 17781 - protein, 256 aa, SPHINGOMONAS
QAIFITGGASGIGRAVAQLFAARGWRVGLADVNATGLEETRALLPEGCATTHLLDVRDRDQWVAALADFAQASGGRMDVLFNNAGIGTSGPFATTDAAELERCIAVNFTGVVHGAHAGFALLAATPGSAMLITSSAAGIYGTAGAAIYSATKFAVRGLAEALDGEWSAAGVKVRTLMPAFIDTPLLDHPTGGSNQLIRENVRRAGLEISPVGDVAEAAWAAVHGEVLHTRVGKTARKLWFAARWMPGALRKQAKRS

SEQ ID NO: 17782 - protein, 241 aa, SPHINGOMONAS
MTSIGIYGSMGRMGQAIAAALPEFGARLAGGTDVGDDPAELARKADVLVDFSATAALEANLAAARAARTPIVIGTTGLAERHHRMIDAAAQEIAVLQTGNTSLGIGLLAQLIHEAASRLGADWDIEIVETHHRNKADAPSGTALMLGAAAAEAMGTTLAEAGVSDRAGLTGPRAAGTIGMASLRGGSVIGDHTVVFASDGERIELTHRADDRAIFAKGAIRAALWLPGRDAGRYTMREVLG

SEQ ID NO: 17783 - protein, 460 aa, SPHINGOMONAS
  unsure (1)..(460): unsure at all Xaa locations
KXKRGREDMAIKTLAGMTALLLASASAQAAPRDPLAPTGRWSANTDGRAPTPPMGWNSWNAFATDVDEEKVLASAQRIVDTGLAAKGYRYVNLDEGWWDHRRADGRMLVRADKFPSAATPDGATSFRPFTDRLHAMGLKAGIYTDLGRNTCAQAYGPNEPNLPRGSVTEREVGLYGHIDQDIALYFGAWGFDYIKIDGCGLRAYGEDSPLVRAGRHRALAPLLDLENVNRSNIPAVRGMFEQVKAALVRADPDGDYLLSLCIWGSANVRAWAKDVGNISRTSDDITPHWTRLLTNFDTAARRPLYAHPGSWNDPDMLFIGKGEFDAEHLTEARSHFALWAMVSAPLLIGADLRTTPQSLMDIFGNAALIAIDQDPAGNQAVLAFDTDDFQILVKTLADGEKAVALFNRTAAPIEATLTAQHLKLRADAPIALTDVWTGARSSLQGERKFKLAPHETLVFR

SEQ ID NO: 17784 - protein, 465 aa, SPHINGOMONAS
SLFRLKPIHAAADQPHGHQLARTLSWYHLVALGVGAIVGTGILTLIGVGADRAGPAVILSFVVAGAICACAALAYAELATSIPASGSAYTYSYVALGEIVAWVVGWSLLAEYTLVVATVAVGWSGYATPFLLGLGVPPELTHGPQMVAGHVAHWGVNVPALFVVWLVAGLLILGTRESATLNAILVVVKLIALAVFVAVALPYFDAANFDPFAPFGYAKHASGGVERGMMAAAAIIFFAFYGFDAISTAAEEAKNPGRDLAIGIVGSMVACVAIYMIVALTAVGALHYTRFADSPEPLALILREIGQPGVAKFLALSAIIALPTVILGFLFGQSRIFFVMARDGLLPKSLAKVSRRGSPVRITLFTAAIVSVFAAFLPIDEIAALANAGTLTAFAAVGLCLLVLRRRAPELARPFRTPAAWVVGLGAIFGCLYLFLSLPTKTQLWFGGWNLLGLVVYFAYARRNA

SEQ ID NO: 17785 - protein, 887 aa, SPHINGOMONAS
IGNDTLGTRDSLTVSGKTYSFYSLPKAAAKLGDISRLPFSMKVLLENMLRFDDGVTVTPEDAQAIVDWQQNPKAPSREIQYRPARVLMQDFTGVPCVVDLAAMRDAITKLGGDAAKINPLVPVHLVIDHSVMVDEFGTPQAFDDNVKLEYERNAERYEFLKWGSKALNNFSVVPPGTGICHQVNLEYIAQSIWSSVAPDGETIAYPDTLVGTDSHTTMVNGLGVLGWGVGGIEAEAAMLGQPVSMLIPEVVGFKLTGKLPEGITATDLVLTVTQMLRAKGVVGRFVEFYGPGLHSMTLADRATIANMAPEYGATCGFFPIDDKTLDYMRLTGRSDENVALVEAYAKAQGMWHDVSGPEPIFTDTLELDMSTVRPSLAGPKRPQDRVSLDSVDDVFNGDLTKVYKKAQPARVSVEGRDHDIGDGDVVIAAITSCTNTSNPSVLIAAGLVARKARALGLTRKPWVKTSLAPGSQVVTDYLNKAGLTEDLDAIGFNLVGYGCTTCIGNSGPLAEPISQAINGNDIVAASVLSGNRNFEGRVSPDVRANFLASPPLVVAYALKGTVTEDMYETPIGQGTNGPVFLKDIWPSNEEIQGLISANIDDEMFRSRYGNVYLGDSHWQGISVTVSDTYAWPTGSTYIHNPPYFEGMSMTPAPVQDIVDAKPLAILGDSITTDHISPAGSIKADSPAGAFLQSHQVAKKDFNSYGARRGNDEVMVRGTFANIRIKNEMVPGIEGGMTKYAGEVMPIYDAAMRHKADGTALVIVAGKEYGTGSSRDWAAKGTNLLGVRAVITESFERIHRSNLVGMGVLPLQFAEGVTRETLKLDGSETFTITGVAGLRPRQDVEVKLTRADGSSETFLTRCRIDTVNELEYFLNGGILHYVLRKLAA

SEQ ID NO: 17786 - protein, 274 aa, SPHINGOMONAS
SCCGDPIPIAVSRPAASVAAMTEGMTYGRYLALDQLLAAQHPLSDRHDELLFIIIHQTKELWLKQILAELHLAKGLVRAGKLIEAYKGLARVSRIQAVMTLSWDVLATMTPSDYTRFRSVLGGSSGFQSDQFRAVETMLGLRGGGAPGPLTDAAAALPSLWDDANAALAAAGFVLPEAVLQRDWPTPYQPNDAVRAAWGQVYRDTNRYWDLYQLAEKLVDIDDAMATWRHKHVLTVSRVIGGKPGTGGTPGVSYLESTLAKRAFPELWSLRTDL

SEQ ID NO: 17787 - protein, 502 aa, SPHINGOMONAS
  unsure (1)..(502): unsure at all Xaa locations
AXRPARAPVSAQADTPIQAEAGAAPVLTRDNGAPVGDNRNSKAAGDLGPVLLEDSHLIEKLARFDRERTPERVVHARGTGAHGVFRATADISDLTKASLFQPGKETPVFVRFSSVIHGKDSPEWLRDPRGFATKFYTDQGNWDLVGNNLPIFFIRDAMQFPDMVHSLKPDPVTNRQDPNRFFDFFSATPESTNMLTQLYSNLGTPASYRTMDGNGVHAFKLVNAKGETVFAKFRWISRQGVHNLTAAQAGAQAFDYHTHDLYTEIAKGNYPSWDLMVQVMRPEDFAKLDYNPFDDTKEWLGVPFRKIGEMTLNKVPDNFFEWTEQSAFAPSNMVPGIEASPDRMLQGRLFSYADTQRYRIGANALALPVNKPRVTVVNNSQDGQLNASGRASRVNYFPAALAPKTTPAEAGAAPYAVDATVAVKPIAKSSNFAQAGVFYRALPAAEKADLIKNLSGDLGKVVSPRTRTIMVSYFYQADKDYGTRLAKAVNVPLAEVEKAVAE

SEQ ID NO: 17788 - protein, 305 aa, SPHINGOMONAS
IDPERAHRGAIRTLGAWGAIRTPFGGGPESATPVTLAGLTFPNRVGLAAGLDKDAEAIAGLFGLGFGAVEVGTLTPRAQPGNPRPRLFRLVEDEAVINRMGFNNGGIDAALARIARLSPRQRPGMLGINVGANKDSTDRVADYALGVTKAAPLADYITINVSSPNTPGLRDLQSRPALDELLAAADAARGTTPLFLKVAPDLDRTGLEGAVRAAIDHHVDALIVSNTTISRPPLASSQRGEAGGLSGKPLKALARAKLIEARELSGGQLPLISAGGIDGPDEAKRRIDAGAVLVQIYSALVYRGP

SEQ ID NO: 17789 - protein, 291 aa, SPHINGOMONAS
RIGTRGSPLALTQAHMVRDALKAAHGIEGEIVVVRTTGDKVQDRPLAEIGGKALWTKELDRALLEGEIDCAVHSMKDVETLRPEAIAIAAMLPRADVRDRLVGAESLAALKPGAVIGTASPRRAAQVKRHRPDVSTVLFRGNVDTRLARLAAGEADATLLASAGLERLGRHDVGHVLPTNVMLPAPAQGAVGIEARAADTRTLALLGAIDHPKTRACVMAERALLAALMADCHSPVAALATLEGAILTIEAELFSEDGSAHVHGMIEGAPEDPMLPAALARDLLDRAPDAV

SEQ ID NO: 17790 - protein, 321 aa, SPHINGOMONAS
IGVIGGGAWGTALAQVAARGTEPVLLWAREPEVVASVNADHENRQFLAGVPLSPSIHATGSLGDLGGCDALLVVAPAQHVRAVLAETAVGTTPLVLCAKGIEAGTRLLVGEVARSVAPRAPIAVLSGPTFAHEVAAGKPTAVTLACEDAALRTRLVERLGAPAFRPYASADVIGAEIGGAVKNVLAIACGVVEGAGLGLNARAALIARGFAEMTRFGLARGAQAETLTGLSGLGDLVLTCSSTNSRNFSLGVGLGQGRSAAELLSDRKTVAEGAFTAPVLREAAAEAGVEMPVALAVNALLEGAPVAEVIDALLSRPLRAE

SEQ ID NO: 17791 - protein, 396 aa, SPHINGOMONAS
MNIHEYQAKELLAKFGVPVPAGFAAMSVEEAVEASKKLPGPLYVVKAQIHAGGRGKGKFKELPAEAKGGVRLAKTEDEVRHAATEMLGNTLVTIQTGAAGKQVNRLYVTDGVDIAKEFYLALLVDRATGRVAFVVSTEGGMDIETVAHDTPEKIHTFDVDPATGFMPHHGRAVANALGLEGDLAKQAQSLAGKVYDAFLGTDASQIEINPLAVTDDNKLLVLDAKVGFDSNSLFRHKDLLELRDETEEDPMELEASKYDLAYIKLDGDIGCMVNGAGLAMATMDIIKLNGMFPANFLDVGGGANKEKVTAAFKIILSDPAVKGILVNIFGGIMRCDIIAEGIVAAAKEVNLAVPLVVRLEGTNVQQGKDILANSGLPIVAANDLGDAAQKIVAEVK

SEQ ID NO: 17792 - protein, 386 aa, SPHINGOMONAS
WQDPFGLDGELTDEERMVQGAARDYAQGELLPRVTSAYLEERFDREIMAEMGTLGLLGPTIPETYGGAGLGYVAYGLVARQVERVDSGYRSAMSVQSSLVMHPIHAYGSEEQRRKYLPKLASGEWVGCFGLTEPDAGSDPAGMRTRAEKIDGGYRITGAKMWITNSPIADVFVVWAKSDAHDGAIRGFVLERGMKGLTSPKIEGKLSLRASVTGEIVMDGVEVGEDALLPNVQGLKGPFGCLNRARYGIAWGTMGAAEACFHAARQYTLDRHQFGRPLAATQLVQLKLANMQTEIALGLQAALRCGRMFDAGTLAPEAISIIKRNNCGKALEIARVARDMHGGNGISADFHVIRHAINLETVNTYEGTHDVHGLILGRAITGIAAF

SEQ ID NO: 17793 - protein, 441 aa, SPHINGOMONAS
MTVVTRFAPSPTGTLHVGNLRTALHNWLFARRHGGTFLLRIDDTDQARSEERFVESIRADLAWMGLTPDAEERQSARFERYEARFAQLVADGRVYPAYETAQELELKRKVLLGRGLPPVYDRAALALTDADRAKLEAEGVRPHWRFRLDHDEAIGWDDLVRGPQRFEAKLLSDPVVRRADGSWLYLLPSVIDDIDLGVTHVVRGEDHVSNTASQIQMFTALGGATPSFAHEALLTGNEGKLSKRLGSLGIDHFREAGIEPQALIALLARLGTSDPVEAFADPAPLIASFDFGRFGRAPARFDEAELAQINARIVHQLPHAAVADRLPAGIDAAGWEAIRPNLTTVAEAADWWAVVEGPIAAPPVADEDRAFLAQARAVAAGLDWSADPWRALTDALKAATGRKGKALFLPLRRALTARDHGPDMAALLPLIGKDRALERLA

SEQ ID NO: 17794 - protein, 311 aa, SPHINGOMONAS
MKLMAGNSNLPLASAIADYLEIPLTQANVRRFADEEIFVEILENVRGEDVFVLQSTSYPANDNLMELLIMIDALRRASAKRITAVLPYFGYARQDRKPGPRTPISAKLVANLITTAGANRVLSVDLHAGQIQGFFDIPTDNLFAAPVMSADIQTRFIDKQWMVVSPDVGGVVRARQLAKRLDNAPLAIVDKRRERPGESEVMNIIGEVKGRFCILIDDIVDSAGTLCNAAAALKAAGAEDVVAYCTHGVLSGAAMARVAKSELRELVITDSIGNHEVVAAGEKVRHLTIAPLIAQAIRRIADESSVSSLFD

SEQ ID NO: 17795 - protein, 491 aa, SPHINGOMONAS
MGIEIKMPALSPTMEEGTLAKWLVKEGDTVKSGDLLAEIETDKATMEFEAVDEGVIGKILVAEGTDNVKVGTVIAVIAGEGEDVSSATAAPAPSPTPAPAPAPAASAPTPTPTPAPAAQPAAASGSRVKASPLARRIAADKGVDLAGVTGLGPETGPAIRSKGARTGTKRGAPKRPGGVTPDLHGSHSPPKGPQIPGPRAPGRGPEDTHHGNTPALGRDPLLREDVGRIPRRRALARKETPKGPGFLGFSKRKSGFPGPRGKRRKASRNHPPKTDRGGRPHPSETRPVPHIYLTVDIRLDALLKLRGELNKALEARGVKLSVNDLLIKALGVALARTPKCNVTFTGDKLIKYSRADVSVAVSTPTGLITPIVKDAANKSVSAIATEMKDLAARAREGKLQPHEYQGGTASLSNMGMYGIKQFEAVINPPQGMIMAIGAGEKRPYIIDDALGVATVMSATGSFDHRAIDGADGAEMMKIFKELVEAPMGMIA

SEQ ID NO: 17796 - protein, 547 aa, SPHINGOMONAS
EPDDPSEEARRITYLELYEEVCRFANVLKAEGVQKGDRVTVYMPMIPEAAVALLACARIGAIHSVVFGGFSPEALAGRIVDCDSRIVITADEGRRGGKRVPLKANVDAAQKHAPVLEKVIVVKATGGDVPMQPGRDLWYHEAAARVSADCPAEPMDAEDPLFILYTSGSTGKPKGVLHSSGGYLLWAAYSHEVVFDYRPGQVYWCAADIGWVTGHSYIVYGPLANGGTTLMFEGVPTWPDAGRMWQVVDRHQVEILYTAPTALRALMKEGDSYVTSTSRKSLKLLGSVGEPINPEAWRWYHDVVGEGRCPIVDTWWQTETGGHMITPLPGATALKPGSASMPFFGIEPQLVDGDGALLEGATEGNLVIARSWPGQMRTVWGDHERFFQTYFTTYRGKYFTGDGCRRDSDGYYWITGRVDDVINVSGHRMGTAEVESALVLHDKVAEAAVVGMPHDIKGQGIYAYVTLNAGEESSEGLRKELRDWVRTEIGPIATPDAIQFAPGLPKTRSGKIMRRILRKIAEGDVSSLGDTSTLADPSVVDDLVANR

SEQ ID NO: 17797 - protein, 643 aa, SPHINGOMONAS
GVDMTAQKPGVKPGDDFWTYANGGWADRTQIAADRTSAGPFVDLALAAETNVRTLLDDMAKNPAAYGASGKQIGDFYASWMDEAGIEARGTAPLKPYLARIAGVQDKTALQVLFASVGYATPVEVEISPGFADPTRYTAAVGQGSLGMPRDYFLNPGEKFEGFRKAYRAYVQQIQELAGIPDASAKADAIVALEMAMAKVQWSPEQSRDIAKLNDPQTIAGLKAKAPEFDWALMLKTAGVDSSPQILMAQNTALIALAKIFAETPLQTWKDYLAYRFVSDHATYLPKAFDQARFDFYSKTLSGVPAQRERWKRGVQMVNGALGEAVGKAYVAKYYPPEAEKQMAELIENLRDSYRERIEASTWMDEATRKAALAKLAAFEPRIGHPDKYIDYSSLTVDRGDILGNVMRSGEFQHQLQLARFPKPVDRTLWAMTPQTVNAYYNPLSNQITFPAAILQPPFFDPKADPAVNYGAIGAVIGHEMGHGFDDQGSMFGPTGKLENWWTPKAKADFGARTAALAGQYDTYEPLPGMKINGKLTLGENIGDLGGVEAAYGAYQKYQAKHGKAKTVDGLSGDQRFFLGWGQAWRVKMREDALRQQLVVDPHSPATARVNGVVRNVDAWYKAFNIQPGDKLYLPPEQRVHIW

SEQ ID NO: 17798 - protein, 187 aa, SPHINGOMONAS
ARALGMLTLPNILTLSRIFTVPLLVGFLWWPQWAPGYAIAFALYVLMGITDYFDGYLARAQGTVSKLGVFLDPIADKIMVAAVILILAGKGVIADWHIIAALVILLREIAVSGLREFLGGIQVSVPVSRLAKWKTTLQLVSLGALILSGALPHWDWVLLVGLVTLWGAAVLTAITGWDYLRVGLSHM

SEQ ID NO: 17799 - protein, 699 aa, SPHINGOMONAS
ARIPMTDQNNRNAPAGGETHQVTDADHPVLTTNHGTPISDNQNQLKAGPRGPVLIEDEVFREKMNHFDHERIPERIVHARGSAAHGYFEVTDSLADVTIADLFQKKGQRTEVFVRFSTVAGGAGSVDTPRDVRGFAVKFYTREGNWDLVGNNIPVFFIQDAIKFPDLIHAAKMEADRGYPQAATAHDTFWDFISLMPESTHMILWAMSDRTLPRSFATMEGFGVHTFRLINAEGKSSFVKFHWKPKAGLASTIWDETVKIAGADPDFQRRDLFERIDRGDYPTWELGVQLFDEDFANAQPYDVLDATKLIPEEVLPVRIVGRMVLDRYPDNFFAETEQAAFVPAHVVPGIGFSNDPLLQGRLFSYTDTQLSRLGSVNFHQLPINAAKGRAEAAGCPFLNQQRDGHMQMAVPKGRANYEPNSLAKAGEEGGAREDPEKGYKTYPAEEQGQKLRIRAESFADHYSQARLFFRSMDPAEQAHIASALVFELSKVSLEHIRVAVMANLRNVDETLAQRVADGLAMDLPEAAPTAAPVLDMEPSPALRIIRGPRELRTLEGKTVGILIADGSDAGELSTLKDAVKAAGGHAMTIAPKVGKVPLSDGSTIAADAQLFGQPSVTVDACAVILSEEAAAKLVKEGAAVQWVMDAFGHLKAIGANAAAQPLLDKAGVEPDEGVTDLRGFVEAAKQRYWDRETKVRTLA

SEQ ID NO: 17800 - protein, 148 aa, SPHINGOMONAS
KPIVLVGLMGAGKTTVGRRLAQRLRLPFVDADAEIESAAGMSVSDIFAKFGEPHFRDGERRVIARLVDGTPKVIATGGGAFINDETRALILGQAISIWLDAEPTVLADRVRRRDTRPLLRGKDPLATLTELARVRNPYYALAEIRVPS

SEQ ID NO: 17801 - protein, 354 aa, SPHINGOMONAS
IPVALGARSYDVRIEPGLLASAGEVLAPLSRGRPMPIVTDTNLAAHCETLVASLAAAGVAAPVLVLPAGESTKSWAQLEALTDWLLAQGVVRSDHVIALGGGVIGDLVGFATSILKRGCNFVQIPTTLLAQVDSSVGGKTAINSRAGKNLIGAFHQPSLVLIDPQVLDTLPQRELRAGYAEVAKYGLIDDAAFFAWCEENADALFAGDPAARATAIGHSVAAKARIVAADERETTGTRALLNLGHTFGHALEAETGFSDTLLHGEAVAAGMALAFAFSAQQGLCPAADAERVAAHLRSVGLPDGLAAAGVTADGKTLVGHMLHDKKMEGSTLPFLLARGIGQTYLDKTVDLETV

SEQ ID NO: 17802 - protein, 581 aa, SPHINGOMONAS
PEAKDAWTYARPEVARVTHVALDLRADFASRTLSGTATLDVLAAPGAKEIALDEDGLAIARVTDAAGKPLPFTVGAAKPDLGAPLTIQLNGARKIVIHYATAPVASALQWLAPALTAGKKKPYLFSQGQPINNRSWIPTQDSPGIRQTWSATLTVPADLVAVASGDRIDGARGVPAGKGWHKFRFRMDKPVPPYLIAFAVGDLAFQPVGPRAGVWTEPSMLAAAAKEVADVEKMIDAAQALYGPYRWGRYDMLVLPPSFPYGGMENPTLTFLTPTIITGDKSNVDVVAHELAHSWSGNLVTNATWSDSWLNEGFTTYFENRIMEAVYGKERAATDADLEWDGLQKDIADAGGTEAPTTRLHGEPGATFGQLDYFKGSTFLRTIERTVGRARWDVYLRGYFDRHAFQPQTTAGFLADLRANLVQGDAGLEANLQLDRWAYAVGLPTNAVHVQSATLKAVDAQLAAVNAGGPVSAVQPQGWATQQWLRFPQWAGSPADAGRLKELDESLVLSASNNAYVRSAWGELAIANRYDPAVPGIGKLVGSVGRGLLIYPIYKDLMAQGDWGKPIARRFYEASKAVYHP

SEQ ID NO: 17803 - protein, 454 aa, SPHINGOMONAS
LSRLIVISNRVTAPNGSNSGAQGGLAVALAAALRENGGIWFGWSGEQTDQFTGQISMQRSEGVTTATVDLEEQDIDEYYNGYANRTLWPLFHYRIDLAEYERGFAGGYQRVNERFADTVRPLIEPDDVVWVQDYHMFPLGQELRRRGCKNRIGFFLHIPWPPRRLLSSLPKAHELIETLFAYDVIGFHTQEWMESFIDFARAEMEAVVQPDGVLRIGLKSVKLVACPIGIDAKEFAALAESESARETFEQMRTSSVGRSLIVGVDRLDYSKGLEERFLGYERFLATYPEQRKEVYLLQIAPPSRATVETYQRIRNTLEGLSGKINGAHADLDWVPLRYVNQGYPRDVLAGVYRAARIGLVTPLRDGMNLVAKEYVAAQDPEDPGVLILSKFAGAAIQMEQALLVNPYSAEEVSDAICQALNMPLEERIERWQALKQGVDEQDVMWWLKKFTDEL

SEQ ID NO: 17804 - protein, 211 aa, SPHINGOMONAS
LDTASLFLDFDGTLVELADHPEGVVVDGTLVDLIRTLEEKLDGRLALVSGRPAEDLAAMFGDRAPSVVGSHGMEFRWSDGRRERAERPAGLVEALAAMRAFAEGRPGVVLEDKPLGAAVHYRLNPEHEADAIALGERLAAEHGLYLQHGKMMVEVRSPGGDKGSAIRTLMADPRFAAGRAVFLGDDVTDEPGFSAVALLGGAGVLVGPPRP

SEQ ID NO: 17805 - protein, 364 aa, SPHINGOMONAS
ILWGRGFGAEGDAVGEVCFHTAMTGYQEIMTDPSFAGQIINFTFPHIGNVGANPDDIEADDPHALGMIVRQDVTEPSNFRSTEHLDAWMAKHKRIGLSGIDTRALTRRIRLGGAPNGVIAHSKSGNFDLDALLEKARGWPGLEGMDLAITVSCETHFGWEGGVWKLGAGYDTSRGESKRPQVVAIDYGSKRNIFRNLVQAGADVTVLPATATFEQVMAFNPDGFFLSNGPGDPAATGEYAVPVIRQLLETGKPLFGICLGHQLLGLAVGAQTTKMFQGHRGANHPVKRLEDGAVEITSMNHGFAVERESLPANARETHVSLFDGSNAGIELTDRPAFSVQYHPEASPGPQDSLYLFERFVGMMA

SEQ ID NO: 17806 - protein, 1104 aa, SPHINGOMONAS
MPKRTDISSILVIGAGPIVIGQACEFDYSGTQAIKALKEEGYRIVLVNSNPATIMTDPELADATYIEPITPAVVAKIIEKERPDAVLPTMGGQTALNTALALFRDGTLEKFGVTMIGADADAIDKAEDRLKFKDAMTKIGLESARSAIAHTEAEALTALDYVGLPAIIRPSFTMGGSGGGIAYNREEFIAIVRSGLDLSPTTEVLIEESLLGWKEYEMEVVRDRNDNAIIVCSIENIDPMGTHTGDSITVAPALTLTDKEYQIMRSASIACLREIGVETGGSNVQFAVNPKDGRLIVIEMNPRVSRSSALASKATGFPIAKVAAKLAVGYTLDEIDNDITGATPASFEPTIDYVVTKIPRFAFEKFKGAEAVLGTAMKSVGEVMAIGRSIHESIQKALRGLETGLSGFNDVDRLVGAPRDVIEAALTVRSPDRLLIAAQAMREGFSVKEVQRFTSYDPWFLQRIAEILDAEKDVATNGLPQDAVGMRRLKAMGFSDKRLAYLALKSVNLRAGSEAMARSSGLIGEIANAISGGVTEAEVRKLRHRLGVRPVFKRIDTCAAEFEAKTPYMYSTYEAPSFGEPENEAEPSDRRKIVILGAGANRIGQGIEFDYCCCHACFALADAGYETIMVNCNPETVSTDYDTSDRLYFEPLTAEDVLEILEVEKSKGELVGVIVQFGGQTPLNLAKALEDAGIPILGTSPDAIDLAEDRERFADLVAKLGLKQPMNGIARSRDEAVRVAERIGYPVLMRPSYVLGGRAMEIVDSLQQLDDYIQTAVQVSGDSPVLIDQYLRDAIEVDVDAIADGTDVVVAGVLQHIEEAGVHSGDSACSIPPYSLPAEIIAEIERQTVALARALKVKGLMNIQFAVKDGEVYLIEVNPRASRTVPFVAKAIGAPIAKIASRVMAGEKLANLPKIDRDIDYIAVKEAVFPWARFPGVDPVLSPEMKSTGEVMGIDKDFATAFAKSQLGAGTVLPQGGTVFVSVKQGDKAVVLPGVKILADLGFKIIATSGTAEFLAAEGIAVETVNKVAQGRPHIVDRIQDGDVALIFNTTEGWQSLKDSMSIRASALAQKVPYFTTAPGSVAAARAIAAMRAQAFEVQPIQAY

SEQ ID NO: 17807 - protein, 481 aa, SPHINGOMONAS
EIPLGLTFDDVLLYPGESEIVPSMADTRTFVTKNLALNIPILSSAMDTVTEADMAIVMAQLGGIGVLHRNLEVDEQCEAVRAVKRFESGMVVNPITMAPSGTLAEAQALMAKHRISGIPIVEASGKLVGILTNRDVRFAENPNQLVSELMTHQNLATVKVGVAQEEARRLLHQRRIEKLLVVDDAYRCVGLITVKDIEKAVTYPHATKDPSGRLCVAAATTVGDKGFARTEALVDAEVDLIVIDTAHGHNKDVSRAVERVKKLSNRVQVIAGNIATAEAARALIDAGADGLKVGIGPGSICTTRVVAGVGVPQLTAVMDAAEEAAKSGVPVIADGGIRTSGDIAKALAAGASAAMIGSLLAGTEEAPGETFLYQGRAYKSYRGMGSVGAMAKGSADRYFQQDIKDQLKLVPEGIEGQVPYKGPARDVIHQLVGGVKASMGYVGAATLPEFQEKARFVRITNAGLKESHVHDVTITREAPNY

SEQ ID NO: 17808 - protein, 875 aa, SPHINGOMONAS
  unsure (1)..(875): unsure at all Xaa locations
SMQRRTILTGAMGTGLAAALPIAAGATSPVIPSPRQRLALDTGWRFHLGHASDLARDFNFGLNQRTYAKAGADTADAAMAEFDDKGWAPVQLPHDWAVDLSYAIPPGMKAEDTKDDVASHGFKAIGRDFPANSVGWYRRRLPIEAGDAGKRIWLEFDGVFRDAIVFVNGYVVARNESGYVPFQADITDFLNFDGKPNQLAVRADASFGEGWFYEGAGIYRPVWLVKAAPVHVPQWGSFVRSTITPQGAQITASIEVRNATELPAKATLRQYIVDAGGTMVAALPDATLTPAANTLVTHEVSVTLPNPRLWSIETPVLYRLVSRLLVNEAPIDVYETSFGIRSIRFDAERGFFLNDKPVKLLGVCNHQDHAGVGTAIPPALDAWRIARTKEMGANAWRSAHNPPSESFLDACDRLGMLVIDEARRNSTDPESTSQLERILRRDRNHPSIILWSVGNEEPQAMNARGGRVSHKMVAHIRRLDPTRPTTQAFDRGQYEAAAREVDVIGFNYHTDKTIPFHARFPNQPIIGTETGSTVSTRGEYFNDRPRQIVRAYDTEYPAWASTAEQWWKVADAHPYVAGGFIWTGFDYRGEPTPHALWPAASSYFGVMDLCGFPKDNYWYYRAWWRPEPLVHLLPHWNWAGREGQDIEVWAYSNGEAVELLLNGRSLGRRPVERGGHVEWRVPYAPGRLEARAIRGGRVVATSMRETSGPAAAIRLTADRKQIAADGRDLAILAAEIVDAKGRPVPTANTPLRFTIDGPAELIGVGNGDPTSHESDHAPARRAFNGLAQAILRHHGAAGIVRFTAEGDGVKPASLALLALXGGPCSSAPHRRHPPFVNGRRAVSPTSHLVMAQGRATSTRSGRPQQGACSVAGPSP

SEQ ID NO: 17809 - protein, 418 aa, SPHINGOMONAS
MTDFSMIDGELHVESLPLARIAAEVGTPVYVYSTERFQANARAFRDALKPLGRIHLAFAIKANPNLAVLKLLANEGFGADVVSGGEMARALAAGVAPKDIVFSGVGKTRRELVKGLEAGIGQFNLELVEEGEVLAALAAERGLTARAALRVNPDVDAGTHEKISTGKAENKFGLPIGEAPAIFERLGKLPGLDLHGIAVHIGSQLLGLAPLESAFERVGRLLAELRAGGHTITHVDLGGGLGVAYRPGEVPPTPEAYAEMVARVTKDWDVELMFEPGRTIAGSAGVLVTEVLWVKPGQIHPWVVVDAAMNDLARVALYDAYHGFAAVKPNGERFVANVAGPVCESTDVFVKAREIDAVKAGDLAVLETAGAYGATMASTYNSRPLVPEVLVSGDRYAIVAGRISAEEIMAAEQVPDWL

SEQ ID NO: 17810 - protein, 472 aa, SPHINGOMONAS
RRRPITERKDSSNSMWGGRFAEGPSAVMREINASIPFDKRMWQQDLRGSKAHVAMLGRQGIVGSEDAATISAGLDQVAEDFAANGVPEDLALEDIHMLSESRLAEKIGPVAGRLHTARSRNDQVATDFRLWVRDAIDQADAALGALQDALLARAEQHADSVMPGFTHLQVAQPVTLGHHLMAYFEMFARDRSRLKDARARMNLCPLGSAALAGTGFNLDREATAKALGFDGPTRNSLDSVSDRDFALDYLTAAAQCSLHLSRLAEEFVIWASQPFGFVALSDQWSTGSSIMPQKRNPDAAELVRGHSGRISGALFSLMMTMKGLPLAYSKDMQDDKPPVFEAHDLLGLSIAAMTGMVESATFRLERMRAAAEAGFSTATDLADWLVREGGIPFREAHHITGRAVAKAEAEGIRLDQLSIQALKEIDARIDERVYGVLSVDASVNSRVSFGGTAPSRVRAAIAAARKGREEES

SEQ ID NO: 17811 - protein, 477 aa, SPHINGOMONAS
VFRHLHQLSLRFHLNRRTGAVTKVVERGTKSIDTMLYFLLFNIAPTILELCMVLGIFGTRFGWWLVAGTLAMVVIYIAFTRWVTDWRSKLREQMNDLDTGAVAHAVDSLLNFETVKYFNAEARESARYDKAMTAYMNAAVTSENSLAWVNIGQAVITNLMLAAGMALVVFGWSTGRFTPGDVVLVSTLLSQLFRPLDMLGWVYRTIRQGVIDMGAMFDLLDTGAEVKDAADAQPLAVQQGHVRFEGVQFGYDADRQILKGIDLDIPAGATVAVVGPSGAGKSTLARLMYRFYDVTGGRITIDGQDIRAVTQTSLRAAIGIVPQDTVLFNETIGYNIAYGREGATPEEIAEAVRGASIANFIQALPQGLDTRVGERGLKLSGGEKQRVAIARTLVKNPPILILDEATSALDSRTEADIQATLESIERGRTTIVIAHRLSTVVHADRIIVLEAGRVVEQGTHAELLREGGIYAEMWARQ

SEQ ID NO: 17812 - protein, 357 aa, SPHINGOMONAS
PKPWVMAIAPYVPGRATTDSGKPAAKLSSNENPFGTPQAARDAYAAAATELERYPDAGAVALREALGAHYGVEPERIVYGTGSDEVLHLAAGAFAGVGDEIIYVRYGFAVYDIAARRVGATPVVAPDRDYATDVDAILACVTDKTRIVFLANPNNPTGTYTAREEIARLHAALPKSVLLVLDQAYTEYLDSEDDDGGLELARTQPNVLVTRTFSKIFGLASERVGWGYAHPDIIAAMHRIRAPFAFSIGAGRAAIAALGDKDFVAHSRAHNAQWRQWFADEIASMGNKGVRAVPSKANFQLVLFEGEVTGEQAYKHLMEDGYIVRWLPGQGLPHGLRITIGTEEEIKGVAASLRRLL

SEQ ID NO: 17813 - protein, 237 aa, SPHINGOMONAS
MARVAVVTGGTRGIGEAISLALKDAGITVAANYAGNDEKAAAFTERTGIKAYKWDVGDFDACAAGVQQVEAELGPVDIVVNNAGITRDGTILKMTRDMWEDVIRINLGGCFNMAHAVFPGMRTRKWGRIVNIGSINGQAGQYGQVNYAAAKSGIHGFTKALAQEGARFGVTVNAIAPGYIDTDMVAAVPADVLEKIVAKIPVGRLGQAHEIARAVAFLCAEEGGFVTGSTLSINGGQ

SEQ ID NO: 17814 - protein, 330 aa, SPHINGOMONAS
PADHPKIPPARVGVLLVNLGTPDAPEPQAVKRYLGEFLSDRRVVEIPPLLWQPILRGIILRTRPKKSAHAYAQVWREDGSPLAAITKAQARGLEGAFGPGVTVLHAMRYGKPSVGDQIAVLKAQGCERILVAPLYPQYCAATTATANDVAFAALMAMRWQPALRTLPPYYDDPAYIAALKTSVEEGLAGLDFTPDAVIASFHGMPQRTLERGDPYHCHCRKTGRLLGEALGRELIVTFQSRFGRAKWLEPATDTTLEALPAKGIRRIAIVAPGFSADCLETLEELAIRGRESFLDAGGENFAYLPCLNDSGAGMELLRQLIGRELAGWVN

SEQ ID NO: 17815 - protein, 424 aa, SPHINGOMONAS
RPLHPETLALHAGWRADPSTGAVVPPIYQTTSYQFRDTDHAANLFALRELGNIYTRLGNPTTDVLEQRIAALEGGAAALAVASGQAASAYAVQNLARAGDNIVSGTDLYGGTWNLFANTLKDMGIEVRFVDPADPEAFVRASDDRTRAWYVETLPNPKLIVAPIGEIAALGRPLGIPLIVDNTAAPLIARPFDHGAAIVVYSTTKYIGGHGTSIGGMIVDGGTFDWEAFPDRQPLLNTPDPSYHGAVWSQAAKPLGPIAYILRARTVLLRDLGAALSPTNAFQILQGLETLPLRMPRHCENAAKVVAFLQSRPEVTRVIHPSVQTGIQAERAARVLTGGQGGLVGFELAGGSGAGRAFINALQLFYHVANIGDARSLAIHPASTTHSQLSAEEQAVTGVSEGYVRLSIGLEHIDDIIADLGQAL

SEQ ID NO: 17816 - protein, 299 aa, SPHINGOMONAS
MRPDDMARTLGGGLLSFPVTHFDAEGAFLEGPYRAHCAWMLSHELAGLFAAGGTGEFFSLTPDEVVRVVGAAVAEANGRLPVISGCGYGTAIAVEIARGAEKAGADGLLLLPPYLVGSSQAGLAAHVEAVCRATGLGVIVYNRDNAVLDDETLAGLCERNPNLVGFKDGVGDIELMTRIYARMGDRLTYIGGLPTAETFATPYLTMGVTTYSSAIFNFLPEWALHFYRAVRADDRTEILAQLRAFVMPYIALRNRGRGYAVSIVKAGMRAVGRDAGPVRTPLTDLTEGEQAELAALIAR

SEQ ID NO: 17817 - protein, 398 aa, SPHINGOMONAS
RVVLAYSGGLDTSVILKWLQQTYNCEVVTFTADLGQGEELEPARKKAEMAGVKPEHIFIEDVREEFVKDYVFPMMRANALYEGLYLLGTSIARPLIAKRQIEIAKLVGADAVSHGATGKGNDQVRFELGYYALNPDIKVIAPWREWDLTSRTKLIEFAESHQIPVTKDKRGESPFSTDANLLHTSSEGKVLEDPWEEVPDYVYSRTVNPEDAPDMPETITIDFERGDGVALNGQAMSPATLLTALNELGRKHGIGRLDLVENRFVGMKSRGMYETPGGTIYHLAHRGIEQITLDRGAAHLKDELAPRYAELIYNGFWFSPEREMLQAAVDYSQEKVTGTVRLKLYKGSVIVTGRKSPYSLYSEKVVTFEDDQGAYDQRDAAGFIKLNALRLRLLGRRE

SEQ ID NO: 17818 - protein, 445 aa, SPHINGOMONAS
MARFTFRLPDIGEGIAEAEIVAWHVKIGDRVEEDQQVADMMTDKATVEMESPVSGVVVELAGEVGDQVPIGSALMVIEVEGEAAAEAETPVEEQVEAENPGVEQSILPGTGRGTAGEAGGGGGASLDDSAEAAPASPAEPPLHHQPAADGPPPRSGEDPKILASPAVRARAADLGIDLAQVKPAEGDRIRHADLDAFLRYGSAQGYHAPHASRAREDQPVKVIGMRRRIAENMAASKRAIPHFTYVDEIDVTALEAMRADLNDNRGQRPKLTMLPFLIVALCRTLPDFPMLNARYDDEAGVVTRHGRVHLGMATQTDAGLMVPVIRDAQDRNVWQLASEITRLADAARTGKAKSEELSGSTLTVTSLGPLGGIATTPVINRPEVAIIGPNKIVERPVFHGDEIVRAKLMNLSISCDHRVVDGWDAASFVQAVKKLLETPVLLFAD

SEQ ID NO: 17819 - protein, 337 aa, SPHINGOMONAS
AAPRMNMIQAINSAMDVMMERDDQVVVMGEDVGYFGGVFRATAGLQAKYGKTRAFDTPITEIGIIGVAIGMGAYGLRPVPEIQFADYIYPALDQLVSEAARLRYRSNGDFTAPITVRSPYGGGIFGGQTHSQSPEGIFTHVSGIKTVIPSTPYDAKGLLIAAIEDNDPVLFLEPKRIYNGPFDGHYDRPAKNWTAHPASEVPTGYYRVELGKAATVREGEAVTILCYGTMVHVVAATIEELGVDAEIIDLRTLVPLDIEAIEASVKKTGRCMIVHEATRTSGFGAELSALVQERCFYHLEAPIARVTGFDTPYPHSLEWAYFPGPVRIREALNKLLK

SEQ ID NO: 17820 - protein, 412 aa, SPHINGOMONAS
YGHLYVQVLVAIIAGVLIGHYAPATGEALKPLGDGFIKLVKMIIAPVIFLTIVTGIAGMRDLRAVGRVAAKAFAYFLFFSTLALVVGLVVGNIIQPGAGLNIDPATLNAGKVAEYTAKAHDSTITGFLLGIIPDTFLSAITEGNILQTLFVAILFGIGLALLGDRSTRIVAALEDVSLAMFKVVAILMKAAPVGAFGAMAFTIGKYGVGTLANLAMLLGTFYLTAALFVVLVLGAVSGAWAGFSICCLIAYLKTELLLVLGTSSSESALPALIDKMERAGCPKTIVGLVVPTGYSFNLDGTNIYMTLAALFIAQATGVHLSLEQQVLLLGVAMLSSKGAAGVTGAGFITLAATLSIVPSVPVAGMALILGVDRFMSECRSLTNFIGNAVATVVVSRWEGRLDHAALQAALKG

SEQ ID NO: 17821 - protein, 273 aa, SPHINGOMONAS
GGDQTSVYSAGAVMTDVAIAAPDQSAPDPMPLPDRGLAVVSIAKSYDKRTVLTDVSVSVGRGEVVGLLGPNGAGKTTCFYSVMGLVKPDSGRIMLDGEDITRLPMYRRAILGLGYLPQETSIFRGLSVEKNISAVLELAEPDRDARQARLDELLDEFGLTRLRTSPAMALSGGERRRAEIARALAANPTIILLDEPFAGIDPISIADIRDLVKQLKQRGIGVLITDHNVRETLEIVDRGYIIYDGRVLFAGSPDDLVRDENVRRLYLGESFSL

SEQ ID NO: 17822 - protein, 209 aa, SPHINGOMONAS
MPATAKICGLSTPETLDAATTGGASHIGFVFFPPSPRHLSFEKAQGLAARVPGHVLRVGVFVDPDDGFLDAAIAAGRLDVIQLHKVTPERAAAVKARTGRETWAALAVKTRADLVPAAGFRGAVDRLLYDAKAPEGAKVPGGTGLRFDWTLLDGFAHPLPWVLSGGLDADNVNEAIRVTGAGLVDVSSGIEAAPGIKDVDKIAAFLKAV

SEQ ID NO: 17823 - protein, 649 aa, SPHINGOMONAS
QDAPYLQGLNDPQREAVLTTEGPVLVLAGAGTGKTAALTARLAHLLWTRRAYPSEILAVTFTNKAAREMKERVGRLVGDAVEGMPWLGTFHAIGAKMLRRHAELVGLQSNFTILDTDDQLRLLKQLILANDLDEKRWPARQLAGLIDGWKNRGLIPADLDAGESESYANGRGQSLYAQYQERLRLLNACDFGDLLLHMLTILKTNREVLELYQKRFRYIMVDEYQDTNAVQYLWLRLLAQERKNICCVGDDDQSIYSWRGAQVENILKFEKDFPGAVVIKLEQNYRSTPHILGAASGVIANNGGRLGKTLWTEIDVGEKVKVLGVWDGPEEARRVGEEIEGLQRGGLSLDATAILVRAQHQTREFEDRFIAIGLPYRIIGGFRFYERQEIRDALAYLRVVAQPADDLAFERIVNVPKRGLGDKALSKVHQFARAQGLPLTTAAARILDTDELTPQARRSLGNLIGDMARWRSMGDDLQHPDLARIILDESGYTAMWQADRTAEAAGRLENLNELVRAMEEYESLSAFLEHVSLVMDNEASAEEPKVTIMTIHAAKGLEFDTVFLAGWEEGIFPSQRALDEGGLASLEEERRLAYVAITRARRRAIILHAANRRIYGQWTSSLPSRFVGELPAEHVESESSMTGGESLWR

SEQ ID NO: 17824 - protein, 346 aa, SPHINGOMONAS
MGQHPKVIEAMEEALHDVGAGSGGTRNIGGNTHYHIDLERELADLHGKENALLFTSGYVSNEATLSTLAKVMPGCIVYSDELNHASMIAGIRNSGCEKRVWRHNDVAHLEELLAADDPAVPKLIAFESVYSMDADIAPIAEICDLADKYNALTYLDEVHAVGMYGPRGGGISDREGLADRLTIIEGTLGKAFGVMGGYIAADQVIIDVIRSYAPGFIFTTSLSPVLVAGALASVRHLKGSSVEREGQQAAAATLKQLMAEAGLPVLASTTHIVPLMVGDPVKAKKISDVLLAEYGVYVQPINYPTVPRGTERLRFTPGPAHDEAMMRELVDALVEIWGRLELRLAA

SEQ ID NO: 17825 - protein, 240 aa, SPHINGOMONAS
VLITGATAGIGEASVRAFADAGWHVVATGRRADRLEKLAGERVHTLAFDIRDDAARDAALDSLPAPFSEIDLLINNAGLALGLEPAHKASLENWRTMIDTNVTALVSITHKLLPGLVARKGGIINLSSVAATYPYPGGNVYGATKAFVRQFTLNLRADLIGTGVRVTSIEPGMVETEFTLVRTGSQEASDKVYAGVNPMTAEDIAETMLWVATLPPHFAVNTLELMPVNQGNGPFAVHRE

SEQ ID NO: 17826 - protein, 858 aa, SPHINGOMONAS
MNLEKFTDRAKGFLQSAQTVAIRMNHQRISPEHLLKALLEDEQGMASGLIQAAGGDAKRALSETDLALSKIPAVSGSGAQSTPGLDNDLVRVLDQAETIAQKSGDSYVTVERLLVALALSLNTAAGKALQAANAKPEALNTAINAMRGGRTADTSSAEDRYDALKKFARDLTEAARAGKLDPVIGRDEEIRRTIQILARRTKNNPVLIGEPGVGKTAIAEGLALRIANGDVPDTLKDRTLMALDMGSLIAGAKYRGEFEERLKGVLDEVKGAEGQIVLFIDEMHTLIGAGKAEGAMDAGNLLKPALARGELHCIGATTLDEYQKHVEKDPALQRRFQPVFVGEPTVEDTISILRGLKEKYELHHGVRITDAAIVAAATLSNRYIADRFLPDKAIDLMDEAASRIRMEVESKPEEIETLDRRIIQLKIEREALKRETDEASRDRLATLEEDLANLEQQSAELTTRWQAEKDKINAEAVLKGQLDQARLELEQAQRAGDLARAGELSYGVIPQLTRQLDEAQSAAKGAMLREEVTGDDIAGVVARWTGIPMERMLEGEREKLLQMEQQLGRRVIGQADAVKAVSTAVRRSRAGLQDPNRPLGSFLFLGPTGVGKTELTKALAEFLFDDPNAMVRIDMSEFMEKHAVARLIGAPPGYVGYEEGGVLTEAVRRRPYQVVLFDEVEKAHNDVFNILLQVLDDGRLTDGQGRTVDFANTIVILTSNLGSQYLTNLADGHPVEEVEPQVMDVVRAHFRPEFLNRLDEIILFHRLGADHMAPIVDIQVGRVGKLLKDRKVTIDLTPAAREWLGRVGYDPVYGARPLKRAVQRYLQDPLADLILRGAVKDGSTVHVDEGDGALALRV

SEQ ID NO: 17827 - protein, 242 aa, SPHINGOMONAS
RFNDKTVLVTAAAHGIGRATALRLRNEGARVFALDRDAAALATMEGVEAVPLDLLDPHAIAALPEKIGAIDALANIAGFVAAGSILDGSDADWMLSFDLNVHAMHRMIRAFLPGMLARGGGAIVNMSSIASSVKGIPNRYAYGASKAAVIGLTKAVAADFVAQGIRCNAVCPGTVDTPSLRQRVSDQADASGISVEDAHAAFVARQPMGRLGREEEIAALVCYLASDEAAFTTGAVHVIDGG

SEQ ID NO: 17828 - protein, 530 aa, SPHINGOMONAS
KLPDAATPVAYRLDFTIVPEQPRFNGHTEIDIDLKAPATSLWMHGRDLHIAKATVRAGGKTLPATFTQKSPSGLAQLDFGKALPAGRVTLVFDYDAAFGTGTQGVYRVNVDKEWYSWTQFESIEARAAFPSFDEPGYKTPFTVSITTKPGFTAVSNAPEASKTKAGDLLRHQFAPTKPLPTYLVALVTGPFATASALIPPTPQRSTPMPLGVVGTKPNAQQLDFALKESGKIVALLENYFGQPFPFPKLDQIGSPIMPGAMENAGADIYGDGILFLDEEAPSERKQAFGMVVAHELAHQWFGDLVTPAWWDDIWLNESFANWMGYRIGNEWRPGLNIELNAIEEGFQAMDLDALSAGRPIHQPIPNDGDIDAAFDQITYGKGGQVVAMIAAYMGDVPFRDGVRLHMKRHAYGNASTDQFFASLADAAHDQRVLASLKSFVDQQGVPVVTLHREGTTLTATQSRYAFFGANLPAEQWIVPLCLRQGETKSCTLLDKPSMTVSAKGSGALVPNAGGWGYYRFELDPAEWDAL

SEQ ID NO: 17829 - protein, 240 aa, SPHINGOMONAS
PDGYHELETLFAFVEHGDTVRVVPAETDSFTLDGPFAPVLAAEGDNLVTRAATRFREAFGGGAHSIALEKRLPVASGIGGGSADAAATLRALAALHGIAPEDTRLFAIADALGSDVPACLLGRTALGRGRGEQLAPVAGLSGMPVLLVNPGVAVSTAAVFRGWDGVDRGPIGSGDLLDVARGGRNDLEPPARALAPAIDAVLAALAVQEGVLLARMSGSGATCFALFDTQTARDSTTATL

SEQ ID NO: 17830 - protein, 506 aa, SPHINGOMONAS
GAGGARPFRDLEPLMRRAVVIGAGFGGLALAIRLQSAGVDTTVIEARDKPGGRAYYWERDGFTFDGGPTVITDPDALKELWRLSGHDISEDVTLKPVTPFYRLSWPDGTTFDYTNDDAVLAGEIAKLDASDIAGYRRFLDYSASVYEEGYVKLGAKAFLDFKSMLKAAPALMQHQAWRSVYSIVSGFVKNEKLREALSFHTLLVGGNPMATSSIYALIHKLERDGGVWWAEGGTNRLIAGMITHFERLGGKVRIGDPVDEILTLGDRVVGVRTKSGVEVEVDAVASNADIVHSYRDLLRNSRSARRTANRLVNKRFSPSLFVVHFGLRGTFPDIPHHMILFGPRYKGLLDDIYTNGVVSEDFSLYLHHPSASDPSMAPEGHSTFYVLAPVPHLGKFPADWSQVGPVLESRILAEVQRRLIPDLAERIVTKFHYAPTDFRDDLAAHHGSGFSLEPILTQSAWFRVHNRDDAISNLYFVGAGTHPGAGIPGVVGSAKATAELMLGELA

SEQ ID NO: 17831 - protein, 223 aa, SPHINGOMONAS
SWLAPLEEEFAQPYMAALRDYLRAEKAAGKRIFPAGKDWFRALDLTPLEQVRVVILGQDPYHGEGQAHGLCFSVQPGVRVPPSLVNIYKEMETDLGIPRAKHGFLEHWARQGVLLLNAVLTVEMGRAAAHQGRGWERFTDAVIRLVNAKPEPVVFLLWGSHAQKKAAFVDSIDKGGRHLVLKAPHPSPLSAHSGFFGSRHFSKANAFLQSIGQRPIDWALPAL

SEQ ID NO: 17832 - protein, 878 aa, SPHINGOMONAS
DIRFLGRLLGDVIRAYGGEELFKRIEYIRATSVDRHRGVAGAGAIDSGLDRLSLDETLDFVRGFMLFSMLANLAEDRQGVATEKDADVAAALERLAKAGIGREPVMALLDHALVSPVLTAHPTEVRRKSMIDHKNRIAELMRLRDHGVTETADGDQVEEAILRQIALLWQTRILRREKLGVPDEVETALSYFRDVFLPVLPALYARWDRALGDRAPSFLRPGSWIGGDRDGNPFVTAESMRFALARAAETVLDHYLESVHALGAELSISTEHVTVPEAVLQLAEASGDTGKSRSDEPYRRALTGIYARLSATHEKLIGKRPGRPSPIPAAPYGHPSEFREDLVAIARGLANGGPLATGGALGRLIRAVETFGFHLATLDMRQNSAIHQRVVAELLKSAGVCEDYAALDEQARIDLLRHELANARPLTSPYAVYSEETASELAIVREAAAAHARYGRDCIRHYIVSMAQSVSDLLEVHVLLKEAGLYVPGETPQAHIMAIPLFETIADLEAAPPIMEAWLGLPEVAAIAAVRGHQEVMIGYSDSNKDGGYLTSTWQLSRGSTALKPVFEQAGLAMQLFHGRGGAVGRGGGSSFSAILAQPPGTVQGRIRITEQGEVIAAKYGSPESAMTNLEAMASATLLASLEPEQLAPADAERFAAAMDRISETAFRTYRGLVYETPGFTTFFRQMTPIAEIAGLKIGSRPASRKKSDAIEDLRAIPWVFSWAQARVMLPGWYGVGAALEAFEDKGLLREMASAWPLFRATLDNMEQVLAKSDMGIASHYAALVEDGELRDGIFGRIQAGWQQTHDALLQVTRQTRLLEKHPLLDTSIRLRLPYIEPLNLLQIELMKRHRAGEDDPRIGEGILLSINAIATALRNSG

SEQ ID NO: 17833 - protein, 273 aa, SPHINGOMONAS
MRIQFLKCHGSGNDFPLIDARALTLTEPEWAILARLLADRGGPVGGDGLLALVPGDDAHAFGMRMWNSDGSEAETCLNGLRCTARLGFDVLGLDAAQVKLKTSSASVARDPEIAPGVVTIRTLVGPNSTRAADVGLVGAPEAVIDARIEGLPNPRRFTAVAMPNPHLVTFVDAVDEDELVALGTWCEGRPALLPARGNVSFVEQRGPQSLFVRTFERGVGLTDSCGSAMAGSVLSAALTGRVPFGTPIEVFNRGGMVRGQAEADRRVMLSGNA

SEQ ID NO: 17834 - protein, 446 aa, SPHINGOMONAS
  unsure (1)..(446): unsure at all Xaa locations
DVLIIGSGPGGYVAAIRAAQLGLKAVCVEARETLGGTCLNVGCIPSKALLNASELFYEAASGALAKHGVKLGNVELDLPAMMADKDKAVKGLTGGIEFLFKKNKVEWVKGLGTFIDAHTVQVGERTVTAKNIVIATGSSVTPLPGVAIDQKVVVDSTGAIALEKVPANMVVIGGGVIGLELGSVWQRLGAKVTVVEYLDQLLPGMDGEVRKEAAKIFKKQGMEIKLSTKVTGVAVNGDKATVTVEPAAGGAAETLEADVVLVAIGRRPNTDGLGLDKIGLATNQRGQIETDHSFRTAVDGVWAIGDVIPGPMLAHKAEDEGIAVAENIAGLTGIVNHAVIPSVVYTHPEIAGVGLTEEQAREKGEVKVGKFPMAGNSRAKAIDDTTGWVKVIAHAKTSRVLGAWIITAPAGTMIAQVAQAMQFGATSEDIAXKSHAQPAHSEAIQE

SEQ ID NO: 17835 - protein, 402 aa, SPHINGOMONAS
TEVKVPVLGESITEATVGEWLKNPGDPVRVDEPIASLETDKVSVEVPSPVAGVMGEQIVKVGDTVEVGAVIAIIAGEGAAAAPAAAAPAATPAPAPAAAPAPAADAAALSPSVRRAVLETGVDPSTVQGTGKDGRLTKDDVIAAASSKPAAAPAPAAAPVPAAAPASTGGRKEERVRMTRLRQTVAKRLKEAQNTAAMLTTFNDVDMTAVIEARAKYKDLFEKKHGVRLGFMGFFVKAACMALKDIPGVNGSIEGDEIVYHDYCDISVAVSAPQGLVVPVIRDAQDLSVAGIEKTIGDFGKRAKDGSLKMDEMKGGTFTISNGGVFGSLMSTPIINPPQSAVLGLHRIEERPVVRNGQVVVRPMMYLALSYDHRLIDGREAVTFLVAIKNAIEDPTRLLIDL

SEQ ID NO: 17836 - protein, 949 aa, SPHINGOMONAS
GVSPGLLETLYRRYKSDPASVEPSWRAWLEGLESTASGPSWQRANWPLTETDALTAGLDPTQMEPAPKPAKGGAPAKPAAPAASTADVTKAAEDSIRAMMLIRTYRVRGHLAANLDPLGLARQNLPADLTPEYHGFSGADLDRPIYLGGALGLQHGTVREIVVILQANYCGNVGLEYMHIADVEERRFLQDRMEGKDKAITFTPDGKKAILSKVIEAEQWEKFLGKKYVGTKRFGLDGGESMIPAMEAIIKYGGQQGVREIVYGMAHRGRLNMLANVMEKPFRVIFHEFGGGSANPDDVAGSGDVKYHLGTSTDRQFDGISVHMSLVANPSHLEAADPVVLGKARALQTIRGDLEKHDQVLPVLIHGDAAFAGQGIVWETLGFSGIRGYNTGGCIHFVINNQVGFTTSPQFARSSPYPSDVAKGVQAPILHVNGDDPEAVTFACKVAIEFRQAFHRDIVIDMWCYRRFGHNEGDEPGFTQPLMYQKIRQHPGVSSIYGQKLIAEGVVDQGFIDEKTTQFNTLLEGEFEAGKTYLPNKADWFAGRWSGLGAPSDGEGSRRNVETGIEKKLFDSIGRTLTTVPQDLEIHKTLGRVLDAKREMFKSGANFDWATGEALAFGSLLSEGYTVRLSGQDSGRGTFSQRHAVWVDQKTEAKYVPLTTVPHGRFEVLDSPLSEYGVLGFEYGYALADPKALVLWEAQFGDFVNGAQIMIDQFIASGESKWLRANGLVMLLPHGYEGQGPEHSSARPERFLQLCAQDNMQVVNITTPANYFHLLRRQMHRNFRKPLIQMTPKSLLRHKLAVSSAEEFLGDSHFKRILSDPSAPADAQVKRLVLCTGKVAYDLIEARDAAGDKNTAIVRIEQLYPFPGEPLTERLKRMTNLEEVVWAQEEPKNNGYWFFVEPLIEQCLIDAGIKVQRPRYAGRAAAASPATGLMKRHTAEQGALVADAL

SEQ ID NO: 17837 - protein, 292 aa, SPHINGOMONAS
MSILVDKNTKVIVQGMTGATGTFHTEQALAYGTQMVGGVTPGKGGSTHIGLPVFNTVAEAKSKTGADASVIYVPPPFAADSILEAIDAEIPLIVAITEGIPVLDMVKVKRALSGSKSRLIGPNCPGVLTPGECKIGIMPGSIFSKGSVGVVSRSGTLTYEAVFQTTNAGLGQTTAVGIGGDPVNGTNFIDVLEMFLADEATKSIIMIGEIGGSAEEEAAQFLIDEAKRGRKKPMAGFIAGRTAPPGRRMGHAGAIVSGGQGGAEDKIAAMEAAGIRVSPSPSLLGETLMEVL

SEQ ID NO: 17838 - protein, 320 aa, SPHINGOMONAS
MARKKIALIGSGMIGGTLAHLAAIKELGDIVLFDIAEGTPQGKALDIAQSGPVEGFDANLKGANSYEDIAGADVCIVTAGIPRKPGMSRDDLLKTNLGVMKAVGEGIAAHAPDAFVICITNPLDAMVWALREFSGLPHQKVVGMAGVLDSARFRHFLAEEFNVSVEDVTAFVLGGHGDTMVPVIEYSTVAGIPVPDLIKMGWSTQERIDAIVARTRSGGGEIVALLKTGSAYYAPATSAIAMAESYLKDKKRLLPCAAHLTGQYGVDDLYVGVPIVIGKDGVERIVEIELNATAKQNFDVSVDAVKELVAACKSIDASLA

SEQ ID NO: 17839 - protein, 521 aa, SPHINGOMONAS
FEYDMQQSPVASLPGSWIGHSPEMRLYQGLVWYQRDFTAAAPKPGNRVFLRIGAAEYRSYVYLNGKPLGEHRGGYTPFAFEVTKLLRPGRNQVTIGVDSVRTANDVPPPVTDWETYGGITRSVTLVTVPDTYVDDAFVRLTPDGTRIAVSVKLEGPAAAGTAVRFRIPGLGAVLDGKTDGEGKWDATLPVPRALVRWSPENPKLYDIAIDAGADHFADRMGFRTIAVKGADILLNGKPIFLRGISMHEEELGADPVRAMTPAAARALLGEIKYGLHGNFVRLAHYPHSESTTRMADEMGLLVWSEVPLYWLVNWNNPDTLADARRIQAENIRRDRNRASVVLWSVANETPTNDARNAFLRTMIADVRALDSSRLVTAALLSGREGKSIMKIDDPLANDLDVMAINTYNGWYSDDALEDLASQEWRGPANKPLIFSEFGADARAGYHDPVASPHKFSEEYQADYYRATLAMAAKVPFLRGMSPWILKDFRSPRRQHPIYQQGWNRKGLISETGQHKLAFDVL

SEQ ID NO: 17840 - protein, 237 aa, SPHINGOMONAS
ASPEATRVKKFEIYRYDPDSGENPRYDTFEVDLDDCGPMVLDALIKIKGEQDSSLTFRRSCREGICGSCSMNIGGKNGLACTTAIEDIKGEVQITPLPHMDVIKDLVPDFTHFYAQYASIKPWLQTVTTTPSGKERLQSPQDREKLDGLYECILCACCSTSCPSYWWNSDKFLGPAILLQAYRWLADSRDEMTGERLDQLEDPFRLYRCHTIMNCANACPKGLSPAKAIAEVKKLAA

SEQ ID NO: 17841 - protein, 588 aa, SPHINGOMONAS
  unsure (1)..(588): unsure at all Xaa locations
NLVAMFFTRAAEKGEAPFLWHKAGGKWHPTSWAEAAAQVASLATALKALGLKPGDRVMLVSENRPEFCISDLAIMAAGCVTVPTYTTNTERDHQHILENSGACAVIVSNTKLAKTLLPAMLRSSAGRIVIGIDDVRLAQHGTLEVHDFRELIAAHPTDAASAAAEATFRREDLACIIYTSGTGGSPRGVMQHHGAILHNCQGCVTVISEDFGWEDEVFLSFLPLSHAYEHTGGQFFPIALGGQIYYSEGLEKLASNIEEVRPTIMVVVPRLFEVLRTRITKQVEKQGAVASYLLEKAVAIGGRKAAGKSGLRDAPMNLLLGATLRPKLAKRFGGRIKALVSGGAPLNPEVGIFFESLGLTFLQGYGQTEAAPVISCNRPAAGLKMDTVGPPLEGVEVKIAEDGEILVRGELVMHGYWRNEAETERVLKNGWLHTGDIGEIDAKGRIKITDRKKDIIVNDKGDNVSPQKIEGMLTLQPEILQAMIYGDKRPYMTAVIVPDPEWVQEFCAKTATPCKFRNLSRDADFKATIGAAVERVNRDLSVIERVRKFILADEAFTIENEQLTPSMKIRRHVLKAVYAERLDTLYXK

SEQ ID NO: 17842 - protein, 181 aa, SPHINGOMONAS
LMDLHQNEDIRSRIRTIPDFPKPGILFRDITTLLLDAEGLRLTIDRMAAQVEGPIDLVAGVEARGFLFGAALAMQLGTGVLLIRKDGKLPGATIAEDYALEYGTDRIAIHADALVPGARVLLVDDLIATGGTARAAVRLLRKAGAEVVQASFVVDLPDLGGADALRGDGLKVSALVAFEGH

SEQ ID NO: 17843 - protein, 275 aa, SPHINGOMONAS
EQQQRARTWFESLRDSICAEFEAIEREADSDAAFTYLPWDRTDTSGAPGGGGVRGVMKGRVFEKVGVNVSTVGGALEGDFAKTIHGAGEDPSFFATGISLVAHMANPHVPAVHMNTRFLTTTKRWFGGGADLNPPLPYEEDTADFHARLQAACDAHDAGHYPRFKKWADDYFYIPHRQVHRGVGGIFYDHLEGDWEADFAFTQDVGRAFLDVYPRLVRRRMHQPFDDADRQRQLEWRGRYAEFNLIYDRGTLFGLKTGGNVDAILMSLPPMAAWS

SEQ ID NO: 17844 - protein, 851 aa, SPHINGOMONAS
PQAIRREDYRQPDWLVPDIALDFDLDPAATRVRAALHVTRNGSHDRPLVLNGDGLEAVAVKVDGVASTDWRMDGQDLVIPLGGDAHTIETEVVIAPERNTQLQGLYASSGMLCTQCEAEGFRRITFFPDRPDVLSKYKVRMEGDKARFPVLLSNGDPIAHGDAESGRHWAEWHDPFPKPSYLFALVAGDLVANTGSFTTMSGREVQLGIYVRAPDLPKTDHALHALKLSMKWDEEVYGREYDLDVFNIVAVDDFNFGAMENKGLNVFNSRYILADPDTATDWDYDAIAAVVAHEYFHNWSGNRVTCRDWFQLSLKEGFTVFRDQSFSADQGSAAVKRIEDVRSLRASQFPEDAGPLAHPVRPDEYIEISNFYTATIYNKGAELIRMMATILGPQKFRAATDLYFDRFDGTAATCEDFVASMEEAGGVDLGQFRRWYSQAGTPRVSANLVQDGATTRLALAQTVPPTPGQPVKEPMVLPLKIRLFGETSGAPLIDEQLVLFDKPEQELRFENLSERAVLSINRGFSAPVIVDANRSAADLAFLSAHDDDPFARYEAMQQLMLDTLVAAVTTGKGEHAALIDAVRGTLTDSSLDRAFIAEAVLLPSDSFIGDQMAIVDPEAIFHAREALRADLGKALEAEWRAAYEGARANRFEYSPAAKGARRLKNVALGYIAASGASDAAELAFAQFDAADNMTDRQGGLATLVNGSSALREQALEAFYQRYAGNALVLDKWFQTQALSSRDDTLAAVEKLARHPDFTLANPNRARALVGAFSINQRAFHDPSGRGYRFVADQLIALDKLNPQTAAKLVPPLGRWKRFDPARAALMRGELERIVASPGLSKDMFEQATKSL

SEQ ID NO: 17845 - protein, 121 aa, SPHINGOMONAS
RYFTEDHEWIEVDGDVATVGITEYAQSQLGDIVFVEVPDEGKELAKGDDAAVVESVKAASDVYAPVSGTVVEGNEDLTENPALVNEDPEGEGWFFKMTLSDESELEGLMNEAKYQAFVEKQ

SEQ ID NO: 17846 - protein, 532 aa, SPHINGOMONAS
TGGRILVDNLVAQGCDRIFHVPGESFLAVLDALHDEPSIDLVTCRQEGGAAFMACADGAMTGRPGVCFVTRGPGATNASIGVHVAMQDSQPMLLFIGDVDRGMRDREGFQEVDLPAMFAPLAKWATRIEDARRIPEYIARAWNVATSGRPGPVVIALPEDMLLDVVEAVDRPAITEPIQAADAFDLDQLYDLLRGAERPIAIVGGGGWDSDTAEDFARFAELIELPVACAFRRQDAIDNASTVWAGNLGYGPNPKLVQRIKTADLLLVVGARLGEATTDGYSLITPEHPGQTLVHVHPDPGEFHRVYRVDLPICARAVRVRRRRSRTVEAAGLSRFDAGAAHAELLDWSTPKPREGVALDLGPCVAAMREALPADTIICNGAGNFSGWWHRYWHYAVQPSQLAPTAGAMGYGVPAAVAAALRFPERKVVAVAGDGDFLMNGQELATAVQHGADMLVILVDNGAYGTIRMHQEREFPERLSGTTLRNPDFAALARAFGGWATTVETTEAFAPALALALAQPGLKLLHCKTDIE

SEQ ID NO: 17847 - protein, 148 aa, SPHINGOMONAS
  unsure (1)..(148): unsure at all Xaa locations
PALADTIFVLNGPNLNLLGLREPEIYGSDTLDDIAGMLEDRARDLGLEVEVRQSNHEGHLIDWLHEAQADGARAVLLNPGGYTHTSVALHDAIKSISTPVIEVHLSNPHARESFRHTSFVGRAAKGTVAGFGSLSYILALEAAARLXQ

SEQ ID NO: 17848 - protein, 442 aa, SPHINGOMONAS
IKKLLIANRGEIALRIHRACHEMGIKTVAVHSTADADAMHVRLADEAICIGPPAASESYLNIPNIISAAEISGADAIHPGYGFLSENAQFAEIVEAHGLIFVGPKPEHIRTMGDKIEAKRTAGALGLPLVPGSDGPISDLEEAKAIAAKAGYPVIIKAASGGGGRGMKVCTSEDQLETLMQQAGSEAKAAFGDATVYLEKYLGNPRHIEFQVFGDGNGNAIHLGERDCSLQRRHQKVLEEALSPVITPEERARMGAIVAKAMSDMGYRGAGTIEFLWENGAFYFIEMNTRLQVEHPVTEMITGMDLVREQIRVAEGHGLSVRQEDLEFRGHAIECRINAEDPRTFAPSPGTITHFHAPGGMHVRVDSGIYSGYRIPPYYDSMIAKLIVYGRTREGCILRLKRALEEFVVDGIKTTIPLHQALLDDPEFLKGDYTIKWLEEWL

SEQ ID NO: 17849 - protein, 563 aa, SPHINGOMONAS
  unsure (1)..(563): unsure at all Xaa locations
LGRFAMSETKAGHGPYTYAQAGVSIAAGNALVRAIGPLARSTRRAGADADLGGFGGIFDLKAAGFTDPLLVAANDGVGTKLKLAIEHNHHDGVGIDLVAMCANDLIVQGAEPLFFLDYYASGKLDNAVAERVIASIAEGCRQAGCALIGGETAEMPGMYADGDYDLAGFCVGAVERDRLLDGKKIAPGDVLLGLASTGVHSNGFSLVRRLAADKGWKLDRPALFDQERLLIDTLMAPTRIYVASLLPELRKGTIHGLAHITGGGLLENVPRVLPEGTHARIDAEAWPLPRLMAFLQAQGNIEPEEMARTFNCGIGMVAVVAADQAEAVTAALTAAGETVFTIGTIEAGERGCTVVGGDETWSARAPWSATHHGETSAGVSSPRKKIGILISGRGSNMASLVEAAAAPDCPYTVALVASDKPEAPGLAWAAERGVPTFAQSPKGMPKAEYEAKIDAALRDAGVEAIALAGYMRLLSDDFVARWRGRIVNIHPSLLPKYKGLDTHARAIAAGDTXAGASVHIVTEELDGGDVLGQARVPILSGDTADTLAARVLAEEHELYARTL

SEQ ID NO: 17850 - protein, 499 aa, SPHINGOMONAS
TRAAFGAWFDTPGSTVQGWETDGKRANTKVMNQIAAMGIAEHADWHVAVRDVESAMASWTPDSWTQAEARQMPQYPDKGALDAATRQLSSYPPLVFAGEARGLTAELAKVSRGEAFLLQGGDCAESFAEFHPNNIRDTFRVILQMAVVLTFASKLPTVKLGRMAGQFAKPRSADTEVIDGVELPSYRGDNVNDIAFTPEARIPDPQRMVQGYSQSAATLNLLRAFANGGYANLHQVHKWTLDFMGKSPWSAKFADVADRIGEALDFMEACGINPDTVPQLKGTDFYTSHEALLLPYEQALTRQDSLTGDWYDTSAHFLWIGDRTRFEGSAHVEFLRGIGNPIGMKCGPSLEPDALLRLLDTLNPGRVPGRMTLITRYGHDKIEAGLPKLVRAVKREGHPVVWSCDPMHGNVVKAANGYKTRPFDRILAEVRGFFAVHRAEGTFAGGIHAEMTGQNVTECTGGAIAITEQGLADRYHTHCDPRLNAGQSLELAFLLAEML

SEQ ID NO: 17851 - protein, 344 aa, SPHINGOMONAS
RRLIGREGADFASNDYLGLADSPALREAVAAALARGVPIGSGGSRLLRGNQTEHEALEADAAAFFGRESALYFSSGYAANAALLGTLPQRGDLVLFDELVHASAHEGMRLGRAETRQTAHNDVAAFAAAIADWRRAGGSGRVWITVESLYSMDGDLAPLAELSALAGAEDAILIVDEAHATGVYGPQGQGLAYGLPRDNLITLHTCGKALGCEGALVAGPKVVRDFLVNRGRAFIFSTAPSPLMAAAVRAALRIVGEGDALRTALFDRVRAARAALGPFGVLDGPSQVLPLILGDDVRTMTVAGLLQESGFDVRGIRPPTVPAGTSRLRISITNNVTLADIAAL

SEQ ID NO: 17852 - protein, 402 aa, SPHINGOMONAS
VWHPFTQHGLGEPIPMVSHAKDAVIHTADGRSFIDAISSWWVTTHGHCNPRIMAAIAAQAAKLDQIIFAGWTHEPAETLAAGLRTMLPDALEHVFFSDSGSTAVEVALKMALGYWHNRGEEDRNRILVLEHSYHGDTIGGMSVGARGVFNRPYQPLLFDVGTIPYPATGAEQATLDALEAECRAGAAAFIVEPLVLGAGGMLFYTPALLAEMAAICARYDVLFIADEVMTGWGRTGTLTACEQAGVVPDILCLSKGITGGAIPLAVTLATAPIFQAHWSEDRARMFFHSSSYTANPIACAAAVENLAIWREEPVLERIAQLGNWQQAALDGLADVPGLANFRRMGTIAALEIEQPENGYLSAIAPRLMAFARENGVLLRPLGNTVYVMPPYSITREQLDKVW

SEQ ID NO: 17853 - protein, 462 aa, SPHINGOMONAS
MTHRFDPTSLREYDIRGIVGKTLGPDDARAIGRGFATLLRRAGGRRVEVGRDGRVSSPMLEAALIEGLTASGCDVVRTGMGPTPMLYYAEATLEVDGGIQITGSHNPGNYNGFKMVFQHRSFFGQDIQTLGKMAAEGDWEDGDGTETVTDADIEDLYVSRLIAGYAGGAYKIGWDAGNGAAGPVIEKLVKLLPGEHHTLFTDVDGNFPNHHPDPTEEKNLADLKKLVAEKNLDFGLAFDGDGDRLGAIDGQGRVVWGDQLLAILAEPVLRIDPGATIIADVKASQALYDRIAELGGKPVMWKTGHSLIKTKMKETGAPLAGEMSGHIFFAQDYYGFDDAQYAAIRLIQAVHVIGKSLTQLKDEMPAMVNTPEMRFQVDESRKFPVVEEVLDRLEADGAQVDRTDGARVNTDDGWWLLRASNTQDVLVARAEAKDHAGLDRLMAQIDDQLAKSGIVRGEQAAH

SEQ ID NO: 17854 - protein, 323 aa, SPHINGOMONAS
MTVRSVILGTGSALPAQRVSNAELAERVDTSDEWIVERTGIRFRHIAGPEETTGTLAAGAARAALESAGVEAASIDLIVLATATPDQTFPATATRVQNALGILDCVAFDVAAVCSGFLYAVQVADSMLRAGVHRRALVIGAETFSRILDWEDRTTCVLFGDGAGAIVLEAQDTEGDAPQGILATKLHADGRYNDLLYVDGGPSTTGTVGKLRMKGREVFRHAVTNLASVMQESLAAAGLEPGDVDWVVPHQANARILDATARKLDLAPEKVIVTVDRHANTSAASVPLALDVAVRDGRIQRGDLLVLEAMGGGFTWGAAVIRF

SEQ ID NO: 17855 - protein, 394 aa, SPHINGOMONAS
ALQRIQPSATLAMTSRVFELKRQGVDVIGLGAGEPDFDTPDFVKEAAIEAIRSGKTKYTNVDGTPELKEAVIQKFKRDNGLDYTAQQVTINVGGKHTLFNAIVATVEAGDEVIVPAPYWVSYPDVIQFAGGTPVFIAAGAEQQYKITPAQLEAAITSRTKWVILNSPSNPTGAAYSAAELKALGEVIERHPHVWVFADDMYEHILYDGFEFATIAQVCPSLYERTLTVNGCSKAYAMTGWRIGFAGGPAPLIKAIAKLQSQSTSNPCSIAQAAAVAALTGDQGFLKDRAAAFQTRRDLVVGMLNDIEGMTCPTPEGAFYVYPEFSALIGKTTPKGKVIATDEDMIGYFLDDARVAAVHGAAFGLSPAMRISYATSEALLREACTRIQTACAELR

SEQ ID NO: 17856 - protein, 307 aa, SPHINGOMONAS
RVFIDGAAGTTGLEIRERLAGRSEIDVMVLGDQDRKDPKKREEALNAADFVILCLPDDAAREAVAMIRNDTTRVIDASTAYRTAPDWTYGFAELEPGQAAAIAEAARVSNPGCYPTGFLALVRPLIRAGLIPHDFPLSVNAVSGYSGGGRSMIEEFEGKGTNPTDTAFRPYGLALAHKHVPEMQKHARIVNPPIFMPSVARTYRGMIVEVPLPLYAFTRKPSVESLENVLRDAYRDSPVVQVLPADVPTVTIEENAGTDRLSVRVFGNDETRQARLIATLDNLGKGAAGAAVQNLNIMAGLDPVAGL

SEQ ID NO: 17857 - protein, 524 aa, SPHINGOMONAS
MLGGMQDFELRVSTLLDHAAREHGPREIVTRWADGSETRTNWAGIARDARRMAQALERLGIRKGDRVATLAMNHSRHLVAWYGVTGMGGLIHTINPRLFDDQLAFIANHAEDRVLLYDRMFAPVIERLKSQWTTIEHYICFDDLGPDGFEAWIGSEDGDYAWVTGDEREPMMLCYTSGTTGNPKGVMYTHRSTVIHALTELQPAVFDLSTQSVAMPIVPMFHAVGWGLPWAAPAVGAKMVFSAINDPKVLCELMNREKVTHSAGVPTVWFAMFQHIDATGEHPKHLKIVTIGGSAAPRAMIERLMKMGMRVNHAWGMTETSPIGTMGAPSPDFDDLDFDAQVDQVVKQGRVPYGVELRTVDDAGNVLPRDGKTAGRLQVRGPWVIDTYYRETRPAVDADNWFDTGDVAMLHPDGVMQITDRAKDVIKSGGEWISSVELENAAVGCAGVAEAAAIGVHHPRWEERPILLVVRKPDSTVSEADILAHLGCHVAKWWLPDEIHFVDSLPHTATGKLLKMEIRKRYKD

SEQ ID NO: 17858 - protein, 402 aa, SPHINGOMONAS
MANVAVIGAQWGDEGKGKIVDWLAERADVVVRFQGGHNAGHTLVIGEKIYKLSLLPSGIVRGTPSVIGNGVVLDPWALKAEVEKLREQGVEVTPDTLKIADTCPLILPFHRDLDALREDASGAGKIGTTRRGIGPAYEDKVGRRAIRVCDLANLDSIGPQLDRLAAHHDALRAGFGQPPINREGLLEELRGIAGFVLPFVQPVWKMLNEARSRGRRILFEGAQGVLLDIDHGTYPFVTSSNTVSGTAASGSGMGPGAVGFVLGIAKAYTTRVGSGPFPSELDNETGERLGTRGHEFGTVTGRKRRCGWLDAVLLRQSVAVSGITGIALTKLDVLDGFEEIQVCTGYRLNGEVLDYYPASAPDQAAVEPIYETMEGWSESTAGARSWAELPAQASNISAASKS

SEQ ID NO: 17859 - protein, 846 aa, SPHINGOMONAS
RTTCAYCGVGCGIRATVTGERAVRIEGDPDHPANHGRLCSKGTHLGETIGLEGRLLHPMIGDRRASWDKALDLVARRFREAIAEHGPDSVAFYVSGQLLTEDYYVANKLMKGFIGSANIDTNSRLCMSSAVAGHMRAFGEDVVSGSYADLDAADLIVLVGSNTAWCHPVVYQRIMAARAERGTKLVVIDPRRTETAEEADLHLAVRPGSDVALFNGLLAHCRAEGLADAANLDVPAGFWEALGEGHDLWSTAQTCDLVPADLQRFYQLFAAHPRTVTLFSQGINQSIRGTDQVNAILNLHLATGRIGTPGAAPFSITGQPNAMGGREVGGLASTLAAHRGFGAQDIADVGRFWAAERMATRPGLKAVDLFRAVGEGRIKALWIMATNPAVSMPDAGRVREALAACPFVVVSDVIAQTDTSVHAHVRLPAAAWGEKDGTVTNSERTISRQRAFLPLPGEAKPDWWIVSQVARRMGFRTAFPFDRPAEVWREHARLTAYRNGGARMLDLQAKAAIGNQAYDEMAPFSWHPQPFADGRYPTPSGRARLVPVAQRPLDAPLRDWPMTLNTGRYRDQWHTMTRTGLSPRLARHREEPLVEIHPDDAAALALADGALARVATPQGNSLFRVAHHAGQRRGELFTPIHWTDRQSRGGRTGLLARDLADPHSGQPGFKLSPARITPVAVDWRGFLIVRGEGAAPDCLWATRVTVPGGVLYELAGTGDAAPLDRALPAGERIEAIDPARGTRRVAVLRDGRLAAVLFVTRAGALPSRDWLIGQLDQPQGPQVLAGRAPGRAADRGPVVCACFDVGLHTITAAIRDQRLLDVAAIGTALGAGSNCGSCRPALARIL

SEQ ID NO: 17860 - protein, 482 aa, SPHINGOMONAS
RVIDHVIAGAAGAGATRHADVFDPNSGAVQARVPLGTAADLDRAVAAAQAAQPGWAATNPQRRARVMFRFKELVEANMDALAHMLSAEHGKVIADSKGDIQRGLEVIEFACGIPHALKGEYTQGAGPGIDVYSMRMPLGIGAGITPFNFPAMIPMWMFGVAIACGNAFLLKPSERDPSVPVRLAELMLEAGAPQGILQVVQGDKEMVDAILDHPAIGAVSFVGSSDIAHYVYQRGVAAGKRVQAMGGAKNHGIVMPDADLDQVVADLSGAAFGSAGERCMALPVVVPVGDKTADALREKLIPAIRSLRVGISTDAEAQYGPVVNAAHKARVENWIQTGVDEGAELVIDGRGFSLQGHEQGFFIGPSLFDRVTPGMKSYQEEIFGPVLQIVRAPDFETALRLPSEHQYGNGVAIFTRNGHAAREFAARVNVGMVGINVPIPVPVAYHSFGGWKRSAFGDVNQHGMEGVRFWTKVKTVTQRWPD

SEQ ID NO: 17861 - protein, 380 aa, SPHINGOMONAS
  unsure (1)..(380): unsure at all Xaa locations
FDLTDDQRQIQELAQKFTADAITPHAAEWDEKHVFPRDTIKAAAELGFAAIYVSEESGGIGLGRLESALIFEAMAYGCPSTSAFISIHNMAAWMIDRFGAPAVKDKYLPSLVTMDRLASYCLTEPGSGSDAAALKTRAVRDGDHYVVTGSKQFISGGGENDLYLTMVRTGEDGPKGISCLAIEKDMPGVSFGAQERKLGWHSQPTAQVILDNVRVPVENLVGAEGEGFRIAMMGLDGGRLNIGACSLGGAQRCLDEAVRYTQERKQFGKAIADFQNTQFTLADMATELEAARALLYLAAAKVTAGTPDKTRFAAMAKRLATDTGSSVVDRALQLHGGYGYLMDYPIERFWRDLRVHSILEGTNQVMRMIVGREMVREXAT

SEQ ID NO: 17862 - protein, 173 aa, SPHINGOMONAS
ETATLAGGCFWCTEAVFNDVIGVQGVESGYIGGTKDNPTYKEVCSGSTGHAEAIRVRFDTDVVSYGEILDIFLATHDPTQLNRQGNDIGTQYRSAIFPHSAEQEREALDAIERARPDWPQPIVTTIEPLGQWWPAEDYHQEYWQGEGQRNPYCLAVIPPKLRKLRKSFANKAK

SEQ ID NO: 17863 - protein, 395 aa, SPHINGOMONAS
LFTSESVSEGHPDKVADQISDSIVDLFLSKDPEARIACETLTTTQLVVLAGEIRCKGVYENGEWAPGAQEEIEKTVRETVKRIGYEQSGFHWQTFRFENNLHGQSAHIAQGVDASGNKDEGAGDQGIMFGFACDETPDLMPATLDYSHKILERMAADRHSGAAPFLEPDAKSQVTLRFDNGKPVAATAIVVSTQHAPGYDQGEKEAELHAYVKKVIAEILPAELLSDATEYHINPTGSFEIGGPDGDAGLTGRKIIVDTYGGASPHGGGAFSGKDPTKVDRSAAYITRYLAKNIVAAGLAKRCTIQLAYAIGVSKPLSLYVDTHGTGTVGDDKIEQAIQGIEKLGGLTPRGIRTHLGLNKPIYQPTAAYGHFGRKPEGDFFPWERTDLVEDLKAA

SEQ ID NO: 17864 - protein, 309 aa, SPHINGOMONAS
AFIFPGQGSQAVGMGKALAEASPAAREVFQEVDEALGQHLFKLMSEGPDSDLTLTANAQPAIMANAIAVLRVLEKEGGIRLADKADFVAGHSLGEYTALCAAGALDLSTTAKLLRKRGDAMQSAVPVAEGAMAALLGADLVKAQAIADAAAEGEVCTVANDNDPHQVVISGARGAIERAVAIAKGHGAKRALLLPVSAPFHCPLMQPAADAMEKALAEVAIQAPLVPVYANVTAAPVADPATIRTLLVEQVTGMVRWRESVAAMFDGGVHEFVELGGKVLGGMVKRISPDATVTSVVSMDDIEALVKVL

SEQ ID NO: 17865 - protein, 246 aa, SPHINGOMONAS
MFDLTGMTALVTGASGGIGSAIAKALAAQGAKLAVSGSNAEKLEAFRAGLGGEHVALTCNLSDRAAVDALVPQAVEALGGRLDILVNNAGVTRDNLAMRMKDEEWEQVIQVNLEAAFRLMRAAAKPMMKARFGRMISITSVVGATGNPGQANYAASKAGLVGMSKALGQELASRNITVNCVAPGFIRSAMTDVLPDAQKEALLGRIPAGKLGEGEDIGAAVVYLASKEASYVTGQTLHVNGGMAML

SEQ ID NO: 17866 - protein, 71 aa, SPHINGOMONAS
EITTRVQALVVDHLGVDAKDVVPTASFTDDLGADSLDIVELVMAFEEEFGVEIPDDAAEKISTVGDAVAYI

SEQ ID NO: 17867 - protein, 416 aa, SPHINGOMONAS
RRVVVTGLGLVTPLGADVETAWKNILASKSGAGTITKFDATDFQSNYACEVKPADHEYGFDAGKRVDHKIQRQVDPFIVFGIDAAGQAIEDAGLTDMPEEMRFRAGCSIGSGIGGLPGIESESLVLHEKGPKRVSPHFVHGRLINLISGQVSIKYGLMGPNHAVVTACSTGAHSIGDAARMIAMDDADIMLAGGAESTVCPIGIAGFGQARALSTGFRDDPTKASRPWDQGRDGFVMGEGAGVVVLEEYEHAKRRGAKIYAEVVGYGLSGDAYHVTAPHPEGSGAFRSMQMAVRKSGLALEDIDYINAHGTSTPMGDELELGAVRRLFGDALGGLSMSSTKSAIGHLLGGAGAVESIFCILALRDQIVPPTLNLDNPSENCAGVDLVPHVAKERKVKAVLNNSFGFGGTNASLVMK

SEQ ID NO: 17868 - protein, 485 aa, SPHINGOMONAS
MQQPVGKLLLFGATGDLAQRMLLPSLYALHADGLLPHGLTITGTARSDHDDDGFRDFAAKALDQFLPADRKDDSAVQGFLQRLHYQTLDASQIDGYAALKEKLGDISGGLAIFLSTAPWLFGPTIKGLESAGLTGENVRISLEKPLGRDLASSREINDIVAEAFPEERTFRIDHYLGKETVQNILALRFGNSLFEPVWNARGIDSVQITVSETVGLEGRAGFYDDTGALRDMVQNHMLQLVALIAMEPPARLDGTAVRDEKVKVLRSLRKIPIAEAPNMTVIGQYGGGAVKGEIVRDYATDLGKDSRTETFVAIKAHVDNWRWQGVPFYLRTGKRLAERRSEIVIQFKPVPHSIFAERGGMLQPNALVIRLQPEEYVQLLVMAKQPGLDREGYRLREVPLNLSLDTEFAGTRRRIAYERLLLDLIEGDPTLFVRRDEVEAQWEWIDAIRAGWDANDLKPKPYASGSWGPSLSIALTERDGVHWHE

SEQ ID NO: 17869 - protein, 495 aa, SPHINGOMONAS
KAPFAARYDNFIGGRFVAPTAGRYFQNVSPVTGQVVCEIARSDADDIERALDAAHAAADAWGRTPVAERARILNRIADRMEANLEKLATAETWDNGKPIRETMAADVPLAIDHFRYFAGVVRGQEGSIGEIDHDTIAYHFHEPLGVVGQIIPWNFPLLMAAWKLAPALAAGNCVVLKPAEQTPASILVWAELIGDLLPPGVLNIVNGYGLEAGKPLASSRRIAKIAFTGETSTGRLIMQYASENLIPVTLELGGKSPNIFFEDVTREDDDFFDKAVEGFVMFALNQGEVCTCPSRALVHEKIYDRFMERALQRVQAIVQGSPLDPATMIGAQASSEQQQKILSYIDIGRQEGAELLIGGGAADLGGDLSGGFYVQPTVFRGHNKMRIFQEEIFGPVLSVTTFKDEDEALHLANDTLYGLGAGVWSRDANTCYRFGRAIKAGRVWTNCYHAYPAHAAFGGYKQSGIGRENHKMMLDHYQQTKNMLVSYSPKKLGFF

SEQ ID NO: 17870 - protein, 369 aa, SPHINGOMONAS
KPATKPARPYFSSGPCAKPPGWSPDKLACQSLGRSHRSKLGKTRLQYCIDLMRELLRLPDTHRIGIVPGSDTGAFEMAMWTMLGARPVTTLAWESFGEGWVTDAVKQLKLDPTVLRADYGQIPDLTAVDWSNDVLFTWNGTTSGARVPNGDWIAADREGLSFADATSAVFAYDLPWDKIDVATFSWQKVLGGEGAHGVLILGPRAVERLETYTPAWPLPKVFRLVSKGKLAEGVFKGETINTPSMLAVEDAIFALEWGKGLGGAEGLIARSDANAAALDKIVAERDWLGHLAEDPAIRSRTSVCLTVEGADADFIKKFAGLLEKEGAAYDVAGYRDAPAGLRIWCGATVDTADIEALGPWLDWAYATAK

SEQ ID NO: 17871 - protein, 448 aa, SPHINGOMONAS
AHRETEAALERAKDAAEAANAAKTRYLVAVSHEIRSPLNAIYGYAQLLERGDSIPSTEAGGVIRRSAEHLTNLVEGLLDISRVESGVLQVRQELVRLPALLDQVVEMFRVQASAKGLSLDYVVEGRLPAYVRTDEKRLRQILINLLSNAIKYTERGGATLTVRYRSQSAAIEVRDTGPGIPPEDLERIFEPFERGREPDAVMQPGIGLGLAITRVLARILGGEVTVTSDVGKGSSFLLRLLLPEPIEAPAGAAAYRRVTGYQGPQKTILVIDDSPAQTTVVNHLLRPLGFSVFEASGGTAGLALAEHCAPDLVLLDIQMPGCSGWDIAEQLRARFGAGLRIVMVSANAHEFHAGRDGHRVHDAFLTKPVDLDALLDMIARQLRLDWIVEDPDAVPTPPAPPPALPETAGPYLDALRRFMKLGHVRGIETTLVTLERDVPESADLVARL

SEQ ID NO: 17872 - protein, 1194 aa, SPHINGOMONAS
VLIANRGAIACRIIRTLKKMGIRSVAVFSDADEASRHVALADIAVRIGPGPAAESYLDVARILAAAMETGADAIHPGYGFLSENAGFAEACEAAGIAFIGPSADSIRAFGLKHSARALAEAQNVPLAPGTGLLDSVEAALEAAERIGYPVMLKATAGGGGIGMRVCTDAQAVRDGYAAVARLGAGNFGDAGLFLERFVPRARHVEVQIFGDGQGRVVALGERDCSLQRRNQKVVEEAPAPHLPEHIRAALIEAAVRLGRAANYRSAGTVEFLYDPARQDWFFLEVNTRLQVEHGVTEEVTGVDLVEWMVRGAGGDYSFLDTPVPAPKGWSIQARLYAEDPAVDFRPASGTLTEVAFPEGVRVESWVESGSAVSSFYDPMLAKLIVHGEDRESAVAAMQAALDRTRFAGIETNVRWLRDVARATDFVTGDVSTRSLETVVHRPQSIVVRSAGTATSVQDYPGRVGLWDIGVPPSGPMDARAFRLGNMLLGNDSAAPGLEVTATGPTLQFNTATRIVLTGADFAATLDGKPVPRNKPVAIAEGQTLALGRVTGGGMRGYILFAGGLDVPSYLGSASTFDLGEFGGHGGRVLRVGDTLHLTDHAPAVIPGPRAIDQAQLGPDWTIRVLYGPHGAPDFFAPEDVDTILSAEWKVHYNSNRTGVRLVGPKPHWARKDGGEAGLHPSNIHDNPYAIGALDFTGDMPIILGPDGPSLGGFVCPFVVIAADLWKVGQLAPGDRIQFEQVSLDEADAAAAVEEAWIEGRAATATSPAKGGGRDAILVDLPAKGRRPRVLFRRQGDRNLLVEYGPITLDLELRLRVHAATTALAALALPGILDIVPGIRSFQVHIDGIRLKEAGLIERLTQIENELGDLEDFVIPSRIVHLPLSWNDPAIHETIQRYMRVVRDDAPWCPDNIEFIRRANGLASAEEVHRIIFDASYLVYGLGDVYLGAPVATPIDPRHRLVTTKYNPARTWTPPNVVGIGGAYMCIYGMEGPGGYQLFGRTIQVWNTYRQTGAFAEGKPWLLRFFDQIRFFPVSHEELTEWRRDFPLGRREIRIEETEFRLSEYREFLAENARSIAAFEKQRNAAFAAERAEWERKGEFDRVASLTETADDSADEAVTVPDGAELVEAPFGGSVWKLLKEVGDPIDAGETIAVLEAMKMEFPVTSPAAGTVAALYVAERQTVTPGSPVLALVRA

SEQ ID NO: 17873 - protein, 494 aa, SPHINGOMONAS
  unsure (1)..(494): unsure at all Xaa locations
HLIDALPLRGAPDAVALEDKAGALTYAALEAAVGGIAHALAAHGLPPGERMASWLPKTRAACLLPLAGPRAGLVHVPINPALKRAQVAHILEDSGARLLVTQKARLAALAPGDVPADCRVVTEEELAGTDAVMPPAGGDPDALAAILYTSGSTGRPKGVMLSHANLWLGAISVAHYLKLTSADRVLGVLPLSFDYGQNQLFSTWAAGARVVPLDYLTARDVVKAVERFAITTLAGVPPLWVQLLEADWPTDIAGKLRRLTNSGGALTRPLVRDLRTRFPGADLYPMYGLTEAFRSTYLDPALVDTRPESIGSAIPFAEILIVDAEGRRAVQGELVHAGPLVAKGYWRDPERTARRFRPAPVFAEHPGMAVWSGDTVAEDEDGLLRFVGRDDEMIKSSGNRISPTEIEEAVVAGGETSEAVAFGVPDPRLGQAILVVARGDGSREEELRARLRRELPSFQQPARYVWRDRLPRNANGKLDRSGLKTEILXTRNRS

SEQ ID NO: 17874 - protein, 421 aa, SPHINGOMONAS
MTKLSGGDSKSTLYCSFCGKSQHEVRKLIAGPTVFICDECVELCNDIIREETKSSLVSKKDGGVPSPQEICDVLDDYVIGQKKAKRVLSVAVHNHYKRLNHGAKGADVELAKSNILLVGPTGCGKTLLAQTLARILDVPFTMADATTLTEAGYVGEDVENIILKLLQASDYNVERAQRGIVYIDEIDKISRKAENPSITRDVSGEGVQQALLKLMEGTTASVPPQGGRKHPQQEFLQVDTTNILFICGGAFSGLEKIIGDRLQGKSIGFGAHVAAPDERRTGELLRQTEPEDLLKFGLIPEFVGRLPVIATLEDLDVEALIKILTEPKNALVKQYQKLFDMEAVKLGFTDDALTAVSKKAIERKTGARGLRSILEGILLDTMFDLPSMDGVDEVVVDKDVVEGRKEPVRIYAKKEKTGSAA

SEQ ID NO: 17875 - protein, 810 aa, SPHINGOMONAS
QSYPVLPLRDIVVFPHMIVPLFVGRDKSVAALEAAMAADKEIFLVAQLDPAEDDPGRDDLYDTGVSAEVLQLLKLPDGTVRVLVAGKERGSLTSIEETGAYLTAHVEPVEEGDASLEAAQEGVDEAVSKLTPENLSPELKALMRSVVDQFENYAKLNRKLPAETAVQLGELEDPSRLADAVAANISVKVADKQSLLVETDPQKRLEMVFAFMEGELGVLQVEKKIRSRVKRQMEKTQREYYLNEQLKAIQRELGNEGEEGEGDEVAELTQKIATLKLSKEARAKAQGELKKLKTMAPMSAEATVVRNYLDVLLGLPWGKKSKLKKDIAEAQGVLDQDHYALEKVKDRIVEYLAVQARTNKLKGPILCLVGPPGVGKTSLGKSIAKATGREFIRQSLGGVRDEAEIRGHRRTYIGSLPGKIVSNLKKAGTANPLFLLDEIDKLGQDFRGDPASALLEVLDPEQNSKFNDHYLEIDIDLSDVMFVCTANSLNLPQPLLDRMEIIRLEGYTEDEKVEIAERHLIAKQIDAHGLKEGEFTLTNEGLRDLIRYYTREAGVRTLEREVAKLARKSLRKILEGKETQVTITPENLADYAGVRKFRFGVGEEEHQIGAVTGLAWTEVGGELLTIESVTVPGKGAIKTTGKLGDVMKESVEAAFSFVRARSPSYGIKPSLFARKDIHVHLPEGAVPKDGPSAGIGLVTSIVSTLTGVAVRKDVAMTGEVTLRGRVLPIGGLKEKLLAALRGGIKTVLIPEENEKDLAEIPANIREGLEIVPVSHVDEVLRLALTEPLTAIDWSDADELATPAARRRAGD

SEQ ID NO: 17876 - protein, 429 aa, SPHINGOMONAS
LGGAALAAPAAARAGPGQLAPTPPMGWNSWNSFATTITEAQALETAAIQARELLPFGYDIFTIDIQWYEPEANSYTYNAKPVPAMDSHGRLLPAPNRFPSSTNGKGFAPIAAKVHALGMKFGVHLMRGIPRLAVERNLPVLGANGVRAADIADTTSICPWNPDMYGVDMRKPGAQAYYDSVFALLASWGVDFVKMDDMSRPYDAHAPEIEAAAKAIRATGRPILLSLSPGETPVPHAAHVAQHAQMWRISDDFWDDWKMLEAQFTRLENWSPHARPGAWPDADMLPLGRLALGQRDTKFTPDEQRTLMTLWGIARSPLIMGGDLRHLDARTRALLTNREVLAVNQASSGNRPWFVADDRRVWTARAATGGHYVALFNTGDKAGEAAFDLRLLGATGTVRVRNLSEGKVEGTSPLRLARTLPPHGAGLYK

SEQ ID NO: 17877 - protein, 1017 aa, SPHINGOMONAS
DWENPAVFARGKMPASATHFPYESRAAALAGDPARSSRYLLLDGQWQFHFSPSSDAVPHGFEKPDYDVTAWKRIKVPADWQAEGFDQARYNNITYPFPANRPLIPHATNPVGSYRRDVQLPATWSGQDVILHIGAAGSAYRVWVNGVEAGYSEDSKLPSEFDVTKLVHVGRNTVAIQVHRWSDGSYLEDQDFWRVSGIERSVYLAAVPKARVADLFVHAGLDAAYKDGKLSTELTLTDRTAPLTARMTLLDGDKPVLVREAALAAGPAQKLTLAADVGGVRPWTAETPNLYTLLVELVDAEGKVVQATPQRIGFRTVEIRNGLVSVNGKPITIRGVNRHEHDPETFHVVSRASMERDIQLMKRANVNAIRTSHYPNDPYLYELADRYGLYVMDEANIESHAYMDYANKHGERRAELQVGFDPAWKDAHVSRVVNMVQRDKNHPSVIFWSLGNEAGIGPNFEAAAAAAKAVDPGRLVSYLGWGTWDGIQDHRPNYYADIYAPMYDPAVKLEDYATNWNFKQPVIQCEYAHMMGNSGGNLKEYWDTIYAHPNKLQGGFAWDWVDQSMYRYTKDGKRYWGDGGEYGPNPGGDIEFGDGLLQSDRTPNPQLYELRKVYAPIQFDGFDAAAGTVTVRNRHDFRDLSGFTFEWEVQENGVAVAKGALATPDVAAHGAGTIALPLAGLARKPGAEYFVTIRARAKADAVPLVPGGTVIGWEQFALDPAYRTAEVAAPKGKVTTQDGQGAITLSAGGATLVVNRATGLVDRYAARGKTLLSGGAPHFWRAVTDNDIGIGTDKQLAAWKGMSQTRTVASVQVQDLGEAGAEVRVAYTMGAGAVRFTSVYRMAGDGSVAVDGKFEPVSKQLPPPFRIGLAFTTPGSFKTVEWYGRGPHESYVDRKTSAPIGLWRGAIAEQNHDYIRPQETGNKVDVRWMELIGGGAGLRVQGDVPLMMTALAFPYADLDRHVPGTWKSTDVVPKAQGTLLVDAAQWGVGGDTQWSEFGKPLLKYRTQLMPMSLHFRL

SEQ ID NO: 17878 - protein, 487 aa, SPHINGOMONAS
VTVHGDKPGAKYDKRLFGQFAEHLGTGIYGGLYVGTDSKIPNVKGFRRDVIDALKAIKVPVIRWPGGCFADEYHWREGIGPKSKRPVKVNTNWGGVTEDNAVGTNEFMDFTEVVGAEPYVSGNVGTAPPSEMAEWVEYMTSPTSSTIANQRRANGRDKPWKLTMFGIGNELWGCGGDMHPEYAADETRRYATFLKVPEGQKLMKIASGANSADYNWTDVMMRKAGDKIDGIGVHYYTVPGPWSKKGAATGFDEESWARTLSKTLKMEELLTEHGKIMDKYDPKKRVALLVDEWGTWYDVEPGTNPGFLYQQNSLRDAMVAALNFNIFAAHADRVRGANIAQMVNVLQAMLLTDGAKMVKTPTYWVFDLYKDYMDGTVLPVDVQSRWYNKDQWTMRAVSASAVRGTDGVVHVGLVNVDPNQPASVSVKLDGVAGTQVAGRILTGAAMDAHNDFKAPDVVKPAAFTGASLSAGTLTVQVPAKAIVMLDI

SEQ ID NO: 17879 - protein, 720 aa, SPHINGOMONAS
APAQAQTAQPLTLQRIFASPSLDGPAPRAVQLSPDGKYLTLLRNRDEDRERYDLWAMDTANGQWRMLVDSKKLGSGAELSEAEKMQRERARIGGTKGIISYDWAPDGRSILVPLDGELFRARLTGEIDKLPAAAGPKLNAAISPAGKFASYVQDQNLVVMDLASGKATRVTSDGAGTVHWGEAEFVAQEEMARSDGYWWAPNDAYVAVERFDEAPVGIVTRAAIGAEGTSIVQQRYPKAGTPNALVELYVLEPTGQKRVKVDLGPDRDIYLARVDWSADGKTLYVQRQNRAQTQLDLLAVDPATGTARVLFSEKAAAKSWINLSYGLKPLDDGSLLWWSERDGHGHLYRWQAGSFTQLTRGAWEVAPDGISVDQKRGRLYFQGNKDDPLERHLYWIDYRKPGTITRLTERGWWNTASMDASGTRAIVSRSNVNQPRQVYLADADGKRIAWVQENAVSDPKHPYNAHVSAHRERTFGTIKGPDGTELHWEMITPKLEPGKRYPVFFQHYGGPHVQTVSRAWGGALQQYLVQHGYIWFQIDNRGSANRGVAFESAIWQAMGSVEVQDQLAGAAYLKTLPFVDPKRIAIYGWSYGGYMTLKMLEAAPGSFAAGISGAPVTKWELYDTHYTERYMGDPRQVPEAYKASSTLGDAGRIADPLLMIHGMSDDNVVLDNGTAMYAALQQQKVPFEMMLYPGQTHRVGGPGISEHLWGTILNFLDRSL

SEQ ID NO: 17880 - protein, 336 aa, SPHINGOMONAS
YRVVVAGATGNVGREMLNILAEREFPIDDLAVLASSRSTGDMVDFGETGKQYKVQNIEHFDPTGWDMALFAIGSEGSAIYAPKFAAAGCTVIDNASLYRMDPDIPLIVPEVNPEAIDGYKARNIIANPNCSTAQMVVALKPLHDAAKIKRVVVATYQSVSGAGKAGMDELFNQSRAIFVGDQVEPSKFTKQIAFNVIPHIDSFLDDGSTKEEFKMVAETKKILDPKVKVTATCVRVPVFVGHSEAINIEFENEISAEEAQNILREAPGIMLVDKRENGGYVTPIECVGEYATYVSRVREDSTVENGLSLWCVSDNLRKGAALNAVQIAELLGRRHL

SEQ ID NO: 17881 - protein, 880 aa, SPHINGOMONAS
VYRFGGGVSDGGAGDKFLLGGKGANLAEMASIGLPVPPGFTISTAMCTRYYEEGETFPESVKAEVANGIAHIEGITGKKFGDAADPLLVSVRSGARVSMPGMMDTVLNLGLNDRTVEGLAATSGDDRFAWDSYRRFIQMYADVVLGLDHGRFEEALEIAKEDRGFTLDTELSAGDLQALVAEYKAIVEELWNKPFPQDVHDQLWGAIGAVFGSWQSERAKVYRRLNDIPADWGTAVNVQAMVFGNMGDTSATGVAFTRDPSTGERAYYGEFLINAQGEDVVAGIRTPQYLTKRAREAAGAKPASMEEAMPEVYGELAAVFDRLETHYRDMQDIEFTVERAKLWMLQTRSGKRTAKAALKIAVDMANEGLVTREEAILRVDPAALDQLLHPTLDPKAPRDVLTKGLPASPGAASGYAVFDSDTAEKRANAGDSVILIRVETSPEDIHGMHAARGILTARGGMTSHAAVVARGMGRPCVSGAGSLSINARDKVMRVGTREVREGDMVTIDGATGEVMAGQVPTVQPELSGDFGTLMTWADEVRRLKVRANAETPLDCRTAREFGAEGVGLCRTEHMFFEQSRITAVRQMILAEDETGRRAALEKLLPEQRSDFLEIFEVMAGLPVTIRLLDPPLHEFLPHEEAEFAEVATAAGVDVDTLKRRAGELHEFNPMLGHRGCRLGVTYPEIYEMQARAIFEAAIAVAEKSGAAPVPEVMIPLVGTRRELELMKAVVDKAAQAVFAEKGRTIDYLVGTMIELPRAALMAGEIAEVGAFFSFGTNDLTQTTLGVSRDDASRFLTTYVEKGIYAKDPFVSLDVEGVGQLIALAAERGRATRPDIKLGICGEHGGDPASIAFCEQTGLDYVSASPYRVPIARLAAAQAAI

SEQ ID NO: 17882 - protein, 263 aa, SPHINGOMONAS
ILFQTGRGDVFEKYLESFAHWHARGWTVSAFDWRGQGGSGRLTPRGDCGHIGDFAAYIGDLRAFVDAWKAETPGPHVVMGHSMGGHLVLRGLVDRAIAPDAAVLIAPMLGVRSALGRMAPTMARLLAGLGDKRRPAWKGNEKPYTTETRANLLTHDPDRYADELWWQAQDPALLTGAPSWQWLVEAFRSMAELEAGPIEAVRTPLLLLVADADGLVDPRAALRIAPRLPDAELLRFGPESAHEILREADPVRSRALGAIDGFL

SEQ ID NO: 17883 - protein, 755 aa, SPHINGOMONAS
  unsure (1)..(755): unsure at all Xaa locations
RTLYEKIWADHVVERRDDGTCLIYIDRHLVHEVTSPQAFAGLRAADRKVRRPDLTLAVPDHNLPTTPRVDAAGNALPIADSASAGQLSALRGNVAEFGVPYIDALDARQGIVHVVGPEQGFTLPGTTLVCGDSHTSAHGALGALAFGIGTSEVEHVLATQTLLLKQSKTMEVRVDGTLGHGVSAKDVVLAIIGKIGAAGGTGYVIEFTGEVIRNLSIEGRLTISNMSIEGGARSGLIAPDEKTFAYLKGRPLAPTGEAWDRAVAYWKTLPTDRHAVYDKVVTLDAADIAPSLTWGTSPEDVVPITGVVPDPQSFDDPSKRAAAQRSLDYMGLTPGTAMQDIPVEHIFIGSCTNSRIEDLRAAAAVVQGRKVADRIPQALIVPGSGLVKRQAEEEGLDRIFLEAGFQWREPGCSMCLAMNPDKVPAGERCASTSNRNFEGRQGAGSRTHLVSPAMAAAAAVTGHLTDVRALMADQAXXXRGETPXKRRSSHXLPERSXAVSPRPMRVPIRGRRRRSRPSRRSSGPSSHRADAGGRLPEIGDGRRPFVRKAVSMYLNTVSAERRXWSRSSRFRARAYPWGAKNIDTDIIIPAHWLKTTTREGLGKGAFESVRAEPGNLFDDPRYAGAPILVAGENFGCGSSREHAAWALADMGIQAVIAPSFSDIFSGNAFKNGIVTVVLPQEAIDRLVQVATANEITVDLETMTVTTDFQDRFAFELDPFRRDCLMQGLDEIGMTLAQDTAISKFESAVAHERPWI

SEQ ID NO: 17884 - protein, 458 aa, SPHINGOMONAS
MAIELKMPALSPTMEEGTLAKWLVKEGDVVKSGDILAEIETDKATMEFEAVDEGTIAQILVAEGTDNVKVGTVIAMIAGEGEDASTAAAAPAPASEPAPAPTEKAPETGTAQLTAAVEKTRPADPAVPAGTEMVKTTVREALRDAMAEEMRADPRIFVMGEEVAEYQGAYKVTQGLLDEFGPKRVIDTPITEYGFAGVGTGAAMGGLKPIIEFMTFNFAMQAIDHIINSAAKTNYMSGGQMRCPIVFRGPNGAASRVGAQHSQNYGPWYASVPGLIVIAPYDAADAKGLMKAAIRSEDPVVFLENELMYGRSFDVPKLDDYVLPIGKARIMREGKDVTLVSYSIGVGVSLEAAEKLAAEGIDAEVIDLRTLRPLDKQTVLESLKKTNRIVVVEEGWPVCSIASEVAAFVMEEGFDDLDAPVLRVTNEDVPLPYAANLEKLALVNADKVVAVVKKVTYR

SEQ ID NO: 17885 - protein, 342 aa, SPHINGOMONAS
KAPTPPAIPNRERPAEPERFKASKEQLLEFYRQMLLIRRFEEKAGQLYGLGFIGGFCHLYIGQEAVAVGLQSALDGEKDSVITGYRDHGHMLAYGIDPKVIMAELTGRGAGISRGKGGSMHMFSTEKKFYGGHGIVGAQVSLGTGLAFAHKYNEDGGVAMAYFGDGAANQGQVYESFNMAELWKLPIIYVIENNQYAMGTSVNRSSAEDQLYKRGESFRIPGIQVDGMDVLACRGAAEEALAWVRAGKGPVILEMKTYRYRGHSMSDPAKYRSREEVQSVRDKSDPIEAVKRELETMGVTEEQLKPLEAEIRKIVNESADFAEQTPEPDPAELYTDVLVETY

SEQ ID NO: 17886 - protein, 426 aa, SPHINGOMONAS
VTAIIDVHARQILDSRGNPTVEVDVLLDDGSFGRAAVPSGASTGAHEAVEKRDGDKSRWLGKGVEGAVDAVNGEIAEAVVGLDAEDQADLDRTMIELDGTANKGRLGANAILGVSLAAAKAAADARGLPLYRYVGGVNAHVLPVPMMNIINGGEHADNPIDFQEFMIVPVGAENIVEAVRCGSEIFHTLKKKLHEKGLATGVGDEGGFAPNIASTTEALDFIMASIEAAGYKPGDDVMLALDCAATEYFKDGAYEMVGEGKTLSSIQNAEFLAKLAADYPIFSIEDGMAEDDFEGWKALTDLIGGKVQLVGDDLFVTNPERLAMGIEKGLANSLLVKVNQIGTLTETLEAVSLAQRSSYTAVMSHRSGETEDATIADLAVATNCGQIKTGSLARSDRLAKYNQLIRIEEELGDAAVYAGRSVLRRA

SEQ ID NO: 17887 - protein, 532 aa, SPHINGOMONAS
RQSRHGLGEQGIVTSATLHWNLITAPLVEHAIRRGEGSLAAEGPLVVATGKHTGRSAKDKFIIRDAETETSVWWGKTNQAMTPAHFAALKADFLAELATRDELFVADLYGGSQAEHRVQVRVINELAWHNLFIRTLLVRPAADALADFVPDYTIIDLPSFRADPARHGTRGETVIAVNFSEKLILIGGTAYAGEMKKSVFGLLNYLLPEQGIMPMHCSANIGPKGDTAIFFGLSGTGKTTLSADASRTLIGDDEHGWSDTAVFNFEGGCYAKMIRLSAEAEPEIFATTKRFGTVLENVVMDPATRTLDLDDASLAENSRGSYPIDFIPNASADNLGPVPKNMIFLTADAYGVLPPIARLTPEQAMYHFLSGYTARVAGTEIGVTEPEATFSTCFGAPFMPRHPSVYGNLLKKRIAEGNVACWLVNTGWTGGKYGIGHRMPIKATRALLNAALDGSLNQAEFRRDPTFGFEVPVAVPGVDSAILDPRETWPDKADYDATAEKLVDQFVENFTQFEDHVEAGVRAAAPRARALA

SEQ ID NO: 17888 - protein, 390 aa, SPHINGOMONAS
MTDVVITAAKRTPVGSFLGAFAATPAHELGRVAIEAALAEAGVKGEEVSEVILGQVLTAAQGQNPARQASMNAGVPKEVPAWSVQQVCGSGLRAVALGFQSIRNGDATIIVAGGQESMSMSPHAQSLRPGTKMGDLSLVDTMIKDGLTDVFNGYHMGITAENLAEQYQVTRAEQDSFAVRSQNLAEKARADGRFKDEIAPVTIKTRKGETIVADDEYIRAGATVDGVSGLKPAFKKDGTVTAANASGLNDGAAALVLMSREEAEKRGAPILATIKSWASTGVDPSIMGIGPVTASRKALEKAGWSVADLDLIEANEAFAAQALSVGKELGWDADKVNVNGGAIAIGHPIGASGARILTTLVHEMNKRDAKKGLATLCIGGGMGIALCIER

SEQ ID NO: 17889 - protein, 781 aa, SPHINGOMONAS
  unsure (1)..(781): unsure at all Xaa locations
PPRAAPGKRAPRPAPRXHSRARAAPRRRMPPARHRWRPRGSGRSPCENRPKLVPEVTTWVKLPEMPPVAVIRSSTVPGVTLPVCTICNVAPLAIETCPFTASRSDAVGVSSNSAVDVPASATLPFTVIVPGDAPGLSVPATATLPLTVPAEPKVAPAATVMVGAVIVEPARPTKRPPASCTSAKVAVPASVAKPPFIRRVSMLTTSPSAIPAPVAVPAISSRSVPAPPSMRGLVAPSRSTTRSSPAPSDRAPMAPALSTRSVPASSRVAPVIVPVLVSVNASFPDATIAAAPGPVAVMRPALVMVSVVSVASRATALVPVAEIVPPAWLVSVPLVAPRGLAIRTPRAATSGAVALPLAAMLPLFCSAXVIGRSPAVRRRSTPTARSPSATIVPLLASDTVPTVAVPAPMSAVNARAVPVPAVARSVPLLVIVAAPAASRAVNEAVAXSPPSIVPLFAAVSMSXAPSTAMPLFASPAAMRPVLVKDKGAXLXTLTAGPVSPAPPIVPLFVIAAVMPXTDPPIVPALVKPASGTASPSANRVLRISDTDPAIVARLITAPSPITRRSAXRLSSPVRVTVVVLPIAATAAAVNPLVGAAPIATEPLVVRARPKVPSLTVMRPLTPVLSPACSNVPPLPSARLPASVPPLAKXMPLYPSDTSPWITPALLMRPPSSRMAPWPNRPPLDVIVPVLTTTPPXKLVMAGPLVWMVPLLTTRKALTIPLDSRVPVWMIVPLLVTVPTPEVPXLPSSSMRPLLISASPPTTAALXLSPPLVAVXSARIVP

SEQ ID NO: 17890 - protein, 1082 aa, SPHINGOMONAS
  unsure (1)..(1082): unsure at all Xaa locations
PXGGFMKGYVRSDTHVSLLAKAGRLGGVVLAAALGTALFAPGAAQAQSLGCQSVNDGSINFTARFVAGDPRQSETTSRTATSTAALSVIAAAAGYSDNISTNMVPGINPFTPGDRLDFTAVVSQYSGSAGMRIRFRVNNSYVGLPAGARVTPDPTGTGTFTGYYNVPSGLQGVGMTVDHLGSTSNSLTDVTVTCTPYIDSNLSLGVTMTHSGTPQQGGTVDYTITPSASGANTGTNVTLTFSLPSGLSYNSGSGSGWSCTSTRCLYTNTIANGASGNPLTLRLNIASNAATSLTPSVTLSGGNAGSSASASDPTSIAVVQIPASVAIATGANQTASTNTVFATPLSVTVRDGSNAVIPNTSGHPSPHRHPAPAAPSRTAATASPVTTDGSGIANAGSFTANGSGGAYSVNATAGSYSPPSAXPTISSRCPASPVSRRPRVPTGGGTTVVITGTGLAGATGVSFGGTAAAGFTVDSATQITATSPAASAGTVNVTVTTPSGTSSTGASNQFTYAVPPTTPTLTSTPATLTNSTSATFQFSLASGTGECSIDGGAFTSCTSPRTYTGLSDGSHSFQVRATSGGGTSAAASYSWTVDTTAPSAPIVTTPANASERVVTNRATSGTSEANATITVYLDGSADGTTTADGSGNWTYTLTALSAAAHTIKARATDAAGNTSVDSSTRSFTAYSELAVTQVSTSITATMNTTSFSATRPVTASGGKAPLAYAISGGTLPTGVTFDTSNGGLNGTPTSVLAATDFTITVTDSIGQASSKIVRLAVNSDRGQIVAFTSTAPGSARVGGTTYTVTAGSSSGLTVALTIDSASSGVCSISGSTVSFLGVGTCTINANQAGNGSYDPAPQVQQSFAVAQGTQSISFTSTAPSAAVAGGASYTPAATATSGLAVAFTIDPSSSAVCAISGGAVSFTGVGSCRVNANQAGNTDYTAAAQVQQSFAVGIGTQTIGFTSTAPSAAAVGGATYTPAATATSGLAVAFTVDTSSGSVCTISGGAVSFTGVGTCTINANQAGNTDYTAAPQVQQSFAVGRGSQTIIFSALPDVAITASPVTLNATAGSGLPVSFTSSTGTI

SEQ ID NO: 17891 - protein, 498 aa, SPHINGOMONAS
RVGRLSLPYRASLALMLVGNLLAASAGLALPHLLGEAVDQLSRPGQGPASLVRLAMLLAAAVAARGLFQMLASFSGERVGQLVARDLRLAYFDALQRLGHGFHDAIDPGDLITRGMLDIEGVRGFIEMGVQRLLQITLLTTAGAVVLVAADPVMAVATLACVPLIAWRAGRMGLQLRIAWTRLQREMAVLTRVMEENLHGSRVVRAFSATAHELSRFDAASGRALALSDDRIRVRARAMASINASFYAAMLAVLGVGAWRIEAGMLTLGELTLCLAFMTVLQLPVRQMSMVMNSAARAVSSGQRVFDILDRSPVVDDTEATQQLPAQDWALVFDRVRFRHAADGPWVLDDISFTLSPGRTLGIVGASGSGKSTIAALAARLYDPDAGRVTLGGIDLRDASLSAVRGTVHVVQQDLFLFDDAARRNIDYARPDIGQAAVRDAAAVAQLDDHVARLPEGYDTRVGERGSALSGGQRQRMTIARGLIADPRILILDDAASA

SEQ ID NO: 17892 - protein, 375 aa, SPHINGOMONAS
IATAVALARWLRQDSIARDRERPVPYTETERLARSGLLAITVPAAHGGADVPWSTVVEVIRILSTGDGAIGQLPQNHFLFVEAVREDGDGAQQALFFGELLRGARFGNAQAERGSSSAVDLRTRLVAEGDGFRLSGTKYYCTGAIVADWIPVAAIDAEGRQVLAYVKRNAPGVEVRPDWNAFGQKTTFSGTAVFDQVQVPAIQVLSHWRLFERTNAFHPYGVLLHAAVDVGIARAAFDDTVALVKARTRPRLGAQAASSREDVLIQAKLGALSTELAALEALLAHAAEALDRARFSGEDRFVAEAATLAFGTKALAEEVGLAIASALFPLVGTASTDASLGLDRHWRNLRVHSVHDANDWRYVQVGDWVVHGRAP

SEQ ID NO: 17893 - protein, 208 aa, SPHINGOMONAS
MSLKILDTFPDFTQESTQGPLNFYDWAGDSWVVLFSHPKDFTPVCTTELGAVAKLKPEFDKRNVKAIGLSVDAVAQHLAWAGDIERTQGTTLNFPLIADVDRRVATLLDLIHPNASDTNTVRSVFVVDPAKRVRLTLTYPASTGRNFDELLRTIDSLQLTDAHKVATPADWRQGDDVIILPSLGADEAKAVFPAGWTEHTPYLRTVPQ

SEQ ID NO: 17894 - protein, 645 aa, SPHINGOMONAS
GFDIAGMDRSVKPGDDWYRFVNGSWMDRTKIPDDRSSFGAFAVLRDLSEMRLRTLIEGYQPTDTAHPDRRKAAILYRGFLDEAAIERLDAKPLLQRLQPLKAAKTKAELARLMGASIGGFGASFFGVGVSDDAKQPDVYALYLRQSGLGLGDRDLYLDAKFAPQVARYRQYVAQLLGMAGWPDAAAAADKVVAMETRIAQAHWTRAQSRDRDKTYNPVTVAALKAQAPGFAWDPFWQAAGLTKASRVIVAQNSAVPKIAQVFADTDLATLKAWEAFRIADDISPMLSKRFADAQFDFRSKFMNGQPKERERWKRAVSFTERAIGEGVGRDYVALYFPPESKAKMDVLVGNLRVALAGRIKNLAWMSPATKEQALAKLQGFTVKVGYPTKWRDYSKLDVRPGDLVGNAERAGRFEWDYRRNRLGGPVDKAEWGMTPQTVNAYYNSVKNEIVFPAAILQPPFFDPKADDAVNYGGIGGVIGHEISHGFDDQGRKSDGNGVLRDWWTPEDATKFEAQAVRLGAQYEAYSFEGLPGLHINGRASMGENIGDLGGVLIALDAYHASLGGKPAPVLDGFTGDQRFFLGWGQVWRTLFRNEALRQQLVSDPHSPGQIRAVNPLRNVDAWYAAWNIDPSQKQYVAPEDRVRIW

SEQ ID NO: 17895 - protein, 450 aa, SPHINGOMONAS
MLFKDLGLSETVLAALSAKGYNEATPIQAQSIPALLEGRDLLGIAQTGTGKTAAFMLPSIDRLVASGKRAQPRGCRMLVLAPTRELAAQIADNAKHYASGTGLRIATVFGGTSVHKNKTDLARGVDILVATPGRLVDLLDQCYMILLGIEILVLDEADQMLDLGFIHALRRIVKELPAKRQSLFFSATMPKTIRELASQFIHNPVEVKVTPVATTAERVEQFVTYVNQTEKQALLTMQLRNLEIDRALIFTRTKHGADRVVRLLAGNGIAANAIHGNKSQPQRERALGEFRSGKVKLMVATDIAARGIDVSGVSHVFNFELPNVPEQYVHRIGRTARAGADGIAISYCADDERPYLKDIERLTRQKLTVQPLPENFMAEADKIKSTRSPMPASRDEQNGRNGRAMQHAQGRRGDGQPARGGRGGPRSDAPRGGEQRRAEGGPRSDQPRRQ

SEQ ID NO: 17896 - protein, 173 aa, SPHINGOMONAS
  unsure (1)..(173): unsure at all Xaa locations
RYATALFELARDAKAIEAVEASLATVRAALDESPEFKALTTSPLIGRKDAGKAVAAAAGAMALDATTTKFLGVLAENRRLAQLPAIIRTFRALATSHRGETTAEVTSAHPLDAEQVDALKQQLRTRIGREVSVDLSVDPSLLGGLVVKIGSQMIDSSIKTRLNSLAHAMKGXG

SEQ ID NO: 17897 - protein, 503 aa, SPHINGOMONAS
AEISKVIKDQIANFGTDAQVSEIGQVLSVGDGIARIHGLDNVQAGEMVEFANGVQGMALNLEADNVGVVIFGSDAQIKEGDTVKRTGTIVDVPVGKGLLGRVVDGLGNPIDGKGPIEYTERRRVEVKAPGIIPRKSVHEPVQTGLKAIDALVPIGRGQRELIIGDRQTGKTAVAIDTFINQKGPNASDDDQKKLFCIYVAIGQKRSTVAQIVRQLEENGAMEYSIVVAATASEPAPLQFLAPYTGCAMGEYFRDNGMHAVIVYDDLSKQAVAYRQMSLLLRRPPGREAYPGDVFYLHSRLLERAAKMNDANGSGSLTALPIIETQAGDVSAYIPTNVISITDGQIFLETNLFYQGIRPAINVGLSVSRVGSSAQTKAMKKVSGSIKLELAQYREMAAFAQFGSDLDASTQKLLNRGARLTELLKQPQFSPLPFEEQTISIFAGTNGYLDAVAVKDVVRFEAAMLAHFRSQHAAVLDEIRTTKAFENGTRDKVKAVLDAFAKTF

SEQ ID NO: 17898 - protein, 291 aa, SPHINGOMONAS
MANLKELKGRIASVKSTQKITKAKQMVAAAKLRKAQAAAEAARPYAQRLEGVVASLASKVGASDSAPRLLAGTGKADTHLLLVANGDKGLSGAFNANIVKAAILKARALIAEGKTVKFYLVGRKGRAVIARTFPGMIVAQFDTTAVRTPGFDEARAIAKDVTDRFFAGEFDVATLFYSHFRSALAQVPTEQQLIPVSVPATTEASSGAAVEYEPDEETILADLLPRNLTVQLFKALLENQASEQGASMTAMDNATRNAGDLINRLTIQYNRSRQAAITTELVEIISGAEAL

SEQ ID NO: 17899 - protein, 472 aa, SPHINGOMONAS
GRISQVIGAVVDVTFENNLPAILSALVTENNGQRLVLEVAQHLGENTVRTIAMDATEGLTRGQTVTDTGNQIQVPVGPATLGRILNVVGEPIDERGPVGTDLRAPIHAEAPLFVDQSTDSAILVTGIKVIDLLAPYAKGGKIGLFGGAGVGKTVLIQELINNIAKGHGGTSVFAGVGERTREGNDLYHEFLDAGVIAKDADGNAISEGSKVALVYGQMNEPPGARARVALSGLTIAEYFRDVEGQDVLFFVDNIFRFTQAGAEVSALLGRIPSAVGYQPTLSTDMGALQERITSTNKGSITSVQAVYVPADDLTDPAPATSFAHLDATTVLNRAISELGIYPAVDPLDSTSRVLEPRVVGQEHYETARAVQAILQKYKSLQDIIAILGMDELSEEDKLTVARARKIQRFLSQPFHVAEVFTGIPGAFVQLEDTVRSFKAVVDGEYDHLPEAAFYMVGGIDDAIAKAKKLADE

SEQ ID NO: 17900 - protein, 234 aa, SPHINGOMONAS
VLVTGGARRIGAAISRGLAARGWAVAVHHHHSPDEAEAFVAALRKNGASAAVVCAELADPAAPQALVDACRAAFGAPLDAVVNNASLFAYDEAPIADHALLDRHMHVNLAAPVGLAMALAAQADLEAGAVVNLLDQKVGNLNPDFFSYTCSKLALEGATHMLAQKLAPRVRVNAVSPGLTLPSLDQTEEEFARTGTQNLLRRTVDPADIAATVAHLLESRSITGQNVFVDCGQH

SEQ ID NO: 17901 - protein, 181 aa, SPHINGOMONAS
ENVAEAIRTLLRWAGDDPGREGLLDTPQRVARAWKEYCAGYAEDPGHHLSRVFEEVGGYDEIVLLKDIPFQSHCEHHMAPITGKASIAYLPRNHVVGISKLARVLHAFARRLQVQERLTAEVADCIWNHLHPQGVAVVIEAQHGCMTGRGVRTPGVGMVTSRMMGVFREDERSRAEVLKLM

SEQ ID NO: 17902 - protein, 297 aa, SPHINGOMONAS
RHLTGISGLQPHEIMFLLDEAEQWVEANRSRAKSDKRLEGLTQINAFFENSTRTLLSFEIAGKRLGADVVNMHAAQSSVKKGETLIDTAVTLNAMRADVIVIRHASSGAVRLIADKVDCPVLNAGDGWHEHPTQALLDALTIRRRRGSVAGQRVVICGDILHSRVARSNILALTALAAEVRVVAPSTLMPPAMDRMFVTPFTDFDAALEDADVVMMLRVQNERMDGGYIPSTREFHMRYGLTPERLARAKPDALVMHPGPMNRGVEIDSIVADHPERSAITEQVEMGVAVRMACLDV

SEQ ID NO: 17903 - protein, 407 aa, SPHINGOMONAS
  unsure (1)..(407): unsure at all Xaa locations
FPKGFLWGAATAGHQIEGNNLNSDIWLLEQVKPSVFSEPSGDACNSLELWPIDLDLVKSLGLNCYRFSLEWARIEPEPGQFSIAMLNHYKAIVDGCRARGLAPLVTYCHYAAPRWFAARGGWLNPEAPQLFARFCDRATRHLGAGIHTAMTLNEPNIVPMLQVVLPPQAQTIIALTLDGAAKALGVPELAVANTAKQADVPRLTAALLAAHKAGKAAIKAARPDLPVGLTLAMFDDEAVGAPAMRDRMRQQLYGTWLEAARDDDFIGVQNYEKVRWGPEGRLPPPAGAVRNDNGGEVYGPSLANACRYAHAVARVPVLVSEHGVATSDDRIRAKLIPGALVELHKAMVEGLPVLGYVHWSLLDNYEWVAGYKSHLGLFAVDRTTFARTAKPSAGVLGAIARANGLXK

SEQ ID NO: 17904 - protein, 564 aa, SPHINGOMONAS
ALIGLVLAIGGAWLAVLGGSLYYLVTGVAMVGAGVLLVRGRTLGGWLYLAIVVLTFLWAWWEVGANAWAQVPRIIALVVLLVAVLAAMATMRVRRERWRFALAGVLAAVAITGVDLAVAANGQPDWVQAALPAPGTQGMADPSGQQTGADWPSYGGTGSARRCSPLAQMNASNVGSLKRAWLIHTGDMPSSPRIAGAPSGVIQGFDARTGKLRWAWDMMHPEWNGYPPAGQEWARGTPNMWTMASGDEQLGLVYLPMGNAAADYYSSLRRPEENQFATSLVALDVTTGKPRWRFQAVRKDVWDYDFGAQATLVEYKGVPAMVLPSKQGDIYILDRRTGRPLIPVGEIKAPQIGVEPQQRAATQPVSLWHTLRQPDLTERDMWGMSPIDQIVCRIQFRRASYKGFFTPPEADRHSIEYPGYNGGTDWGGIAVDPQRGVIVANYNDMLNYVRLVPRAEANQRGWQPRDQARGKIGGAEGAGDPQAHTPYAIDVNAGWQLPFTGMLCKQPPYGGIRAIDMATSKTIWDRPLGEARTNGPFGIPSMLPIPIGTPNNGGSVVTVGVLIF

SEQ ID NO: 17905 - protein, 257 aa, SPHINGOMONAS
MSTALITGASSGIGAVYARRLAARGHDLVLVARNAERLEALANELRAANGVAVEILLADLTKAEDLAAVGDRLRSGAPIDLLVNNAGAALLGGVETADPAKMAELISLNVTAPTMLAAAAVGGMVARGSGAIVNIGSVVSLMPEYFPGIYAATKSYLLTLSQGLAAEVGPKGVYVQAVLPAATRTEIWERAGADLAQIPNVMDVEELVDAALSGFDQREAVTIPPLGDVALWTALETARATLPSGLGAVAAARYAPK

SEQ ID NO: 17906 - protein, 469 aa, SPHINGOMONAS
IPLYQWIDGQKLSGDGRATSDILNPFDGSVLGAMPHATAADLQAALESSQRAFQQWRKVPAWERSEIILNATALIKERIEQFAMMLTLEVGKPLAEAQMEMNLTVQSMVWAGEEAKRIYGRTVESRLPNGRAIIAREPVGPVAAFAPWNVPALLTGRKIAAALAAGCSMIIKPSEETPATCLMIAEAFADAGLPAGVLNVVLGDPAMISTTLISSPIIRKVSFTGPEPVGKQLAALAAQNVTPVTMELGGHAPVIVCDDADIDTVVAFSVPNKYFAAGASCIGPTRFYVQDSVYDAFVEKFTAAAGAIKVGSGLDPETNMGPLANERRLHAMERLIGDAVANGGKITTGGKRIGDAGYLWEPTVLVDVPETAKIMNDEPFGPVAIISRFSTVEEAIEKANRLPYGLASYAFTASLSRANQLADSLESGMVGINTYYFGMPEAPFGGVKQSGYGSENGTEGIDAYLVTKF

SEQ ID NO: 17907 - protein, 542 aa, SPHINGOMONAS
MAAKDVKFSRDARERILRGVDILADAVKVTLGPKGRNVVIEKELRRAPHHQGRCVGRQGNRAQGQVREHGRAMVREVASKTNDAAGDGTTTATVLAQAIVREGMKSVAAGMNPMDLKRGIDLAVTKVVEDVKARSKPVSGSQEVAQVGIISANGDREVGEKIAEAMEKVGKEGVITVEEAKGLEFELDVVEGMQFDRGYLSPYFITNPEKMAVELADPYILIHEKKLSNLQSMLPILEAVVQSGRPLLIIAEDIEGEALATLVVNKLRGGLKVAAVKAPGFGDRRKAMLEDIAVLTKGEVISEDLGIKLETVTLGMLGTAKRVTIDKDNTTIVDGAGEAESIKARTEQIRQQIDVTTSDYDREKLQERLAKLAGGVAVIKVGGATEVEVKERKDRVDDALHATRAAVEEGIVPGGGTALLYATKALEGLTGANEDQTRGIDIVRKSLTALVRQIASNAGQDGAVVSGKLLDQNDTSFGFNAATDTYENLVAAGVIDPTKVVRTALQNAASVAGLLITTEATIAELPDDKPAAPAMPGGMGGM

SEQ ID NO: 17908 - protein, 95 aa, SPHINGOMONAS
MNFRPLHDRVLVRRVEAEEKTAGGIIIPDTAKEKPQEGEVVAVGTGTKAEDGKVTPLDVKSGDRILFGKWSGTEVKVNGEDLLIMKESDILGIVG

SEQ ID NO: 17909 - protein, 254 aa, SPHINGOMONAS
TGLMQGKRGLIMGLANDKSLAWGIAKALHAQGAEMAFSYQGDALLKRVKPLAEQVGSDFLIDCDVSDMAALDTTFETLAARWPTIDFVVHAIGFSDKSQLRGHYYDTTLENFLMTMNISVYSFTAVAQRAQKMMPNGGSLLTLSYYGAEKVVPHYNVMGVAKSALETSVKYLAMDLGPENIRVNAISAGPIQTLAARGIGDFNYILKWNQLNSPLRRNVTIEDVGGAGLYLLSDLASGVTGETHHVDAGYNVIG

SEQ ID NO: 17910 - protein, 288 aa, SPHINGOMONAS
VADPYVTLGVARSASEDEIKKAYRKLAKELHPDRNKDNPKASEKFSQVTQAYDLLTDKDKRARFDRGEIDGDGNPIAPFGFGSGGGGGGFQPGGGHFDFSGNDADIRRPVRGIVRRRQARRRWRLQRRVRRLWRVRASRPAQGRQTAYRLAVSFEDAAKLAPQRITLRDGKTIDLKLPAGLEDGTQMRLAGKGEEGPGGAGDAIVTLEIQPHRFYTRDGDDIRLDLPVTLAEAVLGAQVRVPTPDGPVMLTVPKGSSSGKVLRLKARGFHKKGGGRGDLFVTLMVELP

SEQ ID NO: 17911 - protein, 354 aa, SPHINGOMONAS
MSFNSFGRVFRFTTWGESHGPALGAVVDGCPPGLSLSEGDIQPFLDRRRPGQSRFTTQRQEPDQVRILSGVFEGRTTGTPIALHIDNVDQRSKDYSEVAKAYRPGHADYAYDQKYGFRDYRGGGRSSARETAARVAAGAVARAVIPEVTITAWVEAIGGDAIDYTKFNAAEIGNNPFFCPDADAAQRWEALVDAARKDGSSLGAVVACEATGVPAGWGAPLYAKLDSELAAACMSINAVKGFEIGDGFAAATLRGEENADAMRPRGDGGVDFLANHAGGIAGGIATGQPVRMRVAFKPTSSILIPVETVTRDGEASEIRTKGRHDPCVGIRGVPVVEAMVALVLADQKLLHRAQ

SEQ ID NO: 17912 - protein, 295 aa, SPHINGOMONAS
RAMFSGSIPALVTPFRSGAFAEEDFRALVEWQIGEGSAALVPCGTTGEAATMPKDEHFHIVRVCADQAKGRVKILAGAGSNDTKVAIDNVHAAKDAGADAALMVPPYYNRPSQEGIFRHFAAVAEATDLPIVLYNVPGRTVTDIQPATMARIVQAFPETFVGVKDATGNLSRVSEQRAGCGTGFVQLSGNDETALAFNAMGGVGCVSVTANVAPKLCADFQAAWAAGDTAKALALHDRLYPLHIAMFTDASPGPVKYAMGRVRPGFPQELRLPMTEAGEASRKAVDAALEFAGLL

SEQ ID NO: 17913 - protein, 87 aa, SPHINGOMONAS
MAQQRILVSGRVQGVGYRDWVVRTAQRGGLTGWVRNLRDGRVEVLAAGEDTALALFVEACREGPPLSRVEHVESEAVPEDKAHKGFT

SEQ ID NO: 17914 - protein, 194 aa, SPHINGOMONAS
ERADNESGHEMVPEEVQEAVRTLLRWVGEDPEREGLVDTPKRHAKAWREYCAGYEEDPGMHLARTFEEVAGYDEIVLLKDIPFQSHCEHHLAPITGKASIAYLPKDRVVGISKLARVLHGYARRLQIQERLTAEIAQSIWEHLKPAGVAVVIEAQHGCMTGRGVKTHGVNMVTSRMLGCFLEDRSSRAELMSLM

SEQ ID NO: 17915 - protein, 694 aa, SPHINGOMONAS
FWYVDTDHGVPTILLVDAVKRTKKAAFETTALLASLNAAGLKAQDASKLTISDFVPDLAKNSAVLSVGGKRYACAMAQPYACKESAAPSAGQIAGYLAQQGPADAVLSPDGKRAAFVRDWNLWVRDMATGAERQLTTDGVKDFGYATDNAGWKHSDQAIVIWSPDSKKLATFQQDQRAVADFSITTTQVGHSKVDTWKYPFVGDKEIIQIQRVIVDVDAGQVIRLKMPAEPHRSSLCDDVVCGEGPQDMQWAKDGKTLAFVSTSRDHKVETVRIADAASGAVRDVFTETVPTWFDSGYNDEGINWRYLSERGEILWWSQRDDWGHYYLYSAATGKLVRQVTQGQWNVDHPVYIDERSGTMLVAGVGREPGNDPYYRSIYAIDLKGGAPKLLTPEKQDHIAIPSSDGRYFVDIYSTPQEPQTAVLRRADGSVVQQLAKGDATRLRAAGWQAPESIAVQCSDGKTLCHGLLFKPAGLDPQRKYPVIDYVYPGPFMGTIPSRQFAAAQGDAGALAQLGFAVVEIDALGTPRRSKAFQDYYYRDMGKQAVPDQKSGIQDLAKRYAWLDLDRVGIWGHSGGGNATATAMFLYPDFFKVGIAESGNHDNRNYEDDFYEKYLGLLESDGKKTNYDLQANQDIAKNLKGKLLLAHGMLDDNVPVSSTLLVVDALQKANKDFDLILFPRAHHGYGDQSMYMMR

SEQ ID NO: 17916 - protein, 292 aa, SPHINGOMONAS
MKGIILAGGSGTRLYPATLSISKQLLPVYDKPMIFYPLSVLMLTGIRDVLIISTPRDLPMFQALLGDGSAFGMNLSYAEQPSPNGLAEAFIIGADFVGNNPSALILGDNIYHGEKMGERCKAAAEQASQGGANVFAYHVDDPERYGVVAFDPETGVATSVEEKPAVPKSNWAITGLYFYDKDVVDIAKSIQPSARGELEITDVNRTYLERGDLHITRLGRGYAWLDTGTHDSLHDAGSFVRTLEHRTGVKIACPEEIAFENGWLGAEDLLKRAAGLGKTGYAAYLRKLVAAA

SEQ ID NO: 17917 - protein, 728 aa, SPHINGOMONAS
MTPDEMHAQLQDAFVAPEVAEREAELRESGLVALSLLLGVHNIAITSEQLRYMLGHAEAATVDDLILLAKRQQGVRAKAVDVPRGGLARQPLPAIADGPEGWFVIGGLTEHGVIIQRPGHAPEQVDREGLDALWSGTLVLLTTRAVAGQTLRFGFSWFTAQFQRYRKLFLEVLGITLALNLLGLAAPLLFQSVIDKVLVHNSMSTLSVLAFAFLAVSVWEVALGWIRTRLFTETTQKIDVELGARLFHHLLALPLGYFEKRRVGDTVTRVRQLETIREFLTNASLTVMVDPLFTIVFLGAMLFYSPMLFGVVVVSLVAYAVVSFSVAGPLCTRVEDKFEKSSASNALLVESVSGIHTIKATAVEPHWQNRWERQLAAYTASSQRLINVANTGSQAIELISKLSFAAILFFGAKAVIGGAMSVGALVAFNMFAQRVSGPVIRMAQLWQDFQQVRIAIERLGDVLNHPVEPRPASAATLPVLHGAIRFENVTFRYAEDQPPVLSDITLDIPAGSSLGIVGSSGSGKSTLAKLLQRLNAPDLGRVLVDEVDVAQLDPAWLRRQIGVVLQENLLFSRSIRENIALSNPAMPFEHVVAAATLAGAHDFILRQPRGYDTEIVERGVNLSGGQRQRLAIARALVGNPRILVFDEATSALDAESEELIQNNLRAISAGRTLVIIAHRLSAVRACDRIITLEQGRIVESGRHDELLRLGGRYADLHRRQSGYGEIAA

SEQ ID NO: 17918 - protein, 413 aa, SPHINGOMONAS
TRVRYAIIALIFLITSVNYADRATFSIAGSAAARELALSPVQTGFILSAFAWAYVLAQIPGGVLLDRFGTKRVYAAAILLWSLFTATQGFAGWIAGISVVAMLFALRFLVGLAEAPSFPGNARLVAAWFPAAERGTAAAIFNSAQYFSLVAFAPLMGWLAHQFGWRSIFWAMGGLGVLATLVFVRFIHSPAHHRRVNAAERAYIEAGGGLIHLEEGGATAAQAFAWRNVGRLIANRMMLGIYLGQYCINVLTYFFVTWFPIYLIKERGLNVLEAGFAAAAPALFGFAGGLAGGFLSDRILKRTGSLDRARKIPLVLGMLLASLIIGCVWAPGEGLVITLMSIAFFGKGIASLGWAIMADVAPRRLAGLSGGVFNMFGNIAGIVTPIAVGYIVGTTGSFDLALVFVGAHCLLTI

SEQ ID NO: 17919 - protein, 680 aa, SPHINGOMONAS
LPAANPFAKPSTLPFQAPPFDRIKSSDYAPALLAGMAEQRAEIAAITRVRSAATFENTIAALERSGRLLERATMAFYGVVGANTDDTLQKTQADLAPAFAAHADAIALNPALFARVKTLYDQRQSLGLDAEQLQVLTLTYENMVRAGAKLSPADKTALSKLNAQLSTLETAFQQKLLAAAKAGALVVDDKAKLAGLSDAEIAAAEEAAKARGLAGKYVITLHNTTQQPELATLKDRATREALFEASWTRAEKGDANDTRDTIAQIALLRAQKAKLLGFATWADYVLQDQMAKTPKTALGFMQRLGTPVAAEQRREGAELQAQIQASGGNFQLKPWDWDYYSEQVRKAKYDLNQDELKPYFEINKVLTDGVFYAANQLYGLTFTRRTDLPVYQPDVMVYEVREENGTPVGLMYFDFWKRDNKNGGAWMSNFVNQSKLLGTKPVIYNSCNFTKPAPGQPALISFDDVTTMFHEFGHALHGLFANQTYPSVSGTNVARDFAEFPSQFNEHWALDPKVLPHYAVNYKDGSVIPQALVDKIKRAGTFNSGYSFGEALAAAEMDMSWHSLAAADGKQDADAFEQKALAATGLDVTDVPPRYRSSYFLHIWGNGYSAGYYAYMWTKMLSANAFNWFEQHGGMTRANGQRFREMVLSKGHTEDYAPMFRAFNGADPQVAPLLKDLGLN

SEQ ID NO: 17920 - protein, 288 aa, SPHINGOMONAS
LLAKAETLTEALPYLQRYAGATFVVKYGGHAMGDPELARDFAEDVVLLKAVGINPIVVHGGGPQIGRMLKRLGVESTFVGGLRVTDKATAEIAEMVLAGSINKEIVAWIAAAGGRAVGISGKDAGLVRAEKVQRSEADPLQGIERHVDLGFVGEPVAVDISILQSLAASGFIPVVSPIALGADGHTYNINADTMAGAIAGACGAKRFFLLTDVPGVLSKTGDLLTDLDAARVQALKDDGTISGGMIPKVETCVNAVAAGVDAAVILDGRIPHGMLLEIFTRQGVGTLV

SEQ ID NO: 17921 - protein, 278 aa, SPHINGOMONAS
MTAEIIDGKAFAAGLRARIATLVPAFEAAAGRVPGLAVVLVGEDPASAVYVRSKGKQTREAGMASFEHKLPADTTQADLLALVDQLNADASVDGILVQLPLPRHIDEQAVLLRISPEKDVDGFHPVNAGRLATGLEGFVPCTPLGCLMLLQDRLGSLSGLDAVVIGRSNIVGKPMAALLTRASATVTVAHSRTGNLPHYLKHADIVVAAVGIPHFVKGEWLKPGATVIDVGINRTESGLVGDVDFDGAASVAGAITPVPGGVGPMTIACLLRNTLVAA

SEQ ID NO: 17922 - protein, 305 aa, SPHINGOMONAS
  unsure (1)..(305): unsure at all Xaa locations
TRFAPSPTGRLHLGHAFSALQAHDFARANGGRFTLRIEDIDGTRSRPEHVAAILADLDWLGLIWDEPPTFQSRRLHLYQEALDRLRAMGLLYPCFCTRADIAASLSAPHGPDGPLYPGTCRGLVDPDLTRPHSWRLDMAKAAALAGPLTWHDARAGTVNAAPLSHGDVILARKDAPASYHLAVTVDDGAQGISHIVRGSDLFAATHVHRLLQALLGLPTPEYRHHALLAGPDGTRLAKRHGAPTLESLRLAGEDGRALADKLRKGEVPVGFGPIEAXNSAMIFLAILFLAAVLTTLFFLIKGLVN

SEQ ID NO: 17923 - protein, 281 aa, SPHINGOMONAS
MKTVGVIGAGQMGAGIAQVSAQAGYAVLLSDVDQARADAGKAGIAKQLARAVEKEKITAADAEAALGRITPISDLAAMGPCDLVIEAATEREAIKRQIFETVGKVLGAEAILASNTSSIPITRLAQAAPDAARFMGVHFFNPVPVMGLIELIRGLATSDATVGGVEAFGQSLGKRIVHANDAPGFIVNRVLMPMLNEACFALGEGVATIPDIDAACQLGLNHPMGPFTLADFIGLDTCLEITRVLFEGTGDPKFRPAPLLVKYVEAGWYGRKTKRGFYDYT

SEQ ID NO: 17924 - protein, 492 aa, SPHINGOMONAS
SLPIHAVLPALLDALRGASNAVLVAPPGAGKTTAVAPALLGEAWCTGEILLLSPRRLAARAAAERMAALAGESVGKTFGYATRMDTKRSAATRVTVVTEGIFVNRIQADPELAGISAVLFDEVHERSLDSDFGLALALDAQGALRPDLRLVAMSATLDGSRFSGLMGAAPVVESEGRSFPLTLRHLGRATEARIEDSVAAAVRQALREEEGGILAFLPGVAEIERTAERLGDIGGAVLHRLHGSLEPAAQRAAIAPDQQGRRKIVLATSIAETSLTLDGIRVVVDSGLARRPRYDRAAGMTRLVTERASQAAVTQRAGRAARQGPGTAYRLWEEAATAGLPRFDPPEILEADLSALMLDCALWGVTDPRALAWLDPPPEAAIAEARARLGALEAIDEDGRPTDHGKAIARLPLPPRLGHMLVRASERGLARTAAEVAVLLGERGLGGNDADLELRLRRWKGERGQRAENARRLAERWSKLVPAPASGRGLGG

SEQ ID NO: 17925 - protein, 306 aa, SPHINGOMONAS
NAVILDRMQSEIPLIPELAGHLIAGGGKRMRPMLTLASARLLGYAGTRHHKLAAAVEFIHTATLLHDDVVDSSDLRRGRRTANIIWGNPASVLVGDFLFSRSFELMVEAESLKALRILSGASAIIAEGEVNQLTAVRRIDLSEDRYLDIIGAKTAALFAAACRIAGVVAERPETEEMALDAYGRNLGIAFQLVDDAIDYVSDASTMGKDAGDDFREGKMTLPVILAYARGNETERGFWKEAISGRRNSDEDFAEAIRLVQSCRAVDDTLARARHYGQRAIDALGGFRACEAKDAMVEAVEFAVARA

SEQ ID NO: 17926 - protein, 519 aa, SPHINGOMONAS
WWQKGVIYQVYPRSYADSNGDGIGDLAGVAARLDYLVDLGVDAVWLSPIFPSPMADFGYDVADYRGIDPRFGTLADFDALRDAAHARGLKLLLDFVPNHSSSEHPWFLESRASRENPKRDWYIWRDAAPDGGPPNNWQSYFGGSAWEWDAATGQYYLHQFLKEQPELNWRNPDLRAAMLEAMRFWFDRGVDGFRIDVLWLAIKHPDFPDNPANPAWREGMQDIERLLPAHSADQPEMMEIIAAMRDVTDAYPERVLIGEIYLPIPRLVAYYGARGNGVHLPFNFHLLDATWDAAALARLIAEYEGALPAGGWPNWVLGNHDKPRVASRVGPEQAAVAMMLLLTLRGTPTLYQGDELGMPNVPIPPERVQDPQALREPDTAFNRDEVRTPMPWDASAHAGFSTVEPWLPLNPDWAERNVMAQRDDAGSMLAFTRALLQLRRAHSALSVGSWHAVSSDGAVLAYERRHGADRVLVALNLSDAPQALALPDWAVTLAPVLTTPHHDLRAEGATLLLAPNQGI

SEQ ID NO: 17927 - protein, 336 aa, SPHINGOMONAS
KKAIITGISGQDGAYLAEFLLEKGYKVFATFRRTSSVNFWRIDELGITNHPNLTLVEYDLTDLASSIRLLETCQPDEVYNLAAQSFVGVSFDQPVTTAKITGIGPLNLLEAIRIVNPRIRFYQASTSEMFGKVQAIPQNEDTPFYPRSPYGVAKLFGHWTTINYRESYDIFGCSGILFNHESPLRGREFVTRKITDSVAKIKLGKMEYLELGNIDSKRDWGFAKEYVEGMWMMMQSDVPDTYVLATNRTETVRDFLRLAFKCVDMDIEFRGNGEEEYALDRGTGKMVMRINPAYYRPAEVDLLIGNPEKARTELGWEAKTTLEELCRLMVEADLRR

SEQ ID NO: 17928 - protein, 215 aa, SPHINGOMONAS
MITVSDVSKVYPTRHGSVLVLDGVNFDVKPGEKVAFLGRNGAGKSTLVRLISGAEAPTSGTIRREMTVSWPLAFGGAFQSALTGLDNMRFICRLYGLDWKERVAYVEEFSELGAYLKEPVRSYSAGMRARLAFAVSMVVEFDCFLIDEIIAVGDARFHEKCRIELFEKRADRALIIVSHDAPYIRDHCSRVGVLNKGRLTMFDDIDEGYVFYKSI

SEQ ID NO: 17929 - protein, 227 aa, SPHINGOMONAS
  unsure (1)..(227): unsure at all Xaa locations
IIVTGGSRGLGRSICERLLSKGQEVLALARSVEDVPYAALACDVSDYAQVKAVAKHLRQNNMKVSGVVNAAGIAAMNLAVTTPPDTTARVVQVNLLGTIYCCQVFAPLMMRQKGGCFINFSTIAVALGLKGEAVYAASKAGVEGFSRAFAREMADFNIRVNCIAPGPIDTALLRGITSDQIGKIVSQQILPWQFGPDAVSDVVELLLDDRSGSLSGQVFGIGGAXAL

SEQ ID NO: 17930 - protein, 636 aa, SPHINGOMONAS
NPWMKSLLIWVGILAALALFVTLFDTRTAQPTGNAIPYSTFLDKVQSGDVKETNITPGSGAIGFTTSEGKFRTNNPGDPKLVETLRAKGVVINARPEDTPSIWQYILVQSLPFLLFLGIAFFVLRQMQKNSGSGAMGFGKSRARLLTQKEGKVTFDDVAGIDEAREELQEIVEFLKDPSKFARLGGKIPKGALLVGSPGTGKTLLARAIAGEAGVPFFTISGSDFVEMFVGVGASRVRDMFEQAKKSAPCIVFIDEIDAVGRSRGAGLGNQNDEREQTLNQLLVEMDGFEANEGIIIVAATNRPDVLDPALLRPGRFDRQVQVPRPDIEGRVKILQVHMKKVPIAPDVDARVIARGTPGFSGADLANLVNEAALLAARRGKRLVAAQEFDDARDKVLMGAERRSMVMTDDEKRMTAYHEAGHALVFAHEPTADPIHKATIIPRGFALGMVQPLPERDSYSYHRDKMHADIAVAFGGRVAEELIFGYDKVSSGASNDIMQATRLARAMVTKWGLSDNLGPLDFSESEDSFTGYSVQRAKPMSDETARLIDAEVKAFVEKGLNRARQILGDHTDQLHTIAQALLEYETLTGEEIKKLIAGETLDRGDPTGTPGMPAVGGTSIPKTRKLKDPFGNPAPQ

SEQ ID NO: 17931 - protein, 573 aa, SPHINGOMONAS
LTPLPASVQMGKGSFTVTNGTGIAVPAGDTAAANAAKLLVAHVKVERGLTLGAAGTNGVIRFDRDAAVKGEEAYRLTIDAKGVRIAASSDRGLLYGAMTLAQLLSPDHGFGKAVKLPALSVEDAPRFGWRGLMLDVARHFQPIEFVYGVVDQMASVKLNTLHLHLTDDQGWRFEVKRYPKLTEVGGWRTPPSTGGAPGPKVGGFYTQEQLKGLVAYAAERGVTIVPEIDLPGHAQALVAAYPELGIFGDKPEVSHDWGVNPYLFNPGPKGIAFVKEVLDELMAVFPGTYVHLGGDEAVKDQWERSPEVQAQMKALGIKTENGLQSWMIDQFGAYLEGHGRRLIGWDEILEGGLPPSASVMSWRGEKGAVEAANAGHDVVLSPAPTLYLDSLQSDRRDEPPGRLSIQTLADVYKYEPMPVGIDAAKASHVLGAQGNAWSEYLITPYQVQHMLFPRAAAIAEITWSGKDKRDFTGFVTRLQPQIARWRRSGMEVADSAFAVDYKLQGTRGEALRANQAKVTLATQTGFGTIRYTLDGKQPTAKSPVYKAPLALKPGTTITAAAFDAAGIVTATPR

SEQ ID NO: 17932 - protein, 804 aa, SPHINGOMONAS
AARAVEGDGFPMPPPRTALPQRLPDGDPTRTRIERGWRFHEGDVAPAPLKDHDDTYGSVKAGNARGAAARDFDDSDWAEVRLPHDWASFQPFDKTANVSQGYRKRGIGWYRRRLTLDPADHGKTIELHLDGVATNATVWVNGSVVAHSWSGYASILIDMTPFARFGDEDNVIAIRVDAEAMEGWWYEGAGLYRHAWLVRRSPVSIVTDGVHCDPRKTDNGWQVPVTVTIGNIERAPVGVTIEAELLDPAGKRVAIGTTAATALVLDRVEASIELSAGAPQLWSVETPTLYTVHTRLLRDGKLIDERRTAIGFRTVRFDADKGLFVNDKPVKLKGVCIHQDHAGVGVAQYDALLGWRLERLKAMGCNAIRMSHNAPTAELLDWCDRMGFLVMDENRHFNPAPDYLAQLSWMVRRDRNHPSVILWSVFNEEPMQGTESGIEMVRRMEAAVRKLDDSRPVTSAMNGSFYNPSNVSSVVDVMGFNYYQGEYDKWHRLNPGRPSTSSEDTSAFETRGAFASDPAAHVITSYDEEPAPWGNTHRKAWQLIAAREFIAGGFVWTGFDYHGEPTPYAWPTIASFFGIMDLCGFPKTAFGIHSAAWIDDAPVVWLAPHWTWPGREGQAIKVFVASNAESVTLLLNGKAIGTQKVDRLQGNEWQVPYAPGRLEAQAMRGGKVVARMVHETAGEPVALRLTPARTVMAGDDEDVQPITIDAVDAKGRHVPTANLMTNFTVEGAAIIGVGNGDPNCHEPEKGNARSLFNGLAQILVQAGTGRGKITVKATAEGLKPALLTIDRADIAPRPQVGVTP

SEQ ID NO: 17933 - protein, 659 aa, SPHINGOMONAS
EVVVPLAHGIHARPAARLREVLVPFAARVTITKGDQSADARSPVRLMTLGIKLGDTIRITAEGGRADEAAATLAALIETGMGEKADPANAPAPAPAAAPVAAPVSNEPGLLGGVTAAPGLAIGTACFFRLPELSIDPVGKGASLERARLEDGIAKVVRAIDADLSHAAGPMRSILTAHRTMLDDPDMLETARQAILDGASAGHAWRLALRPQADLLRASGDAHLAERADDMVDLERRVVSAIEGLEDAPLVFPPDTILLADDLLPSQVTGLDPAQVRGFATVRGGPTSHVAILAASLGIPALVAMGAPLRGIAEGETLILDAGAGTIRIAPDTAQRAEAQARVDARAAALAGAHAAAAAPAKLADGTRIEVFANLGSVGDAERAVAAGAEGSGLLRTEFLFLERETPPSVAEQTAEYQAIADALQGRPLIIRLLDIGGDKPAPYLPIATEENPALGLRGIRVGLAHPQVLEDQLRAILGVRPIGIAKIMLPMIASVGELRAVRAVLDRLRDELGIGEKVELGIMVETPAAAATADLLATEADFLSIGTNDLTQYTLAMDRGNPAVASGIDGLHPAVLRLIADTCRGAAARGRWVGVCGGLASDPLAVPILVGLGVTELSATVSVVPEVKALLATLTLEHARAHAAAALNCATAADVRRL

SEQ ID NO: 17934 - protein, 465 aa, SPHINGOMONAS
TNDYVIKDIALADFGRKEIEIAETEMPGLMALRKEFGPSQPLKGARITGSLHMTIQTAVLIETLTALGAQVRWATCNIFSTQDHAAAAIAATGVPVFAVKGESLAEYWDYVGDIFNWGADGDGTTANIILDDGGDATMFALWGAKLEAGATLGEPENDEEVEFQRALKAFVAKYPGYLTKTVQNLKGVSEETTTGVHRLYEIAKKGELPFPAINVNDSVTKSKFDNLYGCKESLVDAIRRATDVMLAGKVACVAGFGDVGKGSAQSLRNGGARVMVTEIDPICALQAAMEGFEVVTMDEAVKRADIFVTATGNADVITADHMKAMKPMSIVCNIGHFDSEIQIAALSNYKWTEVKPGTDLVEFPDGKQIIILAKGRLVNLGCATGHPSFVMSASFTNQTLAQIELWTRGEHYKNEVYVLPKHLDEKVAALHLEKLGVQLSKLSEKQAAYIGVKPEGPFKPDHYRY

SEQ ID NO: 17935 - protein, 242 aa, SPHINGOMONAS
RRKLVAGNWKMHGMRSHLVEIDAIVAAARAHPQVDTLLCVPFTLIAAAAELAGDFTIGAQDVHENDFGAHTGCVSAQMLAEAGARVVIVGHSERRADQSETSHHAWAKAAAARRHGLGVILCCGETEAEHDAGRAERIVQSQIEKSLPDGAAPDWLTIAYEPRWAIGTGKTPTLDEIATMHAIIRAKLRGMIGASANDMRILYGGSVSAANAAAILAVEDVDGALVGGASLTAEKFVPIIEA

SEQ ID NO: 17936 - protein, 543 aa, SPHINGOMONAS
MYKYDEYDASIVAARVEEFRDQVQRRLAGHLTEDQFKPLRLMNGLYLQLHAYMLRVAVPYGTLDSRQMHMLAHIARKYDRGYGHFTTRQNLQYNWIKLEDAPDILAELATVEMHAIQTSGNCIRNISSDQFAGAAADEVTDPRPWAELLRQWSTFHPEFSYLPRKFKIAVIASDTDRAAMRLHDIGIQIVRNDAGDLGARIHAGGGMGRTPMIAHLIKDFVPFADFVSYLEACLRVYNRHGRRDNIYKARIKILIHALGAEEYARQVEEEFQAVKALGIDPPQAEFDRIAAHFAPPAFEAGAVDTVDRSDPDFAVWLDQNVHAHKAPGYAVVTISLKPIGGIPGDASADQIDAMADLAERYSFDELRVTHAQNIVLPHVRKADLYAVWTALREAGLAEANLDLISDIIACPGLDYCSLANARSIPLAQKISERFGDPARQRDLGELKLKISGCINACGHHHAGHIGILGVDRKGTENYQLLLGGSGAEDVSLADITGPGFSEDGVVDAIERATDVYVRERTPGERFVDTYRRIGMAPFKEAIY

SEQ ID NO: 17937 - protein, 673 aa, SPHINGOMONAS
MTNPLLDTLALPHFDAIHPDQIAPALDAVIAEHQAAVERVIASESRSFDDVWMPLERAETAIDALWSTVSHLRGVADTPELRAAHAAGQARLIENQLAVMQNQALYEVLVALTATPDFAARPQADRAAVEHMVRDFRLSGVALDAEAKARFAAVSVELSTLSTGFGNAVLDATDAWFEHIEDPALLAGISPADMAIFADAAKARGLEGWVVTLQAPSVSAVLTFAENRDLRARLYRAYGTRASDQGPHAGQFDNGPRIAALLELRREAAQLLGFPDPVAWSLATKMAPAAGEVLAFLRDLGRRARPAAQAEFAELSAFAARELGIDTLQPWDVPFASDRLRAARYAVDEQEVRAHFPVERVIAGWQALLARLFGVRLVARPDVAVYHPDACYYDVVDAEGVVIAGVYTDLHARAGKRSGAWMAQARPRLNDGNVRRVPVAYLVCNFAPKTEGSPSLLSHPEVVTLLHETGHCLHHLFTRVDRPNIAGTSGFEWDAVELPSQLMEDFAWDRDVLRGMSGHHATGAPLPDVLFDKLIAARRFLAGMALVRQIEFALFDLLLHLGTMGSDPMEVIKAVRDEVAVVRPPEWHRFPHAFSHIFAGGYASGYYSYLWAEVLAADGFQGFAEAGLIDRATADRFRDEVLARGASRPAAESFRAFRGRDPDPQAMLLRHGL

SEQ ID NO: 17938 - protein, 409 aa, SPHINGOMONAS
GVVRMVRHGHVEATGPNCALGDLCEIACDDGVLMAEVAGVEDGSLTLVPLEQGRQLRPGMRVHPVKGGSAAAVGDGFAGRAIDGLGRAIDGKGPVSRDAFAPLAGSMPGPLERVATGRRLTTGLRAIDGLLTLTEGQRVGVFAAAGVGKTSLIEQFARQIASDRCVLCLVGERGREVESLWRVLSARADATRFTLVAATSDETAAVRARAPRLALSLAEYWRDRGEHVLLIIDSITRFAMAQREIGLAAGEPPTVRAYTPNVFAALPRLVERCGAVQAGGAITALMTVLSETDDLDDPIVEVMKSLLDGHILLSRTLAERGHFPAIDVSRSISRQAAKVMDSSHAAVARSAISQLGVYEEARIMIESGVYKAGSNAEIDKAIETRERLMDFLRQSQNDNSSFSNTLAGL

SEQ ID NO: 17939 - protein, 259 aa, SPHINGOMONAS
QAFGQSFQRFGFAVVRDHGVPQELIERAWRLTKAFFDLPEEEKRAHFIPGGGGARGYTPFKTEIAKGATHVDLKEFWHIGRQLAAGHRFADVMAPNIWPTRPEGFRETFIELFAAFDAAGDKLLSAVARYLGLAPDWFDTAVKDGNSVLRLLHYPPVAADAPEVRAGAHEDINLITLLLGAEEAGLELLDRDGKWLAVKPPEGAMVINVGDMLQRLTNHVLPSTTHRVVNPPAERRGHSRYSMPFFLHPAPDFLIKTLP

SEQ ID NO: 17940 - protein, 423 aa, SPHINGOMONAS
LRVALAGLGTVGGGVIRLLDANAELISRRAGRRIEVVAVSARDRTKDRGIDLSRFDWVDDPVELARHAKADVVVELVGGSDGPALALARAALGANKSFVTANKAMIAHHGLELAQAAEDASVALKFEAAVAGGVPVIKGLREGAAANAISRVYGILNGTCNFILSKMEAEGRDFAEILAEAQALGYAEADPTFDIDGIDAAHKLSILASIAFGTQPAFGDLKASGIRHILAADIAEAATLGYRVRLLGIADAGAHGLFQRVHPHLVSLSHPLAHVTGSTNAVVAEGNFVGRLLFQGAGAGDGPTASAVVADLIDIARGEFGPPYAMPATALVSQPPADSGERRGRSYVRFTVADRVGVLAEIAAAMRDAGVSIESLIQRGVSPDGSALVAIVTHEAPERSIAQALEKLRGSQSLTGEPMWMHI

SEQ ID NO: 17941 - protein, 300 aa, SPHINGOMONAS
ILSLRQVSKTYASGHTALDHVDLDIHRGEIFALLGPNGAGKTTLISIICGIVTPSTGTILVDGHDAIRQPRAARSRIGLVPQEIAVDMFSRVGSAARYSRGLFGKAPDHAYCDQLLKDLSLWDKRDAKIMELSGGMKRRVMIAKALSHEPDILFLDEPTAGVDVELRRDMWKLIGRLRDRGTTIILTTHYIEEAEEMADRVGVINKGQLLLVEEKTALMKKLGKRELDLSLVEPLAAIPAELGEWQLSLADEGHKLRYTFDAQAERTGIPSLLRKLHDLNIAFKDLDTSKSSLEDIFVDL

SEQ ID NO: 17942 - protein, 200 aa, SPHINGOMONAS
RAEGRRALTIAGDVGDKAFCEEAVSKVIAEFGRLDILVNNAGEQHPDKDITDITEQQLRRTFQTNIFGMFFLVQAASPHLKEGAAIVNCTSVTMYQGEPELLDYSATKGAITAFTRSLSMNLIEKGIRVNAVAPGPIWTPLNPSGGASPEKLEHFGESVPMGRPGQPNEVAPAFLFLACEDSSYMSGQVLHPNGGTVVNG

SEQ ID NO: 17943 - protein, 451 aa, SPHINGOMONAS
TDPQDIEPWLTDWRRRYHGAAPAILSPASTEEVSALVALANDLGQPLVPQGGNTGMVGGAVPPVDGSALLLSTRRMNTIRRMDAEANLAVAEAGVILATFRDAAEAAGRRFPLDLGARGSATIGGLVSTNAGGVQVLRFGTMRALVAGVEAVLPDGSVHDGLSALKKDNRGYDLNQLLIGAEGTLGIVTAATLRLVPAAAARAVAWVGLESPAKALTLVARLQAATDMIESFEIMPDDTAALVLEHVPGTRVPLAGSHRWHVLIEAVTSDAGAEAPAAVLERMLAGAFEAGLAEDAVIAASEAQAESFWRIRHSISEAERAAGPAVQHDISVPVEDMPRFMVEGGAEAEARFPGTHAIAYGHLGDGNVHFHVRAPKGADRDRWYAEEGPQITRLVHDMVVAAGGSISAEHGIGQMKRDELARLSPPARIAALRAIKSALDPKLILNPGKLV

SEQ ID NO: 17944 - protein, 442 aa, SPHINGOMONAS
MSFADLGLSDELLRAVTDAGYTEPTPIQRQAIPSVLMGKDLIGIAQTGTGKTAAFVLPMIDVLGEGRTRALMPRSLILEPTRELAAQVAENFEKYGLNHKLSMALLIGGVQMGDQVKALEKGVDVLIATPGRLMDLYGRGKILLTGCSLLVIDEADRMLDMGFIPDIEEICTKLPKNRQTLLFSATMPPPIKKLADKFLTDPKTIEVARPATTNVNITQRIVQVPATAHVKRDVLRRLLQQDEVSTAIIFCNRKTTVRDLNKSLKKHGFRSAEIHGDMDQSARIAELDRFKNGDVNILVASDVAARGLDVKGVSHVFNFDAPWHPDDYVHRIGRTGRGGATGTAYTLVTPEDAENIAEIEKLTGHKIERVPSPVAIDGADEAPAPKRARGGKRDAKKAEPRREEAVAEAPAKPKSRRAAAPVREEGPAPAPREEQRSRPPRE

SEQ ID NO: 17945 - protein, 754 aa, SPHINGOMONAS
LEATLHKALEAASSRRHEYATLEHLLLALIDDEHASKVMGACGVDLGELKTTVAHYLDTELEALKVENATDPSPTSGFQRVVQRAILHVQSSGRDEVTGANVLVALFSERESYAVYFLQQQDMSRLDAVSFISHGVGKGGTTPTEASTPKGAAEEDKSNKQEAKTGKGESALKQFTVDLNEKAKIGKVDPLIGRAAEVDRTVQILCRRSKNNPLYVGDPGVGKTAIAEGLARKIVEGEVPDVLKEAVIYSLDMGALLAGTRYRGDFEERLKQVVSELEKLPHAVLFIDEIHTVIGAGATSGGAMDASNLLKPALSGGSIRCIGSTTYKEFRNHFEKDRALLRRFQKIDVNEPSVEDTVKILAGLRSAFEQHHSVKYTPDAIKSAVELSARYINDRKLPDKAIDVIDEVGAMQMLVAPSKRKKVITPKEIEQVIATMARIPPKTVSSDDTKVLANIEQDLKRVVFGQDKAIEVLSSAIKLSRAGLRDPDKPIGNYLFSGPTGVGKTEVAKQLANLLGIPLQRFDMSEYMERHSVSRLIGAPPGYVGYDQGGLLTDAVDQNPHSVLLLDEIEKAHPDLFNILLQVMDNGKLTDHHGKTVDFRNTILILTTNAGASDMAKESVGFGELSREDVQEEAVKNLFTPEFRNRLDAIVPFGYLPPEVVARVVDKFVLQLELQLTDRGVHIHLDEEAKAWLTKRGYDKLYGARPMGRLMQEKIKQPLAEELLFGKLVHGGEVNVKLKDNALAFEITPAAPKK

SEQ ID NO: 17946 - protein, 434 aa, SPHINGOMONAS
LASAARAIREMVPDRRFGRVVAVRGALIEVEGLAGVAQIGSRVEIQSPGGKVEAEVTALDRGVALCLPFVDPQGVGLGAIAELGAGQFTVRPSKAWLGRMINGLGRPVDGLGPLVNGADPQPIKASPPAAAGRSRVAERIETGVRCLDTFVPLCRGQRLGLFAGSGVGKSVLLSMLARWTQCDVAVIGLIGERGREVQEFIEDDLGPEGMARSVVVVATSDEPALMRRQAAWTTLAVAEHFRDQGLNVLCLMDSVTRFAMAQREIGLASGEPPATKGYTPTVFAELPRLLERAGPGAPGQGMITGLFTVLVDGDDHNEPVADAVRGILDGHVVMRRAIAERGRYPAIDVLKSVSRTLPHCLEAEQNDVRLAARKLLSTYADMEEMVRLGAYKAGSSPEVDRAVALAPRIEALLNQGKNDQGHAEAAFAELAAIL

SEQ ID NO: 17947 - protein, 243 aa, SPHINGOMONAS
SLKGKRVLITGGGSGIGAGLVEGFVRQGADVTFFDIAEADSQALVASLTDAAIAPRFYRVDLTDIPAAQAQVQALIEAEGGFDVLLNNAANDDRHTIEQVTPEYWDNRLNVNLRHQFFLAQAVIPAMKAKRAGVIINLGSISWHLALEELTLYQTAKAAIEGLTRSLARELGPDGIRSVCIVPGNVKTPRQMKWYTPEGEAEIVKAQCLPGRLVPDDIAALALFLASDDARLITSHEFFVDAG

SEQ ID NO: 17948 - protein, 268 aa, SPHINGOMONAS
EGPVWVERDAALWFVDIKSHKIHRYDPATGDKASWDAPAQVGFALPAASGGFVAGLQTGLARFDPTDGSFVPLVDPEPELPGNRLNDGTVDSEGRLWFGTMDDGESAATGTIYRLAADGSCVPSSPKVSITNGPAVSPDGKTLYHVDTLGAVVYACDIDPDGALVNRREFVRIAEGEGFPDGPCVDSEGYVWVSLYVGSEVRRYSPAGELVETVPFPVDAITKIAFGGPDLKTVFATTANKHLSAEDKAARPSSGDLFRFRVTVAGQP

SEQ ID NO: 17949 - protein, 456 aa, SPHINGOMONAS
ANIGLIGAIVAVATIGGLLFGYDSGAVNGTQPGLQAAFALDEAGLGFTVGSLLIGCFIGAFFAGTLADAIGRRNVMRLAAFIFLVGALAQGFAHLHGVFVVARIAGGIAVGAASVLSPAYISEVAPANIRGRMTTVQQIMIISGLTAAFVVNYYLAAAAGASTNAFWAGLEAWRWMYLMQAIPAAVFLVALFFIPESPRFLVAKGRIEEATKVLTDLFGPQTARTKLEEIRASFSADHRPSFRDLIDPRTGGIRSILWAGLVIAVFQQLVGINVIFYYGSTLWQLAGFTEADSLLINIVSGAVSIAACLVTIGLVDKIGRKPLLLIGSAGMAVTLFVLVYAFGHGSLDAAGKLVLSPDLGKTAVIAANLYVIFFNVSWGPVMWVMLGEMFPNQIRGSALAVCGFAQWFANYLIAQSFPVMASKLGLAASYTFYAVCAAVSFFLVLKFIKETKGKEL

SEQ ID NO: 17950 - protein, 346 aa, SPHINGOMONAS
AAAASPAYQVSTRCGTTPRCFPTLQGALDAAAGDRSTSWTSITIAPGTYREKPVVRRDRVRITGAGADRTRIVFGAVAETAGRYDPAQWGTPGSATLTIHASDVTVRGLTIENDFDYLANDALAAGDSKKVGASQGVALLLDTDSDRVAFDGVSLLGYQDTLFTRGRRAWFRRGLIAGNVDFIFGSGMLLIEDSEIRSRRRAQPTPPGEYASFITAPSTPLSQPIGIVIHRSRLTREAGVADGSVALGRPWHPTTRFPDGRYADPQAVGQASFLDCTMDAHIHPDHWTSMAGTARDGTKTAIFRPEESRFSESGSTGPGARRNPQAIRWTAALPIAAVRARLFEGW

SEQ ID NO: 17951 - protein, 419 aa, SPHINGOMONAS
IAVAAALAGLLFGFDTAVVSGVTAPITQAFGLSPTGTGIAVSAALVGTLIAALGAGIPGDRYGARAVLRWVGVAFILSALGCALATGLTSFVLFRFIGGLAIGGASVLAPVFIAEISPSARRGALVGLFQLSIVSGILAAYCSNAVVSALPLGEAAWRWKLGVMIVPGLVFLLAMFTIPQSPRWLAARGRESEALDVAARIGLTDWTLAPPHGDDGERLSWARHRTPILLAIAVASFNQLTGINAILYYLNDIFAAAGFSQVSADVQAVSIGAANLLATLLAMTLIDRVGRRTLLLVGAAGTAVMLAGVALVYASRGLEALLLPLLVLFIAFFAVSQGAVIWVYLSEIFPTRVRARGQALGSATHWIWAALLSFGFPIVAQNFDRSLPFWFFAGATLLQLLVVWRFFPETKGVRLEDME

SEQ ID NO: 17952 - protein, 344 aa, SPHINGOMONAS
MATKAYGAYAADKPLEPIEIERRAPGAHDVQIDIAYCGVCHSDLHQVRSEWEGTLYPCVPGHEIVGRVSAVGEHVRKFAVGDLVGVGCMVDSCQHCASCDEGLEQYCENGFVGTYNGPTPDAPGHTLGGYSQQIVVSDKFVLKVNHGEEQLAAVAPLLCAGITTWSPLRHWQVGPGKKVGIVGIGGLGHMGVKLAHALGAHVVAFTTSESKRADALALGADEVVVSRDADAMAAHANSFDFILDTVAASHNLDAFTTLLKRDGTLTLVGVPEHAHPSPNVAALIFKRRSIAGSLIGGIAETQEMLDFCAEHGIVADIEMIRADEIEAAYARMLKSDVKYRFVID

SEQ ID NO: 17953 - protein, 380 aa, SPHINGOMONAS
ATQAVRGGTARSEFGETSEALFLTSGYAYDCAGDAAARFAGEQVGMTYSRLQNPTVEMLEQRIALLEGAEACRTMATGMAAMTAALLCQVSQGDHIVQGRAAFGSCRWLTDSLLPRFGVTTTTIDARDPQQFVDAIRPNTKIFFFETPANPTMDVVDLAAVCAIARKHGIVTVVDNAFATPALQRPMEFGADVVAYSATKMMDGQGRVLAGAVCGSEDFITNTLLPFTRNTGPTLSAFNAWVVLKGLETLDLRIRRQSENALKVGSFLEERVPRVNFPALPSHPQHALFMRQMAAAGPIFSFEVDGGREQAHALLDGLELIDISNNIGDSRSLMTHPSSTTHSGLAEEKRLEMGVTEGMIRINVGLEDADDLIADLDQAL

SEQ ID NO: 17954 - protein, 242 aa, SPHINGOMONAS
LSASDLSVSLGKRRVLHGINAVLRPGKVTAILGPNGSGKSTLVRTLAGLLTPDAGRVTLGGTPLARLDPRERARRMGYLPQEATVHWDVGVADLVALGRLPHRAPFAGLSTEDHAAIDSAIEATGVRSLAGRLVTQLSGGERARVLLARVLAGEPQWLLADEPLASLDPVHQLDLLDRLRALAAGGMGVVIVLHDLVQAARAADDVLLLREGRPVAVGPAATTLAHQPLREAFGVEVMVIGD

SEQ ID NO: 17955 - protein, 390 aa, SPHINGOMONAS
FKTLDDMGDITGKRVLVREDLNVPMADGKVTDDTRLRAAIQTVAELADKGAKVLVLAHFGRPKGVPSAEFSLAQVVKPFEQVLGRPVRYIDWEGDAASVATLNDGDIALLENTRFFGGEEKNDPAVVDRFAALGDLYVNDAFSAAHRAHASTEGLAHKLPAFAGRQMEAELDALDKALGNPEHPVAAVVGGAKVSTKLDVLKHLVARVDHLIIGGGMANTFLAARGVDVGKSLCEHDLTGTAEEILDAADAAGCTVHLPYDVVVAKEFRANPPVRTVNVHEVAADEMILDVGPAATEALADVLKTCKTLVWNGPMGAFEIPPFDAATVSLARTAAALTKEGSLVSVAGGGDTVAALNQAGVAGEFSFVSTAGGAFLEWMEGKELPGVAAL

SEQ ID NO: 17956 - protein, 331 aa, SPHINGOMONAS
MTKVAINGFGRIGRLVARAILERPESGLELVTINDLSDAKSNAWLFSRDSIHGKYPGTVEAEGNDIVVDGKRIKVTAERDPANLPHAENGVDIVLECTGFFTDRASAQKHIDAGAKKVLISAPGKNVDLTVVYGVNHDKLTAEHTIVSNASCTTNCLAPVAKVLNDAIGIERGLMTTVHAYTNDQKILDQIHPDLRRARAAAMSIIPTTTGAARAVGEVLPELKGKLDGSAVRVPVPDGSLVDLTFQPSRDTSVEEVNAVLKAASESGPLKGVLVYTADPIVSADIVHTPASSTVDSLETAVIDGKLVRVVSWYDNEWGFSNRMVDTATVM

SEQ ID NO: 17957 - protein, 638 aa, SPHINGOMONAS
ANAIRALSMDAVEAANSGHPGMPMGMADVATVLFQRYLKFNPADPAWPDRDRFVLSAGHGSMLLYSLLHLTGYARPTLDDIKNFRQIGSPCAGHPENFELAGVECTTGPLGQGLAMAVGMAIAERHLNATFGDDLVDHKTWVIAGDGCLMEGINHEAIGIAGHLKLNRLIVLWDDNNITIDGPVSLSSVEDIPARYRATGWNVLECDGHDEADIVRALDQAIASDKPVLVKCRTVIGKGAPNKEGTSKVHGSPLGKDEVAAARAALGWNHPAFEIPGEIRDAWLAAGARGAAPHAAWAERLAAHPDRLGWERRGTVQPNLLRPHVQSLLANPQKVATRKASELALEAVNAILDETIGGSADLTGSNNTLTKGLQRLDADNYGGRYLNYGIREFGMAAAMNGMALHGGVIPYGGTFLVFADYARAAIRLSALQHARVVYVMTHDSIGLGEDGPTHQPIEHLMSLRMIPNLDVWRPCDVVETAEAWEAALAKTDGPALIALSRQNLPQLRTEAAENRSARGAYALLEAEAPRKVVLLATGSEVEVAVAVREALEAQGIGADVVSVPCFERFDAQDAGYKRDILPADALKVSIEAGTTFGWERYTGTDGLRFGVDGFGASGPYLGLYEHFGLTAGAIVPQI

SEQ ID NO: 17958 - protein, 486 aa, SPHINGOMONAS
MAELLLVIDEGSTSTRAMLFAPSGQCVASKSAELSQHYPGPGLVEHDADEIWRQSHACAAEIVALAGGHQRIAAIGITNQRETVVFWDKTTGIPLAPAISWQDRRSAPLCQKLREAGEEPGIQARTGLLLDPYFSGTKIAWAMANWPQLKAAGDRLAIGTVESWLVWKLTGGLHVTDATNASRTLLMGLGSGAWSDGLIDQFDAPRAALPEIVDCAERLGVTRAFGGAIPICGLAGDQQAATIGQACLTPGDTKATFGTGAFVLTNAGTLQPRSRHRLLSTVLWQLGGRRTYALEGSVFVAGSLVQWLRDSLGLIATAAETATLARSVPDNGGVYCVPALTGLGAPWWEPEARAAISGLSFAAGRAHIVRAALEAMAHQSHDLETAFAADGAQWARLRVDGGMVTNDWIAQDLADILALPVDRPDFAETTALGAAMLAGVGCGMFASLDDAAMMRGTFRTFEPQMEAPVRATRMAGWRDALARVVA

SEQ ID NO: 17959 - protein, 555 aa, SPHINGOMONAS
PSTPCSPRPAPSSKWETVEIRGIPTRVWKNSPPNAAILARLARGYGDRPFTVYQDERVSYEANYRATCHLASWMQAQGVAKGDRVALAMRNLPEWPTIFFAAVSIGAILVPLNAWWTGAELEYGMKDSGAKLLFVDGERHERLKQCYAALPDLERVVVSRACTPLESEVVALESIVGPCTGWAALPDIAFPEVAIAPDDDVTLFYTSGTTGNPKGAVGTHRNLMTNILTSGYSVARAMLRRGEMPPPAPPYKVGLLVIPLFHVTACSAGLMALIAAGGTVVFMRRWEPVEAMEIIQREKVNQTGGVPTIAWQLLEHPERASYDLSSLDTISYGGAPSAPELVKRIYEEFGALPGNGWGMTETMATVTHHTGEDYIARPTSAGPPVPVAELKIMDVDGTRELPVGEVGELWAKGPMIVKGYWNKPEATAETFREGWVRTGDLARLDEEGFLYIVDRAKDIIIRGGENIYSSEVEDVLYAHPAVTDAALIGVPHRALGEEPVAVVHLAPGTSATEAELQAFVRERIAAFKVPVAIRFSEETLPRNANGKILKKDLKA

SEQ ID NO: 17960 - protein, 396 aa, SPHINGOMONAS
  unsure (1)..(396): unsure at all Xaa locations
QDLDSFRSETRAWLEANCPATMREPIRSEKDIVWGGRNPDWAHPDQKLWMDRMAERGWTVPDWPTEYGGGGLSPAETKILREEMKRMGARTPLNSFGISMLGPALLKYGTEEQKLEHLPKIARGEIRWCQGYSEPNAGSDLAGLQTWAEDAGDHYVVNGQKVWTSYADKADWIFCLVRTSKEAKQGGISFLLFDMASHGVSTKPILLISGYSPFCETFFDNVKVPKSQRVHEENKGWDVAKYLLGHEREMISGMGLDRAGGNPLIEGAIATIGLDDQGRLADPILRAQIALFEVRMRAFSAMSERFLDELKAGRAHPAQPSMMKYVGTELNKQRHELIMAAGGSDALEWESAASAKGAKPRAWLRTKANSIEGGTSEIQLNIVAKRILELPGXGGG

SEQ ID NO: 17961 - protein, 372 aa, SPHINGOMONAS
PAMPLYLNDEQTMLRDTAREFVAEHAPVRHLRAMRDAKDPTGFSRDLWKQFAEMGLTGILIPEASGGLGLGHVEAGVVLEEVGRNLTPSPFLSTAVAAVEALKGTAHAERWFPGIAAGEAVIAIAHDEKPKFGRAVALKAERAGNGFRLTGTKRFAHHAHAADLILVTARTAGSDMDAEGMTLFAIDPKAAGLDLRPERLADSSLAAHATFDGVEVTTDAVVGEIDAGAGPLGRLLRAAGAGASAELLGVGAGASDMTLGYLKERKQFGTLIGSFQALQHRAAHLYSELEVARAATLKAQQLLDAGEPADEAVAIAKAMTGLATTLAVQEGIQMHGGIGMTDEYDIGFYMKRARVLAEMFGDSNYHANALAE

SEQ ID NO: 17962 - protein, 506 aa, SPHINGOMONAS
LTLESRVRGAEGWSLTVDNGARIAEGPAALPPGTRVRVEGLFGRVPARRKFLRSTRAEYAACLDGMKRLAMARPDIAFSVEHDGRRVLSVQGGESRPARVAALTDRALQENSVAIDFEREGLVLGGVASIPTFNRGVADHQYLFVNGRPVKDRLLVGAVRGAYAEMLARDRHPVVALFLDVPPEVVDVNVHPAKTEVRFRDPALARGLIVSGLRRALNAAGHRSVQRPSEAALGLWQAGGGGSSSPSSLEEGLGWRDSRTGVGLFETQPHPNPSPEGEGLRHYSGAVRDSGTFFAAAPLARAEPARHEAPLATDFPLGVARGQVAKTYIVAEAEDGLVLVDQHAAHERLVLERMRRAMAGGAVPSQALLLAEVVELDEPGCDRLEARTDELRSLGLELERFGPRAMLVRAVPAALGTGDIHGLVTDLADELASFDEALSLKERLDHVAATMACHGSVRAGRILSVAEMNALLREMEVTPHSGQCNHGRPTWIKLAHGDIEKLFGRK

SEQ ID NO: 17963 - protein, 479 aa, SPHINGOMONAS
IRLDMFHYLTGHHIGFFQNQRGGSLGHRVGALTGSFAALTHRILMEVTPPLIAFGGALLIFLTIDWRMAVAITGIFVAASTGLVFLGLRGDKYHKAFARAASESGGEMVDLVSNIAAIKSFGARARESERLRGFFETEAAAQKRGWMFVERIRVLHDVALVLLVGAALVWAVERWSAGGITAGDVVVVSAMTFRMLNGSRDLAMALIDTSQQFSYLRETLEIVGAPHALDDAPDAAPLVATQGEVRIEGVTFGHHPGRPVLHDLSLTVAPGQKIGIVGPSGAGKSTILQLVQRLHDPQGGRVLIDGQPIDRVTQDSLHQAVAVVPQEVLLFHRSILENIRFARPDATDAEVRAAAEAAHCAGFIALLPQGYDTVVGERGTNLSGGQRQRIGIARAFLSKAPIVLLDEATSALDTGSEIEVQQALDALMAHRTVLAVAHRLSTVVGFDRVIVVEHGRIVEDGPPLTLLRAGGAFQRLWSL

SEQ ID NO: 17964 - protein, 424 aa, SPHINGOMONAS
TAKLHVAGKDVEYPVLKGSTGPDVVDIRKLYAQTGAFTYDPGFTSTASCESGLTFIDGDEGVLLHRGYPIGQLAEHSSFMEVSYLLLNGELPTQAELSKFENTITRHTMLHEQLATFYRGFRRDAHPMAVMCGVVGALSAFYHDSTDITDPQQRMIASHRLIAKMPTIAAMAYKYSVGQPFLYPKNDLSYTGNFLRMTFGVPAEEYEVNPVVEKALDRIFILHADHEQNASTSTVRLAGSSGANPFACIAAGIACLWGPAHGGANEAALNMLHEIGRPERIPEFIARAKDKNDPFRLMGFGHRVYKNYDPRATVMQKTVREVFAALNVSDPVFEVALQLEEMALKDDYFVEKKLFPNVDFYSGVILSAIGFPTTMFTALFALARTVGWVAQWNEMISDPEQKIGRPRQLYTGPTQRDYVPVGQR

SEQ ID NO: 17965 - protein, 458 aa, SPHINGOMONAS
KPVVTRFAPSPTGFLHIGGARTALFNLLFARHHGGKFLLRIEDTDRARSTQPAIEAILDGLRWLGLDWDGDEVYQFARAARHAEVAQAMLEKGAAYRCYLTQDELAAMRAEAEAAKKPLRIRSPWRDRTDGDPSVPHVVRLKAPTEGSVTIRDHVQGEVTVQNAEIDDLVLLRSDGTPTYMLAVVVDDNDMGVTHVIRGDDHLNNAFRQLPIYRAMGWDEPEYAHIPLIHGADGAKLSKRHGALGVDAYRDELGLLPEAVSNYLLRLGWGHGDDEIISREQAVEWFDLAGVGKSPSRFDLKKLENLNGHYIRQSDDDRLADLVAARLPFEVSDSQADLLRRSMAALKPRAANLLELADGAGFLFRTRPLELDENAAALLEGDARTLLAQLHTALDGLATWDTEALEAAVRTVADDAGVKLGNLAQPLRAALTGRRTSPGIFDVLALLGREESLARIAD

SEQ ID NO: 17966 - protein, 450 aa, SPHINGOMONAS
EPATGAVLWRHAIGDADTEVAIARASWAQWAARPLAVRIEALRRFANVVRQKADAFTDLIARETGKPLWEARTEVETVIAKVDISVTSYSERTGQRRIEAPMNTRLALRHKPHGVLAVLGPYNFPAHLPNGHIVPALLAGNAVVFKPSEKTPACGAFLVECFHAAGIPEGCVRLLIGGPDQGKALASHPDIDGLLFTGSANTGIALNRQFAARPEKILALEMGGNNPIVVWNTPDIYSAAVLVVQSAFTSAGQRCTAARRLIVDQKLFDPLMEELHKLIGRLIIGEPHADPQPFMGPVIDNNTADMLTESFLTLSTMGGRPLRHMERPIENRPFLTPGVIDMTDAREKVDVELFGPVLQVFRKTSFEEAIAEANDTRYGLSASLVSQDPKLYDQFWANIRAGIVNWNKPTNGASSAAPFGGVGWSGNHRPSAYYAADYCAYPVVSSESEQ

SEQ ID NO: 17967 - protein, 240 aa, SPHINGOMONAS
  unsure (1)..(240): unsure at all Xaa locations
MSVRRRSLLAGALALPLVARAQTQESWEQRKERLLHEDFPELSRYAADNARILSSGEKVNIVFLGDSITEGWKSKRPGFFTPGRVGRGIGGQTTPQMVLRMMADVVHLKPRFVHIMAGTNDIAGNTGKMTRAQSYDNFRMMAQIAKANGIGVILASVPPADHFPWRQGLDVVGPIREINAWLQGYAKAERLTWVDYTPVLGDAKGAMKPGLAYDGVHPTEAGYDAMATVIEPILKARRAX

SEQ ID NO: 17968 - protein, 449 aa, SPHINGOMONAS
ASQFDVINPATAEPFARCPKADADQLNAAVAAAKAAFPAWAATPIEERAAKVEAVAARLQERLSEFASLLTSEQGKPLDQATGEVMGTVFTLRAFTEMRPETKVLRDEGGNRIVEHRTPLGVVAAITPWNFPMILAANKIGPALVAGNTMVLKPAPTTPLTTLLMGEIFAELLPPGVINIICDQNDLGALLTTHPDVAKIAFTGSTATGKKVMASAADGVKRVTLELGGNDAAIVLDDVEPALAARKVFQGAMYNAGQICVAVKRAYVPEGMYEEFCDEIAELARNTVVDDGAKQGAKVGPVQNAMQFEKVKALIEDAKERGTVLAGGDALDRPGYFIPPTIVRDLDDDAPLVREEQFGPVLPVLKYSDIDEVIARANDSEYGLGGTIWGRDVARATEVAMKIDSGTVWVNQHLAIDPRIPFRGSKQSGLGGELGQAGLHEYTQAHIVN

SEQ ID NO: 17969 - protein, 465 aa, SPHINGOMONAS
  unsure (1)..(465): unsure at all Xaa locations
DIEAAMGTSRDPNELKEMWVSWNDNVGAAMRPDYAKLVGIANQGAKELGFADTGALWRSGYDMPPAEFAAMTDKLWNEVKPLYVALHTYVRRKLNEKYGDAVQARTGPIRADLLGNMWAQEWGNIYDLVAPKGAGDLGFDTGELLEAKGYDWKKMVQTGEGFYSSLGFEPLPGTFWERSLFLKPADREVLCHASAWDIDEKNDVRIKMCIKVNSDDFVTIHHELGHNYYQRAYQAQPALYRNGANDGFHEAIGDFVALSITPEYLVQIGLLDRARVPSADKDIGLLLRQAMDKVAFLPFGLLVDKYRWQIFDGTIPANQYEAGWNKLRLQYQGIVPPVARDETKFDAGAKYHVAGSVPYTRYFLARLLQFQFYKAACDQSGWKGPLHRCSFYGNKEVGARLNKMLEMGASKPWPDALQTFTGSREISGKAMVEYFAPLKKWLDEQNKGQPQGWXPRGTFSSGSCR

SEQ ID NO: 17970 - protein, 531 aa, SPHINGOMONAS
  unsure (1)..(531): unsure at all Xaa locations
PFAELRRDALEQARRLIAAGIQPQDRIALIAETGPEFAAIFFGVIYAGAWPVPLPLPTSFGGAQSYIDQLRVQLESCDPMLLIYPPEIGSMCAEAARITEVNGIDWAAFSERAAPETVLPQAKSDDIAYLQYSSGSTRFPHGVAITHHALLNNLAAHSHGMELVEADRCVSWLPWYHDMGLVGCFLSPVANQVSTDYMKTEDFARRPLAWLDLISRNPGNSISYSPTFGYDICARRMSSQTKASERFDLSRWRLAGNGADMIRPDVMQRFVDAFADAGFKATAFLPSYGLAEATLAVSIMPPGEGIVVELVEETQLSGGTARADRPQRYRAVVNCGKPVRDMTVEIREEDGTPLPEKAIGKVWCKGPSVMVGYFRDEAATEACMVDGWLDTGDMGYMSDGYIYIVGRAKDMIIVNGKNHWPQDIEWAVEQLPGFKQGDIAAFAITTPGGEETPAVLVQCRTSDEQERVRLREEIRERVRSVTGMNCVVELVPPRTLPRTSSGKLSRAKARNLYLNGEIKPYAIAAXSACAG

SEQ ID NO: 17971 - protein, 386 aa, SPHINGOMONAS
QIGTTRVADIAKLRPVQPVTLVRPHAASRAARFFAEKFPGRSMYAVKANPSPDLIQILWESGITHFDVASIAEVRLVAGVAPEATLCFMHPVKAEEAIAEAYFEHGVRVFSLDSMEELDKIVRATKGATDLTLCVRLRVSSDHSKLSLASKFGVGPGESKDLLIAVRQVADALGICFHVGSQAMSPEAYANAMERARVAIVEAGVTVDVVDVGGGFPSSYPGMEPPPLERYFATIHRAFESLPISYSAELWAEPGRALCAEYSSLVVRVERRRGDELYINDGAYGALFDAAHIGWRFPVRLLREPDSNAKDMGFSFYGPTCDDMDRMAGPFELPADIQAGDYIEIGMLGAYGAAMRTGFNGFTAGDTVIVDDEPMVSLYTGEDEAV

SEQ ID NO: 17972 - protein, 256 aa, SPHINGOMONAS
PLKIVSYNVNGIKARIDRLVEYLTEQQPDIVCLQELKSSDDTLPVAAIETAGYGAVWHGQKGFNGVAILAKGQQPVERQRGLAGDPEDAHSRYIEAEVGDLIIGGLYLPNGNPQPGPKFDYKLRWMDRLYDRAAQLLAEERPAILAGDFNVIPNDDDTFSIRAMAEDALMQPESRERYRKLLAQGWTDALRTRFPKGGVWTFWDYQAGAWQRDAGFRIDHLLLSPQAADRFTGAGVDKDYRGREKASDHAPTWVTL

SEQ ID NO: 17973 - protein, 362 aa, SPHINGOMONAS
TEAVIKGKDTILLGTYNYMGMTFDPDVIQAGKDALDRFGSGTNGSRMLNGTFRDHMEVEQALRDFYGVSGAIVFSTGYMANLGMISTLAGKGEYIILDADSHASIYDGCKQGTAEIVRFRHNDVTDLDKRLGRLPAEAGKLVVLEGVYSMLGDIAPLRQMVAVAKKHGAMVLVDEAHSMGFFGPNGRGVYEDQGLEDQVDFVVGTFSKSVGTVGGFCISNHPKFEAIRLACRAYIFTASLPPSVVATAATSIRKLATAHEKRARLWANARKLHGGLTEMGFKLGTETPESAIVAVILEDQEQAVTMWQALLENGLYVNMARPPATPAGTFLLRCSLCAEHRPEQIERVLGMFRAAGQAVGVI

SEQ ID NO: 17974 - protein, 277 aa, SPHINGOMONAS
MALKNYNPTSPGVRGLILIDRSQLFKGRPVKALTEGKTKTGGRNNKGHVTSRGIGGGHKQRYRIVDFKRRLWDVEGTVERIEYDPNRTAFIALINYGADEAGKDRLAYIIAPQRLAVGDKVIAGKKTDVKPGNAMELGQMPVGTIVHNVEMKPGKGGQIARSAGAYVQVVGRDRGMVIVRLGSGEQRYIHAACMATVGAVSNPDNQNQNFGKAGRSRWQGARPLTRGVAKNPVDHPHGGGEGRTSGGRHPVTPWGKPTKGARTRHNKATDKMIIRSR

SEQ ID NO: 17975 - protein, 711 aa, SPHINGOMONAS
NRTWWPNQLDLTVLHQNPPAGDPMGADFDYVAEFRKLDLAAVKADIFALMTDSQDWWPADFGHYGPLFIRMAWHSAGTYRIGDGRGGAGSGTQRFAPLNSWPDNANLDKARMLLWPIKQKYGRALSWADLMILAGNCALESMGFKTAGFGGGRADVWEPERDINWGPEREWLQTSDKPGGRYSGERDLSNPLAAVQMGLIYVNPEGPDGNPDPLLAAHDIRETFARMAMNDEETVALIAGGHTFGKTHGAADPSQHIGPEPEGAGLEMQALGWANSYGTGNAGDTITSGLEVTWTETPTEWGNGFFKNLFEYEYELTKSPAGAHQWVAKDAGEVIPDAHDPSKKHRPTMLTTDLALRFDPAYGPISRRFYENPDQFAHAFAEAWYKLTHRDSGPHAKLLGPEVPAEPRIWQDPVPAVDHVLIDDADVAALKAEILGSGLSIARLVKTAWASASTYRGSDKRGGANGARIRLAPQKDWAVNEPAELAKALAVLEGIQARFNAAQTGGKKVSLADLIVLGGTAAVEAAAKKAGHDLALPFVPGRTDATEEQTDAHSFEALEPKVDGFRNYAGDTLGWSEEELLVDRAALLTLTAPEMTVLVGGLRVLGANHGDSQHGVFTESPETLTNDFFRNLLVTSFTAKWEAQGDGSFVAKDRKTGEAKWTGTRVDLIFGSNSQLRALAEAYATDDAEAAFVTAFGKAWTKVMHVDRVDL

SEQ ID NO: 17976 - protein, 414 aa, SPHINGOMONAS
IGDRKLKPATMMMGHGYDPMLSEGALKPPIFLTSTFVFPNAAAGKRHFEGVTGKRPGGAEGLVYSRFNGPNQEILEDRLAIWEEAEDALAFSSGMSAIATLFLSMVKPGDTIVHSGPLYAATETLIARILGRFGIHWLDFPAGATREEIDAVLSKAATGNVALIYLESPANPTNALVDVEAVAASRDAIFKGDTKPPIAIDNTFLGPLWAQPLRQGADIVVYSLTKYAGGHSDLVAGGVLGSKAHINTIRLMRNTIGTICDPNTAWMLLRSLETLELRMSRAGENAAKVCEFLAAHPKVERVGYLGFLERGEDKRQADIYRRHCTGAGSTFSLYLKGGEKEAFAFLDALKIAKLAVSLGGTETLASHPAGMTHLSVAEARKQALGITDNLVRISIGVEDADDLIADFENALKAV

SEQ ID NO: 17977 - protein, 426 aa, SPHINGOMONAS
MDRILIRGGNRLAGKIAISGAKNAALTLMPCALLTDEPLTLRNLPRLADVDSFGHLLNELGASTSVEGTRPNEFGRVLSVRASRLTSTVAPYDIVRKMRASILVLGPLLAREGEATVSLPGGCAIGNRPIDLHLKALEAMGAEIELSAGYVKATAPGGRISGGRFRFPVVSVGATENALMAASTARGTTVLENAAREPEIVDLCNLLVAMGAVIRGIGTETLEIDGRDRLHGATYAVMPDRIEAGSYACAAAITGGDVELLGASAEDMRATLDALVEAGITVEETVNGVRIAADNGIRPLTLNTAPFPGFATDMQAQFMAMLCKADGASTLTETIFENRYMHVPELTRMGADIEVHGRTAIVRGVGKLTGAPVMATDLRASMSLILAGLAAEGETQVNRVYHLDRGYERLEEKLQGVGADIERVGD

SEQ ID NO: 17978 - protein, 424 aa, SPHINGOMONAS
  unsure (1)..(424): unsure at all Xaa locations
VVATRSGQVQGAIEDGVASWKGIPFAAPTVGPLRWQAPQPAADWQGIRPALQYSHDCMXTPFPSDAAPLGTTPAEDCLYLNVWRPAAAAPAARLPVMVWIYGGGFVNRGASPPTYAGTNLAKQGVLFVSFNYRVGRFGSFALPQLSREDADGGLVGNYNFMDQIAALRWVRENIAAFGGDPANVTIIGESAGGMSVHTLVTSPLAKGLFHKAVVMSGGNGQTAGNATLRDAETIGENLARAHGIDPAAPDALAKLRALSAEQVTDGLSMVELFQPKPGPRTYGGPMLDGKLLVDQEKAYASGAFAHVPMLIGATSADMGGKSGFMIAGARDASATIAAQKVPVWAYRFSYVADSVGKPGAGHATDIPFFFDNARIKYGAATTPRDEQMGKTISAYLVNFARSGNPNGGDLPVWPRYAKASDEIL

SEQ ID NO: 17979 - protein, 531 aa, SPHINGOMONAS
FDYIIAGAGSAGCVLADRLSADGQARVLLIEAGGDNETELINMPRAFMKMFGNPTYFWHFPITEQEGRPSGETWSYGRGLGGSSSTNGTWYLRGEPADYDGWAAMGFGEWRWSEIQRCFQAMESYRGAGADASRGRDGPLQITQLPFRSPAINAAIEAGTQIGLKKVTDINAPGSVRIGYTQATVSRRGRRASSYQAFLKPAMRRPNLSVLLDTLVERVEITNGRATGVRVRTAGGARSIAATREVILSAGALQSPKLLQLSGIGPAEVLERAGVPVVQALPQVGRNLADHLMFTMSWRLHKDPGANREFSGWRLTSHVLRYYLTRTGMMAYTSPEVTALLSIDSSPDWPDAQFGVGPYSLRTTEEMKADPGRGALEDKPGISVNGIALRPKSRGTVAIRSADVADPVDVHANWWGDPADKAFLVKMVRLARRYMRQPALKGFVGEERVPGERFQSDEDIARQLEWLASPGLHSTGTCRMGTPETGVVDGRLRVHGIQGLRVADCSVMPLQPAGNTNGPAMVIGWRAAELI

SEQ ID NO: 17980 - protein, 234 aa, SPHINGOMONAS
RGILITGGLGDIGLAVAHAFAAEGANLLLLDLREDDGRVAADLQASGAAMVLSRAVDVADESALAGAVALAVERFGALDVIVNIAGMMLYKPIAELAAADWRRLLDVNLVGAALLTGHGLRVMRRGGCIVNIASIHARRTSPLVAPYAAAKAALVSLTRSAAIEGKPLGIRVNAILPGAVDTAMLRASPNIRSGAEVVDPADLGVPQDIAAITRFLASDGASFITGEDIVADGG

SEQ ID NO: 17981 - protein, 281 aa, SPHINGOMONAS
VIERAQRDMLGEGPLWDEARQALLWVDIVGRQVHAVDIDSGRHTALPVPEPIGWVLPRAAADDFVAGFRSGFAFLDIDSGAIRPIGNPEPERPQNRLNDAKVDAAGRIWAGSKDDQDEQASGALYRLDADLRWKRLDDGYGVANGPTFCPENKTLYHTDSAARTIYAMDLAPDGSLSGKRVWLRFEDAWGYPDGMTTDAEGCIWIAHWGGGRISRFSPGGKLLRSIALPATNITSCTFAGPALDRMFVTSSRIDAAEEPLAGCLFEIDPGVQGLPQPRFAG

SEQ ID NO: 17982 - protein, 453 aa, SPHINGOMONAS
SGAVWMSAMVAALGGVLFGYDWVVIGGAKPFYEAAFGLTAPTDQAWAVSCALIGCLAGAIASGGLSDRFGRRPALLIAAVIFAVSSLGTAFAASFHGFVLWRIAGGVAIGMASGLAPLYIAEIAPPAARGRLVVLNQIGIVVGLLGAQIVNLLIAEPVIAGAAPADIAASWNGTTGWRWMFAAAALPAIVFLVGCLMIPESPRWLFQHGRKAQARAVLVTFGGEAHADVALEQIRAALQAGPGRSLRSVLGEARLRRVLGIAIVLAVLQQWCGINVIFNYAQEIFASAGYAVSDTLFNIVITGVVNMVFTLVALGTIERLGRRRLLLIGCAGLAAIYLVLGTCYLYGLQGWPLLALVVAAIALYAMTLAPVTWVALSEILPGEARGASMAVATTALWAACFLLTYSFPLLNAAAGTGVTFWLYAFVCAAGFAFISAKLPETKNRTLEDIEQGW

SEQ ID NO: 17983 - protein, 445 aa, SPHINGOMONAS
RFDAIILGAGQAGTPLAGRLSDAGMSVALVERHLLGGTCVNTGCKPTKTWVASAYAAHMARRAADFGVIIGGAVGIDFAKVRARADKISADSRASLRQWIDGMAHCTLFFGHARFESPHRVRVGDAVLEADRIFLNVGGRALVPDMPGVNDVPFLTNSTILKLDAVPRHLVVVGGSYIGLEFGQMFRRFGAEVTIVEKGPTLIGREDPEISDAVHDILEAEGIAIRTGAECIRFARQGEDVLVGVDCHEGSPEVLGSHVLLAVGRTPNTDDLGLDAAGVATDARGYVQVDDYLRTNVEHIWALGDCNGRGAFTHTAYNDFEIVADNLLAGADRKVTDRIPAYALYIDPPLGRVGMGEAQAKKAGHRIEVGRRPMTRVGRAVEKDETLGFMKLVSDADSGRILGGAILGTSGDEAIHGVLDLMVKQGTATDLSHAVPIHPTVSELL

SEQ ID NO: 17984 - protein, 370 aa, SPHINGOMONAS
MKTRAAVAFEAKKPLEIVELDLEGPKAGEVLVEIMATGLCHTDAYTLDGLDSEGLFPSVLGHEGAGIVREVGAGVTSVKPGDHVIPLYTPECRQCKSCLSGKTNLCTAIRATQGKGLMPDGTTRFSYKGMPVFHYMGCSTFSNFTVLPEIAVAKIREDAPFQTSCYIGCGVTTGVGAVVNTAKVQVGETVVVFGLGGIGLNVIQGARLAGAGQIIGIDVNPDREEWGRKFGMTHFLNTRGMSREQIVAKVVELTDGGADYSFDATGNTEVMRTALECCHRGWGESIIIGVAEAGKEISTRPFQLVTGRVWKGTAFGGAKGRTDVPKIVDWYMNGKIAIDPMITHVLALEEINKGFDLMHAGESIRSVVVY

SEQ ID NO: 17985 - protein, 671 aa, SPHINGOMONAS
  unsure (1)..(671): unsure at all Xaa locations
VDGIEVEVPQGATVLQACEAAGKEIPRFCYHERLSIAGNCRMCLVEVKPGPPKPQASCALPAADNQEVRTDSPMVKAAREGVMEFLLINHPLDCPICDQGGECDLQDQSVAYGRGSSRYTENKRAVTEKYMGPIIKTVMTRCIQCTRCVRFGEEVAGVEDIGAIYRGENMQITTYLEKAFKSELSGNVADLCPVGALTHKPVAFEYRPWELKRNLSIDVMDAVGTNIRLDSRGRQVMRVLPRINEDVNEEWAHDKTRYHVDALVRRRLDRPFVRKHGKLVPASWEEAFDAIAGVAANAGSSVAAIAGDLLDAETMYAAKALVKAFGSDLLEGRQTGMAYDTSSLSAVAFNTTIAALEDADAILLVGTNLRWEAPLVNTRVRKAIKRGAKVFAIGPQVDLTYKVEWLGDDLGLLNSLPENLAQAIDNAKKPALILGPGALKNGHGAALAIAGAFQRAATETEAAWNGFNVVHTAAARMAGLMLGYAQKGGIADIVAASPKLAFFLGADEVDFSKFTNSFKVYIGHHGDQGAHHADVILPGATYAEKPGTYVNLEGRVQRADRAVFAPGEAREDWTILRALSEKLGRTLPFDSFDELRAAMASEVPALGQEGLAEFAWNPPSLAAQASGPVTYPVADFYLTNAICRASPTMQRCSAELLHGEAFAEAAEXSAC

SEQ ID NO: 17986 - protein, 338 aa, SPHINGOMONAS
NPLGLNGFEFVEFTSPDPDAMARQFEQLGFVASHRHPRKNITRYKQGRINLMLNRDDAGRVAAFRGEHGPSASAMAFRVADPKKAMEWALAHGAKPTDEDDTVIQGIGGSYLYFIQDEIDLYADWAEFPGWREAEAANSVGLDLLDHLTHNVRRGQMRVWSEFYRTLFGFEEQKYFDIKGKATGLFSQAMIAPDKAIRIPLNESQDDASQIEEFIREYNGEGIQHLALTTDDIYDTVERLRARGVRLQDTIETYYELVDKRVPGHGEDLERLRKNRILIDGSVENDEGILLQIFTETMFGPIFFEIIQRKGNEGFGNGNFQALFESIELDQIRRGVIK

SEQ ID NO: 17987 - protein, 429 aa, SPHINGOMONAS
RTSLVTTYFPGFGNHVSTEAVPGALPIGRNSPQRPPYGLYAEQLSGTAFTAPRAENRRSWLYRLRPSAEHPPYQPYAGAPLFSPHTPAKPLAPNRLRWNPIPTPTTLVDWIDGVETMLATRDPADLEGVVVHRYAANRDMHNRAFVDADGELLFIPQAGALTLLTELGRIDIAPGQIAVIPRGIRFRVLLPEGSAAGYVAENYGAPFRLPDLGPIGANGLANPRDFETPAAWFEDRDEPFQLVQKSLASLWITTLPHSPLDVVAWHGNLAPYRYDLARFNTINTVSFDHPDPSIFTVLTSPSTVAGRANADFVIFPPRWMVAEDTFRPPWFHRNVMSEAMGLIHGAYDAKAEGFAPGGLSLHNLMAGHGPDVASWRGATNAALKPHKIDGTMAFMVETCWPYRPTEHALAQAQPDYDTVWEGFPKAQLP

SEQ ID NO: 17988 - protein, 386 aa, SPHINGOMONAS
WRGTSMTPDFDFALGDSADMIRDTTARFARDRIAPLAARIDAEDWFPRDELWAAMGELGLHGITVPEADGGLGLGYLEHVIACEEVARASASIGLSYGAHSNLCVNQIARWGNAEQKAKHLPKLISGEHVGSLAMSEAGAGSDVVSMKLKAEKTDRGYVLNGTKFWITNAAYADTLVVYAKTGEGSRGITTFLIEKDMPGFAIGQKIDKMGMRGSPTAELVFTDCEVPEANIMGPLNGGVGVLMSGLDYERAVLAGIQLGIMQACLDVVLPYLRERKQFGQAIGSFQLMQAKVADMYVALNSARAYVYAVARSCDAGKTTRFDAAGAILLASENAFRVAGEAVQALGGAGYTKDWPVERFLRDAKLLDIGAGTNEIRRMLIGRELL

SEQ ID NO: 17989 - protein, 642 aa, SPHINGOMONAS
SGAPPVIQSLLIANRGEIACRILRTARAMGIRTVAVYSDADANALHVRQADDAVHIGPSPARESYLVGEKIIAAAKATGAEAIHPGYGFLSENAEFAEAVLAAGLVWVGPKPDSIRAMGLKDAAKARMIAAGVPVTPGYLGEDQSPERLQAEAEAIGYPVLIKAVAGGGGKGMRRVESAGDFADALASCKREAASSFGDDRVLLEKYILSPRHIEVQVFGDSHGNVVHLFERDCSLQRRHQKVIEEAPAPGMDAGTRAAICGAAVRAAQAVDYVGAGTIEFIADASEGLRADRIWFMEMNTRLQVEHPVTEEITGVDLVEWQLRVASGEPLPKRQDELSINGWAMEARLYAEDPAKGFLPSVGRLEIFRPSPDVRYETGVYEGAEITGFYDPMIAKIVVHAESRLDACEALAQACAATDIFPVKTNAPFLWRALDDQDFRAARINTGFIAEKGDALLPPAEPTDDMVKQAAAALIVQEYQGAPTMLHGWDDDLLGAPQPHPWRGALGFRLNAAVNRRVAVAVDGKVHVTELPANWRNATVIAEPVADGVAVNDDGLSFLAALPRTGPTSGAAAADGALLAPMPGRITAVDVAPGAQVTKGQRLVTLEAMKMEHALTAPFDGIVAELPVTAGGQVTEGSLLVR

SEQ ID NO: 17990 - protein, 389 aa, SPHINGOMONAS
IVILSYARTPMGSLQGSLADASATDLGATAVGAAVERAGLKGEAIERIYMGCVLPAGLGQAPARQAALKAGLPQHIEATTINKMCGSGMQATIMAAEALAAGSVDLLIAGGMESMTNAPYLSMRHRSGARIGHDVLKDHMFLDGLEDAYEPGRLMGSFAEETAKEYQFTREAQDAFAIASLERAKAAQTSGAFDREIVPVELQGRKSVTTVALDEQPTKADPAKIPTLKPAFTKDGTITAANASSISDGAAALVLARASVAEKLGLTPIARIVSHAAHAHAPARFTTAPVFAMRKALEKAGWETGDVDLFEVNEAFACVTMIAMQELGLSHEAVNVHGGACALGHPIGASGARVLATLLSALETKGQKRGLASLCIGGGEATAVAVELM

SEQ ID NO: 17991 - protein, 669 aa, SPHINGOMONAS
FKKILVANRGEIACRVMRTARKMGIATVAVYSDADARAPHVRMADEAVRLGPAPAAESYLKADLILQAAKETGADAIHPGYGFLSERESFAKACAEAGIAFVGPPPSAIAAMGDKIESKKLAKQAGVNVVPGFLGEIADTEHAVRIATEIGYPVMMKASAGGGGKGMRLAYSEQDVREGFEATKREGLASFGDDRVFIEKFIESPRHIEIQVLGDQHGNIVYLNERECSIQRRHQKVVEEAPSPFVTPAMRKAMGEQAVALARAVGYYSAGTVELIVSGADKTGQGFYFLEMNTRLQVEHPVTEAITGLDLVEQMIRVAAGEKLAFGQDEVKLDGWAIENRVYAEDPYRGFLPSTGRLVRYRPPVAENAGEGYVRVDDGVTEGSEISMFYDPMIAKLITWAPTRDEAADLQVRALDRFRIDGIGHNIDFLSAIMQHPRFRSGELTTGFIAEEYPEGFHGAPADAALVRKLAAVAVVLDLARTTRAAAISGQLGDQPARSTARSVRIGEHQFDASVEDRGTDMLVTLSGSEAPLAVSGTWRGGEPQFAATINGAEFATAVDRLRTGWKLTAHGAAHRVEVLPLHVAPLRRYMIEKVPPDMSKFLLAPMPGLLTRLHVQPGDKVEAGQPLAVVEAMKMENILRAERAGTVKLAHFSAGDSLAVDAPILEFE

SEQ ID NO: 17992 - protein, 320 aa, SPHINGOMONAS
LRLRRSRASAWSRRLHAETVLTPADLIWPVFVTEGSAEEPIAALPGVSRWGLQGIVERAREARDLGIPCLALFPNTPHALRTEDGREAVNPDNLMCRAIRAIKDAVPEVGVLTDVALDPYTSHGHDGIVDGAGYVLNDETSAVLTEQALVQAAAGADIVAPSDMMDGRVGQIRSALEANGHVNVQIMAYAAKYASAFYGPFRDAVGSRGLLKGDKKTYQMDPANAEEALREVALDLAEGADSVMVKPGLPYLDIVARVKSAFEVPVFAYQVSGEYAMIEAAAAVGAGDREALVLETLMAFKRAGCTGVLTYHAPLAARLL

SEQ ID NO: 17993 - protein, 140 aa, SPHINGOMONAS
MAATRTFSIIKPDATRRNLTGAVTKMLEEAGLRVVASKRIQMSREQAEGFYGVHKERPFFNDLVEFMISGPVVVQVLEGENAVQRNRDIMGATNPANAEPGTIRKELAESIEANSVHGSDSEENAAIEIAFFFKPEEIVG

SEQ ID NO: 17994 - protein, 405 aa, SPHINGOMONAS
FTLNARETHFRDRVKAFVDAEIRPRETDFRAAAATADRWSVNPVLEAVKARAKAAGLWNFFMPPHSGQSHVDDSFVFEGEQLTNLEYALCAEEMGRVGWASEVFNCSAPDTGNMEVLHRYGTRAQKDTWLAPLMRGEIRSAFLMTEPDVASSDATNIETRIERDGDQYVINGRKWWSSGAGDPRCKIAILMGKTDFSAAKHAQQSMILVPLDTPGVTIERMLSVFGYDHAPHGHAEILLRDVRVPVENLLLGEGRGFEIAQGRLGPGRIHHCMRTIGVAEEAIAAMAKRLVSRVAFGKRIADHSIWEQRVARARIDIEMTRLLCLKAADMMDKAGNKAAQLEIAMIKVQAPAMALQILDDAVQAHGGAGVSDDFDLAHNWGSIRTLRLADGPDEVHARAIARAEF

SEQ ID NO: 17995 - protein, 359 aa, SPHINGOMONAS
KAAVLFEANTPLQIEEVEVSSPGPREVLIRTAAVGVCRSDLHFVDGAFPHPVPTVPGHEAAGVVEAVGSDVARLRPGDHVITFFTAFCGSCELCVTGRPSLCVDPSTQRPADAEPRLKLKSGTPLAPFLNLSAFAEMMLVHENACVAISKAMPLDRAALLGCAVITGAGAIFNDSRVRPGESVAVIGAGGIGLAAVNAARIAGAGQIIALDPVEEKRALARKMGATHVLDPGAEGVVKQLLALTGGGVHYAIEAVGRPATAELAWQILRRGGTATILGMIAPGQGVSLPGPSFLTGKKIQGSLLGSTRFPIDMPRLVQLYLDGVLDLDTMVAERIRLPQVNDALDKLRQGTSVRSVIEF

SEQ ID NO: 17996 - protein, 248 aa, SPHINGOMONAS
FTGKVAVVTGAASGIGRATVRAFAAAGAQVVAADRAAAVHETVVGLRDTLAVEMDAGDEGDIQRLVEAACDRFGGIDIFYANAGISGGAAGIFDADIALWTEVLRVNLIGPALAIKHAAPHIVQRGGGAILCTASVAGLRSGAGGTPYSASKAGVINLVQTAAQQLATSCVRVNAICPGLIETGMTQRAFDHARERDKEDKLGQLNPLRRAGRPDEIAQVALFLASDAASYVNGQAIAVDGGLSASHP

SEQ ID NO: 17997 - protein, 147 aa, SPHINGOMONAS
NIGPLDIGRVMAALPHRFPMLLVDRVEELILDQSIVAVKAVTINESFFQGHFPGRPIMPGVLTVEALAQAAGVLAVESLGLAGSGKLVYFMAIDNVKFRKPVEPGVLLKLHVEFVQKRSRVCKFAGKALIDGELAAECEFTAMIADP

SEQ ID NO: 17998 - protein, 230 aa, SPHINGOMONAS
LQIVRLPAFTDNYLWLVHDPVSAETIVVDPGASEPVLAALDERGWTLTAIWNTHWHPDHTGGNAALKTATGCTVIAPAAEAAKIPTADRLVADGDVVAIGAHQAAVIAVPAHTAGHIAYHLAEDAVIFVGDTLFAMGCGRLFEGTADDMFAAMRRLDALPGETRVYCAHEYTLSNARYAVVAEPDNAAIAVRLAEVERLRAAGEATVPTTIADERATNPFLRAADAVILA

SEQ ID NO: 17999 - protein, 255 aa, SPHINGOMONAS
KSAIVTGSTSGIGLAYAKALAAEGANVLINGFGDAEAIEKERAALAEASGGKALYDAADMTKPDQIAAMVARAEAEFGAVDIAISNAGIQHVAPIDEFPIEKWDAILAINLSSTFHLMRAAIPGMKARKWGRIISTASAHSLVASPNKAAYVAAKHGLAGLTKTAALEVATHGITVNCISPGYVWTPLVENQIPDTMKTRGLTREQVINDVLLDAQPTKQFVLPEQVAALAVFLCRDEAAQITGSNYSIDGGWTA

SEQ ID NO: 18000 - protein, 329 aa, SPHINGOMONAS
QRHGAVSLLAHPSPIERLARLEAALGTGVQIYAKRDDVAGIGGGGNKLRKLEFLLGDAIARGCDTFVTTGGLQSNHARLSAAAAARMGLACELVLADVVPRHDPDYRGNGNLLLDAIFGATVHRVPGDTDPLAFAHTRAATLRAAGRKPYVVGAGGSSPVGALGYVACAWEILDQEAALGERFARIVVPNGSAGTHAGLAAGMAAAGAEVARVQSYAVLAAPERAHAETLALAEATLAANALPGSVSAAEVVIDGSQRGPGYGIPTEAMREAVELLARTEGLLLDPVYSGKAFAGLLAAIRGGAFQPGEAVLYVMTGGVPGLFAYREVF

SEQ ID NO: 18001 - protein, 281 aa, SPHINGOMONAS
LWTGVYPAATTQFAEDLSIDFDATQRTQIALVDDGVDGLILLGTCGENNSLEPDEKRQVLRAGVEAVGGRVPLVAGVSEFTTARAIDYARDAEKIGVDALMLLPAMVYVPTAAELEAHFRAVAAATTLPIMLYNNPPAYRVSIDTATLDRLTDVKNIVAVKESAPDPRRFTDLFNRYGDRYTLMAGLDDVALEGLFLGASGWVSGLTSAFPEESVRLVAAFNEGRFDEARAIYRWFMPLLHLDAEHDLVQSIKLAEQIMGRGSERVRLPRLPLAGERRAQV

SEQ ID NO: 18002 - protein, 450 aa, SPHINGOMONAS
SSEHRLRPSLSWPHLIALGVGAIVGTGIYTLTGVGAERAGPAVILAFVIAGAVCACAALAYAELATMIPAAGSAYTYSYSVLGETIAWVVGWSLILEYSLACSAVAVGWSGYLVGWLQSAGVHLPPLLLEGPHAGGLVNLPAVLVSFAIAGMLMLGTRESATLNIVLVVIKLVALGLFVALALPGFDAANFHPFMPHGFASHAEGAVTRGVMAAAAIVFFAFYGFDAVATSAEEAKKPGRDLTIGIVGSMALCTTIYILVAVAAVGAMPTATLGNSPEPLALVLRTLGHPFAAWAIAAAALVALPSVILVMMYGQSRIFFVMARDGLLPRALAKVSPRTGAPVLVTGITGLFVAGVAGFLRLDEIAELANAGTLIAFIAVGACMMLLRRRAPDAPRIFRCPQPYVVGTLAVLGCLYLLFSLPEKTLVRFLLWNVAGLAVYFLYGRARSVL

SEQ ID NO: 18003 - protein, 700 aa, SPHINGOMONAS
FVRLDGRATCLIVDCRGEAPAILYWGRRLPDDLDPAALALLGVRQEAPCSPATTPPLGLTPLIGAGFPGRPGLSAHRDGQGWATWTAITAIHRIDAATVEIDSEDTAHGIGLVHRLHLAGDVLRMRTTLINRGDTALSVEACDAPALPAPEAVTDWTLFEGRWSGELQTRRVARAMGAVARENRRGRTSHDAFPAILAEVGPCGEQAGEVFGVQLAWSGNHRLWAETLSDGRAYLQLGELFLPGECRLAPGARYTSPDLVCAWSDAGRSGLARAFHAHVRARPQHDRLRAKPRPVHYNTWEAVYFDHKPAALMALADKAAAIGIERFVLDDGWFLGRRDDTVGLGDWIVDPAIYSDGLGPLVAHVRKLGMEFGLWVEPEMVNPDSELFRAHPEWVLGTPPAPQLRFRNQLVLDFGQAAVREHLFERIDALLREHAIAYLKWDMNRDITHPGGAGGAAGAHAHVLGLYEVLARLRAAHPSVEIESCSAGGGRTDFGILDYTDRVWTSDTNDALDRLTIQRGLSTFVPAELMGAHVGPADCHITGRRVGMATRVATALFGHFGVEADLNAMEDAERAELAAGIALHKRHRALIHTGDLYRLDRPESEIAFGIVAADQREALFSYTQVTEPRGYFAAPLRLDGLDPAARYRVTLAWPGSGYPASPLFAALGEGAVFSGAALMAAGLQPPRLKPQAAFLLHLER

SEQ ID NO: 18004 - protein, 652 aa, SPHINGOMONAS
VLGVCYYPEHWSRALWAEDARRMKALGLRYVRIGEFAWSRLEPEPGTYDFAWLDEAIETLAAAGLEVVLGTPTATPPKWLIDRYPEILPVDPETGRTRGFGSRRHYDFSSDVYLRESERIVTALAERYGSHPGVVGWQTDNELCCHLTTLSASPVARDAFRLWCKARYGTIEALNTAWGNVFWSMEYRSFDEIELPVGAVTETSPAHRMAWRRFSSDQVARYHDAQVAILRRLSQGKFITHNFIPMNETGVDNHRLARDLDFAAYDNYPLGRTDLWMADAPAEEFRRYMRTGHPDFGAFFFDQTRGLAPGAFWIMEQQPGPVNWAMHNPRPAPGMVRLWTLEAFAHGAGVVSYFRWRQAPFAQEQMHAGLLRPDSSAAAAWPEVEAVVRDLALLGLEERPRGRARVALVVDVEAQWLGDIERQGDSYDYTRILLGYYQAFRRLGVDVDFIAPDGDPADYRLIVVPSLAIARADTAAHLARGGAVVLYGARSGAKTEDFTLPETLAPGALQAVLPIQVQSVETLRPGCEGSIAWNGRVYPSGGWREELGLDASVETLGRFEDGGAALVRKDKALYLATLSDATLLTDLLEALCAEVGVATVRLSEDLRICRRGGLVFAFNYAETAAMAPAPQDATFVLGGHTIAPRDVAIWSE

SEQ ID NO: 18005 - protein, 341 aa, SPHINGOMONAS
RGVDRMKALVCVGPHQAHIEERPRPEPREGEVLIRMRRVGICGTDYHIFDGSQPFFTYPRLIGHELSGEIAEAPEGSGLAPGDIVTVNPYLPCGTCVACRRGRPNCCSRISVLGVHADGGMAEYMTAPLHAVIPTPGLSLDHAAMVEFLAIGAHAVRRAAIEPGARVLVTGAGPIGIGCALFARIAGAAEVTLLDRSARRLATAAEAFGFTDGVIAGPEATEQLEARTGGEMFDYLFDATGNIQAMNAGLANLAHAGTYVLVGLNRDTLSFPDPEFHKRETTLLASRNALSADFEQVVAAIRDGTIPIDRFLTHRVALAEAPAALPGLIAVQESVLKALVT

SEQ ID NO: 18006 - protein, 245 aa, SPHINGOMONAS
LEGKTVLVTGGSTGIGRAAAIGAAEAGADVAINYHSRDDDAAAVVAAIEAKGRRGLAVKGDVADPATATDFVARAVDALGKVDVLVSNAGICPFHAFLDMPAETVQRTMQVNLLGGYFMCQAAANQMVAQGHGGAIVAVSSISALVGGEYQTHYTPTKAGLHSLMQSAAIALGRHGIRCNSVLPGTILTEINKDDLADDEKRKYMEGRVPLGRLGQPEDLAGPIVFLASDMAAYVTGAALLVDGG

SEQ ID NO: 18007 - protein, 239 aa, SPHINGOMONAS
RFAGRTAVITGGASGLGLAVARRMEAEGGQVALWDLNPDQLAVAAAELGGAHVEQLDVSDAEAVARAADATAAALGRIDILVCSAGITGATVPVHEFPLDSWRRVIDINLSGLFYCCRAVVPHMLANGYGRIVNVASVAGKEGNPNASAYSASKAGVIGFTKSLGKELAGKGVIANALTPATFESPILAQLPPSQVEYMRSKIPMGRLGEAEESAAMICFMASEECSFTTASTFDTSGG

SEQ ID NO: 18008 - protein, 557 aa, SPHINGOMONAS
SMTKPEMVWKTAYRHPGEWDRSYAPRSMVDLFEESAAAHPHAPLLDFMGRIYSYGETLDGANRVACGLRALGYGPGDRIGLFLPNVPHYVAAYYGILKLGATVVNFSPLYSVEELAAQVADSGTRLLFTLSATALLPTALKVLEKSDLERLVVGSVAGALPTAKSLFYQLFRGSEVTARPHDPRILAFSKLIANKGDCTIPDIDPERDIALIQYTGGTTGTPKGAVLTHQNLSANARQVRSWIPSAASRRISVLGVLPFFHVFANTCVLNRTVINGGKIIMLPRFNAQQVLTELRRTRPRSLPGVPTMYQALLDAPGMQPSDFSSLRFCISGGAPLPEQLKLNWESTTGAHIIEGYGLSESSGVVSANPYVGLNKSGTIGQPIAGTRVRLVDKEDPRKPAPEGEPGEIVVQGPQIMRGYWNRPEADAGTFVDDHWLRTGDVGIIDEDGYIQIVDRLKDMIAVGGFKVFPSQIEAVLYTHPAVKETLVLGLPDPYHGELPHAYVALNDGMTADAKEMCDWLNAQLGKHERVKEVVIRDSLPKTMIGKLSRKDLLNEVK

SEQ ID NO: 18009 - protein, 446 aa, SPHINGOMONAS
INPATGETVDRIAELDDAGIEAALARGAAGYKQWRETSIETRTALLTRIADSWEADKQHLAELAVREMGKTITSALAEVEKCISGFRHYAEHGPAYLEPTTVKTASGHAVARWLPLGPVLAVMPWNFPYWQAVRFLAPTILAGNVALLKHASSVQGCAAAMEAMARKAGAPEGLFQNLAIKSDKVDAIIADKRVVAVTLTGSEGAGAKVAEAAGRALKKVVLELGGSDPFIVMPSADLDAAVKTAVTARVQNAGQSCICSKRMIVHADVYDTFLEKFVAGMAAVKIGDPMDKETVMGPLSSTQQRDTVLGQVARATAEGARLLTGGATIDRPGAWMMPGVLVDIDPESDVAKEEIFGPVAAVYKVADIDEAIALANDVPYGLGSSVWTQDEGEIERLAREIEAGMTAVNTLLASVPEAPFGGVKLSGHGRELGPWGLHEFMNLKAV

SEQ ID NO: 18010 - protein, 294 aa, SPHINGOMONAS
SLALESALRQVAAEIDDQFDRLLEVPDDPRADLYRAMRHAAIGGGKRLRPLLVFATAQLFSVDKSCAARVATALECIHVYSLIHDDLPAMDDDDMRRGKPTVHKAFDEATAILAGDCLHDLAFELLAHEATHADPFVRVELISELARSSGPAGMAGGQMMDLEAEKASFDLATVTRLQALKTGALISCAVECGAILGRVPHEGRTGLRGYARDIGLAFQIVDDILDAEGDEAVVGKKLGKDGAAGKETFLSLLGIDRAREQARMLVDQAIAHLHAYGPQADLLRDVARFTLERD

SEQ ID NO: 18011 - protein, 248 aa, SPHINGOMONAS
RVGDTYGVTRPRARARASPMTTHILLTGSSRGIGAATAVLLGDDARVKLVGQGTRSGIPADFTDPAAPQALWQQALDALDGRIDVLINNAGIFEANPLDAEHDDWVEGWERTMRVNLTASAELCRLAVRHWQDSGTGGRIVNVASRAAYRGDSPAHWHYAASKAGMVGMTKSIARGYAGEGILAFAICPGFTMTGMAEDYLASRGGDKLLADIPLGRVASPEEIAAIAKFCALDAPPSMTGAVLDANG

SEQ ID NO: 18012 - protein, 597 aa, SPHINGOMONAS
AYKIIDHIYDTVVVGAGGSGLRAVMEVAQSGLKTACITKVFPTRSHTVAAQGGIAASLGNMGPDHWTWHMYDTVKGSDWLGDQDAIEYLTREAPAAVYELEHAGMPFSRTDEGKIYQRPFGGMMQNMGEGPPAQRTCAAADRTGHAMLHTLYQQSLKYDADFFIEYFALDLIMENGECRGVIALCMEDGSIHRFRSHAVVLATGGYGRVYQSATSAHTCTGDGNAMVLRAGLPLQDMEFVQFHPTGIYGAGVLITEGARGEGGYLTNSEGERFMERYAPSAKDLASRDVVSRSMAMEIREGRGVGKEKDHIFLHLNHIDPKILAERLPGITETGKVFAGVDLTRQPLPVVPTVHYNMGGIPTNYHGEVVHLKDGNPDAVVPGLFAVGEAACVSVHGANRLGSNSLIDLVVFGRATGKRIVDILKPNTPHHPLPKDSEALALGRLDHFRNANGGTRTAQLRADMQKTMQRHCAVFRTEELMAEGVSHMEQVYKGLEDVHVSDRSLVWNTDLVETLELDNLLGQAMVTIRSAINRKESRGAHMHEDFPERDDAEWMKHTIATFDGWGGKGGKTDIDYRPVHDYTLTDAIDYIKPKKRVY

SEQ ID NO: 18013 - protein, 473 aa, SPHINGOMONAS
MTQAISPRSRKVRVLATLGPASASPEMIEKLFRAGADAFRINMSHGDQASKIPLFEAIRGLEAITGRPTTILADLQGPKLRVGKFAEGKVMLVTGHQFTLDRDPTPGDATRVELPHREIFEAAHPDARLLLDDGKLVLRVTDVAPDRLTTIVEVGGPLSNNKGLNVPDMVLPLAALTEKDRSDLSFAVEQGADWIALSFVQRPEDLMEARRLIGGKAALLAKIEKPSAIARLEEILEQCDGVMVARGDLGVELPPQQVPPLQKRIVESARRLGRPVIVATQMLESMIESPSPTRAEVSDVATAVYDGADAIMLSAESAAGKWPVESVSMMNSIADAVERDPAHGDRVHFTVLKPDPTTADALSEAAKNIASTISAAAIICFTSSGSTARRIARERPSVPILVLTPERETARRLGLLWGTHAVNTRDVDSFEEMVAKAKRMALRHGLAKAGDRVIVCAGVPFKTPGSTNVLHVV

SEQ ID NO: 18014 - protein, 401 aa, SPHINGOMONAS
DDDVARNVTHIIKRVRDEGDVALRDLTRLFDKHDLAASGWTIDRADCLAAYEGLTPELRDALELAAERIAVYHAKQRPEDRDETDPQGIRLGARWTPVDAAGVYVPGGRAAYPSSVLMNAIPAKAAGVRRLVMVTPTPNGEVNPLVLAAAHVAGVDELYRVGGAQAIAALAYGTDTIAPVDVVTGPGNAWVAEAKRQLYGVVGIDMVAGPSEIVVVADGKNDPEWIAADLLSQAEHDPTSQSILFTDDAAFADKVAAAVDAQIATLATGATARTSWDANGAIILVPDLPTAMPLVDRLAPEHLELACDDAEALFDMVRHAGSVFLGRYTPEAVGDYVAGPNHVLPTGRRARFASGLSVLDFMKRTSFLSLDPSGLAAIGPAAVALAEAEGLPAHAKSVAIR

SEQ ID NO: 18015 - protein, 218 aa, SPHINGOMONAS
MNRLALFDCDGTLVDSQASICLAMEHCFTGQKLEPPARESIRRIVGLSLVEAIARLLPEAEDDLHRHLAEEYKRAYFALRTAGHIEDEPLYDGIPEAIETLDANGWLLGVATGKSDRGLIRVLEAHGLRRHFVTLQTADRHPSKPHPSMIETAIAEAGASPETTVMIGDTSFDMAMAVAAGAHPLGVAWGYHTPHDLHAAGAVRVVEHASAIPAHLEA

SEQ ID NO: 18016 - protein, 491 aa, SPHINGOMONAS
KGKLTSVADPAWVRGPGRLNRAQSKRRNAVTATRTETDSIGAIEVPAHAYWGAQTQRSIQNFPFGPEERMPIGIVHAQAIVKQAAARVNVKHGLDPEIAEVIDQVAQEVIDGTLDDQFPLVIWQTGSGTQTNMNVNEVIAGRANEILTGNRGGKSPIHPNDHVNMAQSSNDSFPTALHIAAARAVTLDLFPALERLHASLDRKAQEWDHIVKIGRTHLQDATPLTLGQEFSGYAAMLASARARFQSVLELDIFKLALGGTAVGTGLNSPPGYAEDVAAEIARITGLPFVSAPNKFEMLATKDQLVNLSGVCNTLAVSLTKIANDIRLLGSGPRSGLGELELPANEPGSSIMPGKVNPTQSESLTMVAAQVIGNHTAVTVGGMQGHFELNVFKPLIGANVLRSITLMAIGMTNFAERAVDGAIANEARIKELVDRSLMLVTALAPAIGYDNAAKIAKNAHEKGLTLKESGLALGLVDEATFDAFVRPETMTG

SEQ ID NO: 18017 - protein, 635 aa, SPHINGOMONAS
MAKVIGIDLGTTNSCVAVMEGGKPKVIENVEGARTTPSIVAFAKDGERLIGQPAKRQAVTNPDSTIFAVKRLIGRRFDDPVTKKDTELVPYTIARGPNGDAWVKAGGEEYSPSQISAFILQKMKETAESYLGESVTQAVITVPAYFNDAQRQATKDAGKIAGLEVLRIINEPTAAALAYGLDKDNNKTIAVYDLGGGTFDISVLEIGDGVFEVKATNGDTFLGGEDFDSTVVQYLADEFKKAEGIDLTKDKLALQRLKEAAEKAKIELSSAQTTEVNLPFITADQNGPKHLVKSITRADLERLVDDLIKRTLEPCRKALADAGVKADAIDEVVLVGGMTRMPKVRQVVKDFFGKEPHTGVNPDEVVAIGAAIQAGVLQGDVKDVLLLDVTPLSLGIETLGGVFTRMIDRNTTIPTKKSQVYSTADDNQQAVTIRVFQGEREMAADNKLLGQFDLVGIPPAPRGVPQIEVTFDIDANGIVNVSAKDKGTGKEQQIRIQASGGLSDGDIEQMVRDAEKFAEDDKKRRAAAEAKNNAESLVHTTERQLAENGDKVDASLKGEIEAAIAETKSAIESGDADAMTAKAQNLAQVAMKLGQAIYEKTAAENASPNAGAAAGGEAGAEEVVDAEFSEVDDNK

SEQ ID NO: 18018 - protein, 195 aa, SPHINGOMONAS
  unsure (1)..(195): unsure at all Xaa locations
ATISRKTSETSIDVTVNLDGTGVYTIHTGIGFFDHMLEQLSRHSLIDMDVKTVGDLHIDQHHTVEDTGLAIGEAIAKALGDKKGIRRYADALSPMDETLTRVAIDISGRPYLVWKTEFSQKKLGEMDTEMFEHWFHSFAQTAGLTLHVETLYGSNNHHIAEAAFKGLARALREAVEIDPRKAGVIPSTKGVLXXS

SEQ ID NO: 18019 - protein, 100 aa, SPHINGOMONAS
LDTLEQTIRDRRLGDPATSYVAKLTARGRAKIAQKLGEEATEAVIAAIQDDRGELVKESADLLFHLLVLLADMGLSLDDVRAELARREGVSGIAEKAARG

SEQ ID NO: 18020 - protein, 485 aa, SPHINGOMONAS
IFGRVKPLDAILATAEKKSLHRSLGAFQLTMLGIGAVIGTGIFVLTAEAAQKAGPGMMISFVIAGFVCAVAALCYAEMAAMVPVSGSAYTYSYAVMGELVAWMVGWALILEYAIAAGAVSVGWSGYMMGFIQNNFGIVVPLQLIRGPFDGGMINLPAMAVAAVVTALLVKGTKESATVNAVLVGIKILALAMFVIVTIPVLKTGQFTPFAPLGFAGISGAAASIFFAYVGFDAVSTAAEETKNPQRNMPIGLIGSLAICTIFYMLVASGVIGTVGAQPVHGPAGEVLSPGTPALSQACAAMSEQAVVCSKEALAWTLRSIGHPFLGWLVGAAAIIALPSVILMMMFGQTRIFFVMSRDGLLPAFFSRVHPKFHTPHVITILTGIFVSLFAAFFPVGLLADVSNSGTLFAFAAVSIAVIVLRKTDPTRHRPFRTPAIMVTAPIAIAGCVYLFFSLSGPTIALFFGWAAIGLVVYYGYSRSRSHVGR

SEQ ID NO: 18021 - protein, 318 aa, SPHINGOMONAS
YDVVAIGNAIVDILAQADDAFIESIGVPKGSMQLMFSPEEADALYAKMGPGREVSGGSAANTVAGIAALGGTAAFIGQVADDQLGTVFAHDIRAAGVHFDTAVRPGQPTTARCLIFVTPDGQRTMNTFLGASQFLPAAALDEQLIANGAILYLEGYLWDPEEPRAAMRKAIEIARAAGRKVAFTLSDVFCISRHGDDFRKLIADGLIDILFANEAELLALCAHEDFEAAVQHIHGKVPLLVVTRSEKGAIALQGDERVEVSAEPIAALVDTTGAGDMFAAGFLHGQAQGKGLEESLRLGAICAAEIIQHYGARAEKDL

SEQ ID NO: 18022 - protein, 618 aa, SPHINGOMONAS
  unsure (1)..(618): unsure at all Xaa locations
PIFRVSMSISNLPTRLAEALEQRGYSTLTPVQSAVLEDQAAGRDLIVSAQTGSGKTVAFGLAMAPELLAGEEMLPPAGAPLALIIAPTRELALQVSRELIWLYSPAGARIATCVGGMDASKERRTLNHGAHIVVGTPGRLRDHLERGALDLSSLRVAVLDEADEMLDMGFREELEAILDATPEGRRTLLFSATMPRPIVALAKRYQRNAFQITTKSDDRGHGDISYQAVTVAPADIEHVVINLLRLHEAETAILFCATRDNVRHLHASLMERGFAAVALSGEHSQSERNHALQALRDRRARVCVATDVAARGIDLPTLTLVVHVELPRDAETLQHRSGRTGRAGKKGTAVLIVPYPRRRRVEQMLHGARIPAVWIDAPTPEQIRAADRERLIAALLQPIETDEEDVALAERLLAEKTPAEIAAALVRAHRSQLPEPEELIEATPEARRAAQQERHRPGFDDTVWFRMDIGRRQNADPRWILPLICRRGHITRNEVGAIRIAANETHFQIPSQLAAKFAAASTSSRARPAMTMTASASSARPKRRSRARVPMVRRVAVLRTAATPTASPAASARARRAAEDWGAPLPEVEGERLALLXSCHPGESRDPFATAPKQKPHR

SEQ ID NO: 18023 - protein, 855 aa, SPHINGOMONAS
TPMMAQYLALKEEAGDCLLFYRMGDFFELFFDDAKIASSVLDIALTSRGEHEGDKIPMCGVPVHAMEAYLARLIKAGHRVAIANQTETPEEAKKRAGSKALVARAIVRVVTAGTLTEEALLDSRTANWCVAVGEAGGGVAIACADISTGRFELIETDAARLEAELARLNPAETIACDATEFAELTTALRPKVDFDSAGGEARLKRLFGVATLDGFGQFSRAGLAAAGGLVAYLEHTAKGSLPFLRPPRVSRAEAAMAIDAATRESLELTVSAAGARKGSLLDAVDRTVTGAGARLLGADIAAPLMDRAAIDARLDLVTLFHDDAGLRDGIRATLRALPDIGRALGRLAAGRGSPRDLGQLRDGLDGAWRLGARIDRLTDAPALLRELAPQLRGHGALIDLLTRALVPEPPVDARHGGYIAEGYDAALDDLRDAGAGGRRAIAALEGEYRTRTGITALKIRHNGVLGYHIEVPARSADALMKPDSGFTHRQTLAGVVRFNAPELHDVAVKVTQAGAHALSAEAAHLEDLTAQALARREPVAATADALARIDVAAGLAERAAEGGWARPELVEHRCFEIEGGRHPVVEAAVARAVGRFVANQCRLSEDSHLWLVTGPNMGGKSTFMLHNPLIAVLAQAGSYVPPTRPTLGLVDRLFSRVGASDNLARGRSTFMVEMVETAAILAQATPRSFVILDEVGRGTSTYDGLAIAWAVVEAIHEDNRCRCLFATHYHELTRLAERCDALTLHHVRAREWKGDLVLLHELADGPADRSYGIAVARLAGMSPATVKRAKAVLDKLEAGRAKTGGLAAGLDDLPLFAAAVQAEEEKVDALRQELESIDVDALSPRDALDVLYRLK

SEQ ID NO: 18024 - protein, 228 aa, SPHINGOMONAS
MPTLVLIRHGQSAWNLENRFTGWWDVDLTEQGVREATAAGTLMKEKGLDFDLAFTSFQSRAIKTLHLALEAMDRLWLPEEKDWRLNERHYGGLTGLDKAETAAKHGDEQVKIWRRSFDVPPPLPEAGSPWDLTQDPRYAGIPIPQTESLKDTIARVLPYWEQRIAPELKAGKRVLIAAHGNSLRALVKHLSGIADEDIVSLEIPTGQPIVYQLDDELKEIERYYLSER

SEQ ID NO: 18025 - protein, 595 aa, SPHINGOMONAS
YPVEVDHARDALLTDFGKETLKDRYLLPGESYQDLFVRVASAYADDQAHAQRLYDYISKLWFMPATPVLSNGGTGRGLPISCYLNSVPDSLDGIVQTWNENVWLASRGGGIGTYWGSVRGIGEPVGLNGKTSGIIPFVRVMDSLTLAISQGSLRRGSAACYLDISHPEIEEFLEIRKPSGDFNRKALNLHHGVLIPDAFMEAVRDGREWQLKSPKDGSVRATVDARALFQKLVETRLATGEPYIVFSDHVNSTMPKHHRDLGLKVSTSNLCSEITLPTGRDHLGNDRTAVCCLSSLNLETWDEWNKDKLFIEDVMRFLDNVLTDYIERAPDEMARARYSAARERSVGLGVMGFHSFLQARGIPFEGAMAKSWNLRIFKHVSAQVNEASMALAVERGPCPDAADMGVMERFSCKMAIAPTASISIICGGTSACIEPIPANIYTHKTLSGSFSVRNPYLEKLLKEKSKNSDAVWNSILEQGGSVQHLDFLTPEEKDTYKTSFEIDQRWILELAGDRAPFIDQAQSLNLFIPADVEKWDLLMLHFRAWELGIKSLYYLRSKSVQRAGFAGGVEADNTIEKPKFDLGESTDYDECLACQ

SEQ ID NO: 18026 - protein, 323 aa, SPHINGOMONAS
MSLLEARKTYKPFEYPWAYEYWKRQQQVHWLPEEVPLGEDCRDWAQKLSDHERNLLTQIFRFFTQADVEVQDCYHEKYGRVFKPTEVKMMLTAFSNMETVHIAAYSHLLDTIGMPETEYSAFLQYKEMKDKHDYLSTFGVDSDEDIAKTLAMFGGFTEGLQLFASFAMLMNFPRFNKMKGMGQIVTWSIRDESLHCEGIIKLFHTFCKERNCMTPSVRDDILDMCQKTVRIEDAFIDLVFEMGPVNGMTPKDIKKYVRFIADWRLGQLGLKPIYMIDEHPLPWLAPLLNGVEHANFFETRATEYSKAATRGNWNEVWDSFDKR

SEQ ID NO: 18027 - protein, 181 aa, SPHINGOMONAS
AAHHPGLPGRDPRPRGSRSPDRGRRMTQIRFASPHDVPQILAFVRELADFEREPDAVVATEAMLEAALFGPRPAAEAVIAEGPDGTAQGFALFFQNFSTWTGLPGMYLEDLYVTPAARGAGVGKALLRHLADIAVTRGYGRFEWSVLDWNQSAIDFYRAMGAVGMEEWTVQRVTGDALRAL

SEQ ID NO: 18028 - protein, 440 aa, SPHINGOMONAS
RKYFGTDGIRGATNLSPMTAAMAMKVGMAAGAHFRRGDHRHRVVIGKDTRLSGYMLENAMVAGFTSVGMDVVLVGPMPTPAVAMLTHSMRADLGVMISASHNPYFDNGIKLFGPDGFKLSDADEEAIEALIDGDVALAPSAAIGRARRVEDARGRYIHFAKSTFPSELTLDGLKVVVDCANGAAYQVAPSALWELGAEVVSIGVSPNGKNINDGVGSTAPQVLSETVVGSGAALGIALDGDADRLIVVDETGTVIDGDQLMALIATGWARQGKLAGGGLVATVMSNLGLERHLAAQGLGLVRTKVGDRYVLEKMRGSGYNVGGEQSGHIILSDYATTGDGLVAALQVLAEIVRAGAPASEVLHRFEPLPQLLKNVRFAGGKPLEDARVKDVIAAAEAELKGRGRLVIRASGTEPVIRVMAEGDDRAQVEVVVDRICDAVR

SEQ ID NO: 18029 - protein, 491 aa, SPHINGOMONAS
WTPIQALPTPKLTDLFAADADRLSRLSADVAGIHFDWSKTHLTPEAVAAFAALAQQMDFAAKRDALFAGEVVNVTEGRAAEHTAERYEGAPESVARARSQHARMRGLIDAIEAEALGPIRHILHIGIGGSALGPDLLVDALGRDMDRYDVAIVSNVDGVALENAMDVFDPQATLLVIASKTFTTTETMLNARSALAWMAEGGVEDPYGQVIALTASPEKAMEWGVDETRVLPFFESVGGRYSLWSSIGFPAALALGWDAFEELLEGAAEMDRHFRLTDLAQNAPALAAFADLYYTQARGCETRATFAYDERLKLLPSYLQQLEMESNGKRVTAEGEIVTYPTSAITWGGVGTDAQHAVFQLLHQGTHLVPVEFVGVIEAGDALAPEHHRQLLLNMFAQGAALMAGKGHEDPARAYPGDRPSSTLLLDSLDPRTLGALIAFYEHRVFVNAVLLGINPFDQFGVELGKEMAKAADRGGLDFDPSTNDLIQRAF

SEQ ID NO: 18030 - protein, 705 aa, SPHINGOMONAS
  unsure (1)..(705): unsure at all Xaa locations
PPALLKVLPDSVRSPALVRIRPPSLSIAPLATIDSAPVPVTVIEPPRFRRAPMVVDRVAAEIPPPEVSSKPAATVRPFLATKLPLSVPVADSARSVPLICAPMRSPAVAVAVIACPVSRPPCPSPIVLPSPWRRRSPPASPRPPRPRPRLAIRSMLASPAAVKSPARRRPPSAFTRSASIERPPRPARVPPADPIAPPVTVILPPATMLPPFANAPATVRAASPAAVIVPALLALVAAKASVPSVXRVAAFEKVPAFRRNTPRPXWLSVPPPVATKLPAAMVRSAALACRSPPERSKVPASDKFSGPVSATQSLAPEVTARLPASSASPATCRLAAPSSRREPAAIVATPGVESCAPALATKLPVAPSFSVPPLIAPPARAKSPAVAARSSVPAAVTVPPDTAADCACTQRSPLPPRVPAPVQAPATATRIVSVPVATILPSFTSAPTVASTPWPVMVPLLASVPSMVSVSAPGVEISPALTSDCAARVRPPWPAITPPPSLLAAPRTTKSSDPVAAPIVPVPLASTPADTSSAPASAXIVPPLASTPPIDSRLSPPVPSARIAPAVLTKLPALATNRPFEPIMPPPLDSAALAATVRTPAPECTIVPPLLFKLPLDSVRSAALVSILPPPFSMSPVARTSKGPAPRTWIAPPTLFSPPSVAVSPCAERTAFDVSSRPAPTTMFPLASRFACSIPTTCRARAPPS

SEQ ID NO: 18031 - protein, 818 aa, SPHINGOMONAS
  unsure (1)..(818): unsure at all Xaa locations
APETVPPVIENAPPVAWARSMPAALSVPPAERIASPFSDTSPFPPSVPLLARRPVTDTASASVPSATICPLLLSASLPIVTPCSPETRPLLTSAPVLVTVVARPDSVPALFSVPAATETAPLATICPVARLSSAPSMTRETAPAPAFSIPPLLLSMPACSSRSPPLTCRVPLLASVPVRLTAPDRAPSSVPPKLERVAAESEKLPDESIARSVTIACAAVSSTRSATRVAPPRPRPPPVAAKASPVPKLNCAPPASISAARSVPALAPTTTASRRSTAPVATIATAPSLDRNCPPRADRSPAESESGPAAXKRPDSVAIASPETDSAPPAKIEPLAPESAPLVVTSRSPAALTMPPALTRLPAARRRLPLVAIVPSMLDTVPVTSRRNSPLPLWRIFPPSTERSAARMVKWSAAERSVAPAXSSVPALLRVTSPVPICSIAAPFRRIVPASKRKAPAPAWPPRAKGRLPAMYPAPRSGSWEPSPIRSPAMNWASPAAWIDAPPSSRSTPAAPTLSGPPAISRDCVPPMSMEPASIWTNPLPPIVPDRPSSTAPMRSVSAXLPVCVMVPPALLSSVSAVSDSPRALCNRPRALVTAAPVTARLPPAAMVPXLLSSKPPAITLTAPAPVIVPPWLATAPPRTESAPLVTIRPALPLSSDCSPASDKVPDPACAMTPPXLISVDVESAALAPLRAMVPPIFESWSDTVMAESPPPTSETNPPSFSQXVAVAFKVPAVSWPLRVSMVAAARWARPPAANVPPALASMIVPALTVTSSPPAMLPPPARXPPARPXPPSCPRRQSARLRLTATLVARSDTSPFP

SEQ ID NO: 18032 - protein, 261 aa, SPHINGOMONAS
MALLDRIWLVGAGNMGGAMLRRWAGAGIDASAITVIDPGSPAIPEGVRHVTAPPEGERPTAVVLAVKPQQLHSVAPVLAPAVAGVPLLVSILAGVEVATLAQALGAKTVVRAMPNLPVAIGKGVVGLTTPSDDAAARAAAETLMRPLGLVEWVPSETMLDALTALAGCGPGFVFRFVDALAEAGAALGLPADQAQRLALATVEGSGLMAAAASESPAVLADRVASPGGSTREGLNVLDRDDALKALLGETLAASARRNAEM

SEQ ID NO: 18033 - protein, 625 aa, SPHINGOMONAS
KTPLLDTVDTPQDLRKLAPAQLRQLADELRAETISAVGSTGGHLGSGLGVVELTVAIHYVFNTPDDRLIWDVGHQCYPHKILTGRRNRIRTIRQGGGLSGFTKRSESEFDPFGAAHSSTSISAALGFATANKLKGAPGKAIAVIGDGAMSAGMAYEAMNNAEAAGNRLIVILNDNDMSIAPPVGGLSAYLARLISSSEYLGLRSLARRVTQKVSRRLTAAAGKAEEFARGMATGGTLFEELGFYYVGPIDGHNLEHLIPVLENVRDAEQGPILVHVVTKKGKGYAPAEKAADKYHGVQKFDVITGAQAKAPPGPPAYTKVFADALLAEAERDATVCAITAAMPSGTGLDKFQAMFPERTFDVGIAEQHAVTFAAGLAAQGMRPFCAIYSTFLQRAYDQVVHDVAIQNLPVRFAIDRAGLVGADGATHAGSFDVTYLASLPNFVVMAAADEVELVHMTHTAALHDSGPIALRYPRGNGIGLELPKVPERLEIGKGRVVREGKEVAILSLGTRLCEALKAGDTLEAKGLSTTVGRSWALASRLDRDLIRRLLTTHEVAVTIEEGAIGGLGAHVLTLASDTGLIDAGLKLRTMRLPDMFQDQDKPEKQYDEAGLNAAHIVDTVLKALR

SEQ ID NO: 18034 - protein, 152 aa, SPHINGOMONAS
LARADNGVIGRDGQLPWRLPADLKRFKAQTMGRPMIMGRKTFESFPAPLLGRRHIVLTRDTAWSASGAEIAHSVEEALALAGEDAAVIGGAEIFALFLDRATRIELTEVHLDAEGDASVPAFDPARWRETAREAYPAEGERPAYAFVTLERR

SEQ ID NO: 18035 - protein, 644 aa, SPHINGOMONAS
PWGVDLTTMDRSVKPGNDFYAYALGSWLRDAPFPPDKARIGYNYDLPDQTELEVRELIEGAGSAPDDPVLRQVSTFYRAYMDEAGIEARGTAPLKPYLARIDAVQDRRALELLMADHGYASPIGIGISADEKDPTRYTVMAGQAGLGLPSRDYYLLPGAKYETIRKAYRAYIVKIQQLAGIADAEAKADAILALETSLAKDQWTPEARRDPQKTYNPMNRAQLAKLAPEFDWNAVLAHQGLGKMPTVVVRETTAVTAAAKRLGDVPLATWKDWLRFRFVSDHASLLPKAFDAARFDFYSRTLQDVQQQSERWKRGVRMVNGALGEAIGKVYAERHWGKDAEALSKELVEDLRAAYADKINGAAWMDEPTRKEALKKLAAFEPRIGHPDKYIDYAAMPVSATDPLANDLASDAFEWQLELSRLGKPVDRSLWAMTPQTVNAYYDPVMNQVTFPAAQLSPPFFDPAADPAVNYGETGATIGHEMGHGFDDEGRQFDASGKLRDWWTPQSAARYTAHAQELVKQFDAYEPIPGTHIKGQLTLGENLADLGGLEVAYAAYRRYVARHGEPKVLDGLTGDQRFFLAYAASWQGKAREGALRAQLLSDPHSPEQYRVNGIVRNMDAWYKAFDVKPGDALYLAPQARVHVW

SEQ ID NO: 18036 - protein, 394 aa, SPHINGOMONAS
GTPMRSAVIVSTARTGIGRAYRGAFNATPAPTLGAHAIRAAVERAGIEPGQVDDVVFGAALQQGSQAPNIARLALLRAGLPVDVPGMSIDRQCASGLMAIATAAKQIVVDNMDITLGGGVESISIVQTPQMRVEPDRELIALHNDTYMPMLQTAEVVAARYGIGRDACDAYAFQSQQRTAAAQAAGKFDDEIVPVTATMNVVNKETKEVSQKEITLAKDEGNRPETTLEGLQALQPVVPNGTVTAGNASQLSDGSSACVLMEEKLASQRGLTPLGRYVGMAVAGTKPDEMGIGPVYAIPKLLERFNLKMDDIGLWELNEAFAVQVLYCRDTLGIPNELLNVNGGAISIGHPYGMSGARMTGHALIEGKRRGAKYVVVTMCIGGGMGAAGLFEVL

SEQ ID NO: 18037 - protein, 991 aa, SPHINGOMONAS
NWKMPTAVPSHHREMMAKLHRAAEPDVLKPLLERARLTPESRERVMDHALALLADLRAAQTRGWVNQFLQEYRLNSSEGVALLSLAEAFLRVPDPETADLLIADKIGDADWKAHSGKSNSVLVNSATWGLMLGRALVGDEKTGALRRLISRAGEPFVRQAVGAAMKRMGEVFVMGRTIDEAMKRMKKPENKGFTASFDMLGEAARTKADAERYFQAYFEAIRAVGRDPKAGHSISVKLSALHPRYEVAQYDRCVPELTDMLAQLASESAAQGIPLTVDAEESERLEMSLDIIASVARRPELKGWNGFGMAVQAYGKRARAVIGWADDLGRPMHVRLVKGAYWDSEIKRTQVEGLSDYPLFTRKAATDVSYLACARDMLAARNIVPAFASHNALTVATILDWAGDSRDFEFQRLHGMGEGLYERLVNEQGYHCRIYAPVGGHRDLLAYLVRRLLENGANSSFVHQLADEQLSEAELLADPVEKIAAVGGTRHPSIPLPVELFGAWKNSGGIDLAERTILAETAMAIAAKPVPAAGATAPVDVRAAIDRATAAFPGWAATPLATRAATLERLADLLEENRIELMALAVKEAFKTIPDALGEVREAADFCRYYALQARTGLAPITLPGPTGERNELRMEGRGVWATIAPWNFPLAIFLGQTAAALVAGNAVVAKPAPQTPEIARVAVRLAHQAGVPEDALVLVTGGPEVGAALTADPRIAGVAFTGSTPTAKKIAAALLEGEDRPLVPLIAETGGINAMIVDSTALPEQVVADVLTSAFRSAGQRCSALRLLLLQEEIAEGVIEMLRGAMELLILGDPADPRTDIGPVIDQAAYDKLMAYRDSAKAQWIKTVPVPATGLFVPPTMIRIDRPEDLTREWFGPILHVATWKAGQLAETVARVNAKGFGLTMGLHSRIARSAELVEAEARVGNLYINRSMIGAVVGSQPFGGEGLSGTGPKAGGPHYLHRFCAERAVSVDTTSAGGNATLLSLDEGG

SEQ ID NO: 18038 - protein, 506 aa, SPHINGOMONAS
  unsure (1)..(506): unsure at all Xaa locations
VAERTVADLRVAVHRNLLRLPPKWFEENRPSEIASRLTSDTALVEQVVGSTVSIALRNLLTGVGGVIYLFVLAPKIAAYLIVGMPLTVLPIVWLGGRVRQYSRNSQDRVADIGAIASETLGAMRIVQAFGQEPRESQRFQDAVVRSFAAAQKRFALRAVMTALVIGLLFTAITLIMWDAVSGVAAGQITGGAITAFVITAGLVTGSFGALTEVYGDLLRASGPATRLAELLQQEPDIAPPAHPVALPSPAEGAIAFDAVTFRYPTRPEVSALQDFSLFVAPGETVAVVGPSGAGKSTLFQLLQRFYDPEAGEIRIDGVAIPRADPAEVRARMAMVPQETVIFAASARDNLRYGNWNASDDAIWAAAEAANAAEFLRELPDGLDTFLGEGGARLSGGQRQRLAIARALLRDSPILLLDEATSALDAESEKLVQDALERLMQGRTTLVIAHRLATVRAAGRIIVMDGGRIVETGTHAELVALGGLYARLAALQFSEAAXSAYGEHARR

SEQ ID NO: 18039 - protein, 420 aa, SPHINGOMONAS
LRGTVTVPGDKSISHRAIMFSALAVGESRIEGLLEGEDVLATAAAMRAMGAEVERGEDGIWRVHGVGVGGLQQPAQALDMGNSGTSTRLLMGLVASHGITATFTGDASLSGRPMGRVIEPLSQMGAEITASPGGRLPLMLRGMCPAVPIAYTLPVASAQVKSAILLAGLNTPGITRVIEPVPTRDHSERMLRGFGAELTVEDSPEGKIISVTGEAELKPQHIVVPGDPSSAGFWMVAASIVPGSEITIANVCMNPTRTGLITALRLMGADIAETNARTVGGEPVADLVVRHAALKAIEVPADLAPSMIDEYPVLFVAAALAEGRTVARGAHELRVKESDRISTMRTALEACGVVTEEFEDGLAIQGSGGAPLAGGGTVATRLDHRIAMSMTVAALAAAQPIAIDDVAPVATSYPNFFPTL

SEQ ID NO: 18040 - protein, 487 aa, SPHINGOMONAS
MTAPAVHLWRLFKWGRILARHGALRGIERDANTPRPVRRFVRVLRIGARLPAVPSYADAFQAIGPAAIKLGQTLATRPDLVGEEAAHDLLRLQDALPPVPFDIIRERIETSYGRPLSALFAEVEERPIGAASIAQVHRAVTTDGRRVAVKVLRPGIESDFARAIDTYEWAAAQLEAYGGEARRLRPRLVIESFKRWTARELDFRREAASASELAEGMTAEPDFMVPQIDWQRTTGKVLTLEWIDGIKLSDRDALVRAGHDMPGLAGKLIKAFLRQAIAEGFFHADMHQGNLFALPDGRIAAIDFGIMGRIDRRARVWLAEILYGLITGDYKRVAEIHFEAGYVPAHHNVAEFATALRAVGEPMRGLPVKEMSIGGMLDGLFSITRDFDMMTQPHLLLLQKTMVMVEGVARGLDPDINLWEVSAPFVREWIRTELGPEAKVADRLIEDLRTLARLPELVRNIERRFPPLAVPRPSRPCARSRWCASVA

SEQ ID NO: 18041 - protein, 434 aa, SPHINGOMONAS
MTFEWPAHGLTLQARIESRTATIGVIGMGYVGLPLAVAFGEAGCSVLGFDLDPEKVVALNQGESYIKHIPGDRIAPLVAEQRITATADLDRLGEVDVLLICVPTPLTRHLEPDLKYVEHTTRAIARSLRKGQLVILESTTYPGTTREVMQPILEEEGLVAGRDFFLAYSPEREDPGNPTFSTTKIPKVVGADDPASAGLAMALYRHIVPQAIQVSSAATAEAVKITENVFRAVNIALVNELKLIFTAMDIDVWEVIDAAKSKPFGFMPFYPGPGLGGHCIPIDPFYLTWKAREYNQHTRFIELAGQINADMPQHVIRVLADTLDARFGRGLRGARVLVLGVAYKKNVDDIRESPSLRLMEMIEARGATADFHDPHVAQINGTREHPTLNFRHGIAWDEATIAGYDPVLIATDHDPVGTMPALAASAKLVIDTRN

SEQ ID NO: 18042 - protein, 274 aa, SPHINGOMONAS
IKPLRKAVFPVAGLGTRFLPATKAMPKEMLPVVDRPLIQYAVDEAVEAGIEQMIFVTGRGKSALEDHFDIAYELEATMAARGKSLDVLDGTRLKPGNIAYVRQQEPMGLGHAVWCARDIVGDEPFAVLLPDDFMFGQPGCLKQMVDAYNKVGGNLICAEEVPDDQTHRYGIITPGTQDGVLTEVKGLVEKPAPGTAPSNLSVIGRYILQPEVMRILENQGKGAGGEIQLTDAMQRMIGDQPFHGVTFQGTRYDCGDKAGFIQANLAVALSRPDL

SEQ ID NO: 18043 - protein, 407 aa, SPHINGOMONAS
VAVLGLGYIGLPTAAVIARTGAQVLGIDVDAHVVETVNSGRVHIEEIDLDGLVSGVVARGNLRASLAIEPADVFVIAVPTPFGANHAPDIGYVLQAATTIATVLKAGNVVILESTSPVGTTEKVAELLSQLRPDLKVPGHSSGSADIAIAYCPERVLPGRILVELIENDRVIGGITPRCARKALHFYRRFVRGACVTTTARAAEMTKLTENAFRDVNIAFANELSILAEGMGVDVWEVIRLANRHPRVNILSPGPGVGGHCIAVDPWFLVHSNPEQSPLIRTAREVNDGKVAHTIARAEALIARLPAAPIACLGLAFKANIDDFRESPALKVAQAIAERHGARVRIVEPYAQALPPALAATGATLTDIDSAIESCPIFLVLVDHDLFKSVPLDERSGKLVYDTRGIW

SEQ ID NO: 18044 - protein, 547 aa, SPHINGOMONAS
  unsure (1)..(547): unsure at all Xaa locations
IRRSRNQVRAANAVLAATNVALEKALHAKTEFLATTSHEIRTPLNGILGMTQVMLADRALAADVRERLELVQGAGLTMRALVDDILDVAKMESGNLTIDPVPMDFRALATDVARLWSEPVAAKGLRFVCALDDAPDWIVSDPGRLRQLLFNLLSNATKFTAAGEVGLHVAVVPASADAGERLQIAVSDTGIGIPAEKLGEIFESFRQADSSTTRQYGGTGLGLAICRNLAHALGGTVLVASTPGEGSTFTLDLPLVRTAPPQASVPAASGPAGVLLVERNPITRAMLRAVFEKAVPNLHFAADAGEAAKLLELEDFAALIVDEAALGTATEDGLVELANLCRVQPGIRITILTAAGGDGARRVQFMDAGVTQVIEKPVAGAELLEAAVPASARTTDDVGKDPLVTRAAXGDNTLRHANFGXNAGVCPGGRASMNILFIEDDPMNRRVVKDMLDVAGATMAEAAWAEEGLARIDSETFDIVLVDLRMPGTDGFETIRQIRARTDAKAGLPIIVVTADTAVDLRERCLATGADDVLFKPVAMDALFDAI

SEQ ID NO: 18045 - protein, 435 aa, SPHINGOMONAS
VRIAMIGTGYVGLVSGACFSDFGHEVVCVDKDARKIELLHQNVMPIYEPGLDALVASNVKAGRLSFTTDLAEGVKDADAVFIAVGTPSRRGDGHADLSYVFAAAREIAENLTKPSVIVTKSTVPVGTGDEVERIIAEVAPNSGAKVVSNPEFLREGAAIEDFKRPDRVVVGTEDEFARQVMREIYRPLSLNQSAPVLFTGRRTSELIKYAANAFLAVKITFINEIADLCEQVGADVQEVSRGIGMDNRIGGKFLHAGPGYGGSCFPKDTLALMKTAADNETPLRIVEATVQVNDARKRAMGRKVIKAMGGDVRGKTVGILGLTFKPNTDDMRDAPSLSIIAALQDAGATVKAYDPEGVEQASKMLTDVEFVENPYAAADGADALVIVTEWDAFRALDLTRIKNSLKSPVLVDLRNIYPPAELERAGLQYTGVGKP

SEQ ID NO: 18046 - protein, 612 aa, SPHINGOMONAS
ISAYLDLHQHKSLLRFLTCGSVDDGKSTLIGRLLYDSKQIFEDQLAALENDSKRVGTQGQAIDFALLVDGLAAEREQGITIDVAYRFFATEKRKFIVADTPGHEQYTRNMVTGASTADLAVILIDARKGVLTQTKRHSYLAHLLGIRHLVLAVNKMDLVEYDQAVFDRIVADYAAFAGSIGIRDFTAIPISGFRGDNVTTRSDAMPWFTGPVLLDHLEIVDVDADADRVKPFRMPVQWVNRPNLDFRGFAGLVASGTVRPGDPVRILPSGRTSSVARIVSMGGDLDVAVAGQSVTLTLADEVDCSRGDVIAAADAPPQAADQFKATLVWMDPAELLPGRAYWLKLGTQTVSAVVRAPEYAIDVNTMARSAAKTLALNDIGVAEIATDRPIVFEPYAESHDLGGFILIDKLTNATVGAGMLEFSLRRAQNVHWQAIEITREAHAQQKGQQPRLLWFTGLSGSGKSTIANLVEKKLYALGKHSFLLDGDNVRHGLNRDLGFTDQDRVENIRRIGEVAKLMTDAGLIVLTAFISPFRAERAMVRSLLAEGEFFEIFVDTPLEEAERRDVKGLYKKARAGEIANFTGISSPYEPPLAPEIRIDTSRTSPEEAAEQI

SEQ ID NO: 18047 - protein, 607 aa, SPHINGOMONAS
MCGIVGIVGKEDVAERLFEGLKRLEYRGYDSAGIATDVDGRIERRRASGKLVNLGKELGANPLPGTTGIAHTRWATHGGPTTNNAHPHATGEVALVHNGIIENFKALREELTARGRSFTSETDTEVVAHLLSEKVEAGMAPADAVREVLPRLHGAFALAILFRQHPDLLIGARLGSPLVVGYGEGETYLGSDALALAPLTQRISYLEEGDWVVITRDGADIFDKDNNPVERPITISGVTGELISKGNHRHYMLKEIYEQPIVVAQTLRAYLQRMEEKVTLPIPDFDLSAIKRVTIVACGTSYYAGMVAKYWFEQFARVPVDIDVASEFRYRAPVMEEGGLMIVISQSGETADTLAALRHARSEGQKIAAVVNVPTSSMAREADLLLPTHAGPEIGVASTKAFTCQLAVLAALAANLAKAKGRMDEAEERRIVRHLGEAPASLNAALAYDESIQAMAGVIAAARDVLYLGRGTDYPLALEGALKLKEISYIHAEGYAAGEMKHGPIALIDDAVPVIVIAPSGPLFDKTVSNMQEVQARGGKVVLISDYDGIQAAGDGCIATITMPKVHPLIAPLVYAVPVQLLAYHVAVAKGTDVDQPRNLAKSVTVE

SEQ ID NO: 18048 - protein, 526 aa, SPHINGOMONAS
DADRAGRSFRLTNLDPMGYDAETSDPQYKSIPYVLVADGEGRCHGAFYDSVADMAFDFGRELDNYHGPYRHMAADHGDLDLWMIAGPDPLAVTRRFTWLTGRPALMPRWSLGYSGSTMTYTDAPDAAVQMAGFLEKLAEHDIGCTSFHLSSGYTSIGDKRYVFHWNRDKFPDPKAFVSSYAQAGVELVPNIKPALLRSHPRYDEVAAAGYFVSDADGQPVEAQFWDEVGSYIDFTNRQAAAWWRDQVKSALLDQGIRSTWNDNNEYEVWDARARFAGFGTTLPAAAMRPVQPLLMMRASRRAQIEARPDERPYVVTRAGMAGLHRYAQTWTGDNRTEWKTLRYNARMALGLALSGVSNSGHDVGGFAGPAPDAELLVRWVQAGVLMPRFSIHSWNDDRTVNEPWMYPEALPAIQALMRLRQRLVPFFYDLLLRYHAEYAPMVLPTWAAFPQDRQCWEECDEHLLGPNLLAAPVVEQGATERRLYLPAGADWTHVWSGETFAGGAWVTVAAPLDGPPPLFARAGAAM

SEQ ID NO: 18049 - protein, 493 aa, SPHINGOMONAS
ERFDLLVVGGGINGAGIARDAAGRGLSVLLVEKEDLASHTSSASTKLIHGGLRYLEYGEFRLVREALIERERLWGMAPHIIWPLRFVLPQTQSPRSAWMVRLGLFLYDHLGGREKLPGTETVKLAHTPFGRGLKTAKGKAFVYSDCWVEDSRLVVLNAMDAAEKGAVIRTRTALTGARREGGDWVATIADGAGEQTVRARALVNAAGPWVADVLGRVPDVVADRGLRLVKGSHLVVPRLYEGDHAFMLQNPDRRIVFTVPYEGEFTLIGTTDEVWEGAPGKAQISAEETRYLLETAARYFAHPPSEADVVWSYAGIRPLYDDKAGNASAVTRDYVLDLDGDEARAPMLSIFGGKITTYRKLAEHAMAELARFFPNRGGAWTAGAVLPGGDLPDGDFDRFVASLQRARPGLPAPLLRRLARAYGTRVEALLGNAATTFDLGADLGGGLTVREVEYLRAYEWAVTAEDILYRRSKLGLHVPPGTAERLEEYLARA

SEQ ID NO: 18050 - protein, 477 aa, SPHINGOMONAS
HILAIDQGTTSTRSVIFDSAGRRVSTAQTEFEQHYPGQGWVEHDPETIWHDALTTAREALLKSGVGVAGIAAIGITNQRETTLVWDRATGETLHRAVVWQDRRTADRCAELKAEGVEAEVRARTGLLVDPYFSATKIGWILDHVPGARARAERGDLAFGTIDSFLLWRLTKGAVHATDVTNAARTSLWNIHKGEWDAELCRLFGIPMALLPEVHDNAHVYGMADPEWFGVAVPIAGMAGDQQAALFGQCCFAPGTAKSTYGTGCFLLLNTGDKAVTSEHRMLTTPAYRINGRTAYALEGSIFVAGAAIKWLRDGIGVITHARQTNDMATRVSDSHGVYMVPAFVGLGAPHWDPEARGAIFGLTLSATQAHLARAALEAVAYQTYDLVQAMVRDGGTRPAMLRVDGGMAANDWLCRFLADILDVAVERPDDLETTARGAAFHAGLAVGLWSGLDELSAIWSRQACFEPAMAADHRTTL

SEQ ID NO: 18051 - protein, 526 aa, SPHINGOMONAS
  unsure (1)..(526): unsure at all Xaa locations
SDVLVLGSGAAGLTTALHLADKFKVTVLAKGGFAEGSTAWAQGGIAAVLEEGDTFESHIDDTMVAGAGLNDRATVEMVVENAPAAIERLVKLGVPFNTEGNALHLTREGGHSHRRIAHVDDATGLAVQTALLRAAQAHPNITLVPDMVVIDLATSRHELRYSGAGNVWGVYAFNRQTNRVELFTARATVLATGGAGRTYLFSTAPRGATGDGIAMAWRAGCRISNMEMMQFHPTCLYNLDVKNFLITEAVRGEGGHLLLPPDAGEEAGHRFMPDFDSRLELAPRDIVARAIDHEIKRLGLDYVHLDISHMGPEFVQHHFPTIYHRLLDLDIDMTRAPIPVVPAQHYTCGGVVIDRDGRTDLPGLYAAGEVSQSGLHGANRLASNSLLECFVFGEAVANHIGAHGASSRRRRRSGRGTRAGXPIPTRKSSSSRTGPRPPLHVELCRHRADDQAAGARRAPHQAAARGSGRLLRAISASRPTXSSCATCLESADLIVRSALHRKESRGLHYTLDYPETLPDAVDTVLV

SEQ ID NO: 18052 - protein, 306 aa, SPHINGOMONAS
  unsure (1)..(306): unsure at all Xaa locations
AIAIDTLCKTYQGGKRALDGVTFDVPRGQIFGLLGPNGAGKSTLINILAGLVNKTSGAVSIWGFDIDASPRNAKASIGIVNQEILFDPFFTPKETLEIQAGLYGVAKDKFDAMALLRAVHLEDKANAYSRTLSGGMKRRLMVAKAMVHSPPIIVLDEPTAGVDVELRQQLWAYVKQLNQRGVTVVLTTHYLEEAEELCDRIAIINHGQLIANKPTRELVGMAQEKVVEVTVDRDIAAAPDNACFQKVERKGERVLVITYRKDQANAGEVLGAVQAAGLGIVDVSTREADLEDVFLNLTRAAXGAEA

SEQ ID NO: 18053 - protein, 260 aa, SPHINGOMONAS
VKIASWNINSVRFRLPIVEQFLREEAPDILCLQETKVIDGDFPEAPFREMGYTHIIKHGQRMHHGVAILSRVPVTEDDRLDWQANQEARHVGVRLPNGVRLENVYVPAGGDVPDRELNPKFGQKLDFIQRMTEWSTTLDVPTILTGDFNIAPLESDVWSHKQLLDVVSHTPIEVEALGRLQAAHGWVDLGRTFIPAPARCYTWWSYRAKDWAASDRGRRLDHMWASPEVAAKATAHKVCEPCRSWLKPSDHVPIVTEFDF

SEQ ID NO: 18054 - protein, 188 aa, SPHINGOMONAS
VRFDGILFDFDGVLLESEYAGNKHVADYLTAIGHPTTPEHSMAHFMGLAGQDFLAAIERWIGRPVPEDFHAARAEEDARVLEEGLPAVAGALRFLESLPADLPKAIASSSPTRWLDTHLRHLGVRDLFGDKLFSGREHVVNGKPAPDLYLHAAAALGVPIEACVILEDSPVGVKGAVASGATVIGLCA

SEQ ID NO: 18055 - protein, 333 aa, SPHINGOMONAS
KPLLATLQGTRQPVPPVWLMRQAGRYLPEYRALRAEKGGFLALAMDSDAAAEITLQPIRRFGMDGAILFSDILVVPMALGQRLWFETGEGPKLAPTVTARSVLDGFDADSSVLEPIYGTIKRVKAALDPSTTFLGFAGSPWTVATYMIAGQGSREQAEARRLAYRDEGLMQALVDRIADQTIAYLRAQAEAGVEAVQLFDSWAGSLSPAQFERWVIAPNARIAAAVRDLVPVIGFPKGAGGKLAAYARETGVDAIGLDETVDPAWANAVLPEGLPVQGNLDPLALITGGAVLESAIDRILAAFPERPHVFNLGHGILPDTPIAHVEQLLARVR

SEQ ID NO: 18056 - protein, 255 aa, SPHINGOMONAS
VTRYAEVIGDPIAHSKSPIIHKFWLDALGIEGDYRRTHVLGDDLAGYFARAKDDADWRGCNVTIPHKLAVMDLVGDPGGVRNTIGAMNTVIRGEDGALIGTNTDAGGFFSPIAGLELEGRHAVVVGAGGGARAVLFALSRVGIGRVTILNRNVLKAAALLSSFGVKGDALPIGTPLPAADLLVNASPLGMQGQPPLDLDLAPLPEHAVVYDIVYAPLETPLLAQARDRALDTVDGLEMLVGQAALAFELFFGAEP

SEQ ID NO: 18057 - protein, 113 aa, SPHINGOMONAS
VNVKDPYGSGEAALHIVVKRQDPTYLTVLINQPGVNVNIQDRDGNTPLIFAAGLGWGPGVDALIAKKANVNLANNGGITPLIRAVLAHDAEIVKKLLDAGADPDRADFGGGLS

SEQ ID NO: 18058 - protein, 738 aa, SPHINGOMONAS
DDESRTRRLQVANARPEDSGRGLAHIPRSLMGALGITEGDVIEIVGKRSTPARAVLPYSEDEGLELLRIDGLQRANAGVGSGDFVEVRRADSKPATRVVFGPAQANLRLRGTGEALKRTFFTRPLTAGDTIATVGHQRADMPPNVQQFVRAPAYALQEIRLTVLSTVPRGVVHIDENTEVELRTEYEEAKESRRADVTYDDIGGMAGTIDQLREMVELPLRYPELFQRLGVDPPKGVILHGPPGTGKTRLARAVANESDASFHLINGPEIMGSAYGESEQRLRQVFEEASKNAPSIVFIDEIDSIAPKRGQVTGEAEKRLVAQLLTLMDGLEARANIVVIAATNRPEAIDEALRRPGRFDREIVVGVPDDRGRREILGIHTRGMPLADDVDLPELARTTYGFVGADLAALTREAAIEAVRRIMPRLNLEEGTIPADVLDTLSVTRDDFLEALKRVQPSAMREVMVQAPTVRWEDVGGLDDAQMRLKEGVELPLKDPDAFRRLGIRPAKGFLLYGPPGTGKTLLAKAVAREAEANFIATKSSDLLSKWYGESEQQIARLFARARQVAPCVIFIDELDSLVPARGGAMGEPQVTERVVNTILAEMDGLEELQSVVVIGATNRPNLIDPALLRPGRFDELVYVGVPDKAGRERILRIQTEKMPLAADVDLGAIAEQTQRYTGADLEDVVRRAGLVALRQSLATREVTMAHFEDALKDSRATVTPEMENDYAAMQGKLKQQA

SEQ ID NO: 18059 - protein, 676 aa, SPHINGOMONAS
TRRGVLKRGLGAAAAATLPAAIARAAAIPADVRSGTIADVAHVVILMQENRSFDHYFGTMRGVRGFGDPLALPLPGGRTVWAQEAEDGRLVAPFHLATREQFALMRVAGTPHSWPDAQAAWDQGRMAGWAAAKTDRAMGHYARDDLAFQFALAEQFTLCDAYHCAVHTGTNTNRLFLWTGTNDPAGTLGGPAIGNSHDELPEKGGYPDSYRWTTYPERLQAAGIDWRIYQDMADNFTDNPLVGFAAYRQARPGSPLHERALTTHGLDRLRADVLAGRLPQVSWIIADAKGSEHPSPSSPAQGAAYTAAVIDALTSNPAVWARTVLIVNFDENDGFFDHVPPPAPPSPDPAAPGGLAGTSQIGAGDEYHRIASVADAAAERSNLIGRPYGLGPRVPCYIVSPWSRGGWVNSQLFDHTSILRFLEARFGVAEPNISAWRRAVCGDLTSAFDFRSPNRPVPAALPDPRPVAARAAALQHQPEPRAPIATGAAPAQEPGIRPARALPYALDVHEAALDPRAITLRFECPGAPAVVHVYDRLHLDALPRRYTLAEGGSLEAEWPLDETGRYDLWLLGPNGFHRHFAGRGTAHAGRVRWEQQQRRGLPSLILDAPAGLDLGWPRHPALAAAFPQTRNRMHIPLNKSGGWYDLVLTDPDDPGFHRRLAGRIENGQDGWSEPTL

SEQ ID NO: 18060 - protein, 390 aa, SPHINGOMONAS
LMRALTWHGKHDVRVDTVDDPEILNPRDAIIEITSTAICGSDLHLYDGFIPTMMAGDILGHEFMGEVVEVGAGSTLKKGQRVVVPFTISCGSCYHCGKHQYSACENGLPADNQDIAQEMYGQPMSGLFGYSHMTGGYAGGQAEYVRVPFSDVGPIVIPDGIEDDKVLFLSDILPTGWMAAENAEIEPGDTVAVWGCGPVGLFAVQSAFLMGAERVIAIDHFPRRLELARRFGAETINFEETDTAAALFEMTGGIGPDAVIDSVGLEAHGFFVDNVLDQIKKSTFLGTDRIHSIRQAILACRKGGRVSMPAVYGGFVDKFPLGALMEKGLTLKTGQTHVQHYMPALLNAILEEKIDTTFLISHILPLEQAPQGYKMFHDNQNEVTKVVLKP

SEQ ID NO: 18061 - protein, 256 aa, SPHINGOMONAS
MTNPFDLTGQVAVITGANTGIGQGIALALAAAGADIAAVGRTPAEETVAKVRDLGRRAEIISADLSTIEPVQRVVDEAVDKLGKIDILVNNAGIIRRADSLDFTEEDWDAVVDTNLKSVFFLCQAAGKFMVRRFGETGERGRIINIASMLTFQGGIRVPSYTASKSGIGGLTKLLANEWAAKGVNVNAIAPGYIATNNTAALQADETRNRQILERIPAARWGDPEDLGGAAVFLASRASDYVQGHVLAVDGGWLAR

SEQ ID NO: 18062 - protein, 328 aa, SPHINGOMONAS
FGEMMLRLSPPGRELLLQTPKLDVAIAGAEANVATGLACLGHDVAMISAVADNPLGGAAIGELRRRGVDAAKVVSEAGRMGLYFLTPGAGLRASEIVYDRAHSVFADRPAAAWDWDALLEGVTRLHLSGITPALGPNTAAAAIAAAEAASARGIAVSFDGNYRAKLWEAWDSDPRGVLTRLIGHADILFGNHRDISLLLGKPFSGDGADRRREAAEAAFAAFPKLQLIASTARHVDDVDSHRIAARVDTRAGSHQTEELRVSGIVDRIGGGDAFAAGVLHGLLEDGNAKAMAEAGLALTALKHSLPGDASLFTRADLTAFAEGGLDVR

SEQ ID NO: 18063 - protein, 440 aa, SPHINGOMONAS
AHALGLKVLIDQVYSHSSDQHPWFQESRTSRTNARADWYVWADAKPDGSPPNNWQSVFGGPAWTWDARRGQYYLHNFLREQPDLNFHNPEVQAATLATAKFWLDRGVDGFRLDAINFTMHDPQLRDNPPAPDTGLPRTRPFDFQQHIYNQSHADIPLLLEKLRALADLYPGRFTVAEVGGPAPEAEMHLFTAGESRLNSAYGFNFLYADRLTPTLVRDAVAEWPDTPGTGWPSWAFENHDAPRAISRWVAPPHRAAFAAMKMLLLLSLRGNAILYYGEELGLTQVEIGYEDLQDPEAIANWPLTLSRDGARTPMPWVADAPHAGFSVARPWLPLGPDHGMLARGSPGGRSGVAAAADQRLIALRHAHPALVEGAMEVLHADESLLVFARTLADTRIVCAFNFSDTTVAIPTDLLGSAAPVEALNDASLDRLPPYAALIAR

SEQ ID NO: 18064 - protein, 709 aa, SPHINGOMONAS
  unsure (1)..(709): unsure at all Xaa locations
MPSHEEFVRAHGAADTEIAAXSARPPSPCSPARSPWRPPPPRATATACPKMRCSTSSSRSLRKCRSHQXSRRPTGDRLVTGFDPTSKAFYHGGDLKGVVARLDYIQALGATAIWVGPIFKNKAVQGPKGQESAGYHGYWITDFTQVDPHFGTNAEFKALVDAAHKRGIKVYMDIVVNHTADVIQFKECGDCAYRSRADYPYQRKGGISGAPINPGFAGDDNHSAANFAKLTRSDYAYTPSVPEAEKRMKVPAWLNDPIYYHNRGNSTFTGESSTMGDFVGLDDLMTEHPRVVAGMIDIFGGWIDRFGIDGFRVDTARHVNPEFWQAFVPAMLARAKARGIPNFHIFGEVADPEVAALTRHTRVDKFPAVLDFAFNQAVTDVASGKGTDRLAKAFAADVLYEGGEATARRLPTFVSNHDAGRIATFIRKALPKIGQDELLQRVQLAQAMLLLLRGVPTIYSGDEQGFVSDGNDQDAREDMFASKVASYNDNRLLGTTATTATPSFNPGHPLFRAIATLARLRTSHPALTRGRQVTRFASEKPGLFAVSRFDPKTGAEIVIAFNTSPEPWTGNVQVETGSTAFRTLAGACPARAAAPGSLPLSLPAFGYAVCAAGASKXTXCRCVTFPPKPAPGGAARVIYQIYPRSFADSNGDGIGDLPGITARLDHVAALGRGCGVDLALLHVTDAGLRLXHRRFLRRGSGVRHAVGLR

SEQ ID NO: 18065 - protein, 159 aa, SPHINGOMONAS
  unsure (1)..(159): unsure at all Xaa locations
LLVVNLGTRGSSTGPAVRRYLAEFLSDRRVVAIPPLFWKPLLYGVILPIRGPKSAEKYAKVWLPDGSPLAVYTRRLTEGLQQVMPDWHVTWAMRYGAPALRKALDGLRARGIKPXVVLPLFPQYSTTTTASIKNRVDAWRPSPPKTWWKVIQDYCEHAA

SEQ ID NO: 18066 - protein, 199 aa, SPHINGOMONAS
VLNSPGHFNAYLAMKSAPDLNPKNFTASLRLDHNRALSQLSLKLGKPVGGIEKLVVWGNHSPTMYPDYRFATSDGASIGDAINDQEWNAGTFIPTVGKRGAAIIEARGLSSAASAANAAIDHVRDWVLGSNGKWVTMGVPTDGSYGIPEGVIFGFPVTTENGQYTPDKDLPIDDFSQKYIDKTLAELEEERSDVSHLLG

SEQ ID NO: 18067 - protein, 584 aa, SPHINGOMONAS
  unsure (1)..(584): unsure at all Xaa locations
QSQQTNTPKPKETRTTEQEQKEDNREATDKHHNGHDTHDEHTYKGRREVAGEETARDQEKGDRQVEHTRDRTTRDKQHEEREDEKRRAQPXPHRDTQTVQPTQQTARRRKEPRGTDSNGRQPQSKTARSRTRQXHQAHEQRTQERQERKNVQRDTAQTXREKHTDREXQHSSVRRTTAXTDREEEKRQAQTKQQKXPQGQRHTERERWRRENGHIRETKGWTADDETHRDTGRLTRADERTTDYGGQQRNGDQRENREHTGSRQNQQQXLQTTSXRETNKRRTEHRNKQXRNKDARTXRRARTRQGEEDASKVTRRXSSDDTTRTGHIHSTSXRPMRGAREIRRQRVTDERTRMNTQEERSTTSTRKQHRXRTAPRERDTYEQTAQHEEDRTETGSQERARNTNTRREPSDSDXRDRGQTGTRAESDGRQEREXRXRQPTTKKRHDXQRDRXRRRHGTEMNWRKHRHERREKRAERRKRXARTRKTRTPREQDAESPEETEAQSEXHRDRDYGKKEGTKTKRGTQLTRKRAHRHERTMHTERHTHARPTTRQGRRRRRRPRSDRRETHGDTRGSSRRRRRRTRD

SEQ ID NO: 18068 - protein, 203 aa, SPHINGOMONAS
  unsure (1)..(203): unsure at all Xaa locations
DVELEAGGSMVVRSPVRSKSKQAPXLTYLRSSGVRICGKCWLKMADKKVLAXTENLKNQPGAWQMKPRPIVLXVKIIEWPCRRFFANNTPFTSSIFSTEAMPLSPKPFQTTXSPETIDGLYKSILCRRRPTHSEYNTXTNDAGLGRTVLAHLYGRLHLPHEXKTRLNKRRLQESFRHYRQHDIIYWTTSAPRGISRSNEXSQV

SEQ ID NO: 18069 - protein, 111 aa, SPHINGOMONAS
FTLEAAHRLPNVPPGHKCARLHGHSFRVELHVSGEPGAETGWIMDFGDIKAAFQPIYDRLDHHYLNDIEGLENPTSERLAIWIWQQLKPALPQLSEIVVHETCTSGCRYRG

SEQ ID NO: 18070 - protein, 364 aa, SPHINGOMONAS
RQPDPGPKETNREGPKRTAFGFTTQRGNEPPSGGVTGKAEGHQPRAETEAKNTRERKDRTAKPKQHRGKTKRAGPRRPTKRKKAGPNGSQGTKRGGQPQTRTQKGDSPDKQKQTRPERPPPKQTAEQPKRGDEQESREDTGNTASGRRSTEQQRHKQEAAKQNRPDETDPKRGTHTTHRRTARSNRDQRSGKEQPHGTRAEGDPESESHKGDKQREQPNGPEQHGRGRTRNNRPRDQRASGPQGQRNKQTDARPQRPPTPEHRPPRRDHTAERTRQAGRSKPARPGNASHEERPQRPPHKTRPSQKEEQEQTTERGTKGPARRNRAKRQEREGRKGEEKTDQTRKAGANDREPTGGEQHDTDHG

SEQ ID NO: 18071 - protein, 223 aa, SPHINGOMONAS
  unsure (1)..(223): unsure at all Xaa locations
PHPADTDAPREEPEAGRDKRAEAHTETHRTPEAHENTQPHQAPSAHRHDHKTKQTTNKRGDPDRTQHDHPTRKQTSETRPTSNRPDRPEEHRPQTKATEQNERRRPRKHATPQRTNNTTNTNGDTRKRRARDQRTTTRKHTSPATQKRTDRQNRPSRRNRDAQAHRHNTRTGRQRRNPERHRPPKENRDTRXPAREKRQPKKTRTHKQSKQPHQHNTRRPRQD

SEQ ID NO: 18072 - protein, 310 aa, SPHINGOMONAS
  unsure (1)..(310): unsure at all Xaa locations
PVARLRISPVLQPRTEYILCARAPPCACEYXNPRPQIPCXHTNDTGVTRSSYPWPDTEHPNSPPCPVPHPPPYLAASTSKFQAPPPCXEPSAPGSPQPVWWGPPPQSGSTRAPPDRPTNAYIIPCHGPLPGXSPQSXTVXGSTRAPPSFSPWHSATTAPPALVRCPRALAHVCSDVLPCVTTPRAHGTCPRAGPLPVPRALQPRFGTSPMDAPGHAPSIGALPEPFRPPPRLPCSXWPRWTKTKKPAGQGVPHGALAPPRPGYSXPLRGSSQRNIKFNPCTPTXGRVAEETXTIPQNQRQTVQDEEPXDQ

SEQ ID NO: 18073 - protein, 341 aa, SPHINGOMONAS
  unsure (1)..(341): unsure at all Xaa locations
GTKNRAHPRPEKGTGKGPRDHQKRSPCGKGAYKAKRGQRRTKGPDKKRGAKQNRRAGQPAEXEQKRRGRETKWANQGAVRISHRHISKPHRRGVSTRGRNTKVXRGRKRAERNNPPQQSRGXPGEITKSGQSTNNGEGKRENGQDHEDVPMSYSNNTLGRGRRKTSQRRXQEDSGCADKXNKPLPGTRATSRTTKQELRPTQGTGEHQKHEGARSTSESTKTVENTRRTQENKNRGHHHGTQGQPDTAAGKRYRGHKTRGPLVKASNTXKTRGQEPSHGNARKAPTGRDRRRDITILRKRVKQPENTLKERRAGEKHKTPHGSRGESNTAEPPARLNKTXK

SEQ ID NO: 18074 - protein, 540 aa, SPHINGOMONAS
  unsure (1)..(540): unsure at all Xaa locations
RQRNDREGKPPGKVTSTTRQGCREFPEAATEGTNRGTGEQNKQRGTPEAHKKPQNTSKDKRKKRGTEDQKAQRRKNETKSRDKDLKKGNRQAQKEGKHTEENSAEVKGRQRPQKNSGRTRPANNMQSGNTHSERTKEDRRTQRKKEQRRNRKGAANTTDGKTQSGRQQKSXASTPEWREQTDRGATIRTQREHTSAGTETSENHKRRAPMNRKSGAQYSVHSENTRSRESQDRPRSREKSARGRRTPRRETHSKPRDTISRHSTQPREKSTXXRSDKRIRRNDTQGGYRRHSLQDTTDRRRQQTHVQDTRRSGANNMQTSKRNERGRIYTRAVRXQKTRMEHNRARHKKSNTRENTHREPKQNSAGYNNTVWRKKYSCDRSXLXTRGDDNTGGKYITHSDXQIQNRAENTTVRATRLQHESTNIPREEEYSGRRNKIEPRDTNRTTTTHKRPRSKEQDRXKRRDGDSKSTTENNNTETNTSRKRXTXRVDRTKNQSARTESERIISRRTAISRAXKYTGDAKHRAEXQTRRGRNNTTGGR

SEQ ID NO: 18075 - protein, 597 aa, SPHINGOMONAS
  unsure (1)..(597): unsure at all Xaa locations
DEEQRRTKTKKQQRSPHEQKNRRTEPENGRKGRTNQPPLQDRNPXKSICHGKTPDRIEEAKPTTEDQDRQKDRRTRPSQLYNQTKYGKTGEAGETDTRKHPKKAHHNQEARNEQNHKKQKARAQRKEGARRTQKKRKDRNRRNPKEKTEKENNRSQPQTQQNTESKGMRDHKQTRDNTSAEDDKRKNTQDRKQRERERKARTQHTTDTDXQRTTDTRENDSSAVRETXRQGRTLREQREDMERPQVDARDKYARTRQRRRNATARERDLRTQHLTTEDRKHTDDAHLHKHEEETRQEHSHHTRGHTQRTNEARTKRSERYQHVREHNRETKHPETSLDTQSDRRGDERQTSTPQRNTDEPACAQTGTKTRKNLTPDEGTERXHTRDERREXRSAPRERNASAQTSEKRPSRHRERQSKKXQKGRRQSKTTQRNKALHGRTATRETAQQRSGTNRQNAKHSRGGRTRREHKRTRRETERQEKATPQEVQHDTQRTTKHDTRNKKGHKTRHKQRRXKDTSRGHRRKDRESDHGDARHRKERTXREHRTRGRDNDPRTKSEERQTXRAKSRESTGRRQEQQTRRDDRSREDKHNTAGERE

SEQ ID NO: 18076 - protein, 480 aa, SPHINGOMONAS
  unsure (1)..(480): unsure at all Xaa locations
GRXHXQXPASHEGRKKVGQKKPKRGEESHRSNRTNLQPFAGNDNAQGGKGRDGGAQHEATQRTPSHRHKKAARAPGRGGQKARNGKKTEHGRTDRAGQRRDAGAEDKRAKHKEGGGARKQTKEGTHHGHRRTQERGRAEQTTSNRRVLKRXHTDTKKQERRTKQTERXXKNGADNAATLNTAXGTHRLHNGRQERTQXSAARTETWSSHMSRQXXRHXDAHAQINRTXAGIRSQDEHHTLSATEHDTTSGEARPAQAQRDGRPHXHARTREREQERAEHAQTAAGAPGKEETGDRGRNKTRHTDSNRERTRTKTKQGPAPGTRHRERGGPAPTKRRRSRPKGKAKNTEEKRHXARQRQGEQKRNDTKEQGQRPAAQDPSEHHEAQREEETSDKNAQKGTRGAEGQRKXSATXTRXEHXXAGDVRARHXHRRHMQLTSTRAGQQRIMRDXAHXXERTENGNTRVGHRHDDMHKRNASHREH

SEQ ID NO: 18077 - protein, 253 aa, SPHINGOMONAS
  unsure (1)..(253): unsure at all Xaa locations
EIXGANREAPGIQASKEPAQATRKSPHRGCTYKSWSDKHEQEKQQTHAGTKREDEQHNQGGERPEKHPAERGTLPPAKKQKRDREAAQRPDPQGGKQRKQAXSDLRNPQNRAQHRPPRGQRSPAKPGQRRAHHEKRQEAPTRGPYXQKSKHRESQSKKKDQTTQETRTHQRRSNEHRERNRKQEDGKPQKARDDQPRKHGNNHPQRRDDQTQDRNAKAGRRQNTRARQKSTSSNQQENNPPGDDKKRDETNNR

SEQ ID NO: 18078 - protein, 479 aa, SPHINGOMONAS
  unsure (1)..(479): unsure at all Xaa locations
KRXHVGAIWRAPRPAKAEARAAGQHITYTGDGTETSFENFYAPPAKPTEDQRGPGGEPRGRQKAGPPPPKTKKHRQTSTTQARQKGRGTTQKNKQTRDKKEQSRRNKKGRREENGRRQRTQHTNRSREKGNQQPHTHRKHGETPNNTPRHPRQTRERYIQTPHRRTGQETKTRTQTYKQEPRRHRAQEPGDTRTTQTERQARRAQKQGNAGPTEQPENRTQXTTDNMRSTKQSNTDHGASKRTDRRQTHSRTRTDRGSRTAGRPPRGTENRRHRARQGDTNSRTLTRRXRSRQPQTEDERTKCNESEATRQSDSAQDHTSTARTPHRAERSGPEMNQXHRARHRTKDAGNERQQQRAYERNEQHQQSEREXRTRDGHDSTRQKRLHGCPNRXGXTRKRHNQNNQICGRHNRHRLSARVRGKTEAHDRTTPHTKPTDDRNRRPKPREARRNDDERHKSRAATNESKHVPEKKRKRTQSKQ

SEQ ID NO: 18079 - protein, 421 aa, SPHINGOMONAS
  unsure (1)..(421): unsure at all Xaa locations
KXEKKSPRGDKHSRALPHNKARDKETRSERRGQGGLSKANRGPQPHTDRNATNTKKTTDGHQSPPKATKTHTQHPTQEKAQPEHKTEREQTPTQNKNATSTKTRPNKKTRNKPIRSHAEPRDEQHRHDNRRARTKQRRPSTNHAKNDERDPQPPRERTTTRKPQPTRGNNRGKHTDRRTSKQTETTEQDPRGKTPSSDARHQSRAQDKSTQGTAHRPRRQGEKPQTARTHDRAQKQNTPQPTTRHTKREIHRGGQTGQQTHLARKKKEKEPHRTETPKPHRAPRHPKKDKXTKEQKAPKPTRATKRRQTDRQHNTTKTETKRETNTKPRPTQHQHNHNEQQGRXKKRGRKHTESPRKPKKHGAKPTHTTPKKHPPPRRPRKRPPPTGKTRXPRKTPHGDPGQETQGEPPQEKKRRTAKQTP

SEQ ID NO: 18080 - protein, 372 aa, SPHINGOMONAS
  unsure (1)..(372): unsure at all Xaa locations
PTDKDTNTQTPKAKRNIDRQTTRTRPKGPDTRPSDTTVRTKRAPENKRTTQTNQQHTRRIAKRNATHRNSDSSRXTHTRHAHRKTTEGRPNRTAHRTRSNDCAGREYRQPRSTHRRRTEERDLPDGTRAQNHGRDDINKTHGRHRHTTKEPITKDTRHKHQERTQQNHQKHRTKQDTNEEARTTTTEEKTDQQNKRDPDRRDKEGTNGTQAESAPRKNDEDTHNQAHRHNGEDTTGTNNAHSHKAKTKTDTRIXQHNNKKRARTERKEHERQTPKTRTKPKQHRTTEDGRETKQKKRDNKIKEAKKPPHQNHRTPEPETHAERDTTNPNDARDNERRDPKHADKADRQKEPHSKRERDTTKQNDGQDTRNDK

SEQ ID NO: 18081 - protein, 764 aa, Thermoplasma acidophilum
MGKIIRISGPVVVAEDVEDAKMYDVVKVGEMGLIGEIIKIEGNRSTIQVYEDTAGIRPDEKVENTRRPLSVELGPGILKSIYDGIQRPLDVIKITSGDFIARGLNPPALDRQKKWEFVPAVKKGETVFPGQILGTVQETSLITHRIMVPEGISGKVTMIADGEHRVEDVIATVSGNGKSYDIQMMTTWPVRKARRVQRKLPPEIPLVTGQRVIDALFPVAKGGTAAVPGPFGSGKCVSGDTPVLLDAGERRIGDLFMEAIQDQKNAVEIGQNEEIVRLHDPLRIYSMVGSEIVESVSHAIYHGKSNAIVTVRTENGREVRVTPVHKLFVKIGNSVIERPASEVNEGDEIACASVSENGDSQTVTTTLVLTFDRVVSKEMHSGVFDVYDLMVPDYGYNFIGGNGLIVLHNTVIQHQLAKWSDANIVVYIGCGERGNEMTEILTTFPELKDPNTGQPLMDRTVLIANTSNMPVAAREASIYTGITIAEYYRDMGYDVALMADSTSRWAEALREISGRLEEMPGEEGYPAYLGRRVSEFYERSGRARLVSPDERYGSITVIGAVSPPGGDISEPVSQNTLRVTRVFWALDAALANRRHFPSINWLNSYSLYTEDLRSWYDKNVSSEWSALRERAMEILQRESELQEVAQLVGYDAMPEKEKSILDVARIIREDFLQQSAFDEIDAYCSLKKQYLMLKAIMEIDTYQNKALDSGATMDNLASLAVREKLSRMKIVPEAQVESYYNDLVEEIHKEYGNFIGEKNAEASL

SEQ ID NO: 18082 - protein, 476 aa, Thermoplasma acidophilum
MLRRSTRSMEISLVRKMPKLAYKSVSQISGPLLFVENVPNAAYNEMVDIELENGETRQGQVLDTRKGLAIVQIFGATTGIGTQGTTVKFRGETARLPISEDMLGRVFNGIGEPIDGGPEIIAKERMEITSNAINPYSREEPSEFIETGISAIDGMNTLVRGQKLPIFSGSGLPHNQLAAQIARQAKVLDSSENFAVVFGAMGITSEEANYFTNQFRETGALSRSVMFLNLSSDPSMERIILPRIALTTAEYLAFQKGMHILVILTDMTNYCEALREISAAREEVPGRRGYPGYMYTDLSTIYERAGKLKGNNGSITQIPILTMPGDDITHPVPDLTGYITEGQIVISRDLNRKDMYPGIDVLLSLSRLMNQGIGKGRTREDHRGLADQLYAAYASGKDLRSLTAIVGEEALSQNDRKYLHFADTFESRYIKQGFFEDRSIEDTLGLGWDLLADLPVQDMKRVKPDHIQKYGRWKKE

SEQ ID NO: 18083 - protein, 637 aa, Thermoplasma acidophilum
MEKIRIIAPYSYRDPVISALHDLGVMQIEEMREDVDRLLSPAKASEQAKTVMDYLQKFRGYENILPKRPVRTRAKFTSLADILNEASKINIDDDIRIAVNRENDIAAAMKDIDSRLSALEYMKGYDFDVSIFNGKHFESYIIPDKNVDIKAFSSLNAEIVPLKNAFIITVAEDRTQDLSRIANSIGARLIHIPDLKGKPDDVIAMLNDERAKLDQAMQEIRKHLGDLSDKYYEKIAQIREALEIEAKKIDVEDKLKGTEYTFAVEGWIPSDSFGRVSDAINRVTGNSCIISTVKTNEMPPTLLRNPRRISLFEFFIKFYSLPEGTEYDPTLIFALVFPVFFGLMVGDWGYGLAILLISLFIIHRVDHPPAKSHIPRVISRFVLMIMSPQSLKTLAKALIPSSIVAIIAGLLFNEFFGFAILPFTVFHVYAVLPKLMLIAGYIGLGMVVFGFILGFIEDLWMKDVKGAMDRLGWLFFAVGIATIGLNLIHHDLTFSVSTGISNLIAVALIVIGIPLIAIKEKSQGFIEMPSIISHILSYLRLVGILIASVVIAEIIDLVFMKSIVSHSIGLAIAGVVILIFGQMFNLILAVFEPGIQGARLIYVEFFSKFYHGNGRMFRPFRSQRKYTEDGLDFDKAR

SEQ ID NO: 18084 - protein, 312 aa, Thermoplasma acidophilum
MNGKHVMITGGAGFIGSNMVEMLLEDNDVTVIDNLSIMDDRYIKPFMGKKNFRFIKEDITESVTPGDYDLVVHLAADSDVRNGSVDPTIDLRSNVIGTVNVLEMMRKKDVKDILFASSSTIYGEAKVMPTPEDYGPLLPISSYGASKLSAEAFISSYSHYYGINAKIFRFANIVGKNSTHGVIFDFINKLKKNSKELEVLGDGTQAKSYMHVTDCVGSMFYIYDRISGTEVFNLGNDDVTNVDTIAKYVIEAMGLRDTRIVRKGGYMGRGWPGDVKYARMDIKKLKATGWKNRYNSDQAVKVAIGEIMKQII

SEQ ID NO: 18085 - protein, 300 aa, Thermoplasma acidophilum
MLSRYPEVSPGDIEKMILQYTGAKSLRVIIGPGLTHFIYRIPAWMGLRRSLIIEPNFNEYEASLLAYGSRTSSLGLGVLKRNPEIVRSYRPDSIFICSPVNPTGDLVDAGLLRKLSMEMSRMGGILFVDQAFGDFVPEHAEETVRIAEEMGNVIIGRSLTKILSIPSLRLGYILVSDQVFGMIRDREEPWAVCEPALEFVRKADLKALRDTSLKRIGEERSYLMEALENMGFEILGDPHANFIAFRSPFEIDLKKQLLKSGILIRDLSDYADFGKNCYRVAVRGRSENALLIQALRNAIL

SEQ ID NO: 18086 - protein, 284 aa, Thermoplasma acidophilum
MNGMQTAEFDGTGRKVSVIGVGTWSLEGSRSENVRSIRYALDHGVNFIDTAEMYGTEDIVGEAIKGYRREDLFIATKVWPTHFAYHDVLKSCEESLKKLGTDYVDLYQLHWPNPSVSIKETMSAMEKLVDEGRIRYIGISNFSVKEMKEAMSALAKYRIVSNQLEYNVATREIEDEGIYDFCRKNGMAIIAYSPLSHGKIFGNEMILETLTDIGKKYGKRPAQVALNWIIRKGAFPIPKASKPIHMAENIESTDFTLSDEDMKTLDSLYQRHPIRSIASRYKGH

SEQ ID NO: 18087 - protein, 391 aa, Thermoplasma acidophilum
MMNRVAIIGYGISKFGKRTDASMYDLIWEAGSEAIRSSGVDKKDIDYMVVSNMGMWSSEELPAVVAGEVLGIRNAGLHRVEAACASGSSAIASAYDAIRSGRSKIAIALGIEKMNEVESETAIELIGRAGNFLWEYEFFGLTFPGYYALYATAYLNRYSGKEEDLALVSVKNHHYAHLNPIAHFSNEITVDDVMKSRYIASPLKLYDSSPITDGSAAVILASEDVAKQYTDTPVWIDAIGSNLGTANLSKRDDFVHIEAAREAAAKAYRMAKIDAAKPYRYLDGADVHDCFSIAEVLAYEDLGFAERGKGLDMLRDGETYIGGKIPVNVDGGLISKGHPIGATGVAMAVEASKQLLRKAEPGRQIDVKNGKFLTHNVGGTGHYAYVTIYSV

SEQ ID NO: 18088 - protein, 702 aa, Thermoplasma acidophilum
MKIGYQLIINTYYAASSVCFRRNIFKSRQNSKIMTLTVCPYCGTGCQIEVDYSGDHYTVHGYTRSAVNEGKLCIKGYQGLSYASSHDRITSPMLRSGDTWVKVSWDEAIDYVVKRLKEIRDRYGPDAIAFQASAKCTNEENYLLQKIARMIGTNNVDHCARSCHSSTVAGLIRTLGTAAATGSIKSLKSTQTFFVIGSNTTEQHPIIGTTIIKQKKAGKKLIVADPRRTKLASIADVFLQFKPGSDVALLNSMMFVILKRGLIDSEFIKSRTEGFEAFAEEIEKYPPELTEQITGVPPDLVEKAAEIYASNRPSAILYGMGITQHIHGTENVMSVSNLALMTGNLGRYGSGIFPLRGQNNVQGSSDMGALSEFYPGYVPPDSPGVEKFERIWEAKLPRKVGLMLSEMFDAAIDGRVKAIYLMGENPVITEANLSDVERGLKNLELFVVQDIFMTDTARYAHVILPATSALEKEGTFTNTERRIQRVVPVKDPPGDARPDWWILSQIYSKIFDREAYRSPEDIFNEIRLAIPNYSGVRYSDLYPDGKQWPINDQHPEGAEILHVDKFARGLGRFMAIPYKSPSESPDEEYPFILTTGRNYYHWHSGTMTRRSEILERESPNPYVEISVNDAKKLSIRNGQTITIESRHGSIKLPAMVTSKIPDGIVFVPFHFKEARVNLLVGENLDPYSKIPEFKVVAVKVKA

SEQ ID NO: 18089 - protein, 476 aa, Thermoplasma acidophilum
MAQGLLQQLDNAKVGKFHLRAWVISGMGFFTDAYDLFIIGTVVSLLPLAGWNSLTTADISLISSVALLASVIGAFTFGRLLDLLGRSRVYGFELMLLIIGAVGSAFLVPVNGVLYLLIWRFILGLGIGGDYAGSSTIMAEFSNAKNRGQLIGMVFSMQGFGLVFGPVIALVMLRYIPSIDLVWRLLLFLGAIPAAIVLYGRRTIGETPRYSINVSGDISSAKKAIQEISGKSTVQANPDELIGEHISWKKMFTDRYFLMTLIGTAGAWFALDWAFYGNSIMSHQMLSAIVPASLGGVAKVKMTTFYALIIFAVSALPGYWIATFTVDRIGRKPLQILGFFMMALSYIILGVFRFISAPSYIIWFMIIYGLSYFFTEFGPNVTTFIYGPEMFPTSLRGMGSGLSSAGGKLGAFIGTALNVVIYAIFGESVLFIILAFISIAGALLTMFFLPETSGRSLEDISGERNYKRALSSGSKK

SEQ ID NO: 18090 - protein, 171 aa, Thermoplasma acidophilum
MGGLEEDLLRVGAIKFGDFVLTSGKRSTYYVDIKEAATDPSVLRKIASEFSGMIRSSKIAGMELGAVPLIVATALQMSIPYIIVRKERSHGTMSLLVGKFEKGEEIDVIEDVVTTGNSVLKAVNTLRENGAVVKRAYCVVDREEGGSDLLKENGIDLHPIIRISQVKGFRK

SEQ ID NO: 18091 - protein, 602 aa, Thermoplasma acidophilum
MQKSYGVALESPTGSGKTIMALKSALQYSSERKLKVLYLVRTNSQEEQVIKELRSLSSTMKIRAIPMQGRVNMCILYRMVDDLHEINAESLAKFCNMKKREVMAGNEAACPYFNFKIRSDETKRFLFDELPTAEEFYDYGERNNVCPYESMKAALPDADIVIAPYAYFLNRSVAEKFLSHWGVSRNQIVIILDEAHNLPDIGRSIGSFRISVESLNRADREAQAYGDPELSQKIHVSDLIEMIRSALQSMVSERCGKGDVRIRFQEFMEYMRIMNKRSEREIRSLLNYLYLFGEYVENEKEKVGKVPFSYCSSVASRIIAFSDQDEEKYAAILSPEDGGYMQAACLDPSGILEVLKESKTIHMSGTLDPFDFYSDITGFEIPFKKIGEIFPPENRYIAYYDGVSSKYDTLDEKELDRMATVIEDIILKVKKNTIVYFPSYSLMDRVENRVSFEHMKEYRGIDQKELYSMLKKFRRDHGTIFAVSGGRLSEGINFPGNELEMIILAGLPFPRPDAINRSLFDYYERKYGKGWEYSVVYPTAIKIRQEIGRLIRSAEDTGACVILDKRAGQFRKFIPDMKKTSDPASDIYNFFISAQAREKYGA

SEQ ID NO: 18092 - protein, 251 aa, Thermoplasma acidophilum
MTEEKYREIVVKDEDGVRVIEIRRENPLNPLTIDLLQEIDHAVRGSGKVIVLRGSDRAFSAGADINNFLTMDDRAAFRFSDLGQNVMNSIATYEKPVIAAIHGYALGGGFELALACDFRISDVNTKYGFPEVGLGIMPGFGGTQRIMELAGPSYGKYLAMTGKIIDEKEALAHGIVNMVSENYIDEAMKLARELAEKPAVSIRYIKEVMTSIGREGYELEKEKFALTFRTKDAKEGLTAFKEKRKPKFTGE

SEQ ID NO: 18093 - protein, 770 aa, Thermoplasma acidophilum
MDGFRIIIAEKADAGRRIAYFLSGGQVKSHRAKGTSYLEFEYNGSKTYLIPLSGHIVEADFESGYSDWNKIDLSDLIDARIVKNIKNKVAYQTLQAFRGKVEEIVIATDYDREGELIGVEALDIIKEGKEEIRRAKFSALTKNEILDSFKNLIGVNYSLADAADARESIDLIWGSVLTRFFSVTTGRLGKSFLSAGRVQTPTLAIVVDREREIQSFRPERYWTISITFDKDGQFKARYPENIKDQDTAEKIYEAIKGKNGRVSSYTSKEDHIRRPAPFSTTEFLREASRIGIMPTKAMSIAENLYMRGLISYPRTDNTVYPRSINLKSVLKKLENTAYSKYVKEIETFDRILPSRGRIETTDHPPIYPVDSPKEQLKGDYGRVYDLILRHFLSTLYRDGKKTVAEAEIYVNGYTFKAAGQHTTDRGWTEIYGYDPKDVYLPELTEGEDLKAIDWNIQREETKPPPRYDMSSLLKKMEELNLGTKSTRHDIIGKLIERGFIEGNPVKPTPLGMAFIDAVRSVNSHIADPEMTAKLEEDMDRIEKNEMSKNDVVEESKKMLHEVLSHFLTKTADVKDIITKGINAGQEIGDCPFHEGKKIMVIRDRFTYTVRCEDPSCKINFRIKRNGSITLSDQKCPVCGLPMIKIIRKGQSPEIKCIDPDCSYNRENEDYGECPADHGRLVLRQSKYGKRFLGCSNYPKCTVTYPLPQMGRITKTGEVCPYCGAPILALSRNGRKWKFCPNMQCEYNKKRKPEAAVEKSVRKKGRNASKS

SEQ ID NO: 18094 - protein, 260 aa, Thermoplasma acidophilum
MMNCSIKIDNVSMRYGEKLALDGVTLDIPEGTIYGILGPNGSGKTTLMRIILGLLKQTAGSAIVCGYDSTRDQMKIKEISGYVPETPILYESMTPSELFSFIASIRRMDEGTFRRRVDALIDAFGIAEYINEFIGSLSFGNRQKVAIISAILHDPKILIVDEGINGLDPRSAKLFKSILTDMRDHGKIIVFSTHILEIAESLCDHVAILYNGHIVANGTIADLRNEANAPSQNLEEIFLKLTNADDIPEVARYLRDEIEH

SEQ ID NO: 18095 - protein, 449 aa, Thermoplasma acidophilum
MMQEELNGIKIKVTPPGPEAKKIIDMNDRYLARSTQSLPVVGKIGRGVYVEDVDGNVYLDFSSGISVTNLGHVDPYVTAKVEDQLHKMWHFPGTDFYTEMQVLAAKSLIEVTPGKFEKRVFFTNSGTESVEAAIKVAKSYTGRGMFIGFIGAFHGRTQGSLSFTASKPIHHRGFFPSMPGVEHVPYPNPYRNPFGIDGYENPDELVNRVIDYIETYLLKTYVPPEDVAGILAEPVQGEGGYIVPPMNFFRELRKLADSYNIPLMMDEVQSGFGRTGKFFASEHFGVEPDVITLAKAIASGIPMGAVVMRKEMNFKESGLHSNTFGGNLIASAACVATIEEMKKLNVVENSAKQGAYLRKRLEELQSKYDAIGDVRGLGLMQAIDFVKDRRTKEPNSKLRNAVIDNAFRLGLILLSTGSSAIRIIPPLIITQDQIDEGIEVLDKAIKQSL

SEQ ID NO: 18096 - protein, 384 aa, Thermoplasma acidophilum
MVSHRYKGFNTKAVQSGELRDPRFGNVTTPIFETSTFVYPNPEKEAYTDHTRDQPYIYTRWGNPTVQAFEEKYAAVEGAEYALSFSSGMGAITSAITGLLHPGSRMLSLSDLYGQTFYFFNKVLGDLGIKVDYIDTERINSLDFDPSKYDAIYMESITNPTLKVPDIRSVSDYAKKSLVIVDATFASPYNQHPLDLGADVVIHSATKYIGGHSDIVMGVVGTNSKEIFNSLVIRRKTYGSNPDPIQAYLALRGLKTLGLRMEKHNRNGMEIATFLRKNDSISRVYYPDTEMGKKVLSGFGGMVSFEIRRDRDVHSFLRKLSIPMVAASLGGVESLITLPAETSHSSLSREERERMGISDNLVRFSIGIEDAEDLIADIQNALGA

SEQ ID NO: 18097 - protein, 193 aa, Thermoplasma acidophilum
MFIAIEGIDGAGKTTLARGIGNMLLGEGYRVYMTKEPTDGMENYAGDGVELFLKFTINRYAHQREIDRHIKNGEIVICDRYIRSSYAYQFEGIAEFFGNSEKAWEWMDSVSEIIKIRPDVQIYVDVDEETAMERISRRGLRNPHFENEQKLRSVRQIYKGFQWDLIVDGGRDKEAIISETFEKIIARLRQEKT

SEQ ID NO: 18098 - protein, 869 aa, Thermoplasma acidophilum
MNGKKVYYYPLRKIFGEKVNSLPRSLRIILESMVRNLDGRSISDSDINAILNWNAENVADTEIRFKVSRVVMQDFTGVPAVVDLASMRDTVKNLGKDPELINPQVRVDLVIDHSVQVDYYGETFALEKNEELEFDRNMERYRFLKWAQKAFKNFKVIPPGTGIIHQVNLEYLAEVVFEGKKDGKDYAYFDSLVGTDSHTTMINGIGVLGWGVGGIEAEAALLGQPITISLPEVIGVRIKGKMQPGVTATDVVLTVTEMLRKVNVVDKFVEFFGPSVKYLSVPERATISNMCPEFGATCALFPIDDQTLQYLETTGRPKDHIDLIKKYLEAQGLFGEGAEPKYTRVIELDLSTVKPSVAGPKLPQQRLDLDQVPASFLSTLEQNGGDRLVTLRKVPLKMKGQNLELSDGDIVIAAITSCTNTSNPYVMIAAGLLAKKAVEAGLKVNPKVKTSLAPGSRVVTDYLTESGLLSYLEKLGFYIVGYGCTTCIGNSGPLDQDLGNAIVNNNLSVVSVLSGNRNFEARIHKDVKANYLMSPPLVVAYALAGNITVNLNKDPIATVGGKKVYLKDIWPTNEEINEAVNKYVRKDMFEKRYGNITNERWEKIDAPSSPTYAWDPKSTYIRNPPFFENFRLDQEFTDFRIKGAYPLLVLGDSITTDHISPAGSIAKDSPAAKYLIENGVKPEDFNSYGSRRGNHEVMMRGTFANVRIKNLMVKREGGYTLFVPENKEMSVYDAAMQYKKMGIPVVVIAGKEYGTGSSRDWAAKGTYLLGVKAVIAKSYERIHRSNLVGMGVIPIEYEGFNPQDIDYTKTIDVDIGSIDPGSKAKITYTDKKGEKHTIDVRLRVDTPAESDYIKSGGILQYSLKKILAS

SEQ ID NO: 18099 - protein, 405 aa, Thermoplasma acidophilum
MAYIQVKEDGTLQVPDRVTIGYIEGDGIGPDISKTTINVLNAALDIAYGGKRSIEWKKILAGDEAYDKTGDRLPQSSLDELKKCVVSLKGPLTTPIGEGFRSLNVTLRQYLDLYANIRPVRYFPGVPSPVVHPEYMNMVVFRENTEDLYAGIEWRYDSDGAKKVREFLASTFNINLTSDTGIGIKPISKFKSTRLVRKAIQYAIANKRKSVTLVHKGNIMKYTEGAFKEWGYEVAKTEFGNYTVTETEYLQDPEKYSNKIVIKDRITDNMFQQVLTRTQEYDVIATPNLNGDYLSDALAAQVGGIGLAPGANIGDHYAVFEAVHGTAPKYAGMDVANPTSLILSGEMMLQHIGWNEAANILDEAIMQTYRDQKLTQDIARLLNVKALKCSEFGEEIINRMKKPVH

SEQ ID NO: 18100 - protein, 242 aa, Thermoplasma acidophilum
MKNMVGSAIYVYLDRPDKKNALDIESIKGLEKALDEACSDEKIRAVAISGKGKDFSAGADIDMLSSFDSSSAYEFRMAMNRLSRKMRDLPKPVIAILKGYSLGGGLELAESADIRIALKDAIIGQPEVSIGINAGAGGNVILPRIVGSGIAMYMAMSGRRMNASEAKAIGLVDEVVDDEDQARKIVEDISSKPAVTLQYIKKLVNASLDLPVDRAMEEEALYFSMLFTRKEVTDLLNRWRKR

SEQ ID NO: 18101 - protein, 614 aa, Thermoplasma acidophilum
MVHLPNVYTAFHGSDIYIYHLSAETTMLAIDESELNQHAMKWIEGIKKFTEAEDVVVCDGTPEEFKQISNELIKSGEFIKLNENRYPNSFLYRSDRTDVARSEERTFIAAPDASMAGSLNNHMTLQQVSEVWNKFFRGAYRGKTMFVIPYALGPLNSRFTDYGIEITDSRYVVLNLHYITRMGKQVIGSMPEKFVKGVHATGTLDPGNKFIIHIPWDKPEGVDADILSVNTNYGGNALLSKKCHALRIASVRARKEGWLAEHMLLLEVEDPHGRKVYITGAFPSASGKTNLAMINPPKQYAEAGWKTRLLSDDIAWMKMKDGMLYATNPENGFFAVVPGTNYRTNKNAMITLSRNTIFTNTGMTKTGEPWWEGLDPLQEELYDWKGVLRKPDGEPIAHPNSRFTSPLSNYPFLSDRSEDPEGVPVSAILFGGRRASLVPLVYEAFNWNHGVFMGATMGVEKTAASEGKVGELRRDPMAMRPFCGYNISDYFRHWIEMGRKLSRRPKIFYVNWFRRRQDGSFIWPGFSENFRVIEWILYRLDHNDNAIETPIGYIPENINTDGLNLTKQDMEELFRIDRDGWREEMKSIGDYFSQIGNIPEDLLIEFEMEKRRIS

SEQ ID NO: 18102 - protein, 616 aa, Thermoplasma acidophilum
MIDIEIGGDAPFFRKIKVHLGKIDASTAYVEGTFNCQGEGSIVLEGNSESTDEVDGLVPDKYEFRIALDQYRFLRNSQSRSNMFQVSLWLDAVYHDPDLSQFSCILDDRLMDIRIAVPKQVVSVRILTESEVKVVYSRRSSQATYDIVEFVISGVSGYAFEVDQVRYPDHGYYRSTKRINSEGNSKIMYHIFPDRFHRYGEDRPGLIKWGEKPSRDSFFGGNLEGIRQKIQYIKDLRVDHIYLNPLFKSKSNHRYDVDDYYSIDELLGTDQDLKNLVSDAHASGIKIVLDMVFNHTSTDFPAFRDVIEKGRNSPYYRWYIFHRDEFTVFRGRGKRGSYPSYETFMGYGGMPKLDHRNPEVRRYCINVLKYYVQKFDVDGFRYDVAHSIYSKFFEEVFSEIGTGILHIGEAWCLPTYLVNGSAWQSYTNYFLGGSIIDFLKGSITLGEFYDRVQRMLIVNGIEKQQAMMNVLDSHDTPRILRILNGDRKKVKLAYSILYLFDGIATIYYGDEVGLDGGKDPDDRRCFPWDSMDEDMHSFFMNLGDLREKYSLGSAGVITVFEDEASFVIEKVKAGRSISVHMAKNGRMKFPKDSLIAVRENQKEVKPWDFYIYLRTV

SEQ ID NO: 18103 - protein, 279 aa, Thermoplasma acidophilum
MIKIPQAGRDLETIAVIGAGTIGSAISISLAKAGYHVISTRRRPDLNAGLKAYGITVTSDNVQAVTSADMVILTLKPADLVSEMKKLSQILEGKIVVSMAAAVPIRVIRHILPRSFIVRSMTNIAAEVNAGYTPFCTLEEDEGKISFVSRVLGVFGETERVDEKYMDALTALSGSGPAYILTIIEAMMYGGLKVGLPRSIALKASYQTVMGSAKLLAMSGDHPSAIKEKVITPGGVTIDGIYELENGKIRTSIMKAIESSTLKARKISKDLFPEESDKN

SEQ ID NO: 18104 - protein, 526 aa, Thermoplasma acidophilum
MNSAELQIHTDTERVEEKYIREDRKLRKDLGIVDLFLIGITGVIGSGWLFAPLYAARVAGPASIISWAIGGVLVLLVGLTFSHLMGFRTEAGGMVRYPIYTHGKLAGSITGWALWLAYTMNPPSEASALVEYMSSYVPGVFHSGTLTPEGMGIALGFMFLFVLVNYYGVKIFARIINGLTALKLVVPTVTMLTLILLSFRFRNFTVSGFYPYGLSSVLAAIVSAGIVYSYLGFQAVINLAGESKRPARDGPTALILVIIFSLVFYIALEITFIGSVPSSFLRHGWSGLFLASPFADIALYFNLTWLYSLIIADSIYSPSGSSMAAVASNSRATYALAKDGFFPSFFVRIDGKTGIPRIALIFNFVISAIVLLTLKSWHSIIEALGVLLLISFIGPAASSGVIRRTSPENQILKGLYGVVQPAIFVMAGIIIFITPFTKIDIVIALFSIPAVLLILKEKNFRNVDLGYGIWLPVYLIIILSFSFLHTYYESLNILVPITAFVFLSLFVYIIAVRAGISFMKSGKQKE

SEQ ID NO: 18105 - protein, 174 aa, Thermoplasma acidophilum
MSLVNKAAPDFEANAFVNGQIKKVRLSSYRGKWVVLFFYPADFTFVCPTEVEGFAEDYEKFKKKNTEVISVSADTVYVHQAWVQHDERVAKAKFPMVEDRKGTIARAYDVYNEETGNAQRGLFIINPDGIVKYVVITDDNVGRSTDETLRVLEALQSGGLCPVNWHEGEPTIKV

SEQ ID NO: 18106 - protein, 896 aa, Thermoplasma acidophilum
MIIDRIRLINFLSHEDSEIFFDTGVNIIVGHNGAGKSSIIDAIRFALFGDKRTKKIEDMIRKGAKSLEVEMEFRHGGHTYIIRRSITRRSKNPESNAMIMVDGSALSQSVKDANDYIEKNIITKSKDVFLNSVFSKQGEMDDLISGDPARRKKLLDEILEIEKLEETYDVLKDVIDSLQAGISNLDYLISENERDRDDLRRYQDDVAELSKQIDQEEAIESDLLRKKEEASAEYNAVSKELIMLDATLKNMMSLSDEANRYEEEIRKIDGKLQEISGSTERYNEITSSKVYASRERIRGYWTDKGQIIDYRKMLKNIDGQVQSYEDNMKKAAELQADHDQYEIMQRRMDEIKHELDDLRTYESKYVSLINEIEQKKKKREEYRKKQKDLGDEISRTLGRAFANASELVAIYEEIRRDIDEINTDLGNLQVKIGALRQKEEEIRRNMNMLEGHNKCPVCGTDLGDEGSRRIREHYSEDLNRLNEEIDHLEREASAIDEKKRQLISMESYLAKGKIREYETYDRQMKDLEAQITDDENSLSTIAYKHTKYEQLDEEYRSMHLEDLRQKYTDWNNAMAVISNIGDIEALRKQKDEVSKKLKDAEDRTHEIESEFPDINSYTPSYIGKIEDEVRLLEPQIKLAEDLKRQRETLREKVKDLRSRSAGMDEIQKRKNELSVKASESETRLKYVEGQIQATLSSLSGKRSKVETLRSHVSEIEQRISDRERDIERMKKIEKAINDVKRIREAFGKNGVPAMIRQSVSDYLTAKTRDYLSSFDLDFDDISVDQDFNVTVYRGGVPEGIDSLSGGEKTAVAFAIRVAVAQFLNADLSLLILDEPTAFLDEERRNSLSDIIEYTLKDSSVIPQVIIISHHRELLASANVAIEVKKIGGRSVVSNAD

SEQ ID NO: 18107 - protein, 385 aa, Thermoplasma acidophilum
MPETEEISKGLEDVNIKWTRLTTIDGNKGILRYGGYSVEDIIASGAQDEEIQYLFLYGNLPTEQELRKYKETVQKGYKIPDFVINAIRQLPRESDAVAMQMAAVAAMAASETKFKWNKDTDRDVAAEMIGRMSAITVNVYRHIMNMPAELPKPSDSYAESFLNAAFGRKATKEEIDAMNTALILYTDHEVPASTTAGLVAVSTLSDMYSGITAALAALKGPLHGGAAEAAIAQFDEIKDPAMVEKWFNDNIINGKKRLMGFGHRVYKTYDPRAKIFKGIAEKLSSKKPEVHKVYEIATKLEDFGIKAFGSKGIYPNTDYFSGIVYMSIGFPLRNNIYTALFALSRVTGWQAHFIEYVEEQQRLIRPRAVYVGPAERKYVPIAERK

SEQ ID NO: 18108 - protein, 268 aa, Thermoplasma acidophilum
MDENRGSRIAINLTGKIALVTGSSSGLGAAIAKYMARAGAKVAVHYRSGKDRADAIVDEIKNDGGFAMAFYGDVSKKEDVQKLFSEIDSKLGTVDILVNNAGIDGKRELVGEDDPDDWEKVIEVNLMGPYYCAREAVKRMKPKKSGVIINITSVHEYVPWSGYTAYSSAKAGLSMFTKALAQELSDYNIRVVAIAPGAIKTPINKDVWGNPESLKDLLNKIAMPRLGEVDDIGQAAVFLASDLASYITGTTLLVDGGMALYPDFKHGG

SEQ ID NO: 18109 - protein, 208 aa, Thermoplasma acidophilum
MQFSVGNIYQPSECHTCMDDQTFISTIKTGDKKKIEEMADDLWNYRDLYQRNALMISAMYGRTDLIEFFAARYDHIDDRDIEGNTALMWAVRNNRMESAKSLIALKCSIDIPDSAGNTPICWAVIFGYTDMVKLLISSGANINISNDEGDTPAILASKYGRSECLKMLIEAGCDLNAKNHNAQNVWKAAEAFGRKEILEVLASLSNGR

SEQ ID NO: 18110 - protein, 184 aa, Thermoplasma acidophilum
MSEREKITIENIVASTSLAEHLDLSRIALALDGSEYEPEQFPGLIYRLQEPKTAVLIFRSGKVNCTGAKNIEDVKRTIKIIIDKLKAADIEVYDDPQIIVQNIVAVYDLESELNLTDIAMSLGLENVEYEPEQFPGLVYRVEEPRVVLLLFGSGKVVCTGAKEESEIEQAVIKVKKELQKVGLI

SEQ ID NO: 18111 - protein, 282 aa, Thermoplasma acidophilum
MFERNLLEGKIALVTGGGTGIGFSIGKRYGELGASIAICGRRENVLADAVFKFKEAGIDADSHRCDVRDPTQVSETVDHFMDRFGKIDVLVNNAAGNFVSPTEKLSPHAFDAVIGIVLHGTVYMTLELGKRWIRNGQHGVVLDIVTTYAWTGSGYVVPSAAAKAGVLALVRSLAVEWAKYGIRHVAIAPGPFPTEATRKNLFPIPEIEDRIVQRVPLKRPGRMDEIANLAAYLVSDGAEYINGSVVTIDGGEWLKGAGQFNHLENLTEDQWKMIYKISRKKE

SEQ ID NO: 18112 - protein, 451 aa, Thermoplasma acidophilum
MEEYDVITIGAGGAAYPAAFRLKRSGFSVLMIDKKGVMSGNCLAEGCVPSKAVIETVHNLAKMRHFGDYSIDYSKIVDHKDSVQNIRYEQHDQELKEAGLKIIKGTARIIDDNTVEVSSDTGTSRYRSSSAIIIASGSETFVPKIPGAELAWTSADLYSLKPKVKKLPKSIAIIGGGYIGMETASFMSILGVKVTVIEMLDRVMSTMDEAMVDKLLPLLPKMDIRTASPVQSIERNGSMYHVNFGKEGEKESIEVEAVLMAVGRVPVFPEGIDDLGIEHDRHGIKVNMAMQTNIKNIYATGDVNGITPLFHAAKRQSLVAANNIMANNVPIDYFDPLSVPFTVYTIPQMAYVGILPSQARKMGIEYLETDYQIEKDALAQINNEMFGEIRIFTDKRMKVIGGYVIGNDAGNVINEIALAVSKGLSLRDLAEMAHQHPMTFEGIDSAARKLY

SEQ ID NO: 18113 - protein, 485 aa, Thermoplasma acidophilum
MYREKFTKITEGFTFDDVLLIPMRTAVEPKNVVVSSRISRHIQVKVPIVSSPMDTVTEDAMAIAMARYGAIGVIHRNQPREKEVEMVKRVKREETIIIRDVYTISPETPIEVARTLMATRNIAGLPVVKDDKLVGIVTKRDLEFVKKGSSVSDVMVRDVITAPENVDIDEAIEILHKNRIEKLPLVDSSGHLVGLITAKDIITRQKFPDASRDSEGQLMVGAAVGPFDLDRAVEVEKAGADFIVVDTAHADNENVLSSLKKMRKQISVDIVAGNIATAQAAEDLISCDVDGLRVGIGPGSICTTRIVAGVGVPQLTAISDVAEAAKDSGIPVIADGGIRYSGDIVKAIAAGADAVMLGSMLAGTEESPGQEMIINGRKYKAYRGMGSIGALTTGLSDRYSKLGNGFIAEGVEGAVPYRGRVDEVLFQLVGGLRTGMGYVGAATIEDLKRNGKFVRITNNGLRESHPHDIRLISEPPNYQISNISP

SEQ ID NO: 18114 - protein, 285 aa, Thermoplasma acidophilum
MQKNGEPVLFFFMAFFWGLNYIMVKYAYVYDVSSSILLMRVLYALVFSAIIFVRQIRFPRTPMEHLKVFVLSNLNITAFFALWFFGETGVSASLTSIVIYSYPIMSLVASYALLNDRFGRGKAMGIALGFAGLIIIFFRSINVSNYIDLIMLILAALSWAMGTVFYRKFLTGYDSAGLNTLQLLYAMPAVILIAFMTGGINRNLMIPQFNLIMLYMGSLGTAVAYFIFLTLYRRYRVSDISAFFFIVPAISVILSVILLHEAVSRIMLIGFAVMSVGIYLSGRLR

SEQ ID NO: 18115 - protein, 305 aa, Thermoplasma acidophilum
MPDKVIEVEHLRQTYDGRTFVVDDVSFYVLKGEIYGLLGKNGAGKTTTIRTMTTILPVHYGKVRILGMDVSENAEKIRRRIGVVLQNESFDFASVERNLKVYGMLWDVPREVLKARIEEVLEVFDLGQLRKVRAMELSGGQKKRLQVAREFLHDMDLLFLDEPTVGLDPIMRRSVLNYIRDKARKGLTVLYTTQIMEEADYLCDRIAIMNRGKIVAEGTSSDLKSKYGDLKTIHVVVSGEIDYEDLRAKFPEDVLFDNEEIRIVSKNVEDILPDLIIYLKTKGIRIERISVEESSLDDVFLKVVS

SEQ ID NO: 18116 - protein, 619 aa, Thermoplasma acidophilum
MFYYKPSDEAIAETNLGRFASSLGMTVKDLYARADRDPEWFWPRVIDDLGLEFFKKFDHVMDLSEGVPWAKWFTGGRINIEYNAVERYSDSENTAIVYESEDGYKSKMSYSELNRKVSALSSAIHDMGIGRGDRVAIYMPFNANSAIAFYAVLRIGAIAVPMFSGYGVDAVRNRIEDSGSSLMITSASYRRKGKAIDMSAVARSINMKTIMDADRTDFYRFEDAVSGGKNVPVERTSSEDPAIMLYTSGTTGKPKGTVHVHGGALVNIAKEVKYYMDLKENDVLHWITDLGWMMGPWALIGTNALHGTIFLYDGAIDYPDPDRIFDIVHDNGVTLLGLSPTVVRMIKFRGTSRTFDTVRVFGSTGEPWDEESWVYLFSILGRGRASISNISGGTDIIGCFLASNPAIPQKPRCLYRGLGMNASIFNEEGREVYNTVGYLVAKFPSPSMTRGLWNNREKYLETYWSKFKDIWFHGDFGEMDEEGYFYLYGRSDDVIKIAGKRVGPNEVEDMVMRVSGVTECAVVSIPDSVKGEVLAVFYVGEPGLSGRIAKQIEVGMGKPFTPAHVVRISRIPKTRNGKIMRRVIRSAFCGLPVGDVSNTDDGDVIREIDDLGKVALRQA

SEQ ID NO: 18117 - protein, 382 aa, Thermoplasma acidophilum
MQGYTDASEMIRSSIREFVRREIEPLRSKIDRDDYFPVDKFRMMGKMGYLGVTVPPEYGGSGAGYIAQAIIEDELGYSSPSLALSYGAHSNLCLDNIYRNGSKYIRETFVPKLASGDYIGSLCLTEPGSGSDALAMSTHIDEVDGELYLSGSKMFITNAPYADLFLVHSRDGDGYSSVIVLASDGGFNRGRSLEKMGMRGSPTGEIFFNRVRIEPGRIVGGRGSGKKIIMSGLNSERVILAFIFIGLARRAIDEAVNYASQRKQFGQHIADFELIQEKLSYMYVRYEASRMLAFRALEKLQFDMMDPIDAASAIMYASESAEYIAREAIQIFGGYGYIKDTGIEMLLRDAILGQIGAGTTEIRKRVIARSLVKMYEEGRRIE

SEQ ID NO: 18118 - protein, 496 aa, Thermoplasma acidophilum
MIEIDGRSLRVEDVYAVAVEYDRVSISDDTLKAVEEKHEAFLKLINSGKTVYGVNTGFGSLLNVHIERDQEIELQKNLIRSHSSGVGDYLENRYVRAIMAVRLNSLAAGYSAVSADLLNMMVEMLNRDVIPAVPKYGSVGASGDLAPLAHIGLAMMGEGKAFFEGRLMDSARALEKAGLKPYQFKEKEGVALINGTSFMSGILSIAVMDAHDILENAIRSALLSFEALGGTSKAFTPWILGARPHLGQVAIGNRFREYLTGSDIVKRADSVKVQDAYTLRCIPQVYGSVADVIDYVENVLSVEINSATDNPLFNGEEVVSGGNFHGEPVALAADFLAIALTDLGNMVERRIARLVDTNLSGLPPFLTPDSGLNSGYMIPQYTAAALCNRNKVLAYPSSADTIPTSANQEDHVSMGATGSLKLLEIIDNVRYIIAIEYLLGSQALEFTDKGMSPSTRKIYEKIREKVEKLDHDRPPSFDIETIRKMMDKKEFISALP

SEQ ID NO: 18119 - protein, 285 aa, Thermoplasma acidophilum
MIKLYDNYVFISQEGGESGERLYSKKFREKSVVDVSGLRIGEGLVVAAGPCSVENEAMILDIARSVKAAGADMIRGGAFKPRTSPYSFQGLAEKGIEYLVEAREETGLPIVTEIMNPEYYRYFDRVDMLQVGSRNAQNFDLLRFLGKQKKPVLLKNGMGNTAREWLETAEYILSGGNGNVVLCYRGVRGIENSTRFTMNVGSIIYAKSETHLPICADPSHASGRRDFVESMALASVAAGADMLEIEVHNDPDNALSDSEQQIRPVDLKRIIEKARALKDLLSHEI

SEQ ID NO: 18120 - protein, 255 aa, Thermoplasma acidophilum
MSGKLEGKIALITGASKGLGRAIAEKFADEGAKVAINYNSDEKGALEVKRRTGGEIFQADVSNRDQIRRMANEIHSKLGKIDILVNNSGIWYLMPFDQYDESKVRRMIDVNLMGAIYTTLEFLPDLKEKRGVIINMASNAGIGTAARNTTFYSITKAGIIMLTKRLAFDLSEYGIRVNAIAPGWIETDLTIGGKSEEEIKRLEDDFRSRTTLKMIGKPEYIGNAAVFLASKDSEYMNGQVMVIDGGRIDNLTHSI

SEQ ID NO: 18121 - protein, 485 aa, Thermoplasma acidophilum
MENGVRYSDLIERLDMSRVTRFYWLLTILATIGGFLFGYDTSNIGSALPLLERIYPGISGFVEGYLVAGASLGAAVGAIIAAGLTDRYGRKYLLIADAAIYAAGALLSAFTVDLVMLLLSRTLIGIAVGADSGIATAYIAEYAPKARRGSLGILQQWMITIGILAAYLIGMATLFFAPGLAYAVGWRIMLGVAAIPAIIGLAFRFMMPESPRWLLVNGKYKEASASLKRLGLNMSEEDLKSVKLSQPHKITPGVKRALLIVGLFFVFQQITGINIPFYYGPVVLENLHIVGKSTSLVYSIYYSIAASAILAIINVAATYIGFRYIDSVGRRKLALMGYAGMTFFGILGGILLYLKLDIGLFIAFAGFIIFFAFGVGGTGWMIQGEYFPTSMRGLYASLGAFIDWIANFAIIELFPVMDSAITIKNVEFVFGVLSLIALILFYYIMPETKGLSVEQIDTLFENNSLGQMKHASISMKKESVPADPK

SEQ ID NO: 18122 - protein, 457 aa, Thermoplasma acidophilum
MRTERDVIGEVQLPDNVFYGINTARARENFRITGLTADSDHIVSIAQVKKAAALANADGGALDKEKADYISKACDEIIGGKYHDQFVIDVYQAGAGTSYNMNANEVIANVALTLMGKNKGEYSVIHPNDHVNMSQSTNDVYPTMMRLTVSKKIRKLKDALNELIESLEAKSREFRGIAKPGRTHLQDAAPVTLGLEFGAYAYAMKKDRDEIIDASDYIMELNIGGTAVGTGINTAKNYQENVVKHINEITKENFRKSTNLLGIMQFMTDFSRVMNAVTNLALDVEKIANDIRLLYSGPGAGIHEIIIPAVQQGSSIMPGKINPSIAEAMNMICHSVIGAQQAVNMSVQAGQLELNVMMPNIDYELTRSIDIMTNGLKMFKQKLIDGIKANVPVCREHLANSFGSAALLNPYLGYDNVAKIVREAVETGKSIKSLVLATGKLTEEQYMKIMDSGVPKD

SEQ ID NO: 18123 - protein, 314 aa, Thermoplasma acidophilum
MSEIYSLKNVKKYYLAQKRGLIDALVKVPKIYVRALDDVSISIMDGNVIGVVGESGSGKSTMGKVMVTLETPTDGELYFKGTRVTKSEYPKIRKQVDMVFQNPATSLNPKMKVKDIVSEPLGHFDEGAIKEVILKVGLSYDEVKDKQSRELSGGQVQRVAIARALMKKPELLVLDEPTSALDESIQAQVLNLLVDLQTEYKMTYIFITHNILVAKYISDYIVVLYAGKIVEYGPTSEVLSKPLHPYTQLLLSSVPTVDVKDVKPPVGDVPSLINLPQGCRFNPRCPFVMEKCRKEEPPLISQGQNYQVACWLYE

SEQ ID NO: 18124 - protein, 410 aa, Thermoplasma acidophilum
MTVKIYGSGGSGTVALPSSKSFTQRYILGSVFLNKSVTLNYVTITGDDSIALDIAQRAGANITMNDSSIKIRTSFTCPSDIYVGESATSYRIALGLLGSAGCITHVKGDPDLAKRPMDPLVKALEANDVHLKLNEDGFYDVDGSESKKRYIEVDGVSSQFVSSMIFYYARKGGGEFLVKNMRSPGYVYITKRVLYDLGYFVNIEKTITINPSGVWKTAIDVEPDYSSLAFFLVLGLLSENVDVRFNIKRMSRIQPDSVLLDMFKDNIAIDRDTLRVLPGIRDRITVDADHNPDLCPPISVIGIFSEHGVEIDNYARLKTKESNRYEGIIDMASRFGAIVEDNGKDLFIKRGDLKDPGTLSYTDHRMIMSAAVAAAASGFEVEIENETKVSKSFPGFFKELSKFANVSESN

SEQ ID NO: 18125 - protein, 268 aa, Thermoplasma acidophilum
MNGNSIIGLIGHPVSHSIGQILYNRIFQDMGIDAFYLAMDVHMNVLPAFLKNSFFLKAFNVTIPHKVSIIPFLDDLDEIASQTRSVNLVIREQSRMKGYNTDYYGLDYALSFNQVEIEEKRIVIAGSGGIARTVIRYMLDHGAHRVDVLTRNAQNARRNLDIPGIGLHENIDEDYDIYVNCTPLGTLGDGDPFSTVDFRSGRTGIDLVYNPPDTPFLKRMRNAGGRTVSGLDVFIGQGLRTLELVFGIRPDSIFREYAVEALNEIRKG

SEQ ID NO: 18126 - protein, 360 aa, Thermoplasma acidophilum
MDAQRFVLPMNGENISVVIGEDITGHISEEVGHYDSLVFMISRNVEEMFGSKIPPLENYGSSTIKITLNDGESLKTLRNYQRIIKVLVEKKVSRNSLLVYVGGGTVGDLAGFVAATYKRGLRMIAVPTTLLAQVDSSIGGKNGLDFSDVKNVIGTFYNPYLIIDDLQFLKSTPDLIREGMGEVIKYSIIAGGDMFRKVSECSLSNFHDHSADIVKMSIKIKADIVNRDYYDRNGVRSILNLGHTIAHGIEGASKGQISHGRAVATGLMVEAHIGEKYGNTRPEVIDEIMKLADNYGIERVRISDIGVNSILRYISNDKKMSEGYINMPVPADIGNIITMKVTERMISDGLNTFIREHERK

SEQ ID NO: 18127 - protein, 658 aa, Thermoplasma acidophilum
MEINKVTVIGSGIMGHGIAEVIALAGIDVNIEDISNEVLDKAKASINSSLDRLVSSGKLKNKDEVLSRIHYFTDIPSSVKDADLVIEAVPEVLDIKKSVFDQLDKSTKDSAILATNTSNIRLTEIAEGIKKKGKVVGMHFFNPPVVLKLVEVIRSQYTEDEVFETVYEFSKRIGKTPIKVYKDTPGFVVNRINAPESLYFCLVIDNNLAKPEEVDRFARSQGLPMGPYELMDYVGIDTVYHSLQYYAKELSPDYSKCQVYTKLFNEKKLGLKTGEGFYKWVNGKAQIPEAKPTKAVELMDIFALEINEAVKIIEDGVASPDDIETGVKLGMNRPFGPITVAKGLTNAEVKAKLEALYQKFSVEVFKPAKSIAEGKLKTVISMQVALSKAEEKKEAASAYISSSDPVIMETKGRIAILRINNTKNNLINAAVMDGLEKALTDLWNNREISVIVLTGNGPVFSAGAQLDSFFSSTFDFMEFSRRGERVFKLLSEIPKVTIAELKGYTLGGGFEMALACDIRVATEDVQIGFPEVTLGLVPGWGGTQRLSRTAGQSRAAYYILTGERFTGKEAYEMGIVAKIFSKDTIDSETLNLAQNIADKVAPISAALAKRLVLRSTNTSLDDGLEMEAISMGLLYGTEDLKEGISAFLGKRKPNYQGK

SEQ ID NO: 18128 - protein, 530 aa, Thermoplasma acidophilum
MEYKYELTIDKLLQSGVSSNPDQIINYTGKREFTFKDFSKRVNTLAKALISIGVKKGDRVAVIDWDTYVYLEAYFAVPMVDAVLHTVNVRYPQDLIYYTMDHAEDKYVIVRDEFVPILSKNREAFYFIKGWIVYSETGQIPDSLSPKYVYDDLMKESYSDIELPQLSENDLATTFYTSGTTGIPKGVQFTHRQIVLHSISSGLALADDPINLTSRDVIMPLVPMFHVHAWGVPYMSIMSGRRYVLPGRYDFDHIIDLIDKYNVSVIAMVPSILYLIVTNPNVKKIAGRGIKAIVGGGALPEGLANAAEKLGITAISGYGLSETAPILTLATYNERVKAMPESEKKKFRLKTGIPIPLVQLRVVDDKMNDVPKDEKTIGEIVVRAPWLTSVYVKNKEGTEALWRGDWMHTGDLAVMDEYGYIRIVDREKDAVKSGGEFIPSLVLEDAISSCSGVVENAVVGRPDEKWGERPVAFYTGTAKPDEIRKHLIEMVNAGRIAKFWIPDDFINIKEFAKTSTGKIDKKVLREMIKK

SEQ ID NO: 18129 - protein, 326 aa, Thermoplasma acidophilum
MKEFAAKEIEPVSKDIEINGIQRSLKEKIAGQGFIGATLPAEKGGAGLDENGYMIILEETAKASPSVSMWIFLTNLYLKLNPDSDKKANILSGSIDVTVDLSPYYLRGKSAALTVTGGKLTGKITNVINGTASSIIASDGSSIYAIDSGMHAVSKSHLGLRGMDLSDVDFDSSTYEKVGSEEKLRMELKNSDGEVAAIFLGIADGTMIKAADYSKVRNAFDRPLKDYTPIFDEIVSAKTEIDLIRFYLYGNQSEYAKALCKIKAREIALTASRSSLQIHGGYGYIHDFGIEKYYRDAMAMAVYFGEDSWENSVISQAVLGEKGGII

SEQ ID NO: 18130 - protein, 397 aa, Thermoplasma acidophilum
MRRRRITVWPRSVWEEARAIPLCLRGIDMNFEFDEAQKEFRKKVEEFARREFTEEAASKYDLQEKYPEEVVRRMISEGVFDYSNPWNILVATETFCKYDAGMGISMLVPFFGNEVIALFGNDDQKKKYLSKVFSGQAKMGLAVTEPGGGSDVANIKTTAVKEGDHYVLNGSKMFITNGDIADFFVLLARTSVEKKKHQGMSVFIVERNFDGFKSNKIHGKLGVRATDTAELTLENVKVPAENLVGEPGRGFYYIMTFFDISRAYVAAQALGIAEGILERAVGILQKDGPITSQPERVQFAIADMATRIEAAKLLTYEAASFIFNFNPNPAVTSMAKAYAAETAVYVSRKAMEITGIDGLSSNIERSFRDAKIMEIWEGTSEIEKLVIARMLKVGDSQ

SEQ ID NO: 18131 - protein, 396 aa, Thermoplasma acidophilum
MNSEKVYLVDFKRTAFSRSRPNDPERDVFNSIRMDEAMAKLINVVIDETGIKPEEINDVITGCALQMDENWTYGGRHPILLANLPENVPGMALDRACSSSLNAITIGAMEIMTGNSDIVMAGGYEHMTHVPMGNSPFLKPNIKLMVRPEYMHWDMNTGYSMGLTAEKLAALRGITRDEMDRYSLRSHQLASKALDDGYFKGEIVPVEVEINGEEKVIDTDQSIRKNTSLEDMKKLKPAFKDDGVITAGNSSPLNAGASLTLLMSEKKVKEYGLKPMARIVSFGWAGVDPSIMGEGPVPATKNALAKAKMDVSDIDLWEINEAFAVVVLNAMKELGIEEDRVNVHGGAIAIGHPLGATGARIAGTLARIMNEKKKDYGVATLCVGGGQGYSVVFERY

SEQ ID NO: 18132 - protein, 388 aa, Thermoplasma acidophilum
MVLLFMNLSFAGFSRMVGISMSKFEECNIKEDLKSDLKRMGFVDMTAVQERTIEPALAGRDLIIRSKTGSGKTAAYLVPIINNISLGRKPSALIVLPTRELALQVHGVAEKLGHSSRIRSTVIYGGASMSRQIELLDRGTDIIVGTPGRILDLHERGFLNLSAVKYFVLDEADVMLDMGFIDDIKRMMSLLREDKQTFILSATMPEEIIDMANDFMRDPETIIVGSDEVTVKEIYHYYAISKRNRKLHVLQTYLKTYGPQKTIIFSRTKVGTKMVCDFLLNMGYNAVMINGDMSQSQRERAMYLFRNRADYLVATNVAARGIDIRDVTDIINFDLPDDPKVYVHRVGRTARLGSEGRAFSIVEEGQRDAVYQIEHMARVSLKQIKLQE

SEQ ID NO: 18133 - protein, 749 aa, Thermoplasma acidophilum [sequence omitted]

SEQ ID NO: 18134 - protein, 783 aa, Thermoplasma acidophilum
MNPGIEKYEIRFDFDLKDFTYTSHERIHLAGDWKDIKLDAVRLSVDKVTCNGQPMRFETGQDTVTVKGSFHDKDVIDIDFHAKVSDTLMGLYLSRTKEGTMITTQFESNGARMAFPCVDHPAYKAVFAITVVIDKDYDAISNMPPKRIEVSERKIVEFQDTPKMSTYLLYIGVGKFKYATDKYRDIDLILVSLKDIKSKYPLEIARKSIEFYESYFGIPYALPKMHLISVPEFGAGAMENWGAITFREVALMATENSGSIMKQNAAITIAHEIAHQWFGDLVTMKWWNDLWLNESFATFMSYKTVDSFSKQWDVFADFIRSETGGALRSDSLKNTHPIEVDVKDPDEISQIFDEISYGKGASILRMIEDYAGYEEFRKGISKYLNDHRYGNAEGSDLWTAIEDVSGKPVKRVMEYWIKNPGYPVVSVVKSGNKFRLTQEQFFLDGTRGQGKWPIPLTVMTKSGKKAMLMEESAEIEDMVKVNVNSSGFYRVSYDGESFETVMKNYSKLSNLDRWGLISDLYAFLISGRVSVDDYLARIKGFFEDSDHLIVEEIASQLTGLYLLKPDSNRIRETAASYLSRQVVALGDKQKGEDDKISKIRGIVTQDLAMVDDHFASDLARKFSTLAEDPDLALAKSIAAAKAYGISELASAADKYTDDEIRVRIIAAMGWCSPSDLKSVFELIDKGTIRKQDMLYVFSNMPANPKGRDFFFSNIDRIVALMEHAFEGTGYTSRILETAIPYLGLARYEDVKKKAEQIRKPSYNVGINKGLETLEIVRKLYNKL

SEQ ID NO: 18135 - protein, 333 aa, Thermoplasma acidophilum
MDPFRKAIKGYDHDRIPVWFMRQAGRYLPSYMKYRQRMGIEEMMSSPDVIVDVTHDPVDRIGVDAAIIFADITTPLSGMGLRVRFLDSVGPVVENNIEKSGISAVEEFDPSSFSHPVLKAISKYRERYADPLIGFAGGPVTLLSYIISDGVDRDLFRVKRMMITEEKAYQAVMTRLTDMIIEFARMQISAGVDAFQIFDSWAGYLSPGEYEHFVKPYVYDILQELSGSIPTIYFSTMTSSYVADMDLPADFYSIDWRIDMKRFSAEIPDEKGIQGNLDPAIVNYDYALHEASKIVEAASGRDRYIFNTGHGLLPSTDPEKLKRLVEYVHSVNL

SEQ ID NO: 18136 - protein, 308 aa, Thermoplasma acidophilum
MKSALLLLSYGSPERIEDLDEYLKNIFNGKPVPESVREENLRKYEMFGGRSPSNRIIESIARKLHEKIGDDMDVILAYKHWNPSIEEAVKGLGSYDNIVAIPLFSFYSQNVKDSYLNPLESALRRYGFSPRLEFVNGLANSDLFLPMWANIISEDASEDSFYLFDAHSLPAPDREEDYLFWLRYSTYKISQILGLSRSDFGFQGGHLGWLGPSIYDVLNRIDASKITVIPISFLYDHLEILYDLDYEFRKAVEAKGMHYRRVRMPNDSAMMVNMIERAARSAITHLSGEKINGSIIGQPRIADTDNGR

SEQ ID NO: 18137 - protein, 411 aa, Thermoplasma acidophilum [sequence omitted]

SEQ ID NO: 18138 - protein, 445 aa, Thermoplasma acidophilum
MGFFDEMDNMRMRPFHRKMEILASMGMFLDGYDLSVIAMAILLMPIQLKFSKPEYILVNVSALAGMIVGAPLLGRLSDRIGRKKIFDIDLILFVVFAITAGLATNFWMMFISRFMLGVGIGGDYPISSTIVSEFAPVKRRGTLLYAMVGMYWLGSLFSGIMNYTFAFTYYFWRYTFIIGGIVAIPIISLRMQIPESPRWLVSQGRADEASKVIENITGKEPDLNEGVIEGKEERSVRFRDLFSSGFLSKTVFVLSVWFLFDVASYGIGFYYPTMMREIGLSASALNTAGLRVIAEIGMIVAVGAIVGYAVAMMLADRVGRRVLTLVGVFVMFALLFLGSMVKIVSLIPLVSFFFSFVLFEQWVGAATLFYPTELYPTNYRSTIQGIATSVSRVGAIMGVVVFPLYPIFHSMFLFATLMFVAFVITVLFAPETKKKPLEKIWNAKA

SEQ ID NO: 18139 - protein, 497 aa, Thermoplasma acidophilum
MMASVTGMIGSGWLFSAFYASSMAGPYSIFSWLVGTGIVAILALIYADLSGRVPMAGAAAGYPFLTNGTVAGSLNAWSLFLGYASTPPLEVIASISYLSFLVPGLLNNNGLLTTTGILLAVALLVAFFILNATGIRNTSRFNNIISYMKIAIPIITSFFFIFTIFSIRNFTLVGTVKPEGIFTAVPGAGIAFSFLGFRQAVELSGEAKNPQKTVPIAIMLSVAVASAIYMIVQIAFIGSLQWGSIKPGDWAALADSGYSSGPMLVLASTLGLGALATVLLFDGIISPLGTSSIYQTTTSRISYRISEMGFFPKKISTTNSRSVPIFALILDLVVMILFVLPFPSWQSLVSVNSDLTIIAYMSGPISLAIFEKYGIEAKGFRLPASKILAPLGFALSALIVYWSGYPTTLYMSAIAIAGLVLFVFARKNPIRDISQGSYMIAILAILPVVSYLGSYGIGIIPFPLDLIVISAVALAIFYAGTRAAPQSVALMENFISS

SEQ ID NO: 18140 - protein, 437 aa, Thermoplasma acidophilum
MSIIFAKLLLIILSYTHMKEKARNVYMVAGGVTKFAKASPEMDFRLRVKKAFDYAMNDAGLTLADIDGSVASYFSDHFQRQLMSGIMVQDYLGLVPKPSKRIEGGGATGGLAFQAGYEEIASGRMDTVAVYGFETMSHVNTWKGNEFIALASDTNFDYPIGGFYTGYYAMMAVRHMYEFGTTVEQLAKVSVKNHGNALHNPYAQSPMKLTVEDVRNAPMVSYPLTRLDVCAMSDGAAVAILASEDKAFEITDHPVLIKGIGTGTDSMRLADRPFGDVPLLPNEKPSDYKDLKYPGVHSFRAGRMAAKEAYEMAGITDPLNELDLIELHDAYTSSEIQTYEDLGLCKYGEGGQFIDEGKPELHGKIPVNPSGGLLAAGHPVGATGIMQAVFMFWQLQHTIKKHFHDDYLQVPNAKRGLIHSHAGTGTYVTVTIMEAAK

SEQ ID NO: 18141 - protein, 153 aa, Thermoplasma acidophilum
MELLNVGDIAPDFETVDQYGKTVKLSSYRGKPVVLYFYPKDNTPGCTTEACNFRDNFNSFKDSGVEVIGVSVDSPESHKKFAEKYNLNFTLASDKSKDIVKKYGVLGLATAKRVTYIIDPDGKIAYVYPKVTPKDHALEVMNKLKDLGLVKNN

SEQ ID NO: 18142 - protein, 338 aa, Thermoplasma acidophilum
MDKLRVGLLGSTGVVGSLLSKMIAIHPYFDLANVYASDRSAGQRYGNVVYGGASDLYRNLEVKESNPDRIISDHNDIIFSAVSDEKAGLIERRLAEAGLPIFTNASANRLEDDVFLIVPEINGDLVGSIKRKGFIIANGNCSTIGLALGIDPVIRGRSAVKIIVTTMQAVSGAGYPGVSSLDIIDNMIPYIQKEETKIERETKKIFSGKLDTEIFATTTRVPVKIGHMESVHIEFDQVLDPSEIRAEFRSYGNGLLKTVYPSLPDRSVILLEKDDRPQPALDATNGGSALKAGMAVSVGRLRVRSRSLDLVLLVNNLVRGAAGSTLLNAEIAYKEGII

SEQ ID NO: 18143 - protein, 1195 aa, Thermoplasma acidophilum
MKEIVDAYFKKYGIVNHQLDSMNSFYATPDNPNSVMQQIVDETKVSDDADPGYFVLDPAKTGGHDIRIYYGRVRENGHYVGEQTIFIGKPEIKEASGASNQITPNEARLRDLNYLAPVTLKLRIVEDGIEKGSEIIKVGDLPVMVRSKICTLSEENLDQYIEKNNGPIGLSRREKLQYVGEDPDDPGGYFIIGGSERVIVSLEDLAPNKIMVEWEDRYESKVEVSKVFSQRGGFRALTSMEKGTDGTINVSIPSVAGTVPLVILMKALGLERDVDVHDAIASVPEMEPIIYSNIEDSKNPKVLPPNGVNTTEDAISYLEKRFAAGQAKEFRDKKISQMLDHSLLPHLGDSPSDRIRKAIYLGRMARSLLELSLGIRKEDDKDHLANKRIKLAGDLMDELFRSAFQSVMKDLKYQLEKTYNRKRGIKIRPAVRQDLLTQRVLHAMSTGNWIGGRTGVSQLLDRVSNLSTISHLRRIISPLTRTQPHFEARDLHPTQWGRICPNETPEGQNCGLVKNAALLINVTQGIDPDSVMEILKGMDVREVLEESPKKGRVYLNGDFIGYHDDPRYLVSRIREERRSGRMSDEVNVRYDDNTNEVIVNSDRGRLRRPLLILKDGKTVLDRTMIERLKHGEISFEDLVKQGAIEWLDAEEEEDTYVAVYAYDIPEKCPHCNSYLYRSMVDWVNPGESEITLECGFCHQRFNVPSKLSKENTHLEIDPAMILGVVASIIPYPEHNSSPRITIASAMAKQSLGFAQSNVRIRPDTRGHLLHYPQVPLVRTRVMDYIHYDRRPAGQNFVVAVLSYEGYNIQDALVINKAAIERGLGRSTFFRTYSAEERRYPGGQEDKFEIPTHDIIGARAEEYYKNLDDSGIIFPEAYVEGSDVLIGKTSPPRFLEEGEERLGPQRRRESSVTMRPNESGYVDNVFLTVSESNSRVVKIKVRSERIPELGDKFASRHGQKGVVGLVVPQEDMPFTEDGIIPDLIFNPHSIPSRMTVGHILEMIGGKIASRTGRFIDGTIFSGEPEKSLRDALVKYGFRKSSTEVMYDGITGRRFKADIFVGVIYYQKLHHMVAGKFHARSRGPVQILTRQPTEGRSRQGGLRFGEMERDTLIAHGAAMVIKDRLLDQSDGTVLYVCGNPSCGHIAIYDRRKGTLRCPVCGNTGNIYPIETSYAFKLMRDELISLGVVMRLMLGDMK

SEQ ID NO: 18144 - protein, 395 aa, Thermoplasma acidophilum
MDFEFTEDQKLLMETARKFSESVIAPSIGKMRSQRRIQDEVYSQMAKMGYLGMTVPEKYGGMGADAVSTGIVAEQIARNDPTASIPVLFLVDNAWSYLMAKYGNEKVFGDILRKVAKGEWITAIASTESGHGSDVAGIDTVAKRSGDEYIVNGEKSFISLVRDVKEHGGGFVTVVKTRENAGSRGISLLYIPYSDDIEISYLEEMGREGSSWGVLRFNDLHVPAKYLIGEENRGFNIVHEGFEFARGLISVISAGTALKSIENGINYMKQRKAFGREIATFEGLQFQVADDVAKMEAALSFAYRALWIYDQEQRHGKYSRFYVSKNIAMAKLISTTWGFDAINDAMQWQGAYGYSKDCPEEWALRGIRSFMLAEGSREIMKLIIARESIGKEYMR

SEQ ID NO: 18145 - protein, 300 aa, Thermoplasma acidophilum
MADLSTSVAGIRLENPLMLASGILDENGYTMLDVMNNGAAAVVTKSIGMEERNGYSAPVIVEYGDSLINAVGLSNPGIDNFAEEIRIAKRSGKPVIGSVFASDAESFVNLGRKMQEYGCDAVELNLSCPHVKGFGLEVGSDPDLVEDIVNEMKSKISVPVFAKLSPNVSDIIEIAKAAEKADAYVLINTVKAMKIDIRARMPVLTNAYGGLSGPAIKPVGVRYVYEVKKETGKDIIGVGGITTYEDAVEYIMAGASAVQIGTALYTVGKSVFRNIISQMNTFMDDEKFHSIQDMVGVAIR

SEQ ID NO: 18146 - protein, 437 aa, Thermoplasma acidophilum
MCSSGSPTFFYNVSISTSMKTSDVSGFYKLSVDDRIQFVKEFSDLTDDEVSILKKNGSLPIEKADKIIENVITTIEMPMGIAVNFRINDRDYLIPMAIEEPSVVAAASNAAKVARKRGGFRAFATEPIMIGEIQVLDVPAPYSAKIALLESKQKILDMANTRSKTLSSMNAGARDLEVEIFEYPYRMMIVHLIVDVRDAMGANVINSMCEYVAPEIARITGGRVNLRILSNLTKNRIAYASAVFPKEIIGEEAVDSIIEAYHMAAIDIYRAATNNKGIMNGVDAVLIATMNDWRSAEANAHSYAAMYGYGPLARYEKDANGDLVGSIEIPMAVGTIGGTTRSIEKARIAMKILGVKDAKEFSGVLAAVGLAQNFAALRALATEGIQRGHMELHSRNIAMSVGAVGDEIDKVVSRMIEEKNISMANAQKILQEIRNKN

SEQ ID NO: 18147 - protein, 295 aa, Thermoplasma acidophilum
MKIKMQDSVSFRMEFREFGKTGEKISKIGVGTYYDVGWMFLARFGRKSGSEMKIRAIRTAVENGVTLIDTAEVYGSEDLVARAIEGVDRESLFIATKVWITHLSYDSAIKACKRSLKRLNMKYIDLYQIHFPSPIGDIEGTLRAMEKLVDDGLIRYIGVSNFNLDQLKHAMEAMKKYEIVSNQVHYSLRHRDPETDMIPFAEKNGMAILAWYPLEHGDLVRDEAYPTAFLSDLRKRYPEMRASQIALSYLMEANSNVFPIPRASNPDHVLENINSVKYHLSEGEIKILKDSFRSL

SEQ ID NO: 18148 - protein, 647 aa, Thermoplasma acidophilum
MESEKGTLPMNEVYNPGMNVYSEIYRKSLEDPENFWAKQAEILTWYSKWNKILDDSKKPFYRWFVGGKLNVSYNAVDRHLEQHRRNKAAYIWVGENGEEKIVTYDGLYRRINNLAKALLNLGIKKGDRIVLYLPMIIEAPVAMLAAARIGAVFSFVFAGFGAGALAERINDSKAVLLITADGGFRNGKVVELKKIADEALEMTSTVRNVIVIKHARNDVNMVEDRDIWYHEIVGDSHTYVEPEHMDANDPLFILYTSGTTGKPKGAVHSTGGYSVWVASTLKWAFNPDEDDRWWCAADIGWITGHSYIVFAPLILGLTSIMYEGSITYPEPDRLWEIIEKYRVNILYTSPTAIRTLMKFGEKYPQRHDLSTLKVLGTVGEPINPAAWKWYYEIIGNSRCPIIDTYWQTETGGFMIAPQRGLGLPPLKPGSATFPLPGVDPAILDDAGKEVRTGEKGYIVFRRPWPGMLMTVNNDDERYVKTYFSKFPGYYYCGDYAVKDEDGYYWLLGRSDEVMNVSGHRLGTIEIEDAIVATGLAVEAAVFGKPDPVKGEAISAFVVPKDANADRHELISEIRKRIRADLGPIYVPDEIRIVKLLPKTRSGKIMRRVVKAVALNQIPGDLTTLEDSTSVDEIKSAIEAFKGEAGGE

SEQ ID NO: 18149 - protein, 996 aa, Thermoplasma acidophilum
MIIRNDYIVIISLDHCMSEKAFSISIDGRSYDANDGETVLQVMMRNRLDISHICYHPSLGPIQTCDTCLVEADGKIVRSCATQVHENMNVVYSEDRVKDLRKEAVQRILANHNLYCTVCDNNNGDCELHNAVLDLKIDKQKYPFSRKPYDVDDSNPFYVYDPSQCILCGRCVEACQDVQVNETLHIDWSLERPRVVWDDGSKINESSCVSCGHCVTVCPVNALMEKTMIGNAGYLTDLDTETKNTMIDLVKAFEPIITMRPVMAISNIESKMRETRIRKTKTVCTYCGVGCSFEMWTVGRKILKVQPKPESPANGISTCVKGKFGWDFVNSPDRLTEPLIRDGDRFRMASWDEALDLIASRLREIKEKYGPDAIEFIASSKGTNEEAYLVQKLARQVFGTNNVDNSSRFCQAPATTGLWRTVGYGGDAGSISDLYVSDLILAVGTNTAESHPVIATRIKRAHKLNGQKIIVADLRMHEMARRADVFIHPRPGTDLVWINAVAKYIVDQGWQAREFIEKRVNFYDEYVKSLEPFTLEFAEKVSGVSADDIRKIATMIHEAKSMAVIWAMGVTQHQAGSDTSTALSNLLLLTGNYGRPGTGGYPLRGHNNVQGASDFGAMSAYLPGYQSVSDEKARKKIEEYWKCQIPDKPGYDNNTCLEAINSDRIRAMYVVGEELVETGSDSEYIRKQLEKLDFLVVEDMFLSETAKYADVVLPAAASVEKEGTFVNTERRIQRIYRVMEPLGNSRPDWQIIQDVANRLGAGWNYRHPSEIMQEVSKIAPIFAGVSYERLEGFGSLQWPVSDGGKDTPLLYTDRFNFPDGKARFYPLKYSPPLTVDQEFDLHLNNGRILEHFHEGNETYRSPGLKEKVPGTFVEVSPELAAERGLKDGDLVRITSKWGSIKVRVLVTDRVSGKELYMPMNSGGDSAVNNLTSRLMDPTAHTPAYKELPVKMEKIEGGHGESPMPRTNPRYGKPHPQRGVMVEEKWKRSDYIKLTGD

SEQ ID NO: 18150 - protein, 322 aa, Thermoplasma acidophilum
MDWELELHSKVEEVNARLLETVKSEEPDLDRMARYTIEAGGKRFRPLLTILAYESSTDEPYFKILDLATGYELIHTASLIHDDIIDNSPMRRGRPTLSYKEGVNNAIVVADYLFAKAYELGSRYGPIVSKVMADASSRLAEGQILEAVNLGNLNISEDTYYRIIENKTAHFFEACARGATIAANADLNTRNMLSGFAFNLGMAFQVTDDILDITGDDKYTGKPTFVDIKHDALTLPIIYALHNSDENDRDKIVGMINGSIEIDKDLLKRIFLRSGAIDYSFGIAKRFITSAMDYLKNVTRSPDIDLLMELALMVIDRIEIYG

SEQ ID NO: 18151 - protein, 512 aa, Thermoplasma acidophilum
MKALVEDDLFSKIGLDDVNSGVYDGEWVKPSGKMLTVKSPIDGSEVAKISLATRADYDRLVSRAIEEFKKWRMIPAPKRGLIIREIGDELRKEKKNLGKIVTIEAGKTPSEGEGEIQEMIDISDLALGLSRQLYGLTIASERPYHRMYEQWVPLGPVAVITSFNFPASVWSWNAFIAAVDGDVVIWKPSSKAALTAVAVMKVIERVLKRNNAPNIFFLMVSSGSEGGDWITNDPRIPLVSFTGSVPVGKKISENVAKRLGKSILELGGNNGAIVSDKADIDLALRGVVFGALATAGQRCTTTRRVIVQEKIYDQFLEKLKNAYSTIKVGDPREKGVLVGPLIDEDAVKDYEHAIDLAIKQGGKLIFGGKRITIKGLEGGHYVMPTIIEAKPDMPIVKEETFASILYVMKYRTIEEAIEIHNSVPQGLSSSIFTTDLREEEAFLSPYGSDCGLANVNTSTAGAEIGGAFGGEKDTGGGRESGSDAWKYYMRRQTVTKNWGQTLPLAQDVVFEF

SEQ ID NO: 18152 - protein, 250 aa, Thermoplasma acidophilum
MKGKVAVVTGSGRGIGREIAVYLAKQGANVVVNVKKRVEDGNETLAEVRKYSNGIMVQADVSTRAGARHIAEETQKEYGQCDILVNNAGLGIGMPFLDSDDRLIEKMVSTNYLSAIYCTQELTKIMPEGGSIIMMASLAGIRPMVSLSLYGSLKAAIIKLTEYLALEFKQKKIRVNSIAPSIVKTKMGESLIDYMHMTEDEYTSKHTLTGSIIYPEEIAKTVDFLVSSPNITGQTIVIDSGQSLIGDLTI

SEQ ID NO: 18153 - protein, 427 aa, Thermoplasma acidophilum
MKIMASQKPHLNLITIGHVDHGKSTLVGRLLYEHGEIPAHIIEEYRKEAEQKGKATFEFAWVMDRFKEERERGVTIDLAHRKFETDKYYFTLIDAPGHRDFVKNMITGTSQADAAILVISAREGEGVMEQTREHAFLARTLGVPQMVVAINKMDATSPPYSEKRYNEVKADAEKLLRSIGFKDISFVPISGYKGDNVTKPSPNMPWYKGPTLLQALDAFKVPEKPINKPLRIPVEDVYSITGIGTVPVGRVETGVLKPGDKVIFLPADKQGDVKSIEMHHEPLQQAEPGDNIGFNVRGIAKNDIKRGDVCGHLDTPPTVVKAFTAQIIVLNHPSVIAPGYKPVFHVHTAQVACRIDEIVKTLNPKDGTTLKEKPDFIKNGDVAIVKVIPDKPLVIEKVSEIPQLGRFAVRDMGQTVAAGQCIDLEKR

SEQ ID NO: 18154 - protein, 486 aa, Thermoplasma acidophilum
MAWPFMNRLICRHRYYRFQIRCIWHIIFCILKKYISWSCIIGIMVEFKSSHAAFDQMRITPTFIEITILSSMGVFMDGFSLSIFSAALTYLKSYILVRAIFVSLAASAIYIGMFLGSFTMGHLSDRIGRKRMYTYDLAITSVFLVLTALSTSFYEFFIFELLAGIGIGADYPLSSSIEAEFSPRRSRGRFLVFNIFMWTIGSIVFYVISIPLIFRFGSESWRWMYGVGAIVPVVVILARRALPESPYWLVKAGKDSEAKTVADSMGREAGYTDVDLPNVEKGSSSFRSVFSGSYLPLIIFASLAWFSYDVSSYGVWNYTPSIFVSVGVSAVSSILSTLLEDLPVIVGFIICLLLIERVGRKILQSVGFGLAGVSLLSFALYADHRTLPFIMLFTAFAMMHLFHNIGPTNLTYVYPVEIFPTRIRGTAMGIATAASRIGAILGVFAFPLITASMGMSASLMFFAIFEFVGFIVTVVLAPETKSRPIT

SEQ ID NO: 18155 - protein, 467 aa, Thermoplasma acidophilum
MLYGVCRRKHLIIDGYLFSMIMEDQERTERYNEDALRYSEYFKGKIQTISKVPVRSLDDFSIWYTPGVAAVSRKIASDPDLSFELTGRWNSIAILTDGTRVLGLGNIGPEAAMPVMEGKALIFNYLGGVNAIPIPIRVQSKEEFVKVAKALEPSFGGINLEDIESPKCFFLLETLQNEMNIPVWHDDQLGTASITLAGVINSLRIVGKKIDQVKVVFNGAGAANIAAAYLFKAAGFKMKNMILVDSKGILHPEREDIDALMINNPWKYQLAIETNGERVKGDLSNAIEGADLLISAAKSGPDTIDSRIVKKMNNDAIVFVLANPIPEMWPQEAKENGARIVATGRGDFPNQINNSLVFPGVFRGVLDARAKGVNFDVMVAASYEIANFVEDPTEEKIVPTMEEWELYPRLASAVASKTVELGLARKSDSKEGFYRRAREIIESNRNIYSKLMDLGLIKRMPNGEHKN

SEQ ID NO: 18156 - protein, 410 aa, Thermoplasma acidophilum
MTESKGFLRLAWARDHMPVIAEIRKRFQAEKPFKGIKVAMALHVEAKTGIFALLLKEGGAEVKMASCNPLSSDDSVVQSLKEDYGMPVFARKGETSEEYYEYLHRTLDVQPDIIIDDGGDLTKIVHTERKDLAKNILGGNEETTTGVQRLRAMERSGVLLFPMFDVNDANMKHLFDNRYGTGQSTLDGIMNATNLLIAGRTVVVAGYGYCGRGIAMRLKGMGANVIVTEIDPIKANEAIMDGFQVRRMNNAIRDADMVITATGMKDVVKYEDALVAKKNIVLANAGHFNNEVAVSEIEKRSLEVNEVREFVKRYRLENGNTVDIIADGRLVNLAAGQGHPVEIMDLSFALQALTAEYLVKNHDKLERKVYPVPADIDRYVAEIRLKQFGGELDQLNEEQIKYLNSWDEGT

SEQ ID NO: 18157 - protein, 238 aa, Thermoplasma acidophilum
MSGENMPDENKFPLIGEKFPEMTVETTHGSMKLPDQYKGRWFMLFSHPGDFTPVCTTEFYSFARRFEDFQKINTDLIGLSVDSTISHIEWVNWIRDNLKIEVPFPIIGDSMGRVATRLGMIQAESSTSTVRAVFIVDPNSTVRLIMYYPLEIGRNVDELLRAIKALQMSDKYRGAMPANWPYNELIGEKMLNPAPKNVKDATGRLKEFKGYAWWLTYKDVPDNEVQETKKIVKMREEK

SEQ ID NO: 18158 - protein, 291 aa, Thermoplasma acidophilum
MDIRTTAVVGSGVMGQGIAQVFARSGYPVTIIDVRDDILANAVRSIKEGRYGLMNLVKKGTMTESEVDKIMGKIRTSTSYGSLSDADIVVEAVPENLDLKRKVFIDIEKNVSENAIIASNTSGITIAEIAQDLKKKDRAIGMHWFNPAGIMKLIEVVRAKMTSEDTISTVVDFSRRIGKTPVVVADVPGFFTTRFIEGWLLAAIRSYEANIATKADIDTMAKLAFGFPMGPFELMNIIGIDTVYHIAEYLREETGDPQFIPPVSLKQMVINGYLGDPKVKYGSKGGWFDMQ

SEQ ID NO: 18159 - protein, 389 aa, Thermoplasma acidophilum
MVGGGPGGSTAARYAAKYGLKTLMIEKRPEIGSPVRCGEGLSKGILNEADIKADRSFIANEVKGARIYGPSEKRPIILQSEKAGNEVGYVLERDKFDKHLAALAAKAGADVWVKSPALGVIKENGKVAGAKIRHNNEIVDVRAKMVIAADGFESEFGRWAGLKSVILARNDIISALQYRMINVDVDPDYTDFYLGSIAPAGYIWVFPKGEGMANVGIGSSINWIHNRFELKNYLDRFIENHPGLKKGQDIQLVTGGVSVSKVKMPITMPGLMLVGDAARLIDPITGGGIANAIVSGMYAAQVTKEAIESNDYSPQMMQKYEKLIKERFERKHLRNWVAKEKLAMLSDDTLDKLVDIVSEQVLTTISVEAILKAIAEKYPEVVKELEDLI

SEQ ID NO: 18160 - protein, 455 aa, Thermoplasma acidophilum
MVVSPIEYRYGRRQVKKIFDDETRLNYMLKVEAAIAKAESELGIIPQDAYNEIQRAVDSGSITLDEVRQVEDEIKHDVMAVVRVLSKYSGSGSKYVHFGVTSNDINDTATALQLHDFSSIYRSNLVSFMETLVGLASKYRDLPMMGRTHGQHASPITLGLKFAVYLAEMIRHLDRWDEMAGRAFAGKVLGPVGTGAALGEMALDVQKRVMDILGIYPEDGATQIVNRDRYIEYLSVINGISVTLEKIATEIRNLQRPEIDELSEYFDFEKQVGSSSMPSKVNPINSENVVSLSRFIRSLIISEYEAGVTWHERDLTNSASERFVIPYASILIDYATDRLNGVLKTLIVKEDNIRRNLENDDSIYSESIVTILTERGMARQDAHEFVRRSAMNARSKGMSFRQGLLENGIERYLSKADLDRAMDPANFIGLAPIICDTIVKKAKERIGMKDGEQAS

SEQ ID NO: 18161 - protein, 377 aa, Thermoplasma acidophilum
MQYINESATVSASNNVEKLRKQGLKIYNFGIGEPDFTTPEGIIDYAFEMAKQGKTHYTPSAGIMELREKIASKLKTRNRIDANAENVLVTPTKFGINLAMMVILNPGDEVIIPDPYYVSYPDIVKLAGGKPVPVRTTDDYDIDLDEMRKFVTPRTRAIILNNPNNPTGKVLSEKEIRDLVDFALENDIYIVSDEIYEDLIYEGSLYSPASMGKEAFEHTITLNGFSKGYAMTGWRIGYFVATEEIVEAANIIQQQTITCASSISQYAALRALDDNESPARMRSEFRKRRDLAYGILSESTDMKVHKPEGAFYMFPGYSKDIPSEKIAEMLLNQEHVVVTPGSAFGDRGRHHFRISFATSEDIIKEGLERLVKFMHTL

SEQ ID NO: 18162 - protein, 380 aa, Thermoplasma acidophilum
MVRLSKDLQFPIRDSFDRNAFSVNFPIYATTAYRSPEGDHFRYSRENNPTVEELARQISLLEGSQLAACFSSGMGSISTVFLSLLKPGDGLVLPMDVFGRTYLFAKDFLSRFGINVSITDPGTDKVIEAIGDKTRMIFVESLSNPVLRVYDIKRLSDSAKQNNALLVVDDTIITPVGQRAIDHGADIVVNSLSKFIGGHNAAIGGSSSGSSEFIKNIDSDRRSLGSSMDPFSAFLFLQGMKTLKIRIERSSRSAQIIAEHLSTLDHVERVYYPGLTENDYHDLALRTLKNYGSVVSFVLDDGVDASKFMSSLERIIPANTMGSVETLISNPYSMSHRNLSDKERARIGVVPGLMRLSVGIEEISDIMDDIENAIKKSLKS

SEQ ID NO: 18163 - protein, 409 aa, Thermoplasma acidophilum
MQILTLISWDFKRNNNFFNQAVLNPYEYWADILEKNGISRYVILLTCNRVEIYLRAGFPEDLEAMKPNVLHDEEAIKHLMEVSSGLDSMSLGENEILKQVKEAYELSVRNGKVDKVLSLIFQKAIFVGKKVRSETEISRGKVSVPSIVYDILSSRVVQKVLIIGNGMIAGEIAPYLSGKFEVTIAGRNIDHVKDLASKYNYSYTTINDLHELIMRNDAIISATSSKTPIIRREEMVEGKLYIDLGNPRNIEDKPGADIITIDDIYSVSNRNGSARMESVDEARRIIEIEMASLMNKIKDVMIDEIFADFYKFAVVVQKMEIEKFSRMHPEIPASDVEAFAHSMINKVMNIPVMTLKSVARSQSNQDFSRIFSKFYDNFSDLVSAALQSYEGRQDTQSLRDRTRRLLQRS

SEQ ID NO: 18164 - protein, 466 aa, Thermoplasma acidophilum
MGFIEEVRTFLGNYAITRKEDLIPYMNDASYFTGEMPEAVLLPGSPEDVQRIMKLAYKYEVPVVVRGGGSSLTGSSILKNEGIVISMLRMNHIIDLNLNDKCVVAEPGVRLDDLERFLDKYGHFYPPDPASSRSATVGGSISTNAGGLRGVAYGVTKDWVLGLEVVLADGTLVKFGNKALKRSMGYDMTALMIGSEGTLGIITKAYLKIWPKPERIARILAFFRTIDDAGNAISEVKERIIPEMAEFMDKISLDSVPDAIKYPEGTNYALIVDASGPPETLQRRREQIEGILKKYAIETRSTTDKAEMNRIYLARKGLYASILRLRKSEKEYIVIGDIVVPVSELPSALKEIEKARDVDGVRCALFGHIGDGNIHANIFADLSNEEAMAKVNKFMMDMAMISVRHGGSVSAEHGIGLEKKKLFVEEMRFHDNMRTLDLMRSIKRIFDPKNILNRGNIFDQDAGSDS

SEQ ID NO: 18165 - protein, 453 aa, Thermoplasma acidophilum
MTLFLIMADQRLFGTNGIRGIPNDDLTVDFAIRVGKSIGMFVSGDVAVGRDTRISGDMIASSVLAGLMATGHNIIDLGILPTPALQYYCKNHALYGVMITASHNPPQYNGIKVIDRDGTEIERPSEEKIENIYSTGSFNMVRWEDVGRIRYVSDAIDQYIDGVLSKVDVRRIKERRFRVLVDTGNGAAYASTPKLLEKLGCSVVTLNANPDGRFTSRNAEPKPENLKELMALMANGNFDLGIAHDGDADRVVFIDERGNFIDGDKSLALLVKNFASASDIVVTPVSSSDTISDVCSAIGATIIRTKVGAPIVARTMIQNGAVIGGEENGGVIYGKHQYCRDGAMTLSLMLDLMARSNRKISELIRELPPYFLEKRQIERTVDWGLLERELRKGEKVDTTDGIKIIKDDGWILIRPSGTEKILRVYAESTDMAMAKKYADQYVAKIRDLQEKLG

SEQ ID NO: 18166 - protein, 426 aa, Thermoplasma acidophilum
MQWQAMGSKDLFQRGSSLFPMGVNSPVRYFKDYPFYVDNASGSRIYDVDGNEYIDYCLAYGPSILGHADPDVVRAVRDQAEKGLIYGAPSEAEIRLGDIIRRSSKNIEMMRFTNSGTEATMHAIRLARAYTGRSIIVKMEGGFHGAHDYSLIRSGSGTLTFGSPSSPGVPEEVARTVVVGRYNDEANIRNIFSQYGSRIAAVITEPIMGNAGVITPEPGFLEFLRDITQKNGSLLIFDEVITGYRFAFSPYQDIIGIRPDLTTMGKIIGGGMPIGLFGGSADIMKKVSPSGDVYQSGTFSGNPVTMAAGFAALKKLQGMDYASLVRRTEKLMNGIDDILAKRKIRHVVNGYRSMFQFFFAESAKNYDEVMKADRDLYFRIFKRLMNHGVYVPPSQFETNFVSFAHSDDDISKTIEAFDLSVGEAAK

SEQ ID NO: 18167 - protein, 295 aa, Thermoplasma acidophilum
MITIRIGTRPSRLAVRQAEIVASAIRHAGYEVEIVKYRSEGDSDLKSPLYSIGKTGVFVERLNSLILSGDIDAAVHSAKDIPYEIDRRLRISAVMPRGRFEDALVSENPLSKLPPGSVIGTSSLRRRYQILYQRKDVKVSNIRGNVDTRIEKMRSEGMAGIVMALAAIDRLELNLRYWPFDPEKFVPAPNQGIIAVVSEDGSKASEVLSSINDADTYDDMMAERSITQGLKLGCSTPVGILSRHTGKGMRILAQFFAMDGSDMMMFDQHVDGLDDVDGIVSYIRENLPEEYGYKL

SEQ ID NO: 18168 - protein, 151 aa, Thermoplasma acidophilum
MEKTLRISKIRDGTVIDHVPSGKGIRVIGVLGVHEDVNYTVSLAIHVPSNKMGFKDVIKIENRFLDRNELDMISLIAPNATISIIKNYEISEKFQVELPSRLIGVLKCKNQNCITNTREPVESEFEIVSKHPLVIRCVYCERTMGEKDIFT

SEQ ID NO: 18169 - protein, 305 aa, Thermoplasma acidophilum
MLKNRSVVSIEDVDIDDLNDLFDLSDSMLKTIEKGGSTDLLRNRIMATLFYEPSTRTRLSFESAMHRLGGSVITVSDVKTSSVAKGETLADTIRMASSYSDIIVIRHPLEGAARLASKFANKPVINAGDGSGQHPTQTILDLYTIKRETGSIDGKTITMVGDLRYGRTIHSLIIALSRFDVRINLVSPQILKLPEYVLTKIGDRSRIMEYDDLSKVIEDTDVLYVTRIQKERFSDQNEYQSVIGSYSVDRDLVSRMKKDAIIMHPLPRIDEIKPEVDELPQARYFKQAYYGVPVRMALIYRILGD

SEQ ID NO: 18170 - protein, 388 aa, Thermoplasma acidophilum
MRDVFIVAAKRTAIGKFGRSFSKLKAPQLGGAAIKAVMDEAHVDPASVEEVIMGNVIQAGNGQNPAGQAAFHGGLPNSVLKYTVNVVCASGMLAVESAAREIALGERDLVIAGGMESMSNAPFLLPADLRWGPKHLLHKNYKIDDAMLTDGLLDAFYFEHMGVSAERTSRKFGITREMADEYSVQSYERAIRATESGEFADEIVQFEGLDHDEGIRKTTMEDLARLPPAFDKNGILTAGNSAQLSDGGSALMIASEKAINEYGLKPIARITGYEQASLDPLDFVEAPIPATRKLLEKQHKSIDYYDLVEHNEAFSIASVIVRNELKIDNERFNVNGGAVAIGHPIGNSGARIIVTLMNALKHRHLKTGLATLCHGGGGAHTLTLEMVE

SEQ ID NO: 18171 - protein, 515 aa, Thermoplasma acidophilum
MPFENENTYVRMVEAGKEDEFHRKYEEALKEVESYFHKEYPNIIKEDIVESKKIKDISPIDGSEIATFQLASDESVNKAVDMLYRSYKNWYNIGYMKRALTFLKAAGMLSDQKFKFAAILTYENGKNRYEAIGDVDEAIDFMRYYAINLIENQGFIKLTGKAYKNEESMSVMKPYGVFGVISPFNFFSIGVGMSSGPLVTGNAVILKPSSDIPLSLYLWVRLMHDAGVPKEVLAYVSGSGSVVGKHIVENKKVAGIVFTGSREVGLDIQRRSIDNGPKVVITEMGGKDAIIVSNKADLNKAVEGVARAAFGFAGQKCSACSLLYVHKDVYDEFMKRLKERTDQIKPDDPRKKETFLNPVINKEAYEKFIKLKPEYNKGKILTGGHELKRPGFYVEPTIVTDLPKDAYIARNEIFLPVLSVFKCNSIQEAIEDINSMDYGLTGGIFTEDPNEIQYYFDNVEVGVLYANRKSGGSTGSMVGSQPFVGWKLSGVSGKGTGSFYYLMQFLREQSQTIAH

SEQ ID NO: 18172 - protein, 211 aa, Thermoplasma acidophilum
MNQTLETGTTTVGITLKDAVIMATERRVTMENFIMHKNGKKLFQIDTYTGMTIAGLVGDAQVLVRYMKAELELYRLQRRVNMPIEAVATLLSNMLNQVKYMPYMVQLLVGGIDTAPHVFSIDAAGGSVEDIYASTGSGSPFVYGVLESQYSEKMTVDEGVDLVIRAISAAKQRDSASGGMIDVAVITRKDGYVQLPTDQIESRIRKLGLIL

SEQ ID NO: 18173 - protein, 316 aa, Thermoplasma acidophilum
MKSESLRDVYGKELVKLGSFDRDIVVLDADLSSSTKTGYFANAFPDRFFNMGISEQSMVTTAAGLALSGKKPFVSTFAIFLTRTYEQIRQSVCYNNAPVRFVVTHGGITVGEDGATHQIVEDVGIMAGLPNMNVIVPADSVETRSVVDYLAGVDKPHYVRLSREKFPVINDEDYEFKIGKSKTIRDGADLTIIADGVMVSKSLEAAESLKKNGVDARVINMSSIKPTDRDAIIKAAKETGHIVTAEEHSIYNGLGSRVAEITSESYPVPVRRIGMRDTFGKSGKAWELFSYFHMDVKDIINEAMTCLEEKNYENIP

SEQ ID NO: 18174 - protein, 289 aa, Thermoplasma acidophilum
MPFKIVPILTPFRGNEIDGEKFKDHCLKLLRDGIDMIFVAGTNGMGPALSFQEKKMLAEYCSDITDRVIFQVGSLNLEESIELARIARSMNFYAVAALPPFYFGGIPEEWIIRYYTQISEVMETFIYNYPKFTGYDINADLARKIKKKGGNILGVKDTVSDIDHMMRYKYLIDDFMVFSGPSNYILHAAVNGLDGAVAAAGNYATEMFVQILDDTARYGRANQIIIDEIFDAASRYGQWASNYSLVRILRGYDAGDPRPPFYPLDDHTEEKLRSEVRSIMQKYGRESKL

SEQ ID NO: 18175 - protein, 422 aa, Thermoplasma acidophilum
MMSMSEKIAVIGAGINGIFAAYYLAYAGYDVTVFERGDIDSGTSGRFHGMLHSGARYATNDEVSARECIVENRRISNIGHRYVENTGGYFLAANDDEAEFGDVLFDACRRAGIDISEIPIEEFARDNPQLKNARRAMRVPDKVIRSYEFVVSVAAAAHLMGTKIRTYSDVKKIDIEGNSVTGIEYERSGKEISEKFDAVVNATGPFSGKILERSGLKQTPVMPSAGIMVVLEGRVSTAILNRMREPSDADILLPYWSNSILGTSAVVVEDPDSFRPEPEDMQMMIDDMSELVPAVKIMPIKRYYYSVRPLIEDAGEDARTASRSFRIVGEEDLDDTLLSVVGGKFTTGRLVGEEIAKRVMHHFGTVIDLKDPDLDATLEAFEKRYASDPIISRALERRGTIDEEYAGIAEAYAISSIIGGKQ

SEQ ID NO: 18176 - protein, 436 aa, Thermoplasma acidophilum
MSGKADPLEIAKEAKPSQANNEVEEDPFEIALKQLRKAAKVLNLDEQALEILSSPQKILQVSLPVKMDDGKVKVFTGFRVRHNIARGPAKGGIRFHPQETLSTVKALSMWMTWKCAIADIPYGGAKGGIICDPSTMSQGELERLSRAYIRAIADFIGPDVDVPAPDVNTNPQIMAWMLDEYENIVRHNAPNVITGKPLEVGGSLGRFDSTGKGGMFVLREGAKKIGLDLSKARVAVQGFGNVGQFAVKFVEEMFGAKVVAVSDIKGGIYSENGFKFDDLLAWSKKIGSVVGFPGSKPITNEELLESDVDVLIPAAIEEQITARNADKIKAKIILELANGPTTPEADEILYKKGKLVLPDVLSNSGGVIVSYFEWVQNNYGEYWSTEEVTNKLDVKITKAARQVLETMDKYHVDPRTAAYVIAVKKVADAMKVRGWY

SEQ ID NO: 18177 - protein, 424 aa, Thermoplasma acidophilum
MLSNLDYLYGLKREGIKFDLDVMRGFADMIGHPENRFKSFHITGSNGKGSTSEFIYSILRQKFSAGIYTSPHLIKFNERIMVNDSMIPDDYIDSFIGKYRPMIEDLAKINRNPTFFEVTTMMAFQYFADMKVDYASVEVGLGGRLDATNIIMPLVSVITQVGYEHADKLGCSLTSIAYEKGGIIKEGRPIVLQDQKPEVVKTIKSISQVRGSPLIMLDPQKIRGLNLSEAGTSFDFEGMNGTYHLETDLIGEYQALNAATAVLAIEASGIGLEKNDIERGIKSARWPGRLEIISRDPLIIIDAAHNPPAVNKMANTFRKVFTKKPLIVAGILSDKDSYAYFHVIRQISDRIIFTTPEEKERAVDPKKLYDLYGHLFSEARVIPDPIDAVNEAAKRSDFVLVTGSIYLIGAVKEYYEKKREKVVA

SEQ ID NO: 18178 - protein, 327 aa, Thermoplasma acidophilum
MNLRKKVMNKFAIKFTNKVSDFMASYFECIDVSKTYAKGQTALRSVSFEIPMHGVFSLIGRNGAGKTTLVRILATELMPTSGKVFIDDIDIIREPDSIRRRIAIIPQEARAISWLTPMQTVTTFLLYRGIRYSEAKARAKEVLADLGLASVADRMNRMLSGGQKRKVLVAALVASDADILFMDEPTTGLDPISRSELWDILSDLKKEKFIFLTTHYLEEAERLSDRIGILDQGEMKAIGTMSDLRSMVPKKYSISLVDKENGNIEIENNGSVIKVGSRIFVDENEAYVIARDLINRNIRFSINPVSLEDIYYSIAKKEIAGGESVQD

SEQ ID NO: 18179 - protein, 538 aa, Thermoplasma acidophilum
MNYFSDDIVLQDVLNYLGYDIDDKLQEMGRYVSEEMIEDSIFIDHYGEPVLQMWGILDNRTDGIWISRTHQNMIDRLLDMGVVSKIASENDLMYHFISGYLISDAGLFCTLTLTGQTAYGLRKYGDARLQQFLNHYANSDHWLGATYYTEIQGGSDLGANQTTAVRSGDKYILNGENKYFASNAGLADGAIVTARMEGARPGAKGISVFFVPTLRSDGTRNYEIRRIKDKLGTIMVPTGEVVLKDSEGYLLGDEKNGIYIALEILEVSRIDDAIAAMGIARKALWEAYFYANKRTAFGKPIIDHPLMLRDLAEMESEVEASTVLSMIAADMFNKASHLKPPYDDQYHMARAFTHMAKNIASWSSDYVTRYTMEVFGGKGFLKEFPVEKFHRDSIVTSLWEGTSNIQALDFLEIVQKRGIDEKILALVWNIMDNLSSENAAMLKAAFDSVRERMVSYKNSENMEYFAKDILNMFGYLSALAYMFSVSEKTGNPGMQMAARIYYYRHFANSLATDIKFSDFRRVIDWMNTTGSEKVIEMK

SEQ ID NO: 18180 - protein, 282 aa, Thermoplasma acidophilum
MEPEILFRKIDDLGEGPTYDERRKRVYWVDIRGKKFHYLSLENSEMKTFQSIGMISSIVPTDRDLMAATVDHGLYLIDDAGKHTLLTEVEKDQKSTRFNDGKADPFGNYVAGTMDLEEKRPIGSLYVLTGKTIRRILENLTISNGIAWNTKKKVFYHIDTPKRRVDAYSYDGKMNIERLGTAVDFRNEVGNPDGMTIDADGNLWVAHWGGNRITIHDPERQKKIDEIIFPAQNITSCVFAGNGLRDLYVSSASNGNPDDMGGSLFVVHTDYAGSKTFTFSVP

SEQ ID NO: 18181 - protein, 433 aa, Thermoplasma acidophilum
MKLWSGGIQRDQNADSTVAFVKRDIEAEIYLMKYEILSLIAYHLDLAQRRLITEAESKCIINSLISLLQDSPKIDPEQEDAHTAVENAVIERCGDMGRNVRLFLSRNEQVHANVLMFTIERCHSIISILLDSIKVLKGADLKGLLPGTTHFMPAMPVTAATYSNYIENSLALAIRSIDRSLADASVLPYGYGSGYGSPNSGKLKVMSEMLGIGPVLKNPMIASSLYQFTIMQISNSIAGLSITLSRIAMDLIEYYRDGYVSLSDEFTTGSSLMPNKRNPDYLELLQGMAAVSSSVAVMSAMATMNKTSGYHRDFQMLKDSYIDMLNYIEEALLRLPDLFKGLRFEITDPMMLPGSIFATGNAWEDFANTHDWKQSYANIGRKIREKQDLKRYMPEDYVDIVEMHYLEEIEKKYGEILKKWDYLIEKAEAYISE

SEQ ID NO: 18182 - protein, 405 aa, Thermoplasma acidophilum
MFAMDKALLLYSGGLDTSVMIKWIQENLSMDVATLTLNVGNSDLVAIEEKARMLGADPVFVHDAKDEFAEKFIAKSIMANGSYEGYPLSTALARPLMAEKAVKYAQKIGAKYIVHGSTGRGNDQVRFEVSIRALDPSMQVLVPVREWNMMRKDEVEYAKTHGIPVKLDGKYSIDENIWGRSVEGPDLEDIGKGVPEDVYEWVVPPWKANAEHTLKIAFDGGIPSEIDGEKMKLADLIVFLNTLAGSSGIGLIDHMENRVVGLKSHEVYECPAATVITHAHRYLESLILNRNEAEVKMNMDWQFAKFVYGGLWHDPVMNAVNAAEAEFNRDISGEIKIRMSHGIMYIEGAWGNSFLYSKDLINYSSMAFDQRASKGFIDIYGNATVHSHNRNPKMVKEVQGSSVEF

SEQ ID NO: 18183 - protein, 478 aa, Thermoplasma acidophilum
MAYREDSEARKLGTWDLVFQGLGQITPITILSGLIVSIVGLSGINAPLAMLISFVAVVLAANTIYQFSGIISHAGGYYAYVEHGLGRHVGKFTGLQYLLYQASNLALEYLIVIWGFSKSLNYAFGTSLPVWSGMVWMGSMMALSYVLMRRGAKPSLRLALILGSIQIAFVAILSMIIIPSADDNTVQAFIPSSGSGWTGVFLGFIVGGYLAFAGYGSVVPMGEEARSPRKTIKKAIIAIVVMAGAIFVLGSYAMVVGFGLSNLGNFSSSIIPGLIVARRFTGLAGAVIFIVVSTFLSTYGTVIGMGTPMTRVMYALGRDRVLPGWLGRIDGRGVPARSIDMTYAISAVSAAMLGTYFYLADGFYAGLFYAWAIFGTIATLSTLLIHILTNTSLSVSSVKRRSGNFIFWIALPSLTTILMITAYYYSLIGMTMPYLIAPIVFAAWIVISALILMARKDEYASIDFSPSMEHMGAGTGDE

SEQ ID NO: 18184 - protein, 515 aa, Thermoplasma acidophilum
MEHTRLHNKGLTLDKIFLKTLRTTHNGFLTDGKDRIGYGEFYDRVIAIAEELHRDLGENRTVSVMDWNTLNFATLLYAVPLSGNVLHPVDVRQPPEQVMSSMKEAQSSYLLYSADFGRLADAVKTSGIVKEDNIRSTKEVFDESTDHKPGNAGLPELEEDRIASVLFSSGTTGKPKGVRYRHRDIVLTIWAMETNLSAFPGPARLASSDTVFSLIPFFHLWSWGTLYISTLIGASYVVGGRFDPGSTSDLIKRNGVTWMSMVPTMFNALISWDRNSLDGMKILIGGSAIPSGILNFASDHQIELTGIYGFTDGLAAGIGTSNINGSLSERNADAVNAITPLVFTDFEVEGENNEIKFRSPWIPEGYFNVQEERAYRDGWFYPGDSAEFTQDGKIRIRDRIKDLIKSGGEFIPSALLEYYISEIGDIGDVAVIGVHDDKWIERPVAIYRTRSGATVNDEIIRSYLKDLSNKGLIRDWWIPDRFIPVDSMPMTGTGKIDKKTLRAMLEKGDLRTDRK

SEQ ID NO: 18185 - protein, 258 aa, Thermoplasma acidophilum
MTSAKYIFDFSGSTAVVTGAFQGIGKAIADALLDAGAEVYGIDKAFPDHGVDEGRFHGLHGSVDSLDDIASLRDRVAETSGRLDFLVNNAGIYFYKKIEDSTEDDYERITSVNLKGYFLMTREFLQLLRKSDYPSIVNIASVSGQRPEAGHPLYSMTKGGILALTRALSADLGMLGIRVNSVSPGNIKTPMNDEDILDQARKRGLDPDEVERQYAAESVLGRRGEAAEVASVVLFLLSKGASYINGADIVVDGGLLLV

SEQ ID NO: 18186 - protein, 470 aa, Thermoplasma acidophilum
MEEGKVVQVHKSETKKSQVRWVIVSLLFLAILFNYADREIWIVSEPAFAYSFGWSHSATALTATAVHNISLILFFWSLSYAIFNFPGGWIVDKLGLRKSMATMFAIWSVFTALTAATFNFISMVIVRVIMGAGEGPVWPINSKVVKGWANRYDESKSFTLAGAGQAVGPVIGLIAGGILVTMFGWPAAFILFGVLGLIFAAIWYFYVRDRPADDSKVNSEELAYIREGKTEEEKEEKVLPSGVSWKMAAKMIFGTQAGWGTFLVFLSFGYVLFTFLYWLPPLMFSTFAHTVEKSGLYSAAIDVALIAGFLGSGPFNDGLLRKFPDNKPLARRLGAIIPMVLMIIMVGLSYFTGKAHNLLGTAIFLGIGSGLMNLTVGSWAVNAVDLAPAGTSATVYGIYNGSLNLVGAFNSIIEGALFIKYGPVLAFTSSIIFMLMFLGGYLGLIRKKTWERAMAYKEQLSKEAYAYMKE

SEQ ID NO: 18187 - protein, 445 aa, Thermoplasma acidophilum
MLDNANLTGTHVSWTLIASLGDFLDAGMFAGTGITLSAILAYLHITSTLLAGFPALITLLGTAFGALVFGPLGDKYGRKFIYQVDMIVYAVAAILLAFSFNFIWAMVFYAIIGISVGADVPTSWSLISEFAPKSGRGKLMTYTNIMWYVGVLVELAIAIAIYNTGITLFRTIWIMLGIIAIIAWALRRRLTESPRFDVLKGRYEDLHSATKILGSAQEATISASTAPKYKEYRYGELFTKYGGPLLFAWFLYLMWGIPASTYGEFFPYIFSSLHLVSTRVVFAFEAIYFGSAIVPGLLIYYFLTDKVGVGRYPLYLTSAAMSAVSFLLLVYKPFLYNVPVLLISFLLFGIGQGLGVWPITRLYSLEHFPTSIRNSGQGFIWFTMRFEGAIFGLFTPLIVKASVTYIGWIAGIFFLVAFIVVGVMGVVAPGYVRTESKSLEQTAGE

SEQ ID NO: 18188 - protein, 245 aa, Thermoplasma acidophilum
MITGGSRGIGRAIALGLAKQGANILISYASHDSEADEVLETASKYGVKAHKVKVDQSDPYESIRFAEKAIETFGKVHILVDNAGICPFEDFFRISVDLFEKVWKVNVESHYFITQRIAKNMIENKINGRILLISSISAHVGGEFQTHYTTTKSALNGFMHSIAIVLGKYGILVNSLEPGTILTDINKEDLSNQEKRAYMERRTVVGRLGLPEDMVAPALFLLSDDNTYVTGTELLADGGMLINLQ

SEQ ID NO: 18189 - protein, 255 aa, Thermoplasma acidophilum
MFSDLRDKVVIVTGASMGIGRAIAERFVDEGSKVIDLSIHDPGEAKYDHIECDVTNPDQVKASIDHIFKEYGSISVLVNNAGIESYGKIESMSMGEWRRIIDVNLFGYYYASKFAIPYMIRSRDPSIVNISSVQASIITKNASAYVTSKHAVIGLTKSIALDYAPLLRCNAVCPATIDTPLVRKAAELEVGSDPMRIEKKISEWGHEHPMQRIGKPQEVASAVAFLASREASFITGTCLYVDGGLSIRAPISTPE

SEQ ID NO: 18190 - protein, 599 aa, Thermoplasma acidophilum
MASELDGFKKWDKDLEGDLGKFEFFVNGYSNVSFNCIDRHAMKTPQKTAIIWLSEDGLRQSITYRDLMLQTAKFAKGLADEGVKMGDVVTIFLPNRIEAFIAAHACFRIGAIYNIIFSGFSAKALLDRMKETNPKVVITTDSSLRRGRKINLKETLDSIISEVPSVKKVIIIKRDGKHDLNLGEREVYYDDFMSGITGYAEPVPIEANAPGFVIYTSGTTAKPKGVVHSGIGFLVGSYHNVKYALDLGPEDIFWCTADVGWLTFPIFELVGGLAHGATVIAYEGALDYPDIRHFYSIIQDFKVTKLFTAPTFLRMLARNGSDVASGYDLSSLRLISLVGEPLDVKTWKWVYNDLGHGRIEINNTYGQTETGSAWTSSLVGVTGARPGSCGLPLPGHSFDILDEGGQPVENGRIGTLVLRKPFPSLARGIWKDPQRYFKEYLSVFPGNYCTYDSAVRDRYGHIWVLGRTDDVINVSGHRISTMEMEDAIMSIPEVSEAAVVGVDHAIKGMSTAVFVTLGNGIDLPADLGKRIQDEIARRIGNYAKPESVYVIPEMPKTRSGKIMRRLLREIVISNKVSGDLTGLEDPGVISRILQEMKQA

SEQ ID NO: 18191 - protein, 474 aa, Thermoplasma acidophilum
MESNAYAKPVKVPGRSIITSLSAMGYFLDGYDLSVISVFTLVLVTYHIFRYTAFTESFVTGSALLGAFVGAVLFGHYADRIGRRYLYIFDLIFFAVFAVLTALATNIYEMIAFRFFVGLGVGADYSLSPVYTTEMYPNAKRGGGYGWVWTFWSLGAAAAFIIGYGFYLIDPLTGWRWTLGLGAIPAIVVVVMRMRMPESIRWKAADKNVSEQEIRDVADSIGIKKEEMDSIMAERNRESRIRSGSLSSLFKGEYGKRTLIVWIQWILYDIAGYGIGLYSPLILKELGVSGSYTLLYSFMFYMPIGFMGAFGAVMLNDRVGRRPLQILGFGSMALAILLFFFAASGKGQVFLAIGILAFIIDYALGNLGPGNTMGLYAIELLPTKLRSSSMGSATGITRIVSFLSAFLFPYLSKPTVLGKEGFFFVLFVVMILALIFTIFFTPETKGLSLEEITVAKYRHEGWKPVLALDDTSKK

SEQ ID NO: 18192 - protein, 419 aa, Thermoplasma acidophilum
MTYMPENMDPFEMALQQLEKAAAVLKLDEQALEILKQPEKILQVSIPVRMDNGRIKVFTGFRVRYNTARGPGKGGIRYHTEETLSTVKALAAWMTWKCAIVDIPFGGAKGGVICDPKSMSQGELERLSRGYIRAIADFIGPEVDVPAPDVYTNPQIMAWMMDEYENVVRHSAPNVITGKPLEVGGSEGRGDATAKGGMYVLREGAKRIGLDLSKARVAVQGFGNAGQFAVKFVHEMFGSKVVAVSDTKGGIYVKDGIDYAALLEHKKKTGSVVGFPGSEPITNEELLESDVDVLIPAAIEEQITGKNADRIRAKIVLELANGPTTPEADEILYKRGILDLPDFLSNSGGVTVSYFEWVQNNYGEYWTADDVYKKLDQKMTKAAHDVFDAMDKYKVNPRTAAYVVSVKKVADAMKARGMY

SEQ ID NO: 18193 - protein, 497 aa, Thermoplasma acidophilum
MLPMFGNPGTTEIPMIRDVTDYVLALHDGVAAAIAEGYAISSGRPSIVNLHTDLGVGNAMAYLITALKNRTPVIVTAGQQDQRHLAYSPLLSGNLYDLAGNFAKYRSEVRRASDIAYEMRKAYQIAAEPPRGPVFLSFPMDVMEQDGLYSGEGVAVSEYGIADDDDVNRIAQAINESENPAIIFGSEIDEFNAFSEAVEFARKVGCPVYSEPLGNRSSYISDDPQYAGELFPAAILINLQLMQHDLLVFIGSDITLYPYTTDTVLPEKRKIFVGLNNTRRMGETYIANPKTFLRKITPLVKKKNSYSAQKDYRKFTDAMRERKRMGYNYVSYRISKYFSDYTLVDEAISMSEPLRHYFGYRPHGYFTARSGQIGWALPASIGMAMDSPKVVSVIGDGSLMYSVQALWTARHYGIPLKMIVLRNGGYSILRSYAKSYYPEIKDADFLRPDPDVESILSSYGIDVNTADTDLRNLEWLRSGSDQKAIVVDVDRSIPNMF

SEQ ID NO: 18194 - protein, 1140 aa, Thermoplasma acidophilum
MSSYIERIEAHNFKSFRRKKVINFTKGLNVISGPNGSGKSNIGDMLLFVLGTKSIHAVRADRLSDLVSKGSGNECSVSVTFRSDDGRSLVIERRLVIEDEPKSYYYVNGVRSRLSEIDETLASMGINFGTYSFVLQGDINDFISYSGQERRKLIERISGVDQFDSEIERVKADIEAVSRNMEINQTIIDEKRQNLERLRTEKEKKERYDALLKRKRDVEYTEILNRKNAMERQKRTIEGQISDLTKEIAQLEERRSDLEKRSEAIRIRREDVAKRIDDLTSGEMNRVKTDLHSVEVDIAKIRGIIDEKNRNMEKLEETIAKYESERDSTDREIEDLDRQIEEKAKRKRALEDRYADLKKRYDDLFSRAQAEAVDAAETRRKSKEYQEKIDGLGREIEELKAAGSQMNADLAVLLQKKAALEERKEDLDLKIRTSEWKAKETSEDMGKYSRKYYDLKAKYDQINDRISDLKSEISEKEASAKIASSRVPEYVRNVKMLEESVEGVIGLVRDLISYGEKYVKAVESAGGGRLNAVVVKDDAVAKECIQILKDRKISPMTFLPLNKMRDPPAQRDVGKISKDPGYLGILMDFVDFEDQYRSAVYYAIRDTILVQDIDAGRRLMGIFRLVTLDGDIFDPGGSITGGYRNYASDYASALRMQHDLEGMKIQLSSLMDDRSRIKREMDQAFSEMSEASRRTGEIMKEQEMLKKEAERSREELKQVMDDISSTDRAIADKKRMIDENEKVIEQKTLDLHKYQEALNDLYDRIDPEFFKNIGDLSNEINEVRSEIDAVASELNQITSRRDILSSERKHLEDQMIDTKLQENSIAAEIDDLNGKKRELEEKAKKYQYALNDLEGRYGNLSAQVREADKQIREMENGINDAKASIDLKNDLMNDLKVKAGILEGNLSSIERELSSYSGCEAVIGDLQAMRQEIERAIMDLGEINNAAPQQYEDALKDLDDYEKKHEKLMEEKKALEETTAMLNEKKREVFVKTFTDISEKMNYVYGIINGGTAKLIMIGSDPLTSSVEVSVTPKDKATVKIQALSGGEKSVAALSFITAVQILMPSSIYFLDEVDMYLDAYNAENMIKMISQNAGEAQTIVISLKSLVFSYASNAIGVTSVNGESFVFNGHFDGSPEAAP

SEQ ID NO: 18195 - protein, 436 aa, Thermoplasma acidophilum
MCVLMPHFLYLRSLISGRRYINKDHRYPCRRLGFMGIYDIFDDESARSISGMSIDEMAKKYGTPVIIYSRARIVSNIRRIREAYENRVRMLYSVKANDNPRIIEIMHQESIGSDSASPMEIMMSIFSGIPPEDILYSPNNASEYDLNFALDRGIAINFNTFTQYRKMREKPERISFRINPGFGMGEFAGTTTGGARTKFGIDPDAAILAYRKAREDGIREFGIHMMIGSNNRDHVKIAEAYSNFFRIADRIGREAGVSFQFADVGGGLGIPYVQGENELDIAALGSAVLKEFDRYHFGDLVLEPGRYLVGDAGIIVGTVNDVHNGFAGTDIGMNLNIRPALYGARHTIIPVGERVEGEKITVTGQICENTDRIGDTAWRLSEGDRIMVLDAGAYVYSMSSRYNGRPRPPEIMIMEDGKDVMIRRREDFSDFIATVV

SEQ ID NO: 18196 - protein, 1047 aa, Thermoplasma acidophilum
MPRRDDIHRILVIGSGPVVIGQAAEFDYSGSQACLSLREEGYYVVLLNSNPATIQTDHRIADRVYIEPITVEAVERIIEKEKIDAIEPHMGGQTALNLAVKLKNSGILQRYGIKIIGTPVESIELAEDREKFYEFLKAMGEPQPARYRIRRDHIDEDVASIPDIPVIVRTSFSLGGTGGSIVQNRQDLLAMAENLFRASDIDYLEVNESLEGMKEIEYEVIRDSFGNCITVCNMENLDPMGVHTGESIVVTPSQTLSDIEYQMLRDSAIRIISGLGIEGACNIQFALSEGRYYVIEVNPRTSRSSALASKATGYPIARIAAKIAAGYGLHEIKNPITKSTFAAYEPSLDYVTVKIPRWPFDKFSVDRTIGVQMKSIGEVMGIGRTFEEALMKAIASLDNAFSSNIRLHVPDDELWRLIGKPNDRRIFAIFEGLFRNFDVKRMSRLSGYDEYFIEKMRNIVEALRNMDMGRIPENLLRIKRIGIPDEIISAFCGVPADTITKYRIDRNIMPVYKRIDTCSGEFEVAVPYMYSTYEDEDETPDLSGSIMIIGSGPNRIAQGLEFDYGSVKAILALRDMGYRSIMLNSNPETVSTDFDISDALFFEPVTPEYVVNVIRRSGCAGLIVQFSGQTGQNMARRIEEILGKHIVLGTSTESIDRIEDRTVFSRVIEGLGIKQPPFAIAENENDTVRKAMGLGLPIILRSSHVIGGRSMEIIYDVDYLADRAREIFAISKNVLVSKYLENAVEMDVDFVSDGTSYSICGIIVHIEEAGVHSGDATMVYGPGIVPVDIEKKIEGIVGSMVREFRLIGLSNLQIAVRDGDVYVIELNARSSRSVPFISKATGIDWVRLAVECMIGSRIENKRMEAKSYFLKVSVFPFSKFSDMDVVYGPEMKSTGEAMYPGRTLAEALRKSLQRSISSVLITVRDEDKPRIVDIARILLEKGVKLYATAGTSKFLADHGIPTETLYRVRDRREPRILDMISSGSIDMVINTTEMTAGAVRDGFKIRRICIMRGIPLIMNINLARAYAEALGQVEVDYREIGDYLQVS

SEQ ID NO: 18197 - protein, 353 aa, Thermoplasma acidophilum
MEKVEMKRYLITSDGTVIAGYGYGSPVTGYGELVFTTSMTGYLESMTDPSYVGQILVFASPTIANYELRKGVMESDRVKVSGIVTRDAHINMPAGTLGLDFDRFLRDEGIPAIDGVDTRLLVRKIRQGGVLRAYIADDPQGHSDFPDPMSENLVARAVDARGVKNIRGKGERRILFIDLGSKKTLRDMMLEHFSLIMASADSDLDAIDKYDAIFVSNGPGDPDHPSLRPVVNFLKRNIGVKPIFGICFGLQIIALAYGSKTYKMKFGHRGSNHAVTDGNRIYVTTHNHGYAVDPDTVRDFHVRERDINDGTIEMIEDGMMMAVQYHPEASPGPHDTRWFFSEMRRRTEDAAKG

SEQ ID NO: 18198 - protein, 698 aa, Thermoplasma acidophilum
MISSEVSEDRIKDLWRDFFRLYGYSDEINRIHQEYPEVRTLYVSFRDLEDYNWQFAGSILVSPEIYIRAGEEVILQDYLLDRVTQRFNIFNLRIKDLEEKNVAYRIRDIRSANIGTLISVSGIVRKNTEVFPKLKNAAFECSSCHGLTYVEQTENRLSEPQVCDHCGLSRGKDKIFFKLRPNLSEFIDVQKVEIQEDPETLEGGSQPQRITIITEDDLAGLLYPGNRVIVDGILRTEQRRQGNIPLTEFFTYLYAINVRKDVKELESVKITEEDKKRIIEISKKPDIIDVISRSIAPTIHGLDMVKKALALQMFGGVRKVMKDGTTMRGDIHILMVGDPGTAKSQLLKYMAEVSPRGIFTFGRGSSAAGLTAAAVRDEFGEGRWTLEAGALVLADNGFVAIDELDKMDEHDTAAMHEAMEQQTVTISKAGIMATLKARASVLAAANPKFGRYDLNRNLAEQINFPLPLLSRFDVIFKMVDHPNKDSDSRLAEHVLKAHRIGEIYRSIEHSDADIEIDEQGFEPEIDKDTLRKYVAYARNNVFPRLSDEAIAILQDQYVKTRSTSHDAIPITVRQLESTIRLAEAAARARLSTIVTVEDALLAKKIVDYYLMDVSMDNGKMDIDIIYTGASSKQRNDMETVLDIIKQLKSEKGMAEVADVINVAMSRGMTQKKAEEALLKLKNAGQIFEKSYGKIDVIS

SEQ ID NO: 18199 - protein, 493 aa, Thermoplasma acidophilum
MDTKLYIDGQWVNSSSGKTVDKYSPVTGQVIGRFEAATRDDVDRAIDAAEDAFWAWNDLGSVERSKIIYRAKELIEKNRAELENIIMEENGKPVKEAKEEVDGVIDQIQYYAEWARKLNGEVVEGTSSHRKIFQYKVPYGIVVALTPWNFPAGMVARKLAPALLTGNTVVLKPSSDTPGSAEWIVRKFVEAGVPKGVLNFITGRGSEIGDYIVEHKKVNLITMTGSTATGQRIMQKASANMAKLILELGGKAPFMVWKDADMDNALKTLLWAKYWNAGQSCIAAERLYVHEDIYDTFMSRFVELSRKLALGDPKNADMGPLINKGALQATSEIVEEAKESGAKILFGGSQPSLSGPYRNGYFFLPTIIGNADQKSKIFQEEIFAPVIGARKISSVEEMYDLANDSKYGLASYLFTKDPNIIFEASERIRFGELYVNMPGPEASQGYHTGFRMTGQAGEGSKYGISEYLKLKNIYVDYSGKPLHINTVRDDLFQ

SEQ ID NO: 18200 - protein, 780 aa, Thermoplasma acidophilum
MEVEKYDLTLDFDIQKRTFNGTETITADAGDIVLDAVGLQINWMKVNGRDTAFTYDGQTVRAPGDSQPQKIEISFAGKVSDSLSGIYYAGRENGMITTHFEATDARRMFPCVDHPAYKAVFAITVVIDKDYDAISNMPPKRIEVSERKVVEFQDTPRMSTYLLYVGIGKFRYEYEKYRDIDLILASLKDIRSKYPLDMARKSVEFYENYFGIPYALPKMHLISVPEFGAGAMENWGAITFREIYMDIAENSAVTVKRNSANVIAHEIAHQWFGDLVTMKWWNDLWLNESFATFMSYKTMDTLFPEWSFWGDFFVSRTSGALRSDSLKNTHPIEVDVRDPDEISQIFDEISYGKGASILRMIEDYAGYEEFRKGISKYLNDHKFGNAEGSDLWTAIEDVSGKPVKRVMEYWIKNPGYPVIKLKRNGRKITMYQTRFLLNGEEEGRWPVPVNIKKKDGVERILLEDEASIEADGLIKINADSAGFYRVLYDDATFSDVMGHYRDLSPLDRIGLVDDLFAFLLSGHIDPETYRQRIRNFFDDEDHNVITAIVGQMEYLRMLTHAFDDDARAFCRSRMQFLTGKQDENLKIALGRVSRLYVMVDESYAEEMSKLFKDFDSAEPEMRSSIATAYALVTGDLKGLLEKFRSVDRDEDRVRIISAFGKLKSNTDLSTVYGMVEKTEIKKQDMISFFSSALETLPGREFIFANLDRIIRLVIRYFTGNRTASRTVEMMIPVIGLDHPDAEDIVRNIGSKNISMGLAKGIEMLAVNRKLVERIRQTAVK

SEQ ID NO: 18201 - protein, 269 aa, Thermoplasma acidophilum
MRMQCAKLIIHWHVSISMPNAIVSAASSGIGKGIASVLSRSGYRLTLFARDEKRIDEARKELKLKFGLEPLAIPADLSKPEDIDRVVKKHRETYGSIENLVINYGDPRVAGFTDLSDEDWQYAIDMIFMSTVRITREALKDMIRARHGSIVYVTSMTVREPMEGFSLSSSLRSAVVALAKNISLEVSKFGIRINTISQGYINTERLRDVIKTGVDRTEGMRRLSGDVPLRRVGDPEEIGEVVEFLLSSRASYVNGANIPVDGGITKFPL

SEQ ID NO: 18202 - protein, 360 aa, Thermoplasma acidophilum
MFTLGSSMKMTVFGSSHGEAVGSIIDGFPIGFKIPLDYVQKYMEYRRPGSSILTSQRKEDDEVEIISGLHEGYTDGSPLTLIIRNKNVISSYYSEIRENPRPGHSDYTMFLKYGEFRNYEGGGFLSGRMTAPLVAAGSIAKAYLEGMGIKVKSYMRSIGDVECSRVSGEAYSFETRMPDPECDARARELIMRVMKAGDSIGGRIDTVVENFPGGVGEPFFDSVESSIAHAIFSIPAVKAIEFGDGFRLASMLGSEANDPFDLADGKIVTKTNHNGGILGGITNGMPIRFSIAVKPTPSIHIPQQTVNLSTSEKTTITVKGRHDPCVAIRAVPVVECLTSFVLLDLLIQSGNVNRYARKTR

SEQ ID NO: 18203 - protein, 745 aa, Thermoplasma acidophilum
MESNNGIILRVAEANSTDPGMSRVRLDESSRRLLDAEIGDVVEIEKVRKTVGRVYRARPEDENKGIVRIDSVMRNNCGASIGDKVKVRKVRTEIAKKVTLAPIIRKDQRLKFGEGIEEYVQRALIRRPMLEQDNISVPGLTLAGQTGLLFKVVKTLPSKVPVEIGEETKIEIREEPASEVLEEVSRISYEDIGGLSEQLGKIREMIELPLKHPELFERLGITPPKGVILYGPPGTGKTLIARAVANESGANFLSINGPEIMSKYYGQSEQKLREIFSKAEETAPSIIFIDEIDSIAPKREEVQGEVERRVVAQLLTLMDGMKERGHVIVIGATNRIDAIDPALRRPGRFDREIEIGVPDRNGRKEILMIHTRNMPLGMSEEEKNKFLEEMADYTYGFVGADLAALVRESAMNALRRYLPEIDLDKPIPTEILEKMVVTEDDFKNALKSIEPSSLREVMVEVPNVHWDDIGGLEDVKREIKETVELPLLKPDVFKRLGIRPSKGFLLYGPPGVGKTLLAKAVATESNANFISIKGPEVLSKWVGESEKAIREIFKKAKQVAPAIVFLDEIDSIAPRRGTTSDSGVTERIVNQLLTSLDGIEVMNGVVVIGATNRPDIMDPALLRAGRFDKLIYIPPPDKEARLSILKVHTKNMPLAPDVDLNDIAQRTEGYVGADLENLCREAGMNAYRENPDATSVSQKNFLDALKTIRPSVDEEVIKFYRTLSETMSKSVSERRKQLQDQGLYL

SEQ ID NO: 18204 - protein, 336 aa, Thermoplasma acidophilum
MKAALLEKLNQPLSIVDREIPEPGENEVVIKQDYAGLCYRDILSATGFFPRIQLPIIPGHEIGGTVVKTGSEVRNFHVGDHVASLIYIPCGKCEYCRSGNENLCPYKKSIGEEVQGGFREYVNVPEISLISAPKEVDTRYLPIASCVTGMIYHALFKLAKVKEGQRVLITGAGGGVGSNAVQMAKAFGATVIAETTSESKKEMLEKIGADYIVDGNGKFNEDVKKIGGADIVLECVGIHTFERSLRSLNNGGKMIVIGNIKPDPVNLPLGLIILKGNTIRGSISSTRKDVSDALKMVAENRIKPVIGSEVSIDRINEAMEMMKNKQTEGRVLIKFS

SEQ ID NO: 18205 - protein, 208 aa, Thermoplasma acidophilum
MAMQIKGVIFDFDGTLLDSVELRITAWKKAFQNFGVNVPEDLIRPMIGYPGIDLAKKFVKNPLDVEMLQEDYFLKNIESAKFFQDVIPTLAELRKRGIKTAVVTSTRRIVMQKFSLQVDHVVTIDDVSKGKPDPEPYLKALKMMGIPAEECIVVGDIENDLIPAKKLRCISVLVKHGRDISSNYADYEIENIADILNVIDHLAEKNNR

SEQ ID NO: 18206 - protein, 297 aa, Thermoplasma acidophilum
MMGISVSNVSKRYGDLMALNRVSFNVNGTGCLVLLGPNGAGKTTLMKIMTNIIRPSEGNVSINGFNVRENPGKALETVGSLIEQPEFYPYITGYEALMFTCRIRGISKEKCISEVQRVSTLTHCRDYLNRKTKEYSRGMKQRVGLATALIGDPSIIILDEPTFGLDPNGMMEIRDIIMKMKKEKLIVLSTHLISEAELLADYIGIIDHGRLMHFGPVEKQRYLEVKGQINEAHVNVPGVEIVKKDDVRMILRKSDGVDNWAIIKALETSGSIIETFDYYSIIEDLYRNNVSQTDAEM

SEQ ID NO: 18207 - protein, 504 aa, Thermoplasma acidophilum
MKYGFLEKLYPVFRRYLKDRKHEREDHEWDYEIERHGEIAVRRFIELGPTFIKLGQILSARPDLLPKEYLKSFRLLQDRVDPDPFPLAREIIERNVGKIEDVFEYFNENAISGASLGQVYEAVYHGKKVAVKVNRYNIEERVRNDLIVIKHLLRLAKGRIDNFLYLSIENVVSDFNRRIFDEIDYRKEASNMRAIAANLKEEDRVIVPGIIEELSGKEVLVMEYIEGIKIDDVQRLKDAGLDTKEIALRYDTIFMRMLLKNEIFHADPHPGNVSVREDGSIILYDFGMIGHINDDMRFRLLSLYDGLLNRDPDEIIDALIALNALSPGANRGVIRKGIELAISNFYGRSAEDLEIRELLDVANDVIFQFPFRLPRALVLYMRMSSLLEGVCQQLDPDFKFIRVLQKLLYDEGLIQTLYKQQLKNFLSDTLRSVEKAVQIVPLMKRRLESEDETVRPQRDYRIPASIFLGFILLSLFIEEKTRPLVFIPLIAIDIVAFLYIMIRK

SEQ ID NO: 18208 - protein, 334 aa, Thermoplasma acidophilum
MEAIRLPIIKTENLTKIYPGGIKAVDGLNIEIEEAEIYGLLGKNGAGKTTTIKMLTTAIDPTSGNAIIGGYDLRKDKEKIRRIIGVVPQDLTTDADLKGVENLRMIASFYNIPKQEAEQRIKDLLEIVDLSDWGNKYVSQYSGGMRKRLELICGLVNSPKILFLDEPTLGLDVNTRSKMWKYIRDIQKELGVTIILTSHYLEEVDQLADRISIIDHGKILITGTPDSLKASLKGDVITMEFNSMEDAELARSYPGSLEASVMGDAKVRMKVENSDTELPKILEYLLEKNVSPITINVKKPSLDEVFLEYTGSSIEEDIDPEQFRRMMQNVRRLR

SEQ ID NO: 18209 - protein, 401 aa, Thermoplasma acidophilum [sequence omitted]

SEQ ID NO: 18210 - protein, 886 aa, Thermoplasma acidophilum
MAQIEKFVYRFDEGGKEMVDLLGGKGAGLAEMTKIGLNVPPGFTITTKACIAFLKHGGFPEGMMDQVMQALHDLENKVGRVFGDEKNPLLVSVRSGAPVSMPGMMDTVLNVGLNDSTVEGLAFMTDNRRFAMDAYRRLIQMFGEIVYGLPHEEFREKIEEVKRMRGYDEDRFTVQDLQGLIDQYTVIYRKHGKIFPQDPETQLVESIKSVFNSWNSKRAVAYRKMNGIPDDMGTAVSIVAMVFGNMGDDSATGVAFTRDPNTGEKKVFAEYLTNAQGEDVVAGIRTPKYIDDMQNEMPQVYADLMKTCDILEHHYRDMQDIEFTVERGKLYLLQTRTGKRSAKAAIRIAIDMVDEGIISEEEALMRITPATFDRTMHPQVKTTGREIPLGKGLAASPGAASGMIVFSSERALEIGKSKKMILVRPETTADDVRGMAVCEGFLTQKGGMTSHAAVVARAMGKPAVVGVESMSVNANEKTLTIGGKKLREGDVVTIDGTSGYFYEGELPVEKPTVDDYSKRLLEIADKYRRLGVRANANTPEEAKIARENGAEGIGLARTERMFLGNDRIGIMRSMIMSETPEDRKKYLDQLLPMQIHDFVEFFRTMEGYPVIIRLLDPPLHEFLPNKEDIIRQIYDVNNGKGKIEDLPYLEKLLKTVRDLEEFNPMLGFRGCRVGLVYPEIYDMQVRAIIEAAAKVIEEGREIYPEIMIPLVGHHNELRKIRARLEETAKSVRNHEKVKYKFGTMIEIPRACVTADKIAQYADFFSFGTNDLTQMTFGYSRDDAEGKFMFFYLENGILESDPFSSVDRDGVGELMKMAVERGKRAKPDLEVGICGEQGGDPDTIEFCDEIGLDYVSASPHRIPVARLAAARSSIARNRPEMTQISKY

SEQ ID NO: 18211 - protein, 544 aa, Thermoplasma acidophilum
MKTKIVATIGPASSSPEIMKQMIDNGLSLVRINSAHADIKDVSKITQMVRSINRDVGIMIDLKGPELRTGEFAGGTLKISSGKDYVMGKDIVLNNMNVLSAVQVGDRILMSDGEVSFEVESTDPFTIRALNDGVLRDRSRVNIPGRFIELGTITDRDRAFIREGIADGVDFFALSFVQKSENVDSLRDFVIDSGGDQYIISKIETKSGLDNIEEIVKSSDGIMVARGDLGVELPLKEVVLAQKHIIKTAHEDGDFTIVATQVLESMVNNSSPTRAEISDITNAIIDNADALMLSEESAIGKYPVQAVRTLKEVSDYVEDKVSFDSSYYFKGNTIAYSVARAAKILSDDIKSDGIVALTHTGSTVRMISSLRPKAMVYAATVSESLARKLNIYFGVLPLHMEGNAEDLSFSEIMEYIVRSGRFADGSKLVMTSGDPYFTFGGTNDVKVAVVGKFIGRGYSFGDSLSGTATYGTKGDILMSEDGRIPGTDFRAFIFTSDIKPSLMSSLKGKTVVTKARLVRQIKEGERIYIDGNTGIILMASPDQK

SEQ ID NO: 18212 - protein, 361 aa, Thermoplasma acidophilum
MTEQKAIVTDAPKGGVKYTTIDMPEPEHYDAKLSPVYIGICGTDRGEVAGALSFTYNPEGENFLVLGHEALLRVDDARDNGYIKKGDLVVPLVRRPGKCINCRIGRQDNCSIGDPDKHEAGITGLHGFMRDVIYDDIEYLVKVEDPELGRIAVLTEPLKNVMKAFEVFDVVSKRSIFFGDDSTLIGKRMVIIGSGSEAFLYSFAGVDRGFDVTMVNRHDETENKLKIMDEFGVKFANYLKDMPEKIDLLVDTSGDPTTTFKFLRKVNNNGVVILFGTNGKAPGYPVDGEDIDYIVERNITIAGSVDAAKIHYVQALQSLSNWNRRHPDAMKSIITYEAKPSETNIFFQKPHGEIKTVIKWQ

SEQ ID NO: 18213 - protein, 276 aa, Thermoplasma acidophilum
MKILRGEEIAEKKAENLHGIIERSGLEPSLKLIQIGDNEAASIYARAKIRRGKKIGIAVDLEKYDDISMKDLLKRIDDLAKDPQINGIMIENPLPKGFDYYEIVRNIPYYKDVDALSPYNQGLIALNREFLVPATPRAVIDIMDYYGYHENTVTIVNRSPVVGRPLSMMLLNRNYTVSVCHSKTKDIGSMTRSSKIVVVAVGRPGFLNREMVTPGSVVIDVGINYVNDKVVGDANFEDLSEYVEAITPVPGGVGPITATNILENVVKAAEFQKNNL

SEQ ID NO: 18214 - protein, 796 aa, Thermoplasma acidophilum
MEVEIRIVSASYRQSDVAVELFGRTREGESVAALYFGFRPYYDVVEPDEAYLKVIQNDPEFVKMEDKRLWIRGKYENVKRIYIRSPWKVPEYREKCPFEVLAADIPFHHRFIYDLDLGSCVKIIGENISDRETSFTTDIVIRADRIENVNDFNPNLKVLSFDVENEINRENVEDYGKILVIGYSVSFQGKTVTGSLSGEEQDILRSFVDLIRAEDPDVITGYNIDGYDIPVIKKRMDRYGIKLEIGRDGSIPRRIMNQFWRVHGRLISDTWWSVKRILHPKHESLDYVANMLLGEGKDNIDRLHIEDEWKKRREEVIAYCIKDADLTLRIFEKLMVMNRLMYMSSVTKLPLDDVANVGTSNYVDSILIRAADRENIGVPMNQHEIKTEEIQGGYVHSIGAGLYSNVIVLDFKSMYPSMIIKYNVCFTTLDPNGEILSPNGVRFLSPEKKKGLIPRILQELMADRDEVKRRMKAAKTKDEREFYDGIQNAIKVLMNTFYGVLASSFYRFTDHKIGSAITAFARETIKGIISTLESAHYRVIYGDTDSVFVESGAGSAEDAIKRGKDLSERLSREQGLTLDFQMVLDPFFSHGAKKRYAGRCVYPDDMKGEIVIKGYEVRRTDSFDLQSQALSKVIDFILNRDIDGAIKYADDLIKKVRAGDPSIDIDSLVISRTVKDFQSYRANQESLANIRAAKKLIDMGETFVPGMKVSWIVTNGKRTPQEVEPYIYGRDLNVKPDWDYYARRLSETLGRVIDVFRTDLGQGQKTASLESFGSSSDEAKPVNKEPRKNSTLDSFF

SEQ ID NO: 18215 - protein, 271 aa, Thermoplasma acidophilum
MEAGSTDPPKNLIKVNEKQIEWCCDMIRLNLSVKNLKEITDLLSTIVSEAKFRVDENGMSVTAVDPAHVAMIRLEVPKEAFVEFHTDGQEEIALDIDRLKSVIRLASSSENVGITKDGEKLKFELGTINKSISLLDPSTIVTPKIPNITSEYYAVLKKSDFERGLRAAEDISDSIRFTLSQDGFKAYSHSESEESEMILPKDLITDMSCNTTIKSSYPLEYLLKFIKAISSTDSLKLSFRDDYPLSVEFYLDQNPGAKIKGLFLLAPRMEQ

SEQ ID NO: 18216 - protein, 312 aa, Thermoplasma acidophilum
MVENTKKKKVEEIERCPECGSTNLIRDYEHGELVCGECGAVIEDAYIDQGPEWRAFDSEQNESRARAGSPMTYTIHDKGLSTDISWKNKDSYGRSIPTRNRAQLYRLRKWQKRIKVSNAAERNLSQALQELERMASNLSIPDDVKETAAVIYRKAVKQNMIRGRSIEGVVAGALYAACRITNVPRTLGEIASVTRVKKKEIGRTYRIMSRYLKLNIMPSKAEDYISRFCSKLKLSMDTRNKALEILRSAENAGLTSGKGPTGVAAAAIYIASLMTGERRTQRAVAEVAGVTEVTIRNRYKELTEKLQLNVEQ

SEQ ID NO: 18217 - protein, 550 aa, Thermoplasma acidophilum
MMMYEDDIRRIALINAYQHEGKADLKSVMGKVMAEIPDLRRDPRSAREMVSRIVDEVNSMSAYEIRETVETRYTSSIRKEKKVEEHRLPDLEGVNGPVVMRMAPSPSGPLHIGHTRMAILNDEYVKRYGGELILRIEDTNPKNIDPDAYHMIPEDLEWLGVNVTKIVIQSDRFDLYYAEAKKLMENGHMYVCTCPREEFKKRKLESIPCKDRDNPPETNLELFDKMIDGTIKEGDAVAVVKTDLKHPNPSVRDWIAFRIIEARHPRVDDKYRVYPMMSFSVAVDDHYLGLTHVLRGKDQLTNTDKQRYIFDYNGWKKPYYYHYGMIKFPGIKLKTSLMKKGILSGQYEGWSDIRLGTVRAFAKRGYRPETFRRYWINSGLREIDAIFSIEIFDSINREIVDPRAYRFSFVKDPVPVRIEGMPNISAKLPLHPTHPEYGFREYEVKGSVYIASRDFAAISEGERIRLKDLCYIRKKGNGIIYDGVEMTEKTKIINWCPEGSRDFSVLKPDGSKDSGLIEPKSSGYRGIAQLERYGYVNFADGDDLAYFTHP

SEQ ID NO: 18218 - protein, 307 aa, Thermoplasma acidophilum
MTVEGETPKRCPECNSEHLIRDYEHGELICADCGAVIEDAYIDQGPEWRAFDSDQDERRARTGSPMTYLSHDKGLATEISWSNKDYYGKRIPHKNRAQIYRVRKWHQRIRVSNAAERNLSLALQLLNDIGAKLGIPKDIKETAALIYRKAVEKNLIRGRSIESIVCASIYAACRKVNIPRTLDEISKASEVNKKKIGKAYRHLAKELDLNLKPTTPFSYISQFCNKLDLDKQAIVISEDIVRQAMSMGISSGKGPTGIAAAAIYIASVKVGKPRTQKEIARISGVTEVTIRNRYKEISKALNISISE

SEQ ID NO: 18219 - protein, 314 aa, Thermoplasma acidophilum
MEIKTVGVIGAGTMGSAIAELFAFNGFNVVMKDQNMDLARSGYSGIEKILNDMKRINDEKPEKEIARIENYGIKLSDDQKNAIRKKIGVQVDVNAMLKRISLTDKYSDLSSCDLVIEAAFENQDVKNRIFSDISDLSEHAIIASNTSSLSITEMSSRLKRPENALILHFFNPPYLLPLVEVVPSLYTSDEAKNTAVSLISRMKNHREGMVPVMAKEREGFIVNRLLIPLINSASDLLDSGVASAEDIDTAMKKGAGFPMGPLELADMIGIDVVVDVMEVLERAYGERYKTSVILRRMREANRLGRKTRIGFYKY

SEQ ID NO: 18220 - protein, 325 aa, Thermoplasma acidophilum
MARKKISVIGAGNVGATVAQFLAAKQLGDVYLFDVVDGIPEGKALDIQEGAPHWRYDLDVVGFSTSDETKYKNMEGSDVIVVTAGLARKPGMSRDDLFDKNVEIISDVSRNIKKYSPDSIIVVVSNPADIMAYALQKFTGIDPSKIMGLGGSLDSSRFRTFLAKELNVSVEDVNAFVIGGHGDDMVPFIRYSSVAGIPIENLLSKEKIDEIVKRTRFGGGEIVNYLKTGSAFYAPGISITAMVESVIMDKKRVIPCAAYITGKHADHYGIRDKFIGVPIKIGEKGVEQIYDIDFKPDELELWKKSVASVEASSKKVDEWIAKHAH

SEQ ID NO: 18221 - protein, 199 aa, Thermoplasma acidophilum
MGQKAPDFTVNTSKGPVTLSSYRGKWVLLFSHPGDFTPVCTTEFIAFTERYKDFQALGVELLGLSIDSVYSHIAWIRDIKEHFGIEIPFPIIADIDKEVARQYNLIDEKSGATVRGVFIIDPNQIVRWMIYYPAETGRNIDEIIRVIKALQFNWERKLATPANWQPGQEGIEGAPSTVDASLKRDGEPGVKTWYLKFVK

SEQ ID NO: 18222 - protein, 320 aa, Thermoplasma acidophilum
MFPIIRMRRYRKDQNFRDLFSETSIRPEKLVMPIFVEEGISKPVEISSMPGILRYPLGDLKAYVKHLEDIGVKSVLLFGVPSHKDSMGSAAYDKNGVIQKAISVIKDNTNIITIADLCLCEYTDTGQCGLLKDGYVDNDSTLEVYRKIAKSYAEAGVDIVAPSGMMDGQVSAIRDELDNDGFENVMIMAYSSKFSSNLYGPFREAAESAPKVGDRKSYQMDYRNQREALREIDLDVYEGADIIMVKPAIFYLDIIAKARERFDLPLAAYSVSGEYNMIYNAVKNGYLSEDAIRESLVSIFRAGADIVITYFTEQILTNSK

SEQ ID NO: 18223 - protein, 384 aa, Thermoplasma acidophilum
MGNFGVTQDEELVLSFVRKFAEEELKPLAKEIDEKMEVPRKIIDRMKDLGLFATYIPKEYGGYGMSFPFLVRAIEEISKACPSTALVLDGALTLFAEPLIMFGSEDLKKRYLPRVAAGSVGGLAITEPGAGSDAAGISATAVKKGDRYVINGDKIFISNGRISDFFVLDAVTDPGKRHRGITAFVADRDTPGLKISRDIHKMGIRGSSTVELAFEDMEIPAENIVGKENEGFKVIMETLDAGRIGIAAQALGIAENALAEAIDYVKQRKQFGTEIANFEGIQFMIAEMATEIEAARYLTYVAAEKWQNKENTIEISAMAKMKASDVAMRVTTDALQLFGGYGYTTDLDAERHMRDAKITQIYEGTNQIQRLVIAKEILKKTRYY

SEQ ID NO: 18224 - protein, 322 aa, Thermoplasma acidophilum
MIDLFRRYYRENNIDPPELISKREVGYMTFSGEVIRHLKINNRFELNMLLRDAAPMHVYSSAAYYRKPDERKMPEKEWGGADLIFDLDSDHLPGSEKLSQKEMLIQIRDQTERLVSDFLIADFGIPKSSIKIYFSGNRGYHVHISDDRVYRLGSDARREITDYITGNSLDETVVRRAIDMLGIASGGWPAVVSKELGEASPANQRRESDLRKAIKRARENHSVLIDSPVTYDIHRIIRMPNTLHGKSGLIVKEVEIDHLGEFDPFQECIPDQFRDGEYDVFLPEKIKPVEIGGIESPKMPGKHRVKTFMAVYLVASGRAVFP

SEQ ID NO: 18225 - protein, 549 aa, Thermoplasma acidophilum
MISNMMTGQVPILVLKEGTQREQGKNAQRNNIEAAKAIADAVRTTLGPKGMDKMLVDSIGDIIISNDGATILKEMDVEHPTAKMIVEVSKAQDTAVGDGTTTAVVLSGELLKQAETLLDQGVHPTVISNGYRLAVNEARKIIDEIAEKSTDDATLRKIALTALSGKNTGLSNDFLADLVVKAVNAVAEVRDGKTIVDTANIKVDKKNGGSVNDTQFISGIVIDKEKVHSKMPDVVKNAKIALIDSALEIKKTEIEAKVQISDPSKIQDFLNQETNTFKQMVEKIKKSGANVVLCQKGIDDVAQHYLAKEGIYAVRRVKKSDMEKLAKATGAKIVTDLDDLTPSVLGEAETVEERKIGDDRMTFVMGCKNPKAVSILIRGGTDHVVSEVERALNDAIRVVAITKEDGKFLWGGGAVEAELAMRLAKYANSVGGREQLAIEAFAKALEIIPRTLAENAGIDPINTLIKLKAEHEKGRISVGVDLDNNGVGDMKAKGVVDPLRVKTHALESAVEVATMILRIDDVIASKKSTPPSGQGGQGQGMPGGGMPEY

SEQ ID NO: 18226 - protein, 567 aa, Thermoplasma acidophilum
MEKIKEDVIILGGGMAGLRAAVAAAEYNKNISVGVVSKLYPLRSHSVSAEGGTSAVLNPKDSFDLHAYDTIKGSDYLADQDAVEEFVRLVPEQIYTTDHWGCPWSRNPDGTISQRDFGALSFPRATFAADKTGFHVMQTLFSRALKYDNIHFYNEYFATSMFLDGGRFNSLTTINLRTGEFVVFQGKSIIFAAGGAGRLYQFSTYAHSVSGDGDAIAYRAGIPLKDMEFIQFHPTGLVPSGILITEGARADGGYLLNGEKKRFMQAYAPNKLEKASRDVVSRAIMWEIEAGRGAKGEYGDMEYVYLDLRHMADILDERLPMITEIAKKFNGIDAHTELIPVHPATHYTMGGIDSNVKTTTDFSGIFAAGENACVSIHGANRLGSNSTNECLALGNVAGVSAAKYAMEHDIPDLVVENVNNEEKRIWDDLLKRDGGENVAKIREDLRINMDKNVGIFRDADGLNTSLKNIKQYKERYQKISIQDKSSTFNMELEWALEVGFMLDLAEIITVGAIMRTESRGAHYRKDYPNRDDENFLKHTIATYTKDGPKITYKPVVITKWQPTVRTY

SEQ ID NO: 18227 - protein, 240 aa, Thermoplasma acidophilum
MADEYEFEIKRKDQSGKVYYSTYKVPKDKISTVLEGLLYIKENLDQSLSFRYSCRMEICGSCGMEIDGKPRMACSTIVEDLKKDKIRIEPLRHYKVIRDLVVDIDPFFEKYREVKPYIIRDDDGKYDKELPQTPEQFHEYANFAMCIKCGLCMAACPIEGSDPQYLGPAPLAAAWRYIADNRDKGAKYRVEIVDGEEGTSRCHFAGECTEVCPKGVDPSFAIQKLRRTALKIELASIFGR

SEQ ID NO: 18228 - protein, 100 aa, Thermoplasma acidophilum
MFCPKCGSLMTPVNGKYVCPSCGYEISKNKETIKIVSKSADKETIMIKEEVSAEPLDSDAVCPRCHHKGARYVLKQTRSADEPETKFYTCEECGYRWREY

SEQ ID NO: 18229 - protein, 228 aa, Thermoplasma acidophilum
MERPETDLDRDELVSSFLGRLKRYKGLRIPENISKDENLNRIAPYLKRSGLMADLPENVIVDALKLYLESSSRGVSRGRGCVAVLAACLLIASRRQANPMTLKYIARSMHTDPSRVWRTENAIVKNMKTPSISARPMDFVERYSELLNVDNDVRSEAIALVQQFSREMRIMRKAPSTIAISAIYLASERLSKHLVQRYVVKKTGITEVTLIKTYKEMAEYLSMGTADT

SEQ ID NO: 18230 - protein, 289 aa, Thermoplasma acidophilum
MGSGSAETIVCRNLTKAFKKRRILDNVNFSLSGGVNILVGENGAGKSTLFYLISGIMKPDGGIAMLNGIDSWKSHRQAMRGVSFMPEKPSVLGGTSVREHIYWFSALNGTGMERIIDYLHFFRVDYVLQATFQSLSLGEMQLVMIACYLSTESSIFILDEPNSNVDVHKRSLVSEAIRQKADRSNSLFLISTHVLDEMLTIYDRMLVLDKGTVRFSAEFGKASFVSVLRTNNNNRMLDSIREWDGSAVLINGAIFTSLEIKRCAEIASENGVVIMSYFLIPAEMVRIYG

SEQ ID NO: 18231 - protein, 336 aa, Thermoplasma acidophilum
MGTDISDIVVSHETSLKDQGNQTFSIDTYNILYQLLSNVRQYDGMPLMDSHGNVTSHLYGIFYRTINLLENRIRPVYVFDGKPSPLKNRTISERQMMKEKAKAELEEAIERGEEDLRQYYSRINYITPQIVDDTKKLLDYMGIPYVDAPSEGEAQASYMTKKNVDGVISQDYDCLLFGARKILRNFAIYGRRKVPRKNIYKTVYPEYIILDEVLSANQINQDQLIGIGILVGTDFNEGIKGIGAKKALALIKKEGDIKSVLKHIGKNIENLDEIIDFFKNPPVVDYDFKFRKPDTDAIEHFLCDEHDFSRERIRDHLESLRKNDQASTQFRLDSFD

SEQ ID NO: 18232 - protein, 303 aa, Thermoplasma acidophilum
MGDHGDAKDHASELKDIFSLKKIADAKYSYEDSDYVIFGVPFDNTSSYRRGSKYAPDSIRSAYVNLESFEFSYRFDLLRARISDLGDMEESEDVEYVVDQVDRVTKMVFSDGKIPIMLGGEHSITVGAVRNFPEDVHMVIVDAHSDFRDSYMGNKLNHACVTKRALEILGPNRITSIGTRSVSLEEYQDPDFEKVEFIPSFSVREYGIERFINDIERRPGRVYISIDMDGIDPAYAPAVGTPEPFGLTDYEVRRLVERLSYKAIGMDINEFSPLYDNGNTSMLAGKLIQVFIASREKYRIEHI

SEQ ID NO: 18233 - protein, 381 aa, Thermoplasma acidophilum
MRILYFTDTYYPTPDGVSVYLKEVKQKLEDEGHEVMIFSVTGDSREHNVYVPKYTAPFLPYPQYRVPVSFIPFRVFRRALEFNPDIVHLHNAFYMSSVGYLVARRIGVPPVATFHTDVSRMKESINMPFKNLAFDLGERYSLFLYRKCRMVMAPSATVEEYLKIRGVKNVVTLPLFVDTDKYRYVPADSGERYILYLGRITVDKGIYRVLDLAEAMKSEDVRFKIAGVGPELDRIRRIVKYHGMKNVEILGYVDDQRKMDLMANASLFVYPSSADTFGISVFEALASGVPVMVSEDFPVKENTEAISYVKFGDIRSAVETAERILHEDRRKLAAEARHLVESKYSLERHISSLLEIYDYIRAERRKMGSSEKMRADNSAYR

SEQ ID NO: 18234 - protein, 294 aa, Thermoplasma acidophilum
MYQLVYYEAFSAREALIEIRGLKKVYSSGKVALGGIDLDIPSGISAIIGRNGAGKTTLMRILSTQLLPTSGSIRINGFHVVREASKVRKIVCSIPQEASPIGVLTPLEQVKMYLVARGFSYSTADAEAKRALEEVGLAESMRVPADTLSGGMKRKIFVAMALASGSEIVFMDEPTTGLDPISRYEVWAAIRKLGSNVLLTTHYMEEAASLSSYIVLVESGRIMNRGMLRELLSVFSGKVRVECRQYQEESIEIGGIYIKYVDSDEAEAYVKMGCDVKNITLDDLFIKERIQLEP

SEQ ID NO: 18235 - protein, 389 aa, Thermoplasma acidophilum
MKILIMGIDGYIGFPLAMRLLNRGHQVYGLDNYITRRRVSKVGSDSALPILSFHERNRRLKRHFGHQIPFFYGDASNPDFVYKVIEKIRPDAVVHLAEQRSAPYSMIGLREANETMVKNITSTMNLIYAIKDIVPEAHILKLGTMGEYGTPNIDIPEGFFEIEYNGRRDVLPFPKNAGSWYHWTKVHDSNNLMFANRVWNLAVTDVMQGVVYGTKTQEIDETGLYTRFDIDEVYGTALNRFTAEAIIDMPLTVYGKGGQTRGFLSLNDSIQCLTLALEKPPKAGEYRVLNQFDEKYSVGQLAEMVQRIFENEYGKRPEIAHLDNPRVEKEEHYYNPEHRKLEEMGYRRTKIIEEEIVDAISDLSKFRDRIYNLRGTLMPKTFWKLSAYN

SEQ ID NO: 18236 - protein, 247 aa, Thermoplasma acidophilum
MDGLITAAGLGTRSMASKYYRKEIFSVYDERDGQMVIRPMLDAVIYRMKYAGIDNIYVVLDHEDGVTKKFIEESYPDLHIIEQRERRGYGYAVYLARDHMDSPFVLNAGDGMLLDPDVENTIVHSFKGGNLLVAFQVDDPRKYGVLEMSGDKVVGVREKPEKPPSNLALAAFYVLDPSIFDHIDIDRKESELTPAIDATIKAGVKTEARMIRKDEWISVGQVSSYVDVVNRTYSFARERAKTGDFKK

SEQ ID NO: 18237 - protein, 408 aa, Thermoplasma acidophilum
MDEFFLMNSFDLAGKTVYLRVDINAPVNPLTGEIMGIDRFRAHIDTIRNLRNSKVVIVAHQSRPGKDDFISLRQHAQILSHLLNKRVQFVDQLFGSQVNRAVSEMSDGDIVMLENSRFYSEEVDLTTIESMESSNIVRSLSPLFDYFIIDAFAAIHRAQTTLVGFHRIKPNIAGTLIEREVSMIERFRKIREKPKIAILGGAKIEDSIAVSENFLSRGFVDKILTGGVVANAFLWASGFDIGKKNREFIMKNNGDYEKLLDKCRAILSKYGDKLVMPTDFVMNPSGQRISINEKIPDDQILADIGLDTIVEYSEIIDGARAIFMNGPMGMYEIEDYSSGTREVFTAVAHSKAFKLAGGGHTLSALDKLGLTKMIDHASTGGGALISYLSGETMPVLEALKESKKLFEG

SEQ ID NO: 18238 - protein, 354 aa, Thermoplasma acidophilum
MLQYRSSKMISMEIVEFKWLKFLDRYRSMAKHNLSNSGMPEPDLRSMGIDTRYESYLNEMVDLDAALRDTVARRYGVDRDNVIITNGGTEAIFLASAFISASSEVIAVPSPEYEPIFIVPESLDRRVRRVKLEKIGQAEKNSESLALSLPNNPTGKYGDIADLVRDAGRTYRYVYIDETFHDFTDDRGSSLYDGSKNLIVSNTMTKFYGLSSLRVGWIVSDKENIDAIRRIKDLTTINNARFSLFLARQAIEKWDRFRERTHSIVRKNADIARKELSDFGFYSDEYEGAPFMFVGDGRFDSEMMASKAISGYGVLVAPGSYFGLDGYLRVCLTALDAREDIAAFREFAEKELGK

SEQ ID NO: 18239 - protein, 613 aa, Thermoplasma acidophilum
MSKIIGIDLGTSNSAAAVVISGKPTVIPSSEGVSIGGKAFPSYVAFTKDGQMLVGEPARRQALLNPEGTIFAAKRKMGTDYKFKVFDKEFTPQQISAFILQKIKKDAEAFLGEPVNEAVITVPAYFNDNQRQATKDAGTIAGFDVKRIINEPTAAALAYGVDKSGKSEKILVFDLGGGTLDVTIMDFGDGVFQVLSTSGDTRLGGTDMDEAIVNYIADDFQKKEGIDLRKDRSAYIRLRDAAEKAKIELSTTLSTDIDLPYITVTNSGPKHIKMTLTRAKLEELISPIVERVKGPIDKALEGAKLKKTEITKLLFVGGPTRIPYVRKYVEDYLGIKAEGGVDPMEAVAIGAAIQGAVLKGEIKDIVLLDVTPLTLSVETLGGIATPIIPANTTIPVRKSQIFTTAEDMQTTVTIHVVQGERPLAKDNVSLGMFNLTGIAPAPRGVPQIEVTFDIDSNGILNVTAVDKATGKKQGITITASTKLSKEEIERMKKEAEQYAEQDRKAKEQIELLNNAESLAYSVEKTLNDAGDKVDKETKERLTNEVKDLRKAIEEKNTENVKTLMDKLSKDIQEVGAKMYQQASANTQQSAQSNSQNSGSSDGKTVDAEYKEKS

SEQ ID NO: 18240 - protein, 365 aa, Thermoplasma acidophilum
MAKDYYKILGVDRNATDEEIKKAFRELAKKWHPDLHPENKQEAEEKFKEISEAYEVLSDPQKRRMYDQTGTVDFGAGGQNFNWDNFTHYSDLNDIFNDIFGGNFASDFFSGFGRGQREEQYDLDLYTNLDITLEDAYYGTEKRIKYRRNAMCPDCNGTGAKNGKLITCPTCNGTGQQRIVRGQGFFRMVTVTTCQTCGGRGRIPEEKCPRCNGTGTVVVNEDISVKIPKGATDNLRLRVQGKGQSYNGRTGDLYVVLRVRNDRNVQRINDDLMIDQKINFAQAALGDTIEVNLFREKYSLKIPEGTQPGEVLRIKGAGMPHLNGHGSGDLLVRVNVEVPKRLTQKQKDLIREIFDIKENHRSWFH

SEQ ID NO: 18241 - protein, 488 aa, Thermoplasma acidophilum
MDANGRIVSFAYRLNRQYFPAPGWVEQDPVNLWRNVRITLKKAIEESRIDLTGIASAGVTNQRETVLVWDRKTGRPLYNAIVWQDKRTSRRIKDLDEETSNSIMKTTGLRPDSYFSASKIQWLLENVEGLRKKMADGDVSFGTVDSWIIWNLNGSVNRSITVTDHSNASRTMLYDIAKLRWNPDLLDIFGGISETSLPEVMSSGSAEYGYISKDTSAIFDGREVPITADIGDQQSALFGQGCFNPGDVKATYGTGTFILSNAGTEVPQTSGTLLRTIFYSISGRELSYALEGSILASGSVLRWLQNSLHLFRSAKDIEDAAEKLKSNDGVYFVPAFSGLGSPYWDQDARGLFIGLTESTTADHLARSVLESEVYMATDVIMEIEKEIGRNIAKIRCDGGGSRSDFLMQFQADIANAEVLVPESSETTALGSAYLSGLVSGLWKSKDEIRELWRLKKVYRPVMSEEERKRNYVGWKDAVKRCMGWHPNI

SEQ ID NO: 18242 - protein, 338 aa, Thermoplasma acidophilum
MIRVGINGYGTIGRRVARAVSLQDDMIVTGIVKTKPDYVSMVASRDFKIFVPDKSYEKAFQDAGIKVEGTVENLIDDSEIIVDATPEGQGEKNKDLYVKRRIKAIFEGGEEPEIAQASFNAYSNFEEARSKDYVRVVSCNTTALARTLHPLRERFGIRYVDATIVRRATDPNDSKKGPINAVEPSLSIPSHHAPDLRTVMSGLNVSTIAIKAPTTLMHVHAVRVELEKDASKNDVIEAWRSYRRIMEIGKNSGITSTGQMMDLAREFGRDRSDLYEIAVWSQSVSVQGNHVSYIQAVHQESDVVPENVDAIRSMFDIADRDRSVSMTDSKLKIEKRVF

SEQ ID NO: 18243 - protein, 323 aa, Thermoplasma acidophilum
MMESNEENREKKTIEDLPGVGEATAEKLRENGYDDIMAIAVASPKDLSDVTGIGEGAAAKIIAAARKFADIGNFETGEEILERRKSIQKLTTGSKNLDDLLGGGLETQAITEFFGEFGSGKTQIMHQLAVNCTLPKEKGGFDSDVMMIDTENTFRPERIIQMAKSKGADPDETLKRIHVARAYNSHHQILLAEKAQDTAKEYNIKLLIVDSLTAHFRSEYVGRGSLAERQQLLNKHMHDLLRFGTIYNAVIAVTNQVSARPDVFFGDPMAPIGGNIVGHTATFRIYLRKSKGGKRIARLIDSPYLPEGETVIQISEEGVSDGT

SEQ ID NO: 18244 - protein, 589 aa, Thermoplasma acidophilum
MATKSSTSQAVSKLRQPIVCVLGHVDHGKTTLLDLIRGTSVASKEPGGITQRIAATTVDISRILKETEKLNTKGLKIPGLLFIDTPGHVAFSNMRARGGALADLAILVIDINEGIMPQTVESIDILKKFKTPFIIAANKIDLIPFFTDVKTNLFTEFIRKQRQEYVNELDNRIYSIMNKLYEFGLNSDRFDRISDFTKTIAIVPVSAKKNIGVPEILMVLAGLAQRFLEREIEYRDINGHATIIEVRKEESAGITLDAVLYQGTISVGDSIAVNTKNGPAVTKVKALFVNTGKGQRALKEVKKVSAAEGIRVLISDKIDVISGSPMIVVRDNLDQVMKEIEEESKVDIPLSEEGIYVKAEAIGSLEAISYELNKQGIKIKQAQVGDITKRDIMDVSTLPDPINRIIVGFNVSVLPEARDAMSSSDVSIVTGDIIYKIVEDTQKVMDERKKMLLQGRKMSMPVPSRIRILPQYIFRASKPVIVGVRVETGQIKVGDNLIRGDGKYAGTIKSIRNEDVSVRYQDAPAEVAVAIDNVTLNRQIFPDDVLYVDITENVVKELRRAPMEKEIMDTLEEIIRIKRKDNPFWGTRV

SEQ ID NO: 18245 - protein, 148 aa, Thermoplasma acidophilum
MTERTLVLLKPDAVKRRLIGRIISRLEDKGLKVVALKFMQMTKDQAENHYSVHRSKPFFKDLVTYITSGPIVAMVLEGPKAIEVVRILAGSTDGSKAQPGTIRGDFSMGIEKNIIHASDSPEAYSHEMPIFFNESEIVEWSYGDEIIY

SEQ ID NO: 18246 - protein, 588 aa, Thermoplasma acidophilum
MLFSVVADAFEKMESTTKRLELTDLLVNLLKEADDDLPLLIYLLEGKLGPDYLGIETQMSDKLIIKALSVASNISEDEIAKEYAKAGDIGTIAKEIAEKRSLRSLVQEEMTVKYIHDTLMKMARTTGSGSTKARVDAYMDLFLNSTPKEIMYITRIITGKLRIGISDATILDAIVKAFADEKYSEDIENAFNFHPDLGYIASELRKGNIDAILKLGPTPMIPFKVMLAERLRSVEEILEKMGGRCAFEYKYDGMRTETHIERGKVRLFSRGNEETTNQFPDITKAASETFKVDSAILDGEAVPYDPDTGELYPFQVISHRRGRKYDLDKVSSEIPITVFLFDIVYLNGRDLSKTPYTERRKILESIFTESDSFRLAKRIESGDPAEVHRFFNSAIEDGCEGLVAKSTSPDSFYKAGARGWLWIKLKRDYQAQLWDTLDLTVVGAFYGHGRRKGTYGALLLATYNDKNDTFETVCKLGSGFSDDVLFSLPKKFEQYVSKEKPARVISNLEPDVWFYPAVVMEVIGAEITVSPIHTCAYGEIEKDSGLSVRFPRFTGKWREDKKPEDSTTSREILEMYKEQKKTITEEKS

SEQ ID NO: 18247 - protein, 292 aa, Thermoplasma acidophilum
MYKGIVTPMITPMGQNGEIDYRATEILIDNLADFGVDGLFPMGSTGLFPMFSTDEKKKFLGFVRDHSKKIEVYAGVGSSSTQESVELSKYTEDIGIKVRVLMPTYYIKPDEDWMYRHFSTVISAASNDLFIYNIPQLSGSWISESLIEKLTREFSNVKGIKDSSGDMRFFSRIIRHKNEKFDIFQGQDDLLFLSLSIGASGGVCGLSNISPYITNLYHEFSAGNLEKARKIQIDEVNPLMYAINEATFPAGYYYAFYKMNGIKGGYRAPMVEPTTDQKKKIDQELTKIPKKQ

SEQ ID NO: 18248 - protein, 352 aa, Thermoplasma acidophilum
MEFQKFRTMHFPRDVYIGHDVLEHIVDVVGENSRNKNAIIVSGDLTYELAGRKVHDLLSTYGYEVHVFLAGNANYDTLERIEYESLDIQAGIVIGVGGGAKIDLAKKLAFDRKLPFVSVPTAPSHDGIASPRASLRRNGISYSEEGAMPIGVIADTAIMIKAPYRYLAAGAADVISNLSAVKDWKLAHRLKGEEFSSSAAAMSEYSAQEVLSQINEIKKYEESSVWLVTKNILASGTAMAIAGNSRPGSGSEHLFAHALEAAGVENMLHGEMCAMGTVISMYLHDENWQQIKEAFDNLGISIRSRDYGIEDEIVINALRTAHAIRPERYTILGESDMSYDAAVKALELTGII

SEQ ID NO: 18249 - protein, 375 aa, Thermoplasma acidophilum
MRVLDDIDEKIDKATKLLQGGIKEESLGHKDKAKEYYFAAYRLMLEAANASPPDLKKKRLDQCNIILSAYQRVNENRTAPAEEKTSDRISEGEALLEEIGLEKPEIPKVTFEDVAGLDDVKNEILGKIVYPMKFKELSQEYNIQFGGGMLLYGPPGTGKTFIVKAIANEVRARFINVNPASLYSQWFGMFEKNISKLFRAAALLSPSIIFFDEIDALVPKRDTSNSDAAKRGVAQLLNEVGGINSQKNKNLFIIAATNNPWEIDEAMLRPGRFDIKIYVPPPDIIARKKIFELNMAKVKQAGNIDYNLLAQQTEGYSGADIEFICKKASQNVFMEAVKSGKQRQVETRDLLDVIGSIKPSIDADLLSKYREFAGF

SEQ ID NO: 18250 - protein, 324 aa, Thermoplasma acidophilum
MKEIRIILMGTGNVGLNVLRIIDASNRRRSAFSIKVVGVSDSRSYASGRNLDISSIISNKEKTGRISDRAFSGPEDLMGEAADLLVDCTPASRDGVREYSLYRMAFESGMNVVTANKSGLANKWHDIMDSANQNSKYIRYEATVAGGVPLFSVLDYSILPSKVKRFRGIVSSTINYVIRNMANGRSLRDVVDDAIKKGIAESNPQDDLNGLDAARKSVILVNHIFGTEYTLNDVEYSGVDERSYNANDRLVTEVYVDDRRPVAVSRIISLNKDDFLMSIGMDGLGYQIETDSNGTVNVSDIYDGPYETAGAVVNDILLLSKVQK

SEQ ID NO: 18251 - protein, 393 aa, Thermoplasma acidophilum
MQRLSWVEEELSALKAEGRYVPIRTIESAQGSWVTIGGKKVLNMCSNNYLGFANHPETKKAAIEAIEQYGVGAGAVRSIAGTDEIHARLEEKIAKFKHMESALVYQGGLLANVGTIPALVGKDDVIFSEELNHASIIDGTRLSSAKRIVYKHLSVEDLEKQIRENRSAFKKALVITDGVFSMDGDIAPLPEITEVAEKNDVMVYVDDAHGEGVLGDHGRGIVNYFHLEDRVDIEMGTFSKALGSMGGFVAGSADLIDLLKQKARPFLFSSALNPGDAAAVLKAIEILEKDDSLIKKLWHNSDILKKSLSDVGYNTGHSKTPITPVIIGDEKKTVELSKMLYDEKDVFASPIVYPTVPKGTARIRLMPSAVHTDADIKVAVDAFTDLGKKLHII

SEQ ID NO: 18252 - protein, 402 aa, Thermoplasma acidophilum
MEYRFSDIFRYIKPSEIRSLLKYTSDPELISFGGGMPNPESFPIKEMKEILNDVIDNYGKKALQYGTTEGLDPLRDELAKYVEKTEGIRAKREEIILTTGSQQALYAIGKIFTNPGETVITEGPTYVGAISAFNSNKAEMIAIDLDDKGMDVDALEERIRNFMANGTKPKFIYVIPTFQNPAGTTMVLDRRKQLLEISKRYEIPIVEDNPYGQLRYDGDPVPSIKSMDDDGNVIYLGTFSKVMAPGLRLGYVIADRQIVEKINLVKQGLDLASDSLSEYIAYEYLKRGDIYRQIPKTVSLYRKKRDLMLKSIAEYFPEGVKYTKPNGGMFLWVSLDEKIDTTRMLERALKAKVAYVSGAAFYPHGEKHNSMRLNFTYSDDDKIVEGIKRLAYVINEEMEVVE

SEQ ID NO: 18253 - protein, 254 aa, Thermoplasma acidophilum
MNIKPLPDNGDLVVVKITEVKNFGANGVLEEYPGVEGYIHISEVATGWVKHIRSYLREGQRVVCKVIGVNPERKVVDLSLKRVNQHQSREKIAEWKNEQKADKLFEIVCSRLNRNPEECKEQFGRRLVELFGTLFAAFESAAQSNGEWLPEMNGDWKNVFVEIAKENITIPEVSVSGYFEVYSLASDGVERIKEVLTIPEDTGKVELEYVGAPRYRIVVKDKDYKKAEEILKKVVQIVNEKAKKLQVEVEFNKQ

SEQ ID NO: 18254 - protein, 229 aa, Thermoplasma acidophilum
MIFLDYDGTLVPIIMNPEESYADAGLLSLISDLKERFDTYIVTGRSPEEISRFLPLDINMICYHGACSKINGQIVYNNGSDRFLGVFDRIYEDTRSWVSDFPGLRIYRKNLAVLYHLGLMGADMKPKLRSRIEEIARIFGVETYYGKMIIELRVPGVNKGSAIRSVRGERPAIIAGDDATDEAAFEANDDALTIKVGEGETHAKFHVADYIEMRKILKFIEMLGVQKKQ

SEQ ID NO: 18255 - protein, 441 aa, Thermoplasma acidophilum
MKYIVVSSRCPFSHDKAAGKEIIKENVGGVATALRRAMEKYGGTWICWGDGKLDGKYLDEDVGKYRIRRVMLSVPEKHGYYDLYSNRTLWPLFHYFRERVKYTDNGYEIYRRVNEKFTNMIVQSLSPEDVIWIHDYQLSLVPKMLRDRGITNRIIFTWHIPWVSKEMFETLPESRDIIDSLSRSDFITFHTETYRKNFTDLLDENSRAKSLVIPLGIDYRYFSKTRGTDIKSYALMDRKLIFSIDRLDYTKGLVNRVLSIEELLRRHPDLVGKFVYVMIVTPSRTTVSDYVAMKRELEMHIGRINGEFGSISWMPILYMYRKISDKMLVSYYKNADIALITPLIDGLNLVSKEFVASSDKGILILSRFAGASNCLDGAVVVNPNSLGEVAEAIYSAMNMGEDEIRERLRKMKEEVSRRDTDWWIRRINAIAKRKINDRTVT

SEQ ID NO: 18256 - protein, 188 aa, Thermoplasma acidophilum
MRITIAGKIGSGKSTVSSELSRITGYTVYSSGTFFRETARKMNMSIEDFNVYSESHPEADYYTDETQKAFMQANDNIIVEGRLAGWISYLNGINAFRIFLYATYYTRLVRFAGRENIDIDSARDLMEKREKSEKERYRKLYGIDVDDLSIYDIVVNTEFMKPPEIAVYIANRIDEMSRKDIFTPRILR

SEQ ID NO: 18257 - protein, 183 aa, Thermoplasma acidophilum
MRSVITGVAGVGKTTVLDIVSKETGIKIVNYGTLMFDLAKKRGLVENRDQMRKLSRDIQIDLQKNAATEIGRMEDVIVDTHMSIKTPFGYLPGLPEWVLREINASAFIIIEADPELILRRRQNDPTRARDEDSVESIREHQEINRAFAAAYSIFSGATVKIITNEEGKPDKAAHDIIKVIAVD

SEQ ID NO: 18258 - protein, 543 aa, Thermoplasma acidophilum
MIAGQPIFILKEGTKRESGKDAMKENIEAAIAISNSVRSSLGPRGMDKMLVDSLGDIVITNDGVTILKEMDVEHPAAKMMVEVSKTQDSFVGDGTTTAVIIAGGLLQQAQGLINQNVHPTVISEGYRMASEEAKRVIDEISTKIGADEKALLLKMAQTSLNSKSASVAKDKLAEISYEAVKSVAELRDGKYYVDFDNIQVVKKQGGAIDDTQLINGIIVDKEKVHPGMPDVVKDAKIALLDAPLEIKKPEFDTNLRIEDPSMIQKFLAQEENMLREMVDKIKSVGANVVITQKGIDDMAQHYLSRAGIYAVRRVKKSDMDKLAKATGASIVSTIDEISSSDLGTAERVEQVKVGEDYMTFVTGCKNPKAVSILVRGETEHVVDEMERSITDSLHVVASALEDGAYAAGGGATAAEIAFRLRSYAQKIGGRQQLAIEKFADAIEEIPRALAENAGLDPIDILLKLRAEHAKGNKTYGINVFTGEIEDMVKNGVIEPIRVGKQAIESATEAAIMILRIDDVIATKSSSSSSNPPKSGSSSESSED

SEQ ID NO: 18259 - protein, 459 aa, Thermoplasma acidophilum
MFEGLDSRRITFFQIKSVIVSGIGIFSDSYNLYAISLVYYLVSASLDLSPLQDSLMTSASFMGAAAGAFLFGFIADRIGRKPMYGIDLAFIALGSFLQLFTVNFYELVIFRSILGFGIGGDYVLSPVIMAENADTRDRGKLMIMTFPIMAAFGAMLVAFVDQISLLYLPSSAVWHVVLAFGGVPALLVIYLRRKIPETPRFEARVRGNSTELSKIETEIGSAVNVDIDRKPFISRLRASILMITVSAVLWILYDMYSTTFAIYGPITIAYNLGLTPITFTYYAELFAGIPGAIISALLIDRVGRRKLIVVGYAGVFVWLLMYSLLLAKASIFAGLASDITPAGLIGKAAILGFFFYIMNYLFSATGPASIIGGAMVTPEITPTKVRGTSQGITVGIDRTADAVGLTAFPILLSKFGLSAMVLAYAMIAVLSIIMIFMIPEAAGKSLEEVSKDYDTTTQI

SEQ ID NO: 18260 - protein, 233 aa, Thermoplasma acidophilum
MQQGQMAYDRAITVFSPDGRLFQVEYAREAVKKGSTALGMKFANGVLLISDKKVRSRLIEQNSIEKIQLIDDYVAAVTSGLVADARVLVDFARISAQQEKVTYGSLVNIENLVKRVADQMQQYTQYGGVRPYGVSLIFAGIDQIGPRLFDCDPAGTINEYKATAIGSGKDAVVSFLEREYKENLPEKEAVTLGIKALKSSLEEGEELKAPEIASITVGNKYRIYDQEEVKKFL

SEQ ID NO: 18261 - protein, 354 aa, Thermoplasma acidophilum
MQIETEDPHETINNYKLRIDERISRFFDRKEAETKDDLSRRVIRMIREYTEGGGKRLRPIFLVLGYRLFADENNAIFDASISIELAQSYLLIHDDVIDDSDLRRGKPSMHIRLWRSFFPESEKGKKMGEGLAIVAGDLAETYAHESLINSDFDPSLLLLADMELTKTIEMTGYGQFLDVVSGTLNDFRENDLIRLHLWKTARYTLEGPLAMGALLSGRHDQIMDLRLFGRTLGIAFQLKDDILGLFGDEATTGKSIYSDVNEGKRTLLMIKAMEFSDRQDAEFIDRILRRGNVTQEEFERIRNIVMKSGSYDYSVKLMDSLVAKSKEYLNRIRGNSCAKTYLSWLSDYLVARDH

SEQ ID NO: 18262 - protein, 328 aa, Thermoplasma acidophilum
MKAALVYEPLGNENLRIEDVDDPKVLDGQVLIEVRKAGLNPVDYNTINGKIVYKLNPLPHIPGTEVYGVVAQDSGNFKKGDRVVVYNRVFDGTCDQCISGNEHLCTAGGIWGVVSNGGYAQKVAVPEKNVFRLPKNVSDEMAASIGVAALTSFRALRLAGCAPGKSVLIFGASGNTGMFSVQMASMMGCDVYAVSRKDWIEEFGATEVFEADEIPDSMKFDIVVNPLGTLFWKESLKHLGIRGSLVTFGIFTGREGSIDIADLYTGERRILGSTGGTRSDLRDLLEFMKMHDLRVKISREFKLTEMQDALKFYNEDHDGRILISMRVS

SEQ ID NO: 18263 - protein, 483 aa, Thermoplasma acidophilum
MFPKGFKFGFSEAGFQFEMGISDPDPNTDWYVWTHDKYNIQNHVVSGDLPENGAGYWDLYHRDHDFAQHLGMNAARIGIEWSRIFPKSTEEVKVSVQNDRGDVLNVDITDRDLDKLDKIANKDAVNHYRSIFSDFKNRGNYLIINLYHWSTPVWINDPSKRDIEKDNAVGNCFTTRSIVEFAKFAAYVARAFDDLADRWSTMNEPNILFNGQCSNDWRPDSMAIRKKLFAEAHARAYDSIKKFSEKPVGIVYANGDMQPLTDEDREARDLAEYEIRYSFFDAITKGDLSWYANAAQNRSLDYSSDKREDMANHLDWVGVNYYSRDVVKKDGDRWAIVPGYGYATGENKRSLDGRSSSDTGWEVYPEGIYHLVMSYQKHIGLPMMISENGVADDSDRLRPRYVASHLKNLESAIRDGAKVEGYLHWALTDNYEWASGFSKKFGLLKVDFKTKKRYIRPGALVFKEIVENNGVDEDLEWLAADKF

SEQ ID NO: 18264 - protein, 297 aa, Thermoplasma acidophilum
MLDMEKDLSEIIDLSIELKKNRYRSYESLRNKVLGLIFEKPSTRTRTSLEVAIDQLGGHAVYLNPSEMQLGRGETISDTGHVLSRFLDAIAYRAYDHRNVVELARSTSIPVINALDDVEHPLQIVADFMTIKEKKGRFTNLKFSYIGDGNNMANSLMLGAAILGTDMYVASPKGFEPKQEFVEKARSIAKQHGSSITITNDPVEAARDADVIYTDVWISMGEESKKGEKEKAFKDFQINEKLVSNAKRDYIFMHCLPAHRGLEVTDGVADSINSVIFDEAENRLHSEKGVLYKLLSY

SEQ ID NO: 18265 - protein, 294 aa, Thermoplasma acidophilum
MKGSRRCSKMVLINKNTKVIVQGITGHQGSFHTGEMLKFGTKVVAGIAPGKGGTKFADKVPIVNSVSEAMQYEPDATMISVPAPYVKDAAYEAIDNGLKIVYILTEHVPYQDTMEIVKEASLRGITVLGPNGPGITVPFESKIGIMPNHIFKEGDVAIASRSGTLTYEIVYAVTKAGMGESTVIGLGGDRVVGLTFIDVLKMFEKDEKTKRIVLVGEIGGNNEELAADYIKKHVKKKVVAYIAGRSAPPGKRMGHAGAIIERGVGTAESKLKAFAEAGVKVADYPQDIPKLLEE

SEQ ID NO: 18266 - protein, 376 aa, Thermoplasma acidophilum
MTLCNHWYGDLLNLYEYMGKDIFRQYGIPVPNGYVVSSVDEVRKLTNPVAVKSQILLGGRGKAGGIKFAKTDQELKDAVKALLGAKVRNLTVTKVLIEDMLNIKHEYYVSITLNRSARAPTVIASAMGGVEIETVPDEKIFKRIIDPSLGYSDFIGREASTFMGLSPDLSKQFLDLLKKLYNVYKGEDAELVEINPLVETNDGKLIAADAKVVIDSDAMFRHREFNIQDPEKTPLELKAEGKGYAFVELDGDIGVIANGAGLTMATLDALLLHKGKPRNFLDLGGTDNVDIVVNAFDLVLEAKPKAILVNIFGGVTKCDTVAQGIVDAKKKFDIKIPIVVRLSGIHEEEGRQILKENGIEAFSEMMPAIERVTKVF

SEQ ID NO: 18267 - protein, 469 aa, Thermoplasma acidophilum
MSKEYDLLILGYGAAAFSAAIKASEITSGQASIAMVGTGPLGGTCVNVGCVPSKMLISAAKNLKYIAKPRYPGLKATYAVETGEVMDFIRMAVDEERHNKYEAVISGYENIDLYRSRAVFTGDRRVKLDDGQELFGYNVLIATGSRPSIPAVPGLANAGYITSNEFWALERIPESLVIIGSGPIGSEIGQAAARLGSRVHIVEIADQILPGISKDMAQMVMDAMASDGVEFSLSSMVKDVSVRNGKKIVRFEKNGVQHEIEADEILVATGRSPNADLDLEKTGVKYDRYGIEVDSTLRTSNRKIYAAGDVVKQRLKLETLASKEGVIAAENMFDHAGISVDLNSFPVAVFTSPEYASVGYTEDEALKAGLNYDVRSIYTTDVPKERILRNDRGMIKIVAEQGTGRIIGIQIVAENAADMINEASAILHAGMTVGDVIDTPHVFPTVNEGIKLAAQSFLRDISMMSCCME

SEQ ID NO: 18268 - protein, 124 aa, Thermoplasma acidophilum
MIMTEVPEGLNYTKTHEWYRKDGNTATIGITDYAQSQMTDIVYVDLPKVGDKKKAGDVLLTIESVKSAEDVYSPITGTVTAVNEEVAKHPESINKDPYGSWLVKMAIESEGEHLSASEYRKLIQ

SEQ ID NO: 18269 - protein, 460 aa, Thermoplasma acidophilum
MDCPEPRSCHAKKPFISPDHSVKVSMVVPNGEGDKTAAVVGLQFGDEGKGKITDYLSGSYDVVVRFNGGTNAGHTVVTDEGTFKFHLLPSGSLRTSYVVLGSGMVIDPVALIPEIEIVRKINPALKIIISRNAHVVTKMHRQIDVEEEKIRSSLMIGTTAQGIGPTYEDKYARTGIRMVDISDIDLIKEKIETMYRMHSNLLANTEFSNLAKREEMAKEIYEAGIKLTGYLDYTEVAIDRLYSQGKRILFEGAQGVFLDPDFGFYPFVTSSNTISASVYTGTGFSLRKVNRIIGVAKAYVSKVGEGPFPTEITGDLAKQLRDLGGEYGTTTGRPRRVGWLDLPMLKYAVRIDDVDEIAITKVDTLGMLDTVKVCRQYLIDGKPIDYVPRDMNTIKKIEPVYDEFEGWGAISDSISGRKISIDQLPSKLVKYIKYIEDQVGKPIGIISMGKERNRTVRIIK

SEQ ID NO: 18270 - protein, 476 aa, Thermoplasma acidophilum
MTENNGGLDAINEAINTSHGSFHLKTVLISGLGFFTDAYDLFIIGVVVSLLSLAGWTTVDTFYKGLISSTALISAVIGAIIFGRLLDYLGRKRVYGLELAILIVGALGSAFLTPYNNVIALIAWRFILGIGIGGDYATSSTIIAEYSNTKSRGKLIGSVFSMQSFGLVAGPLVALAFMLHGIPPAITWKALLAIGAIPAAIVIYFRLKMPEPPRYTAAAKGDVHKAAKDLKEYTGIHVEVSSKDKYVVKAKWTALFKDRTFLLTLIGTMGAWFMMDWALYGNSIMSSTILSALVPSTIKGLPALIRSTEYTLLIFAGAAFPGYWIATSVLDKIGRKTIQLIGFAVMALSYALIAIGYHSIIGNISMFLALYGLSYFFIEFGPNVTTFVYPPEVFPVTTRGLGTGMSAAGGKIGAFIGTFADAIILGTDASAHLPFLFSLLAVFAVIGFALTLVLLPETKGRNLEDTSGEKRYTVKA

SEQ ID NO: 18271 - protein, 459 aa, Thermoplasma acidophilum
MISSMTESWEELKERAYGPMDKQKSKWFNYKMLLLTGGGIFVDGYNIVIISFGLAGIETLFGLQHNAFLVGLIGISVIIGNLVGALLSGYFVDKVGRRTIFIIDLILFVFFAIISGLVTNAYELVVARLLVGLGIGLDYPIATSYLSEYTPINPRGKFLVMNITFFNIAGVVAAIVGYSLLPLGATIAWRYMLMSAAVPAAITIAGRIRTPESPRWLLEHGRKKEAIQAIERVTESTLPDDTQKFIMDSNVKPPVSGYYKELLTKYTKSAIFIGLFYFFFAIAFVNASLYGPSILASFGEAGLIGSSLYWLLFVVGDIICILVIDSFGRRNSTLTGWAGMLITMIILAFAPSNLKLLSLGAFILFAMFQGIGPGSLHMVYSPELFPTRIRATAEGWKQGIGRLGGVLTGLFFPSLVIGDKLLILILTSIAGLVLSILMAPETKRKGLEEISEKDINLQI

SEQ ID NO: 18272 - protein, 456 aa, Thermoplasma acidophilum
MAETKQLSDEDQVKDIIARANRIPVWSLPTAFLAIIGIGYFFTFYDISDIGLAMPAIAKQFDIGTSLSLFIALSVGLIGYGIGSYIIGSLADIYGRYRSMILTMGLTALGSFGDAISVNVPELTIFRFITGLGLGADLNLVSSYVSEFAPPSIRGKITVYTFLIGILGQAITPFVGLSLVPVYYNGWRYLFGIGAVIAFIALILRFELPESPRWLAAKAHNLEKARKVLEMMEATAVKKIGKLPDPKPEEVVLEEPKFPTLYLFRRPYSTRLGLLVVMWFFWYIGNYAFLGDSAAILASAGFSISSSILYLAVGAIGYPVGAAIMVVSADRFERKYVIFADTVVWFIGLMLFSAKISAFIFAGSFLASMALGMYLQVAYTYTAENYPTRARSSGFALTDGIGHVGGAFGALLLPVLVASYSFAFGFRFIAITGLIAGILAMLGPKTSNRTLEAISA

SEQ ID NO: 18273 - protein, 436 aa, Thermoplasma acidophilum
MYDAIIIGSGPGGYAAAIRLGQRQKKVALIEKDKIGGECLNYGCIPSKALIELANSINYLREMPGVSLNYSIDMKKWQEWKWSMINRLTGGVETLCKGYGVDVIRGEAYIVDATHVKIGEKVIEGKNLVIATGSKPVRIKGIDDVMYNREVLDLDHIPESTAIIGGGYIGVEIGTALAKLGSKVTIIEMMPSILPGTDQELVRHVERRLSQLGVRVMTGKKVLNTQHGDKIRVNMEGGEYVEAEKVLMTVGRVPNTEGFGLENLKLEMDGRFIKTDAHKRTSVPNVYAIGDVSGQPMLAHKAYYDADIAADNICGMDSVVEYRAMPYVIYSDPEIAYTGSKSAKSTRFPVAANGRSLTMNESIGTFNIYYDEKGIVTGAGLAAPHASELISELSLAVESGLMAMDIGLTIHPHPTVSEGVKETAEEAYGKPLHFKI

SEQ ID NO: 18274 - protein, 400 aa, Thermoplasma acidophilum
MYEFKLPDIGEGVTEGEIVRWDVKEGDMVEKDQDLVEVMTDKVTVKIPSPVRGKIVKILYREGQVVPVGSTLLQIDTGEEAPVQQPAGRAESTVQVAEVKQVPLPEVSGHVLASPAVRRIARENGIDLSKVGGTGEGGRVTLDDLERYMKSPAPSPAPSAGKAEAVHTAPQIPAQKPAPGREEILEMHGLRRIIFDKMTKAKQIMPHFTVMEEVDVTSMVSILDSAKARNRKVTVTGFLARIVPSILKQYPYLNAIYDETRRVYILKKYYNIGIAVDTPDGLNVFVIKDADRKSMVEISAEISDKASRARENKLQLDEVQDSTFTITNVGTIGGIMSTPIINYPEVAILGVHRILEREGRKYMYLSLSCDHRLIDGAVATRFIVDLKKVIEDPNAIIYEI

SEQ ID NO: 18275 - protein, 319 aa, Thermoplasma acidophilum
MNMVQALNSAMDLKMSEDDSVIILGEDVGRDGGVFRVTDGLQAKYGPQRVIDTPLSELGIVGMAIGMAVNGLKPIPEIQFQDFIYTSMDQIINQMAKIRYRSGGDYTVPLVLRTPVGGGIKGGLYHSQSGEAYFAHTAGLTVVSPSNPYDAKGLLISAIESPDPVIFLEPKRLYRAQKVEVPDEKYTIPLRKANVLKQGNDVTIVTYGSMVPTVMSVASKSKYDVEVIDLRTIAPMDRDTIISSVKKTGRVVIVHEAPRTLGVGAEISAMISERAIEYLYAPIVRVTGPDTPFPYRLEEYYLPNEGRINAALDRVMSFR

SEQ ID NO: 18276 - protein, 337 aa, Thermoplasma acidophilum
MTEVLDQDEKNLIVRGFTSMVLGRYFDKKIITAQRQGLVGFYTPMMGQEATQAGAAMALSKEDSVYGYYRDVTMLIYLGHPIEKIFDQIMGNAEDSAKGRQMPSHYSAKEINFMSVPSPVATNLPLAVGAAYAKKYRKQEGIVITTFGDGGTSTPDFHAAMNFAAVFDLPVVFLCENNGWAISLPVEKQTKAEIYKKAEAYGMKGVYVDGNDFIKTYRTVKDAVEYARSGNPILVEARSYRMGPHSTSDDPSKYRKNEVQENSDLDPLVIAEKLMISGGYLNQAEIDKIKDESKKMIDEKFEERLKIPAPDPETMFDDVYSEITWAIEEERGEILRR

SEQ ID NO: 18277 - protein, 351 aa, Thermoplasma acidophilum
MSGIVTYGSYIPRYRIKPDEIARVWGENPDHIKNGIYILSKSVPAPDEDVATISVEAARNALKRKKIDPKEIGAIYVGSESHPYAVKPTATIVGSAIGVDFSLFAADYEFACKAGTAGMQNVKAMVDSGMIKYGLAIGADTSQGAPGDALEYSASAGGTAFIIGKDDTIAEINSTLSVASDTPDFWRREGQPYPSHGERFTGEPAYFRHVITAAKMMMERMETQPKDYDYVVFHQPNGKFPTRAAKMLGFEEKQYKDGLLTPYIGNTYSGSMMTGLSSILDVSKPGDHILAVSFGSGAGSDAFDITVTDRIEEMDRNRAPTIKKMLENVKWVDYAIYAKYKKKIIVGDGIE

SEQ ID NO: 18278 - protein, 387 aa, Thermoplasma acidophilum
MALSDVYIIGAGETKFGELWDKSLRDLAVEAGLEAIKDANIYSRDLQMLYASNSLAGTINEQSNIAALAADFSGIAETHVPAVRVEASTASGGAAVREAYLAIKSGEYDVVMVGGVEKMTDIYGSEIIDVQSSILDREWESFNGATPAALAAITARRYMHDFKVPREDIAMIAVNDHANASMNPDAQYRNKITVEQVINSDPVAEPLNVFDCSPISDGASAIILASDEYRKKNRLDGIRIVSSAMSEDYLALHSRKSIYTLESARIASKQALERAGIKKNDISFLELNDSYSIYGLLELEDLGFAEKGKGRELLGEIKINGSLPVNPSGGLKAKGNPLGATGVSQFYEAYLQLKGKAGQRQVKGARYGMLHNMAGTGATSVVHIVGE

SEQ ID NO: 18279 - protein, 212 aa, Thermoplasma acidophilum
MTESERQCGIDEAGRGPVIGPMVISLVCCDLSFLKEIRVKDSKALTRKRRSELFEKIMGRCSVRYRILHPKDLNRMMAAESLNKIEEDEIVDLLRYADDLVYIDCYDVIEERAQEIIQMRSGRQVVCKHKADAIFPAVSAASIVSKVIRDAEIDRLHDRFGDFGSGYPSDPRTIDFLKKYLKENQDPSEIVRIHWSTVQRLLHSEKNQKKLF

SEQ ID NO: 18280 - protein, 364 aa, Thermoplasma acidophilum
MMCLSEEQQILRTSIKDFVKRYVVPGLNEIKNDRFPRDILRELGKNGFFNVMIPGFGVQDSYSYSLIVEELASASPSLAWLYVTHVAAAYALSRMGSEDQKSQYIEKMADGRLLATIAITEPASGATASAVQTKAEFDGKAWVINGSKTFITMASDADAFIIMARSDSEKPAFTDFILRSDDRGVSRSASLKGSGMPGIGWGEIFLENVETGQDRVLGNRNEGIKIIPTIAKVFTIGAASISLGIMDVLNANALEHIRERKINGSSLSSFQVVQDRYLHMYTNGQAASALIYRAAINDDIKLAYAAKVFATEKAIENAVTASRLFGANGYERSVGIASYIDDALAVPLHFINNDVLTGLFMNSV

SEQ ID NO: 18281 - protein, 770 aa, Thermoplasma acidophilum
MKMIKEVVKRDGTVVPFEKNKITMAIYKAMLSVKNGTMKDAEQLADKVVARLKDKERPSVEEIQDVVEDVLMTSKIDGKTFTDVAKSYILYREKRRAIREEKELMGVKDDLKLTLNAVKVLEARYLLKDEDGKIIETPRQMFRRVASHIGIVEALYDYIKYKKTGKVPENAEIIGKVSPTQEEVLRRAFGYMKEDGIIEGTFEEFMDFIQTKGTSAGHYINRFEEVMSSLDFVPNSPTLMNAGTKLGQLSACFVLPVGDSIEDIFETLKNTALIHKSGGGTGFSFSRLRPKDDIVGSTKGVASGPVSFMKIFDVTTDVIKQGGKRRGANMGILNYNHPDIMEFILSKDSENKVLSNFNISVGVTDDFFDKLDNDDYVDLVNPRTKKIMKRIKAREIWDAIIDQAWKTADPGLIFLDEINRKNPVKNVGDIESTNPCGEQPLLPYESCNLGSINLSKYVVDGKKIDFDRLRETVWTATRFLDDVIDANKFPVEQIKKVTRMTRKIGLGVMGFADMLIKLEIPYNSWEALEIGEKVMSFINDESHKASQALAEERGVFPAWYGSEWEKEGIKMRNSTTTTIAPTGTISIIAGCSSSIEPIFALAFVRHVLNGQELLEVNPLFEEKTRELGIYSEELMRQVAETGNLENVKINEEVKKIFVTAHEIDPQWHVLMQATFQRYCDSGVSKTINMRSDATREDIARAYRMAKDLHCKGITVYRDKSKTVQVLTAGTAETKKPEEKEVIELVTKMPDKYLKIDSTFDPACPTGKCDK

SEQ ID NO: 18282 - protein, 359 aa, Thermoplasma acidophilum
MSLKGVVMAGGKGTRLRPITYSIPKPLVPVAGKPVISYILDAFYRSGISDIIITTGYKFESLIKGVLENKNSQQNILFSVEKEAAGTAGGVKIAENFLDDTFVVGSGDILIDFDIGDMIKEHQRRKNKITIAVTKVDDPSQFGIAEIDEEGYIKRFLEKPGKNETFSDTINAGVYIMDRSLLRYIPSTGQFDFAKDLFPKLLSQGIKIGTYLIDGVWLDAGRPKDVIKANQIMVEKYGESFNGTGKAIIKSKVPQGCSIKPPIYIGEGVHVGNNSTISGSAVYDGVSIGDDVQIENSVIMASSKIMRGTKVVNSVIMQNTTIGEDCEIHDSVLSQKLNLQNGSKVFQVALSSEIVQDEN

SEQ ID NO: 18283 - protein, 295 aa, Thermoplasma acidophilum
MTDLLQEFEEKRDILRKAIEEHIKKRDEAAQQSRNYAEQRDQLNAKAHEMRDQVKQKISQKNALIEEVQKIRTEKEEHFQKLSELRKEYKKITEEANYASVNQRDIKAKERELQKLIKKQETMQLPKAEEDKVVQEIKRLSNEIKKMKEDREKQLSENEKVKALLAEIDKEKTLARDLKKRAEEISNQISEISNDINKSLQELDEVRKKADEMHEMAIKYGKESEQEHEAFIQAKNDLKDLEKVIAGLRTKKRATKKKEKDDELQQKAEVLFEKFKNGEELTTDDLLILQKAGFL

SEQ ID NO: 18284 - protein, 360 aa, Thermoplasma acidophilum
MPTIEERIKEIEDEIKRTQYNKATEHHIGLLKAKIAKLQMEASASHGGSHSGFAVPKSGDATVALVGFPNVGKSSLLNRLTNSESEIGDYAFTTLQPIPGILEYKGAEIQILDLPGIIENASYGSARGREILSAVRAADLIVIVTDVQAGGIDKILTELYNAGIVVNRKRRNVEIRKTTSGGIRLHRPKNVDIDEDYIKEIMKEFKLVNADVYIRENVSVEDIIETLQGRYVYIPSIVAVNKIDMNPSFDTSQVSQYGEVFRVSAKTGYGIEELKEGIFRSLNLIRIYLRNKAGVVDFQKPLIVREGTTVREVCRKINRSMIDSFRYAIVSGKNRPIGEQRVGIDYPLMDEDIVTIISRY

SEQ ID NO: 18285 - protein, 375 aa, Thermoplasma acidophilum
MKDVIVIGAGPSGSFAAYRLAKAGFTVDILEEHREVGKPVECTGLVSQRVLKYVRTKSIAGTVRGANIFFPNGKSVHIEKDDPTIVLFRDAFDKDVAAMAIGAGSGIRINARALSVTEHDDHVTVRYRENGSIKEEDARIVIGADGINSVVRRDVYGMRQKHVVSTLQYDMASGIEDEDSVNVYLGSQYTHGFFGWAVPGGDIVRVGTGSYKASARPYMDNLSRRFGDNRTLGITGAGIPIRMAERLSSRRTVLVGDAGGIVKPLSGGGIYTGIFSSDVAANYVVEALESDSSEASLRKYDREIRNTIGKELKKDAMIQRIYSRISDRSFNRIYSMISNEKIIDVINRSGDIDYPSTVIIKVLLRNPGILYSMWK

SEQ ID NO: 18286 - protein, 330 aa, Thermoplasma acidophilum
MSGCQWQYQGSVMIEIWTEKYRPKSLSEIYGEDENIQKLKSFVEKKEIPHLLFAGSVGTGKTSTAIALAIELFGDSWKENMVEMNASNENGIDVIRNKIKDIARIKPSNPLGFKILFLDEADQLTAEAQAALRRTMEIYSETTRFIFSCNYSSKIIPPIQSRTVVMRFRPVPDEYISRKLQEIAKNEGFQIDEESMHALVEVSAGDMRKAINVLQAVYTSGEISPKKIYEIIGYASPEKIQKMISRAINGLFDEAREIVDGMLIYDGLSGIDIVRSLHSYVRSSMISPKQKIEIIKALADAEFRIVEGSNDRIQLDALIAKLAEIGSRTD

SEQ ID NO: 18287 - protein, 241 aa, Thermoplasma acidophilum
MNGLRAAVKNGAVSVFKQDDYFGIALQETKADSTSVPEEMYHLGYYLYNNPAKKKGYSGTMSLVREKPIDVSYGFENEEGRILNLEFDKFYFINVYFPNAQHGLTRLDMKLDFDEKFLEYSNELRKKKPLIICGDFNVAHEEIDIARPKDNENNAGFTKQERDWMTKFLDSGYVDTYRIFMKEGGHYSWWSYRFNARAKNIGWRIDYFVVSDDIRDRVKKAEILETVTGSDHAPVTLEVDL

SEQ ID NO: 18288 - protein, 528 aa, Thermoplasma acidophilum
MIFHVMGFNFVRDVIEKNDRRKTALIVSDPELNSRSETYGTLLKKSYKLANFLYEMKVRPGNRIMIMMENSLEIYHAVTASIALGAVYAPTASILPDSQIKYRIDHLNPKAIFSDSGSYDKLKGYGYTVVNLEDPDTAKEIDGYQETFSRFYDDPDAEHVIFFTSGTEGNPKMVLHNNTYPLGHRTTVRWLDLRAQDTHWNISSPGWAKWGWSSYYSPMISGSTVFNMRYRKFDPEVALKAMEKFLITSICAPPTVWRMFLLQDLSSMNLHLRKAASAGEPLNPEIIDRIRQYLGVTVKDGYGQSESTLMVGNLEKQTVKPGSMGRPLDPYRVVIVDDAGNRLPPNTTGHIAVDIGERPNGLFVSYMNDPSLTRDRFRNGLYYTGDMGYMDEDGYLWFVSRSDDVIKSSDYRIGPFEVESALLRHPAVAESAVVGTPDEIRGDLVKAFVVLKSGYTPSQDLARELSIHVRNLVGPHARPRKIEFVGELPKTISGKIIRKELRKLELEKYNKAKSDPSSKGLGYEFYVD

SEQ ID NO: 18289 - protein, 183 aa, Lactococcus lactis
MLEKNLDKAIEKVLVSEEEIIEKSKELGEILTKEYEGKNPLVLGILRGSVPFLAELIKHIDCHLETDFMTVSSYHGGTKSSGEVKLILDVDTAVKGRDILIVEDIIDTGRTLKYLKELLEHRGANVKIVTLLDKPEGRIVEIKPDYSGFTIPNEFVVGFGLDYEENYRNLPYVGVLKPEVYNK

SEQ ID NO: 18290 - protein, 695 aa, Lactococcus lactis
MNNNKQPKQGNFVKNILMWVILAIVVVVGFNFFFSSNQSSVDKISYSQLMTKLDGNKIENVTMQPSDSLITVTGEYKEPVKVKGTNNFPLLGNSSSEVKNFQAYIIPTDSVVKDIQNAAKSNDVKLSVVQASSSGMWVQILSYIIPMLLFVGIFWLMMGGMGARGGGGGGNPMSFGKSRAKQQDGKTSKVRFADVAGSEEEKQELVEVVDFLKNPKKYHDLGARIPAGVLLEGPPGTGKTLLAKAVAGEAGVPFYSISGSDFVEMFVGVGASRVRDLFENAKKTAPSIIFIDEIDAVGRQRGAGLGGGNDEREQTLNQLLVEMDGFQDDGNSVIVIAATNRSDVLDPALLRPGRFDRKVLVGAPDVKGREAVLKVHAKNKPLASDVDLHNVATQTPGYVGADLENVLNEAALVAARQNKKEINAADIDEGMDRAMAGPAKKDRIQSMREREIVAYHEAGHAIVGLVLENGSTVRKVTVVPRGRIGGYMLALPDEEIMQPTNFHLQDQLASLMGGRLGEEIVFGVATPGASNDIEKATHIARSMVTEYGMSKKLGMVSYEGDHQVFIGRDYGQTKTYSEATAVMIDDEVRRILGEAYDRAKEAIETHREQHKAIAEALLKYETLDAKQIMSLFKTGKMPDEAAAAEVPEPKTFEESLKDANANVDDFSNINIYNGDEKTDSKPEENKEKSEDETAE

SEQ ID NO: 18291 - protein, 391 aa, Lactococcus lactis
MDLLKKFNPNLDKIEISLIRQFDQQVSSIPDVIKLTLGEPDFYTPEHVKQAGIVAIENNQSHYTGMAGLLELRQAASEFMNKKYGLSYAAEDEILVTVGVTEAISSVLLSILVAGDEVLIPAPAYPGYEPLITLAGGSLVEIDTRANDFVLTPEMLEQAIVEREGKVKAVILNYPANPTGVTYNRGQIKALAEVLKKHEVFVIADEVYSELNYTDQPHVSIAEYAPEQTIVLNGLSKSHAMTGWRIGLIFAARELVAQIIKTHQYLVTSASTQSQFAAIEALKNGAYDALPMKKEYLKRRDYIIEKMSDLGFKIIEPDGAFYIFAKIPADLEQDSFKFAVDFAKENAVAIIPGIAFGQYGEGFVRLSYAASMDMIEQAMARLTDYVTKKRG

SEQ ID NO: 18292 - protein, 472 aa, Lactococcus lactis
MVVGAQATEVDLVVIGSGPGGYVAAIRAAELGKKVTIIEKDNVGGVCLNIGCIPSKALINIGHHYQESLEEEKGENPFGLSVGNVKLNWESAQKWKQDKVVNQLTGGVKMLLKKHKVDVIQGTAEFIDNNTINVEQEDGFQLLQFNDVIISTGSRPIEIPSFPFGGRIIDSTGALSLPEVPKHLIIVGGGVIGSELGGAYRMLGSKITIVEGLDHILNGFDKEMSDIIANRVKSAGSEIFTSAMAKSATQTDKDVTLTFEVDGKEQTVTGDYLLVSVGRRPNTDLIGLNNTDVKLTDRGLIEVDDSYATNVPHIYAIGDVVPGPMLAHKASFQAKVAAAAIAGAEDDVDLHVALPAVAYTTTELATVGETPESVKDRKDVKISKFPFAANGRAISMNDTTGFLRLITETKEGALIGAQIVGPGASDLISGLSLAIENGLTSKDISLTIQPHPTLGEAIMDTAELADGLPIHV

SEQ ID NO: 18293 - protein, 532 aa, Lactococcus lactis
MTEIFKMPDIGEGMHEGDIANWLVKVGDVVKEDDPIAEVQNDKLMQEILSPYSGTVTKLFVEAGTTVEVDSPLVEFDGDGSGSSAAAPTPQETAGSDTATTDAPSGEAQIFTMPDIGEGMHEGDIANWLVKVGDEIKEDDPVAEVQNDKLMQEILSPYSGKVTKLFVEAGTTVEVGAPLIEYNGNGAAPAAASPAPVAEAPKAASPASPANAPLTKTTSTGHILAMPSVRHYARKAGIDLSQVPATGRHGHTTLADVKAFESGSVAPIAQTTPEAAPAPKADKPAAPVAEKAPSVKAGAGDRREAMNPTRKVVSKVMTAQHTHIPPVTNFDQVEVSKLVKHRAVFKEIAAKQDIKLTYLAYVAKALATTAHKFPDINASVDYEKQEIVYHEHVNLGIAVNAPTGLYVPVIHEAETKSILEIAKEIAELATATREGTLKPQQMQGSTITISNIGSARGSWFTPIINGSDVVILGLGSIVKEPIVNGEGEIVVGQNMKLSMTYDHRLIDGMLGQTSLNYLKSLLADPEFMLMEI

SEQ ID NO: 18294 - protein, 326 aa, Lactococcus lactis
MAVKTYIAAITEALDLALEKDKDALIFGEDVGQNGGVFRATDGLQAKYGEERVFNTPLAESGIGGMAIGLATQGFHPIMEIQFGTFIFEVFDSIAGQMSRTRYRFNNTRSNNIVVRTPYGIGTKTPEMHADSIEGLFSQIPGIRVVMPSNPADAKGLLLASIENNDPVIFLENLHLYRSLKGEVPEGYYTTPLDTAAVAKEGSDVSIIAYGGTVPLALKAAEQLEKDGIKAEVLDLRTVAPLDIESIGKTVEKTGRVVVVQEAQRTAGIAANVMAEISERFVLNLKAPIGRVSGPDSIFPFAQAENDWAVKAEDIVNKVKEVVDYD

SEQ ID NO: 18295 - protein, 374 aa, Lactococcus lactis
MSNSEQILDFKAQLELQDTTFPMLQILNEEGKIVDEDGLKRAGLSDEKLVELFKSMLFARQVDIRSMKLAKQGRMGFFGPHAGQEASQMASSFAFTDEDWLFPGYRDLPQIYAKGWPIWKGLLWSRGHQLGNEYTTDDGKPVNSWFPQIIIGAQYVEAAGVALGLKKRKKDAVAFVYTGDGGSSQGDTYEGINFAGAYKAPLVAFIQNNGYAISTPRSLQSAAPHLAAKGWAAGAPSIVVDGMDAIAMYLASKEARAWAVAGNGPVVIEAITNRLEPHSTAGDDPLRYRTKEDIEAWWKKEPLVRMRNFLTEKGLWDTEKEEAYIAELDAGIDADIKKANNVEKQKISSFIKNTLEVPSQAMAEQIAKFESEGK

SEQ ID NO: 18296 - protein, 426 aa, Lactococcus lactis
MTNHNYKFDTLQVHAGQVPDPVTGSRAVPLYQTTSFVFNNSDHAEARFALQDPGAIYSRLGNPTNDVFEARIAALEGGSAALGVGSGSAAITYAILNIATVGDNIVSASTLYGGTYHLFSGTLPKYGITTKFVNPDDPKNFEEAIDEKTKAIYYETLGNPGNNVIDYDAIGQIAKKHGIPVIVDATFTTPVTFKPFEHGANVIVHSATKFIGGHGTSIGGVIVDGGNFDWANGNFPDFTQADESYNGIKFAELGEIAFVTRVRAILLRDTGAALSPFHSWLFLQGLETLSLRVERHISNTKKIVEFLDNHPKVELVNHPLLESNSYHALYQKYYPKDAGSIFTFELKDKDEKKARDLIDHLEIFSLLANVGDTKSLAIHPASTTHQQLNAEELASAGISKGTIRLSVGIEDVTDLIADLEQALEKI

SEQ ID NO: 18297 - protein, 715 aa, Lactococcus lactis
MKFKKKNYTSQVDEMDCGCAALSMILKSYGTEKSLASLRLLAGTTIEGTSALGIKKAGEGLGFVVQVLRADASLFEMKKVPYPFIAHVIKNQKYPHYYVITGANKNSVFIADPDPTVKMTKLSKEVFLSEWTGISLFLSPTPSYQPTKEKTSSLLSFIPIITRQKKVILNIVIASFIVTLINILGSYYLQSMIDSYIPNALMGTLGIISVGLLLTYIIQQVLEFAKAFLLNVLSQRLAIDVILSYIRHIFQLPMSFFSTRRTGEITSRFSDASSILDAIASTILSLFLDLTIVLMTGLILGLQNMQLFLLVLLAIPLYIVVIIIFTPLFERQNHEVMQTNAILNSSIIEDINGIETIKALASEQERYQKIDYEFASYLKEAFTLQQSEAIQTAIKTTVQLVLNVLILWFGATLVMHQKITLGQLITFNALLSYFTNPITNIINLQTKLQKARVANERLNEVYLVPSEFEEKKTELSLSHFNLNMSEISYQYGFGRKVLSEIKLSIKENEKLTIVGISGSGKSTLVKLLVNFFQPTSGTITLGGIDLQQFDKHQLRRLINYLPQQPYIFTGSIMDNLLLGASEATSQEEIIRAVELAEIRADIEQMQLGYQTELSSDASSLSGGQKQRIALARALLSPAKILILDEATSNLDMITEKKILKNLLALDKTIIFIAHRLSVAEMSHRIIVIEQGKVIESGSHSELLAQNGFYAQLYHN

SEQ ID NO: 18298 - protein, 469 aa, Lactococcus lactis
MGFMRKADFELYRDADKHYNQVLTTRDFLALGVGTIISTSIFTLPGQVAAQFAGPGVVFSYLLAALVAGFVALAYAEMSTVMPFAGSAYSWISVLFGEGFGWIAGWALLAEYFIAVAFVGSGFSANLQQLLAPLGFHLPKVLANPFGTDGGVVDIISLLVILLSAIIVFRGASDAGRISQILVVLKVAAVIAFIIVGITVIKPANYHPFIPPHNPKTGFGGFSGIWSGVSMIFLAYIGFDSIAANSAEAKKPQKTMPRGIIGSLLIAVVLFAAVTLVLVGMHPYSAYAGNAAPVGWALQQSGYSVLSEVVTAIALAGMFIALLGMVLAGSRLLYAFGRDGLLPKGLGKMNARNLPANGVWTLAIVAIVIGAFFPFAFLAQLISAGTLIAFMFVTLGIYSLRRRQGKDLPEATYKMPFYPVLPALGFIGSLFVFWGLDVQAKLYSGIWFLIGILIYFAYGNRRSRKSEEK

SEQ ID NO: 18299 - protein, 345 aa, Lactococcus lactis
MSFKEISPKINIDAIKMLGHLNSEQQEKKLQRDKELEAIIKGEDDRLLLIIGPCSSDNEEAVLEYARRLAKLQEAVKDKIFMVMRVYTAKPRTNGDGYKGLIHEPDADGHTDLINGIKMVRDLHYKVITETGLTTADEMLYPENLPMVDDLVSYHAIGARSVENQQHRFVASGIDVPTGLKNPTSGNLKVMFNGIYAAQQSQDFLFGRAEVQTSGNPLAHAILRGGQDENGKYHPNYYTDNLLDTIEIYEKMGLKNPFIVIDTNHDNSGKKFMEQIRIVRQTLVNRDWDDKIRQNVRGFMIESYLEDGRQDKPEVFGKSITDPCLGWDKTEALVQEIYEAENKNN

SEQ ID NO: 18300 - protein, 575 aa, Lactococcus lactis
MTTMLKGIAASSGVAVAKAYLLVQPDLSFETKTIADTANEEARLDAALATSQSELQLIKDKAVTTLGEEAASVFDAHMMVLADPDMTAQIKAVINDKKVNAESALKEVTDMFIGIFEGMTDNAYMQERAADIKDVTKRVLAHLLGVKLPSPALIDEEVIIVAEDLTPSDTAQLDKKFVKAFVTNIGGRTSHSAIMARTLEIPAVLGTNNITELVSEGQLLAVSGLTGEVILDPSTEQQSEFHKAGEAYAAQKAEWAALKDAETVTADGRHYELAANIGTPKDVEGVNDNGAEAIGLYRTEFLYMDAQDFPTEDDQYEAYKAVLEGMNGKPVVVRTMDIGGDKTLPYFDLPKEMNPFLGWRALRISLSTAGDGMFRTQLRALLRASVHGQLRIMFPMVALVTEFRAAKKIYDEEKAKLIAEGVPVADGIEVGIMIEIPAAAMLADQFAKEVDFFSIGTNDLIQYTMAADRMNEQVSYLYQPYNPSILRLINNVIKAAHAEGKWAGMCGEMAGDQTAVPLLMGMGLDEFSMSATSVLQTRSLMKRLDSKKMEELSSKALSECATMEEVIALVEEYTK

SEQ ID NO: 18301 - protein, 398 aa, Lactococcus lactis
MMGNKKIVLAYSGGLDTSVAVKWLTDKGFDVIADCMDVGEGKDLNFIHDKALQVGAVESVVLDCKEEFAKIFVGAALKGNLMYENKYPLVSALSRPLIAQKLVEVAKEKGATAIAHGCTGKGNDQVRFEVAIHSLAPELEVIAPVREWHWAREEEIEYANQNGVPIPADLDNPYSIDMNLWGRAIEAGVLENPWNTCPEDAFFMTNSVENAPNEAEFIEVEFKEGLPIALNGKSLELHEIIKKVNIIAGKHGIGRIDHIENRLVGIKSREFYECPAAITLLKAHKDLEDLTFVRELAHFKPVLENELANLIYNGLWFNPATKALIAYLDETQKVVNGIVKIKLYKGLATPVGRKSTNSLYSEKLATYTAADEFDQAAAVGFIKLWGLPTQVNAQVNLK

SEQ ID NO: 18302 - protein, 459 aa, Lactococcus lactis
MVEKLWGGRFEASLDKQTEEFGASIKFEQRLAPFDLKGSLAHVKMLGETGIITTEESKKIAEGLKKVEEKLLNGQIEFKMENEDIHMNMESYLHQEIGPLAGKLHTARSRNDQVVTDMHLYLKSILEAVLEALKVLRETIVKLAVNQIDTIMPGYTHLQHAQPISFGQHLMAYYQMLTRDFERFEFNVKHTDMNPLGAAALAGTTFPIDRMLTTKLLGFEKAYDNSMDAVSDRDFILEFLSNASLLMMHLSRFCEELLLWSSHEFKFVSLSDTYSTGSSIMPQKKNPDMAELIRGKTGRVYGNLTALLTVMKGLPLAYNKDFQEDKEGMFDSADTIITSLTVMNGMLSTLTVNRVNMEKSTEQDFSNATELADYLATKGLPFRKAHELVGLLVLDCIKKGIYLQDVNLQDYQMLSPLINEDVYEVLKSRTAVSRRNSLGGTGFESVKKQIEEAKKELQI

SEQ ID NO: 18303 - protein, 261 aa, Lactococcus lactis
MKTLITGENKGIGFALAQNLGHRGYEVLVGARNETRGQEAVEKLKAEGITAKFVKVDLDDLNQLTSLSALTDIDLLINNAGISGNIHSDKGHLDMEKSAFDYSTTDLEETIKTNFLGTHAVIKELLPHSLTENAKIINITVPVSQEYWMPLAYVTSKAAQNAMTFAFGHQFKKDKSKKQIFAVMPGAVATDLNGAKVGDSPFVKSPEETAQMISKFIFDDKNHNAQIINFDGTIYDNYEPGLRNKVIKDVAKNGLKRKFKK

SEQ ID NO: 18304 - protein, 404 aa, Lactococcus lactis
MRKFEKSHKLDNVSYDIRGPVLDEAQRMRANGEKILRLNTGNPAEFGFLAPDEVISDLIQHAVDSEGYSDSKGIFSARKAIMQYCQLKGFPNLDINDIFTGNGVSELIVMAMQGLLDTGDEVLIPMPDYPLWTASVSLAGGTAVHYLCDEQAGWFPDIDDIRSKITSNTKAIVLINPNNPTGALYSKDLLLEIVQVARENNLIIFSDEIYDRLVMDGAVHVPIASLAPDLFVVTMNGLSKSHRIAGFRVGWMVLSGEKSHVKGYIEGLNMLASMRLCSNVLAQSVVQTSLGGTQSVDKLLLPGGRVYEQREFIYKAINDIPGLSAVKPQAAFYIFPKIDREMYKIDNDEQFVLDFLKQEKILLVHGRGFNWKEPDHFRIVYLPRVDELAEIQEKMERFLWQYRK

SEQ ID NO: 18305 - protein, 478 aa, Lactococcus lactis
MEHKKLKAFPNDFLWGSASAAYQVEGAPFEDGKKASVWDNFVRIPGKTFKGTNGDVAVDHYHRYKEDVALMKELGLKSYRFSIAWTRILPDGRGEVNQAGLKFYEDLIDELIANEIEPIVTIYHWDLPQALEDLYGGWESREIIADFVNYAEVLFNAFKGKVKYWVSLNEQNIFTSQGWSLATHPPGKRDMKLFYQVNHIANLTNAAVINKFHELEMDGQIGPSFAYTPQYAKDSDPLNVLAAENAEELYSHFWMDVYLYGEYPIAAMAYLRENGLAPEFEAGDAELLKSAKPDFLGINYYQTATNAWNPVDGGVGVGSFNTSGKKGTTKESGIPGLHKKIQNPFIDRTNWDWEIDPEGLRIALRRITSRYRIPVMITENGLGEYDKVEDGKIHDDYRIKYLESHVKAIKEAMTDGAKVIGYHTWSYTDLLSWLNGYQKRYGFVYVDQDETMEGSLKRIPKDSYYWYQHLIETNAEEV

SEQ ID NO: 18306 - protein, 326 aa, Lactococcus lactis
MLTFWQDYPEIQNKLKDVQALMIERLKINNQEIEAALEKFASRGGKMVRPALFLLFAGIVPNGSKDEEKIIKIAASLEMLHSATLIHDDIIDDSPLRRGLPSIESQFGKDVAVYAGDFVYTVYFELLIETMNGTSFVAKNAQSMKKILQGELTQMQSAFDKNNTARRYMKAISGKTAELLSLSCLEGVYFAGGDKKLQHSARKIGRAIGLAFQVYDDILNFTVGLDEADKPILTDFRQGIYTLPLLLAREVNDEAIAPYLEAPENLSRQECLDLAELVTESGGIAGALLVAGRLTELALNEIRKLPESTNRQILEEATQILLERNY

SEQ ID NO: 18307 - protein, 289 aa, Lactococcus lactis
MKGIILAGGSGTRLYPLTRAASKQLMPIYDKPMIYYPLSTLMLAGIKDILIISTPTDTPRFKELLQDGSEFGINLQYAVQPSPDGLAQAFIIGEEFIGDDSVALILGDNIYHGPGMSKMLQNAAAKEKGATVFGYHVPDPERFGVVEFDENMNAVSIEEKPEEPKSNYAVTGLYFYDNDVIEIAKNIEPSPRGELEITDVNKAYLERGDLSVELMGRGFAWLDTGTHESLLEAAQYIETVQRMQNMQVANLEEIAYRMGYITADDVLKLAQPLKKNEYGQYLLRLIGKD

SEQ ID NO: 18308 - protein, 349 aa, Lactococcus lactis
MTEFKNIVVTGGAGFIGSNFVHYVYNNHPDVHITVLDKLTYAGNVNNINMLFDSGRVELVVGDIADPEIVDQVASKADAIVHYAAESHNDNSLKSQDEFIQTNFIGTYTLIQAARKYDLRFHHVSTDEVYGDLPYREDLPGHGEGEGEKFTDKTPYNPSSPYSSTKAASDLIVRAWVRSFGLKATISNCSNNYGPFQHIEKFIPRQITNILSGIKPKLYGDGKNVRDWIHTEDHSSGVWTILTKGRMGETYLIGADGEKNNKEVLEDILTRMGKDKDDYDRVTDRAGHDLRYAIDNSKLRTELGWAPKHTDFESGLQATIDWYRENENWWKAEKEAVEAKYAETQKVLD

SEQ ID NO: 18309 - protein, 398 aa, Lactococcus lactis
MNDNIAVKIDHVSKFFHLPTEATNSLRTTLVNRLRGIKGYKEQHVLKDIDFTVEKGDFFGIVGRNGSGKSTLLKIISQIYTPEKGNVIVNGKLVSFIELGVGFNPELTGKENVYLNGAMLGFSREEISDMYDEIVDFAELEEFMNQKLKNYSSGMQVRLAFSVAIKARGDVLVLDEVLAVGDESFQRKCNDYFLERKKSGKTTILVTHDMGAAKKYCNKAILIENGLIKVSGDVNDVANQYSLDNLQTEVTARSDLEIDVKEEWIENLEVNFINQQKITPNDEVKFEVSYDVKKDTETYIAFSLTDVDRNIWIYNDNSLDYLTKGKGHNRAIYTCKLDQVNNLKLKLQVSIRNKRDEMIAFADEKVILINRNDISDDDKSAQDSATGLIQRNGSWEFE

SEQ ID NO: 18310 - protein, 379 aa, Lactococcus lactis
MKEKTVAIFNGYYIPHLGGVERYTYNIAKKLTEKGYRVIIITTQHDENLTNEEIQEGIKIYRLPIKNLWKNRYPFLKKNRIYHSLIEKIEAESIDYYVANTRFHLPAMLGVKMAKAKGKEAIVIEHGSSYLTLNNPVLDFMLRKIEQLLIGRVKKDTSLFYGVSNEASEWLKTFDIKAKGVLPNAVAVDEYFNQKIEKDEKKLTISYAGRLIPQMKGVEILLSTFSKLSKERKNLELIIAGDGPLLNEVKRKYSQKNIKFLGYVPYEKVLEIDAKSDVFVLMSRSEGFATAMLEAAMLENVIITTPTVGGARDIMPDETYGYIIENNETKLFETLTKVLDNKEHMRLMQKKISKNVLENFTWEQSAKQFIKVFNELDEK

SEQ ID NO: 18311 - protein, 493 aa, Lactococcus lactis
MSNWETKFLKKGFTFDDVLLIPAESHVLPNEVSMKTKLAKNLTLNIPIISAAMDTVTDSKMAISMARQGGLGVVHKNMSVEEQAEEIHKVKRSESGVITDPFFLTPNHKIEEAENLMATYRISGVPIVDTLENRKLVGIITNRDLRFITDYNQQIKNMMTSENLITAPVGTTLDTAARILQEHKIEKLPLVDEAGKLAGLITIKDIERVIEFPNAAKDEQGRLLVAGAVGVSSDTFERAEALFAAGADAIVIDTAHGHSAGVLRKIREIRNHFPDRTLIAGNIATGEGARALFEAGVDVVKVGIGPGSICTTRVVAGVGVPQITAIYDAANVAREFGKTIIADGGIKYSGDIVKALAAGGDAVMLGSMLAGTDESPGEFEIFQGRKFKTYRGMGSLAAMKKGSKDRYFQGAVNEANKLVPEGIEGRVAYKGTATDIVFQMLGGLKAGMGYTGAADITALHDSAQFIEMSGAGLKESHPHDVQITKEAPNYSVQ

SEQ ID NO: 18312 - protein, 219 aa, Lactococcus lactis
MKKTDWSQPLRNRLAEDYFPKMIEFINQTYQEGKVYPPENQIFRAIELTPLAQTKVIIVGQDPYPQPGKAQGLAFSYPATFKVNRPDSIVNIQKELREEGFSKDDSDLTAWAEQGVLLLNAVLTVPEFASNAHAGKIWEPLTDEIIKIASDDERPKVFILWGGFARKKAKLIDGSKHLILEAAHPSPLSASRGFFGSHPFSKTNEFLVESGQSPIDWSK

SEQ ID NO: 18313 - protein, 398 aa, Lactococcus lactis
MAKLTVKDVELKGKKVLVRVDFNVPIKDGVITNDNRITAALPTIKYILEQGGRAVLFSHLGRVKEEADKAGKSLAPVAKALSEKLGQDVVFPGTTRGAELEAAINELKDGEILLVENTRFEDIDGKKESKNDPELGKYWASLGDGIFVNDAFGTAHRAHASNVGISANVDKAVAGFLLENEIAYIQEAVEAPERPFVAILGGSKVSDKIGVIENLLSKADKVIIGGGMAYTFLKAQGYEIGTSLVEDDKLDLAKELLEKAAGKLILPLDHKVANAFAGYTEVKETADQNIPAGFMGLDVASKTIADYNTQLEGAKTVVWNGPVGVFENTDFQAGTVGLMEAIVKQPGVKSIIGGGDSAAAAINLGYADKFSWISTGGGASMELLEGKVLPGLAALTEK

SEQ ID NO: 18314 - protein, 315 aa, Lactococcus lactis
MLKGIDLTYPQLTYLPETGILYDNTYNEKTVPIISGGGSGHEPAHVGYVGSGMLAAAVTGPLFIPPKSKNILKAIRQVNSGKGVFVIIKNFEADLKEFNEAIKEARTEGIDVRYIVSHDDISVNAYNFHKRHRGVAGTILLHKILGAFAKEGGSIDEIEQLALSLSPEIYTLGVALAPVHFPHQKTSFVLAEDEVSFGIGIHGEPGYRVEKFEGSERIAIELVNKLKAEINWQKKANKNYILLVNGLGSTTLMELYSFQYDVMRLLELEGLSVKFCKVGNLMTSCDMSGISLTLCSVKDPKWLDYLNVPTGAFAW

SEQ ID NO: 18315 - protein, 248 aa, Lactococcus lactis
MKSPIAINDISVKFGDKAILDHLSYEFESGKIICLIGPSGAGKSTFIKAIVGMQKLDSGNVKILERKIPDREVLGKLGYMAQEDALFKELTGKQNLEFFGSLQGIKKKDLQGKLDKAAATVNLTKQLNQSISNYSGGMQRRLSLAIALQTDAPILLLDEPTVGIDPELRQEIWEELRNQANQGKTILITTHVMDEAERCDVVLMLRNGKFIAEGSPKEIKEKYQVASVEEAFIVAGKNLELQNKGAAK

SEQ ID NO: 18316 - protein, 611 aa, Lactococcus lactis
MLTIGRRYLNFWPVFWALFLLVIQVVTNLWLPTITADIINKGIGQSDMKYIWFMGLIMLFVSLASWLSAIGNVYFASKQSQGLGLKLRHDLFKKVLFMDERNFQEFGDATLITRTTNDVTQLQNVFQTMLRMMLMAPMMLIGSIFMAWKLSHDLLLVFLIALPILTLAVVINIAISMPRFRSMQTKVDKINLIFQQGLTGVRVIRAFRRDQYEIDKFDEANRDLTHTSQVVLTTIAMLMPIMTVILSFTNIGIVWFGAHLISKNMMEMGSLVAFLTYATQILMSFMQLSAVAVMVPRAQVSAVRVREILESKDKITDENSSISVEALKRQRLSSDGNDKLSESNSVRNSLALNHVSFKFDEAKRQALSDLSVNVAAGQTLAIIGGTGSGKSTILNLIARLIDPTNGSVTIDGTDIRQISQYDLHEKVSFTQQKAQLFSGTVRSNLQFGKSDATDEEMWQALEIAQAADFVREQGGLELAVEQNGANFSGGQKQRISIARTLIKEAEIYLFDDSFSALDFATDRQLRTAINHSEKHKNKIKVIVAQRIATVMSADQILVLENGIAVGLGTHESLAKSCPQYQETMQSQLSDDDLVKMGVSIAHLTARGGDDQ

SEQ ID NO: 18317 - protein, 281 aa, Lactococcus lactis
MTLTDTYTLNNGIKIPKVGFGTWQSASGEEAYNAVKAALEAGYRHIDTAAVYKNEESVGQAIADSGIPREELFVTTKLWGVGTTEDAAKALDESLKKLGLDYVDLYLIHWPNPKAFRPDFETRNLAVWKAMEAGVKAGKIRAIGVSNFHPRHLKPLLKFAEIKPAVNQIMVNPSDQQEEIVSFNVDNNILTEAYSPLGTGKIFEVPELADLASKYNKSIAQVVLRWSLHKGYLPLPKSVTPARIKENAEIFDFDLSIEDIAFIDSLHGKAGLAKNPDEVDF

SEQ ID NO: 18318 - protein, 422 aa, Lactococcus lactis [sequence omitted]

SEQ ID NO: 18319 - protein, 846 aa, Lactococcus lactis
MAVKRLIETFVPENYKIFLDIDRKTKKIKGQVAITGEAKDSVIAFHAKGLHFSKVRAFSVDTNFIENEEDEEIVVKIGETGRVTVSFEYEAELTDNMMGIYPSYYEVNGEKKMLIGTQFESHFARQAFPSIDEPEAKATFDLSVKFDEEEGDIIVSNMPELLNINGIHVFERTVKMSSYLLAFVFGELQFKKGKTKSGVEVGAFATKDHSEAALDFPLDIAIRSIEFYEDYYKTPYPLPHSWHIALPDFSAGAMENWGCITYREVCMLVDPENATIQSKQYVATVIAHELAHQWFGDLVTMQWWDDLWLNESFANNMEYVCMDALEPSWNVWESFSISEANMALNRDATDGVQSVHVEVTHPDEIGTLFDPAIVYAKGSRLMVMLRKWLGDEDFAAGLALYFKRHQYGNTVGDNLWDALAEVSGKDVAAFMHSWVNQPGYPVVTAEVIDDTLVLSQKQFFVGEGADKGRLWNVPLNTNWSGLPDLLSSEKVEIPGFAALKAKNDGKALFLNDANMAHYIIDYKGQLLTDLLSEVETLENVTKFQILQDRKLLAKAGVISYADVVNILPAFTNEESYLVNTGLSQLISELELFVDEDSETEKAFQSLVGKLFAKNYARLGWDKVAGESAGDESLRGIVLSKTLYAENADAKAKASQIFAAHKENLAGIPADIRPIVLNNEIKTTNSAELVKTYRETYVKTSLQEFKRELEGAVALIKDEKVIAELLESFKNADIVKPQDIAFSWFYLLRNDFSQDAAWAWEKANWAFLEEKLGGDMSYDKFVIYPGNTFKTADKLAEYKAFFEPKLENQGLKRSIEMAIKQITARVALIDSQKADVDKSIKEISEKL

SEQ ID NO: 18320 - protein, 573 aa, Lactococcus lactis
MKHKWVALFSIVSTFIYAGVQLYQPQIMKRIMTVMSSTTYSRHQMADKVSGYGVELLVVAGIGIIFAIFSTLSAARIAQEIGADVREATYKKINTFSYENIEKFNAGNLVVRMTNDVTQVQNLMMMVFQILMRIPVLLIGAVVLSITTLPRLWWITVLLIVLIVLVTAVLMGRMGPHFMAFQKLMDRINAIAKQNLRGSRVVKSFVQEKNQIKDFDETSDELYDHNWAVGKLFSAMIPLFTVIAQGVIWLAIYFVSTFVTESTTVAQDSIGGIATFMTYMGMIMFAIIMGGMISMFASRGMVSIGRINEVLNTDPAMKFDENAKDEVLSGSVKFDHVSFSYPNDEEPTLKDISFEVEPGQMVGIVGATGAGKSTLAQLIPRLFDPTEGTVSVGGKDLKTVSRGTLKKNISIVLQKAILFSGTIAGNIKQGKADATDEEMTRAARIAQAAEFITTKDGQYDSEVEERGNNFSGGQKQRLSITRGVVKNPNVLILDDSTSALDAKSEKLVQEALNKDLKDTTTIIIAQKISSVVHADNILVLDQGKLVGQGTHQELVAENKIYQEIYDTQKAQED

SEQ ID NO: 18321 - protein, 664 aa, Lactococcus lactis
MENTKSTRKMSDTTRAIRFFYLYLKRYKLQFAVIMIFIILATWLQVVSPSLLGDAITNLTKYVTDFFTHQHAGQSQDALQQIAQQLSQQMHQTVDWHNVPEVVKSLPQAAQDQITANLPKGTTLETLKTVATSHAASTSTFMKGMWQLLAVYVATGVSMLIYTLLFSRIVAHSTNRMRKGLFGKLERLTISYFDRHQDGDILARFTSDLDNIQNTLNQALVSVISNAAVFVGVIIQIFNKDVTFAWLTVAASPVAILSAVIIIRQSKKATDKQQEEVSQLNAYMDEKISGQKAIIVEGLQEDSINGFLEHNENVKKRTFAAQAWSGMIFPLMNGFQLLSIAIVIFGGTAYVLNDDSMSIATGLGLLVAFVQYVQSYYNPIMQISSNFGQLQLAITGATRLNVMFDEPEEVRPENGKKFDTIKDGIQIENLDFEYLPGKPVLKKVNIDVKKGQMVALVGPTGSGKTTVMNLMNRFYDVNGGAIKFDGTDIREFDLDSLRSNVGIVLQESVLFDGTIADNIKFGKPNATQEEIETVAKTTHIHDFIDSLPDKYETHVSDDESVFSVGQKQQISIARTILTNPELLILDEATSNVDTVTEQQIQWAMEAAIAGRTSFVIAHRLKTILNADKIVVLKDGEVIEEGNHHELVAQGGFYSELYHNQFVFE

SEQ ID NO: 18322 - protein, 421 aa, Lactococcus lactis
MKKIVINGGKRISGTIPISGAKNSVVALIPATILANDVVTLEGVPDISDVASLVEIMEIMGAKIERNLEEGRLVIDTRSVVSRPLPYGKINSLRASYYFNGALLGRFGQATVGLPGGCDLGPRPTDLHDKAFKALGAKKIQEEEAEHLEVIGDSLVGTTIYMDVVSVGATINTMLAASRAKGLTIIENAAREPEIIDVATLINNMGAQVRGAGTDIIRITGVDEMHGAQHTVIPDRIEAGTYLALAAAMGDGVIIENVIYEHLESFIAKLEEMGVGLTIREDSIEVHKSENLKSVNITSVPYPGFATDLQQPITPLLLKAKGRGSIVDTIYQKRVNHVPELARMGANISVLDDRIIYDAPNELTGSCVQATDLRAGAALVTAGIIASGTTKISNIEFILRGYDHIIEKLTAVGVDIQLIEE

SEQ ID NO: 18323 - protein, 272 aa, Lactococcus lactis
MKLNNQIEIPELGLGVFQIPNDETADVVKNAIVNGYRLIDTAKIYENEEGTGQGIKEGLAMTGLSRDDLFITSKLWGDNHSYEETVQNFEKSLKKLDLDYLDLYLIHWPGTHYAYKEAWNAMEDLYKAGKIKAIGVSNFQKSHLEELLSYAKITPVLNQIELHPKLSQEELRNFLELHDIKVQAWSPLMQGQLLDNEVLKKIADKHGKSVAQIILRWDIQQDILVNVKSIKSERMIANRQIFDFSLDSEDMKAINSLNEELRVGPDPEHFNF

SEQ ID NO: 18324 - protein, 233 aa, Lactococcus lactis
MPKLVFARHGESEWNLANLFTGWADVDLSENGTKQAIEAGKLIKEAGIEFDIAYTSVLKRAIKTTNLALEYSDQLWVPVVKSWRLNERHYGGLTGLNKADAAAKHGDEQVHIWRRSYDVLPPAMDHDDKYTAHGDRRYAGLEDSLIPDAENLKVTLERALPFWEDQIAPALKEGKNVFVGAHGNSIRALVKQIKKLSDDEIMDVEIPNFPPLVFEFDDNLNVQNEYYLAPKKA

SEQ ID NO: 18325 - protein, 187 aa, Lactococcus lactis
MSLVGKKIEEFSTDAYLGGKFIKVSDKDFYGKWSVLCFYPADFSFVCPTELEDLEETYPTLKSLGVEVYSASTDTHFVHAAWHEHSDAISKITYPMLADPSQKISRAFDVLDEEAGLAQRGTFIIDPDGVIQALEITADGIGRDASQLVDKIKAAQYVRNHPGEVCPAKWKEDGASLHVGIDLVGKI

SEQ ID NO: 18326 - protein, 547 aa, Lactococcus lactis
MKFSELGLSEGIVNTLTEIGYEQPTPIQEQTIKLALEGRDVLGQAQTGTGKTAAFGLPTIEKIDASNPAIQALVIAPTRELAVQGQEELFRFGKSKGLKVRTVFGGSSIEKQIKGLKAGAHIVVGTPGRLVDLIKRKAIKLDQLETLILDEADEMLNMGFLEDIHFIIEKTPEARQTLLFSATMPNDIKKIGVKFMKNPEHIKIAAKEMTADRIDQYFVKTKEFEKFDVLTRLLDVERPELAIVFGRTKRRVDELIRGLKLRGYRAEGMHGDLDQNKRLAVLRDFKAGHIDVLVATDVAARGLDVSGVTHVYNYDITQDQESYVHRIGRTGRAGKSGRSVTFVSYNEMGYLRAIENMTKKPMKGLKPPTKEEAYQASLSVAMDDVLRDLSDDSAKAKLAKFDKQAASLLEKFDAKELVALLLQGRVKDPDNQEEVKITAERPLPYNGEGKGFKKKGKGGGGRYKGRGNGDRDGNRGGYRGNRDGKDGDRGGDRKRNWKDRDDNRGGYRGKRDDRRFDDRKQGEKTPRKRTTGTEKSAGFVMRSRGDK

SEQ ID NO: 18327 - protein, 457 aa, Lactococcus lactis
MNTNQNEENKPSQRGLKNRHIQLIAIAGTIGTGLFLGAGKSIHLTGPSIIFVYLIIGALMYILLRAIGEMLYQDPNQHSFLNFVSRYLGEKPGYFIQWSYLLVVVFVAMAELIAIGTYINFWLPDLPIWMTEVFVLVLLTLLNTLNPKFFGETEFWFGMIKIVAIIGLILTAIILIFSHYHTGTDTVSVTNITKGFEFFPNGLSNFFESFQMVMFAFVSMEFIGMTAAETDNPRPTLKKAINQIPIRIVLFYVGALLAIMSIYQWRDIPADKSPFVTIFQLIGIKWAAALVNFVVLTSAASALNSALFSITRNLYSLSKLNNDKILKPFTKFSKAGVPVNALLFTSLLILFTPFISMIPAISNSFVFITSVATNLFLVVYLMTLITYLKYRKSSDFDPKGFVLPAAHIFIPLAIAGFVLIFISLFCFKDTIVPAIGSVIWVLIFGLFTFFKKIKTAE

SEQ ID NO: 18328 - protein, 459 aa, Lactococcus lactis
MENLQEKHEAQRGLQNRHIQLIAIAGTIGTGLFLGAGKTIQMTGPSVIFAYILIGIAMFFFLRTIGEMLYNDPSQHSFLNFVTKYSGVRTGYFTQWSYWLVIVFVCISELTAIGTYIQFWLPQVPLWLIEIVMLALLFGLNTLNSRFFGETEFWFAMIKVAAIIGMIVTAIILVAGNFHYSTVLSGKTVHDSASLSNIFDGFQLFPHGAWNFVGALQMVMFAFTSMEFIGMTAAETVNPKKSLPKAINQIPVRILLFYVGALLAIMAIFNWHYIPADKSPFVMVFQLIGIKWAAALINFVVLTSAASALNSSLFSATRNMYSLAQQHDKGRLTPFTKLSKAGIPINALYMATALSLLAPVLTLIPQIKNAFDFAASCTTNLFLVVYFITLYTYWQYRKSEDYNPKGFLTPKPQITVPFIVAIFAIVFASLFFNADTFYPALGAIVWTIFFGLYSHYKKI

SEQ ID NO: 18329 - protein, 477 aa, Lactococcus lactis
MENQNQVKRNLKQRHITMIALGGTIGTGLFLTSGATISQAGPWGAVLAYCFIGIMVYFVMTSLGEMATYLPTSGSFSDYGGRYVDPAFGFALGWNYWLNGAITIAVDLTTAGLITQFWFPHLPSWIFSGIATVLIFIINVMAVGAFGETEYWLSTIKVITIVLFLAIGLLTIFGVLGQGNVDVVANLSAGNHGFVGGISGFVGVLLIAGFSFQGTELLGITAGESEDPGKSIPKAMNSIFWRILLFYIFSIIVIAAIINFKDPRLLNPNSTAVMSPFTIVFKNIGFAVAASVMNAVILTSVISSANSVMYASTRILYSLGQEKGAPKFFGRTAKNGIPFYALLATTIICFIAFLTGIFGTQIYLFLVDLSSLTGFLAWLGISISHIRFRRAYIAQGKKLEDLPYKAKWFPFGPIVALLMTAAIAINLDPAMLFSEHWGEGLALYAAIPIFIILYFGYKWKYNTKIIPLEEVDLSREK

SEQ ID NO: 18330 - protein, 314 aa, Lactococcus lactis
MKITSRKVVVIGTGFVGTSIAYSMINQGLVNELVLIDVNQDKAEGEALDLLDGVSWGQENVIVRAGDYKDCKNADIVVVTAGVNQKPGQSRLDLVNTNAKIMRSIVTQVMDSGFDGIFVIASNPVDILTYVAWETSGLDQSRIVGTGTTLDTTRFRKELATKLEIDPRSVHGYIIGEHGDSEVAVWSHTTVGGKPILEFIVKNKKIGVEDLSNLSNKVKNAAYEIIDKKQATYYGIGMSTARIVKAILNNEQAILPVSAYLRGEYGQEGVFTGVPSIVNQNGVREIIELNIDAYEKKQFEKSVSQLKEVIESIK

SEQ ID NO: 18331 - protein, 211 aa, Lactococcus lactis [sequence omitted]

SEQ ID NO: 18332 - protein, 310 aa, Lactococcus lactis
MTINKMGTGIAHSKLILIGEHSVVYGQPAIALPVTILKTTVTITSSKYGQYIENNEFRRRLDLMGDEFEGIRQLIMRLLSKFHSSKMPFSLEIDSNIPQGRGLGASASLATAIIRAFYDFFDAELPQKDLLFYANFSENITHGKSSGIDVATVNSEHPLWFIKDSTIEPFELNLHGFIVIGDTGVHGFTSQAINIVREKLVEEKEKTQDSINHLGQLATDSKDFLMTDKLKEFGHVMNKAHERLSDLGVSHPRLDNLVETARKNGALGAKLTGSGLGGVMVALAENEKDAIRISQRLLKNGAKNTWIYSF

SEQ ID NO: 18333 - protein, 318 aa, Lactococcus lactis
MKNIVTARAHTNIALIKYWGKADIALNIPTTSSLSMTLEPFYTTTSVEFTDNESDSLILNSEVADSSRVSQFLEMMRGQYGNFPKVMIQSENHVPTAAGLASSASSFAALTAAMFGLLDLEKDDSEMSRIARRGSGSASRSIFGNFSVWNKGEDHQSSFAESFYNEDIGLSMIVAEISAEKKKMSSTKGMQLAQTAPTYSAWVEKSAIQLEEMKQAILNADIEKVGLVAQDNALGMHEQNRLSNQPFDYFTHETRHVIDFVNQAYQSGLLAFVTIDAGPNVKIITDHATEKVLLAKLQAEFPELTFDIARAGGAYEYL

SEQ ID NO: 18334 - protein, 329 aa, Lactococcus lactis
MNISEKKMSIKVPGKLFFAGEYSVTKEGNLALITTIETNFEVRISATTGKSIFKTNVGLSDFEFSLSKIEFTKENPWNFALTALKNTLSAADSFEKKSVSKILSSSPEISLEIVSDLGFGENKKGYGSSASVVCGLVNAVNQFFDFQLSLEKRFEIAAKTHFEVQGSGSMGDIAAIMYGGSVFYQNHKRVIPLEIPWATYVVQTGKAAKTSEKIKIKLSDEFYQASNELVIELATAIDIQDFALFKEKLSENQLLLLENIPEGYMTKELAIALNLLNSYPEFAAKISGAGFGENIILFAQNTQAIAEVQNKLSEYGINLEKFKVAQKNN

SEQ ID NO: 18335 - protein, 446 aa, Lactococcus lactis
MKFTDFNFKDYINQTLENIKFEKPTEVQEKLIPIVLSGRDLVGESKTGSGKTHTFLLPIFQKIDTDLDEVQAVITAPSRELATQIYKAAQEFTKVNDKLRVSNFVGGTDKARQIKKLESSQPHVVIGTPGRIHDLIKSNALIVHTANTFVVDEADMTLDMGFLADVDQIASSFGKRVQMLVFSATIPQKLQPFLKKYLHNPVMQKIANKTVISDTIENWLVSTKGSSHNQLLLQLTKATNPYMAMIFANTKGRVDDIHHFLTSNGLKVAKIHGDVPPRERKRIMNSIKNLDYQYVVATDIAARGIDIEGVSHIINDEIPKDLTFFVHRVGRSGRNGLQGTAITLYSPSDDSSIREIEKMGVTFQPKAIKDGEIVDSYDRDRREKRTKKQDEISTKTIGALKKGKKHVKPGYKRAIKWQIEEDNKKKRRAERNKNARKTRDSRKQSF

SEQ ID NO: 18336 - protein, 478 aa, Lactococcus lactis
MTLKKDFLWGGAVAAHQLEGGWNAGGKGVSVADVMTAGSNGVERKITDGVIEGENYPNHEAIDFYHRYKEDIALFDELGLNCFRTSIAWTRIFPNGDEAEPNEEGLQFYDDLFDECLKHGIEPVITLSHFELPYHLVTEYGGFRNRKLIDFFVHFSEVVMNRYKDKVKYWMTFNEINNQANYLRDFAPFTNSGLKFPEGASEKEREEMMYQAAHYELVASAKVVALGHKINPDFQIGCMIAMCPIYPATCKPEDMMASTVAMQRRYWFADVHVRGHYPSYLKAYFDRKEFKLDILDDDLKALEEGKVDYIGFSYYMSFAIKDHGKAPTFDYNEDKDLVKNEYVKASEWGWQIDPLGLRYAMNWFYERYEKPLFIVENGFGAVDEVEADGSIHDPYRVDYLKAHIEAMKNAVDYDGVDLMGYTPWGFIDLVSAGTGEMKKRYGVIYVDKDNEGNGTLERSKKDSFTWYQKVIATNGEEL

SEQ ID NO: 18337 - protein, 452 aa, Lactococcus lactis
MGKYFGTDGVRGEANVELTPEMAFKLGRFGGYVLSQHELGTPKVYVGRDTRISGQMLASSLISGLLSVGIEVYDLGVIATPGVAYLVKKDGASAGVMISASHNPALDNGIKFFGGDGYKLEDEKELEIEALIDAEEDTLPRPSAQGLGMLHDYIEGVRKYQAFLKTTAEGNFEGYKVVLDTANGAAYTSARAVFADLEANLTVIGENPDGLNINVKVGSTHPEAMAKKVVETGSDLGLAFDGDADRLIAVDENGEIVDGDKIMFIVGKYLLGQGKLAQDTLVTTVMSNLGFHLALEEAGINSVITAVGDRYVVEEMKKNNYNFGGEQSGHMIFLDYNTTGDGQLSAIQLLKVMRETGKSLSELASEVTIYPQKLVNVRVKDNAAKKSAMDVPAIQKVISEMETSMNGKGRILVRPSGTEPLLRVMAEAPTHEEVNHVVDTIVEVVEAEIGVK

SEQ ID NO: 18338 - protein, 221 aa, Lactococcus lactis
MFKAVLFDLDGVITDTAEYHFRAWKALAEEIGINGVDRQFNEQLKGVSREDSLQKILDLADKKVSAEEFKELAKRKNDNYVKMIQDVSPADVYPGILQLLKDLRSNKIKIALASASKNGPFLLEKMNLTGYFDAIADPAEVAASKPAPDIFIAAAHAVGVAPSESIGLEDSQAGIQAIKDSGALPIGVGRPEDLGDDIVIVPDTSYYTLEFLKEVWLQKQK

SEQ ID NO: 18339 - protein, 169 aa, Lactococcus lactis
MLTKKNYQSPLGEITLLSDETYLLGVWFKEQKYFAANYDLNQAKEDKSLPIINAIDWLDAYFKGENPDLKKIKLKPEVTEFRKKVLKILSDVPYGSLITYKEISNLLQVNEEKKRNMSQAVGGAVGHNPLSIIIPCHRVVGTDGSMTGYAGGLEKKKALLTLEQAHLKK

SEQ ID NO: 18340 - protein, 427 aa, Lactococcus lactis
MMDKIIVKGGQTKLQGEVEIEGAKNAVLPLLAATLLASEGEVVLTNVPILSDVFMMNNLVNHLGTAISFDQEAKKIIAKSNSEIKTTAPYEYVSKMRASIVVMGPILARNGQARVSMPGGCSIGSRPIDLHLRGFEQMGATITQNAGYIEAKADKLKGAHIYLDFPSVGATQNLILAATLADGTTTLENAAREPEIVDLANLLNKMGANVKGAGTDTIIIKGVEKMHGANHSVVQDRIEAGTFMVAAAMTQGDVLIKDAIAEHNRPLISKLSEMGVNFIQEESGLRVVGPEKLKATSVKTLPHPGFPTDMQSQMTAAQAVAVGESVMVETVFENRFQHLKEMRRIGLEVDITRNTALIQGNSNLQGAAVKSTDLRASAALILLGLVAKGQTTVRRLSHLDRGYYKFHEKLKALGADIIRVEDEDGEG

SEQ ID NO: 18341 - protein, 748 aa, Lactococcus lactis
MLCQNCNINEATIHLYTSVNGQKKQIDLCQNCYQIMKSGGQEALFGAGNASNGNSDEPFNPFNDIFSALHGQDFNGAASTQTPPTQTGGRGPRGPQNPRAKQPKGMLEEFGINITESARRGEIDPVIGRDEEIKRVIEILNRRTKNNPVLIGEPGVGKTAVVEGLAQKIVDGDVPQKLQNKEVIRLDVVSLVQGTGIRGQFEERMQKLMDEIRKRNDVIMFIDEIHEIVGAGSAGDGNMDAGNILKPALARGELQLVGATTLNEYRIIEKDAALERRMQPVKVDEPSVDETITILRGIQARYEDYHHVKYTDEAIEAAAHLSNRYIQDRFLPDKAIDLLDESGSKKNLTLKFVDPEDINRRIADAETKKNEATQAEDFEKAAHFRDQITKLRELQNHEVSDDEIPVITEKDIEQIVEQKTHIPVGDLKEKEQTQLINLADDLKAHVIGQDEAVDKIAKAIRRSRVGLGKPNRPIGSFLFVGPTGVGKTELAKQLAKELFGSSESMIRFDMSEYMEKHSVAKLIGAPPGYVGYEEAGQLTERVRRNPYSLILLDEIEKAHPDVMHMFLQILEDGRLTDAQGRTVSFKDSLIIMTSNAGTGKVEASVGFGAAREGRTKSVLGQLGDFFSPEFMNRFDGIIEFSALSKENLLKIVDLMLDEVNEQIGRNDIHLSVTQAAKEKLVDLGYNPAMGARPLRRTIQENIEDSIADFYIEHPEYKELVADLIDDKIVISNQAQETAETTDEEVPAE

SEQ ID NO: 18342 - protein, 337 aa, Lactococcus lactis
MVVKVGINGFGRIGRLALRRIQEVEGVEVAHINDLTDPAMLAHLLKYDTTQGRFKGTVEVKEDGFDVNGKFVKVTAERNPEDIQWADSGVEIVLEATGFFATKEKAEKHLHPGGAKKVLITAPGGNDVKTVVFNTNHTILDGTETVISAGSCTTNSLAPMADALNKNFGVKGGTMTTVHSYTGDQMTLDGPHRGGDFRRARAAAENIVPASSGAAKAIGLVLPELSGLMKGHAQRVSTPTGSITELVTVLEKHVTVDEINEAMKAAADESFGYNVDEIVSSDIIGMAYGSLFDATLTEVTDLKDGGQLVKTAAWYDNEMSFTAQLIRTLEYFAKIAK

SEQ ID NO: 18343 - protein, 151 aa, Lactococcus lactis
MTKKYAMTATEVMEVIPNRYPIMFIDYVDEISENKIVATKNVTINEEVFNGHFPGNPTFPGVLILESLAQAGSILILKKEEFQGKMAYIGGIDKAKFRQKVTPGDVMKLEFEITKFRGKVGTADAAAYVDGKKVTTCQFTFIVDEAAEQTN

SEQ ID NO: 18344 - protein, 250 aa, Lactococcus lactis
MFLEGKKIVIMGVANNKSIAWGCAKAMKDQGATLIYTYQNERMEKQLAKLAEPEDLLIECDVTSDESIRRAFGTIEARVGKIDGLVHAIAYSKKEELGGNVTDISRDGYALAQDISAYSLLAVAKAAKPLLKKGSGIVTLTYMGSVRAIPNYNVMGIAKAALESTVRYLAAEMAHVGVHVNGISAGAIKTLAVSGVSGYKDLIKESDSRTADGVGVTIDDVGQTAAFLVSPLASGVIGDIVYVDKGVHLT

SEQ ID NO: 18345 - protein, 365 aa, Lactococcus lactis
MIYNFGAGPSVLPKEVLKKVQEELLDFEKSGMSVMEISHRSKAFQKVIDEAENDLRDLMSIPQNYKILFLQGGASSQFSMVPMNLAIGKKAYYNISGAFGEKAYDEAVKLSHFLDLMAISLGSTKKDNYNHLLKIDKSKIDEKNGAYLHLTTNNTIEGTSIFPENLPEFASLPLVADMSSNILAVDYDVSKFGLIYAGAQKNLGIAGLTIVIIREDLLNEAESLSSMMDYQILVENGSMYNTPPTFAIYVAGLVFKWVKAQGGVKKLEEMNQRKAQLLYDLIDQSDFYQNPIKNKDERSICNVVFTSPSQELDELFTQKAEEKGFKSLKGHRSVGGMRASIYNAFPLEGVVELVKFMKEFEEGYK

SEQ ID NO: 18346 - protein, 472 aa, Lactococcus lactis
MAQANFGVVGMAVMGKNLALNVESRGYTVAIYNRTTSKTEEVYKEHQDKNLVLTKTLEEFVGSLEKPRRIMLMVQAGAATDATIKSLLPLLDKGDILIDGGNTHFPDTMRRNAELADSGINFIGTGVSGGEKGALLGPSMMPGGQKEAYDLVAPIFEQIAAKAPQDGKPCVAYMGANGAGHYVKMVHNGIEYGDMQLIAESYDLLKRVLGLSNAEIQAIFEEWNEGELDSYLIEITKEVLKRKDDEGEGYIVDKILDKAGNKGTGKWTSESALDLGVPLPLITESVFARYISTYKDERVKASKVLSGPAVNFSGDKKEVIEKIRKALYFSKIMSYAQGFAQLRKASEEFDWDLPYGTIAQIWRAGCIIRAEFLQNITDAFDKDSELENLLLDDYFVDITKRYQEAVRDVVSLAVQAGIPIPTFTSAISYYDSYRSENLPANLIQAQRDYFGAHTYERTDKAGIFHYDWYTED

SEQ ID NO: 18347 - protein, 185 aa, Lactococcus lactis
MLEKRSTDNSVSNKNMELKDYIATIENYPKEGVVFRDISPLMADGNAYNYAATEIVQYARDKEIDMVVGPEARGFIIGCPVAFALGVGFAPVRKPGKLPREVIEATYEKEYGTDTLTMHSDSIKPGQRVLIVDDLLATGGTIAATIELVEKMGGIVVGCAFLIELDELKGREKIGDYDYKVLMHY

SEQ ID NO: 18348 - protein, 816 aa, Lactococcus lactis
MKFENIKYTPTLDRILEKAEEYAHQYQYGTIESAHLLAAMATTSGSIAYSLLAGMNVDSSDLLIDLEDLSSHVKVKRSTLRFSPRAEEVMTAASFLAIHNNSEAVGTEHLLYALLQVEDGFGLQLLKLQKINIVSLRKELEKRTGLKVPESKKAVTPMSKRKMAKGVAENSTTPTLDSVSSDLTEEARLGKLDPMIGREAEIDRLIHILSRRTKNNPVLVGEPGVGKSAIIEGLAQRIVNGQVPIGLMNSRIMALNMATVVAGTKFRGEFEDRLTAIVEEVSSDPDVIIFIDELHTIIGAGGGMDSVNDAANILKPALARGDFQMVGATTYHEYQKYIEKDEALERRLARINVDEPSPDEAIAILQGLREKFEDYHQVKFTDQAIKSAVMLSVRYMTSRKLPDKAIDLLDEAAAAVKISVKNQQTKRLDLEKELTEAQEELSEAVIKLDIKASRTKEKAVEKIADKIYKFSVKEDKRQEVTDQAVVAVASTLTGVPITQMTKSESDRLINLEKELHKRVVGQEEAISAVSRAIRRARSGVADSRRPMGSFMFLGPTGVGKTELAKALADSVFGSEDNMIRVDMSEFMEKHSTSRLIGAPPGYVGYDEGGQLTERVRNKPYSVVLLDEVEKAHPDVFNIMLQILDDGFVTDTKGRKVDFRNTIIIMTSNLGATALRDDKTVGFGAKNITADYSAMKSRILEELKRHYRPEFLNRIDENIVFHSLESQEIEQIVKIMSKSLIKRLAEQDIHVKLTPSAVKLIAEVGFDPEYGARPLRKALQKEVEDLLSEQLLSGEIKAGNHVSIGASNKKIKIAQIV

SEQ ID NO: 18349 - protein, 433 aa, Lactococcus lactis [sequence omitted]

SEQ ID NO: 18350 - protein, 507 aa, Lactococcus lactis
MKFKHEPLNLYLNFKKSAEQFPDSPIIFDEAVGAFPELALETTYQKTHQAIVDKASLLSELGIKKSDKVIIFKSSAFDTYLLAVAVSYLGAVPAMISYHLPAETMDILAGRLGNPWLIYDQVTDKTVNEMKNLEDSKKLSVSKFALEKPTQIADSQQLASDEIAYLTHTSGTTGVPKLIAHSANSMGWRWVLQRTVMDWMPDKEEILAFHISPVHSRFNIGVSSAMTFGFGLMPLNDLSKDNLVNLFAKHQPYAFETHPNDFVRLANLAKQEPEIFASIRYLHSTFDAINKETMHTFLSASKQKDPVFLQIYGQSECGPMIWKKHRLSTLADTNAREMGIGMPGLSKARIADEDGNECPAGTPGRIHFLSKGRALTYYKEEERFNKEVYGDWWDTGDWGLMNEDGILFLHDRQVDLIDKIESNLAIEDLLLDQHDFLDEVVIIRDKSGKPQPILALAENAEMDWSAWWASIVDLPFLNEPILMAYDEIPRTATMKVQRLALERELAK

SEQ ID NO: 18351 - protein, 1137 aa, Lactococcus lactis
MKKLLVANRGEIAVRVFRACNELGLSTVAVYAREDEYSVHRFKADESYLIGQGKKPIDAYLDIDDIIRVALESGADAIHPGYGLLSENLEFATKVRAAGLVFVGPELHHLDIFGDKIKAKAAADEAKVPGIPGTNGAVDIDGALEFAKTYGYPVMIKAALGGGGRGMRVASNDAEMHDGYARAKSEAIGAFGSGEIYVEKYIENPKHIEVQILGDSHGNIIHLHERDCSVQRRNQKVIEIAPAVGLSLDFRNEICEAAVKLCKNVGYVNAGTVEFLVKDDKFYFIEVNPRVQVEHTITELITGVDIVQAQILIAQGKDLHREIGLPAQSEIPLLGSAIQCRITTEDPQNGFLPDTGKIDTYRSPGGFGVRLDVGNAYAGYEVTPYFDSLLVKVCTFANEFSDTVRKMDRVLHEFRIRGVKTNIPFLINVIANENFTSGQATTTFIDNTPSLFNFPHLRDRGTKTLHYLSMITVNGFPGIENTEKRHFEEPRQPLLNLEKKKTAKNILDEQGADAVVDYVKNTKEVLLTDTTLRDAHQSLLATRLRLQDMKGIAQAIDQGLPELFSAEMWGGATFDVAYRFLNESPWYRLRKLRKLMPNTMFQMLFRGSNAVGYQNYPDNVIEEFIRVAAHEGIDVFRIFDSLNWLPQMEKSIQAVRDNGKIAEATICYTGDILDPSRPKYNIQYYKDLAKELEATGAHILAVKDMAGLLKPQAAYRLISELKDTVDLPIHLHTHDTSGNGIITYSGATQAGVDIIDVATASLAGGTSQPSMQSIYYALEHGPRHASINVKNAEQIDHYWEDVRKYYAPFEAGITSPQTEVYMHEMPGGQYTNLKSQAAAVGLGHRFDEIKQMYRKVNMMFGDIIKVTPSSKVVGDMALFMIQNDLTEEDVYARGNELNFPESVVSFFRGDLGQPVGGFPEELQKIIVKDKAVITDRPGLHAEKVDFETVKADLEQKIGYEPGDHEVISYIMYPQVFLDYQKMQREFGAVTLLDTPTFLHGMRLNEKIEVQIEKGKTLSIRLDEIGEPDLAGNRVLFFNLNGQRREVVINDQSVQTQVVAKRKAETGNPNQIGATMPGSVLEILVKAGDKVQKGQALMVTEAMKMETTIEAPFDGEIVDLHVVKGEAIQTQDLLIEIN

SEQ ID NO: 18352 - protein, 441 aa, Lactococcus lactis
MNLLSKEEKMIKNSQIPSEFYKKYNVKKGLRDINGKGVLAGLTNISAIHSFDKEGNQIPGILEYRAYNIKDIINDLRKENRFGFEEMTYLLLFGELPTANELQEFQNLLASRRTLPEFFIRETILTNPSSDVMNSMSRCILALASYDEKVSDISIENVLEQSFGLIADFPLLAIYSYQSYVHYFKKESLYIHYPDPKMTTAENILRMLRPDCHYTEVEAKVLDIALILHMEHGGGNNSTFTTHVVTSSGTDTYATIAAALSSLKGPKHGGANIKAAKMLENIKENISNYEDDAEIEKYLHKILNKEVFDKQGLIYGIGHAIYSLSDPRFEVFKSYVETLVKEKGLEEEFKLYEKVARLAPKVISENRKIYKTICPNVDFYSGFVYRILEIPQELFTPLFAIARIVGWLAHRIEELINMNKIIRPAYESVLESKNYIKLGER

SEQ ID NO: 18353 - protein, 848 aa, Lactococcus lactis
MKKISISKKIYHYYDISETERIEDFPYSLRVLLESLIRQKNDENINQAHIQSVKDYLKGEVGQETVFLPSRVVLQDFTGVPAIVDLAAMRDAMVELGKNPELINPEIPVDLVIDHSVQVDFQGNEEAFLLNSKKEFERNRERYEFLKWAEQSFDNFRVVPPATGIIHQVNIEYLSEVITEKNGVLYPDSVFGTDSHTTMINALGVLGWGVGGIEAEAVMLGEPSSLTVPEVVGVRLIGKLGAFATATDLALTITKILRDEKVVGKFVDFFGEGLKNLSLADRATISNMAPEYGATCGYFPIDNETLKYLRATNRSEEVVARVETYAKANKLFYDEKREPYYNKTINVDLSEVATRLSGPSRPQDMLELSELANNFEDFAKKQKPLKEEDGKIAIAAITSCTNTSNPHVMMMAGLLAKNAVEQGLTVPSWVKTSLAPGSKVVTSYLEKAGLLPYLETLGFYVVGYGCTTCIGNSGPLLSEMETEIRNKELIATSVLSGNRNFEGRIHPLVKANYLASPPLVVAYALACSVRKNLTTGALGTNLEGEKVYLKDILPTSDEVNDLVQKYVTSDLYAESYAKVFDENTVWNNIKTKKSEVYDWKSESTYISNPPYFENLTMINKPIASLSNLHVLAKFGDSITTHHISPAGNIPLKSPAGDYLSSRGLAYKDFNSFGSRRGNDKVMTRGTFANIRIKNQLVAPLEGGYSLFNNETLPIYEVAKKYKEQGQGLIVLAGKDYGMGSSRDWAAKGTKLLGVKAVIAESFERIHRSNLVMMGVLPLQFLDNENAETLGLSGYESFSIELPENPKIHEKITVSTAEKNFEVLLRFDSQADLDYYANDGIMPYVIRKK

SEQ ID NO: 18354 - protein, 412 aa, Lactococcus lactis
MKIEMKNGKLVVPDYPAIGYIRGDGVGEDIFPQAQKVFDAAVLKIYGQKKKIEWQKLLAGGEAFETCGEYLPKETLAHINENLIAIKGPLMTPVGESFRSINVTLRQKMDLYACVRPVEYFKGIKSPVKAPEKVDMTIFRENTEDIYAGIEFASETNESHNLLKFLEKELNVHSIRFPKTSALGIKPVSPEGSKRLVNAAFEYALKMNKKRVTFVHKGNIMKFTEGGFRNWAYEVAREYPTFTKLEYDEIKNERGSLQAENEKKAALKSGKIYVDDVIADNFLQQIILNPENFEVIATLNLNGDYISDALAAQVGGIGIAPGANINYKSGHAIFEATHGTAPDIAGKNIANPSSLILSGVMMFEYLGWQEVAELIKIALSFSFRNGNLTADLGGKLSTSKFSDVLIDFIKTY

SEQ ID NO: 18355 - protein, 918 aa, Lactococcus lactis
MKFYQKSKEELLHSYDVKIDRGLSSTQVTDNRERYGENKLPEEKEESYLKVFFKSFKEPIIIVLLGAVALSFFSSFYSFQIVGDKKHGLESLYEAIAIAILIIINAFLGFWQEISARKNLNSLKEMNNRFASVLRDGALEKISSNELVVGDIVKVTVGDFVEADIRWLELDELQLIESHLTGEADAIIKNIEVINENVEIGDQTNMGFSGSIVSNGQGIGIVVATGENTELGKISQLMKDEGIKSSPLQETVKKLTKTLMKISAGIVLLTFVFGLISSGEFSINSITSVFSTSIALAVASIPDALPVVLSIVLTIGAVKMSKNKGLIKTLSSVETLGSTSYICSDKTGTLTQNEMTVTKFYANGQLYNVDGLGYSSIGEIHLIAKGEKNINFAQFMKNIVLCNDSSVKEVEGQVKTFGNPTEVALTVLGSKAGYSKNKLLKNNKIIRTLPFSSSRKMMSVIVQNDEGFYVYTKGAPDVLMEKASGILIGDIVDQSEQSKDNFIKVVDDYADEALRTLAVAYKKVDEEEALYGATEDVEKDFILTGVAGIIDPPREEVKESIRQLHDANINVVMITGDHEKTARAIAYDLGIVKEKNATVLKGIDLEEMSDQKLYAEVKNVNVYARVTPEHKQRIVKQLQNHQQVVAMTGDGVNDAPALRAADIGVAMGITGTEVTKDSADLILLDDKFTTIEKSVYSGRTIYANIKNFMRHELTTNVAEVLALVLGLVLFRSSVGNVAAMTPTLTALMVLWVNMVSDAIPSFSLGYDVAETDLMKEKPRNPNESILANHTWSRVLIRGTVMGTMVYLGFLLAAQNGLNASEAQTVAFLTLVYGQLWHVFDARSSRTLFRRNPFGNIRLVGAVLFAGVSSFLVTIIPFFNSVMGTAQLTLPVYLLVIFIPALPTLILSGIKEVFKIKIW

SEQ ID NO: 18356 - protein, 380 aa, Lactococcus lactis
MAIEMLGLILAGGQGTRLGKLTKDVAKPAVPFGGRYRIIDFALSNCANSNVKNVGVITQYQPLTLNAHIGNGAPWGLNGINSGVTILQPYSSQEGSKWFEGTSHAVYQNISYIDQQNPEYVLILSGDHIYKMDYEAMLESHKEREASLTVSVMEVPLEEASRFGIMNTDDNDRIIEFEEKPKEPKSNLASMGIYIFNWKRLREVLVNGYSKGNPMEDFGGDVIPAYIEAGENVFAYRFKGYWKDVGTIDSLHQSSMEFLDLNNELNITDKSWRIYSHNDISAPQFITEKSNVKNALVGDGCYVDGTVLHSILSQNVHVQEGTVIEDSFIMSGTFIGENVTIKNAIIGENAKIGDNVEIIGENEVAVIGHGEIKGENKNEQ

SEQ ID NO: 18357 - protein, 379 aa, Lactococcus lactis
MNNSNKMAAILSNISSSKHLSPLTEVRPIATLPFDCKYHLIDFPLSSLSNAHVDNIFMTFNEGETQSVFDHLGSGGEWGLDGFNSRYFVYIQQDFDRLREQGKDYFAQQLNFLRKSKAPYTVLLGSKFICNVDLTAVLKIHKLAGKEITTVYKKVSPDLASEYDTILRFDESGKMSNCYVNQLENPQEKEALCLNLFIVNTDWLINFIKEMQDIGELTSIARLIRVYMKNYDVNTYEYTGYMSNITNIKSFYDANMVMLDPQNFTSLLYSSQPVYTKIKNEVPTYFSENSKVENSQLGSGCIINGKVKNSLISRGVKIQDDALIEESLVFTNSEVKSGAQVKFAIIDKGVVVENNVKIIGSSEKPVVIPKGTVVTADIL

SEQ ID NO: 18358 - protein, 483 aa, Lactococcus lactis
MKERKMKVLFASSECAPFFKTGGLGDVAGALPKELAKKSEIDSVAVILPYFKNEMKEEYRSLLKDEFYDFVDVGWRHEYVGVKSLEKEGVKYYFLDNEHYFGRGQLYGYGDDGERFAFFDLALCQLLEKLDFIPDVLHVNDWQTAMVPFLLKEKYNWIKAYEKIKTVLTIHNIEFQGLMHGDALSELFGMGMERYFEGVVRHNGMLNMLKTGILYADRVNTVSPTYAKEIQTSEFGCGLESILQYVDGKVSGILNGIDYDIYNPENDILIPYHFSEEELSGKGQMKAELQKRTGLPLNPNVPLIGMVSRLTNQKGFDLVLSQLEKVLEENVQIVLLGTGFPEIEEGFRYFSQKYPDKLSANIAFDIQFAQEIYAGSDFFLMPSAFEPCGLSQMIAMRYGTLPIVHEIGGLKDTVIPFNPISKEGTGFGFVDFEGQILVETINRALEVYGKEPEVLNKMVLSAMSKDFSWGTKAQQYIELYQEL

SEQ ID NO: 18359 - protein, 800 aa, Lactococcus lactis
MKLSKKQFKQDFEERLTSKFATDLTKAGYQEIYDALASVVKHYYANIWVADNQYKDETGKKQAYYFSIEFLPGKMLKSNLLNLGILNTVREGLNDFGIELDEVAKIEPDMAIGNGGLGRLASCFMDSLASTGLPGNGNGIRYRYGLFKQKIVDGYQVELPDSWLNNGNPWEVRRADKAVEVTFGGEVWLEDDGKGNLIPHYKDQERVLAVPYDTPMVGFENTTVNNMCLWRSEVPEELDPKFQNLDYMRQTSMLSAELYPDDSNYDGRLLRLKQEYFFVSAGLQRILHHYKGTQKKDIRKIGDYIAVHINDTHPALCVPEFMRLLVDEYGVGWNRAWDTTLKVMSYTNHTILSEALEKWPEEMIKQLLPRIYQIIVEIDRRRTAELLPKVGATLVHNTRIIKDGQIHMANLSIIGSHSTNGVAKLHSDLLKDVELHDFYEIYPERFNNKTNGIADRRWIQIANERLSGIIDETIGKSWRHDLDELKLLKNFNNDEKTLEQLQKAKFDDKLRLAAVIKEQKGITVNPDAIFDVQVKRLHAYKRQLLNALHILKLYFDLKDNPELDRIPRVFIFGAKAAPSYHYAKSIIKVINEIANMINNDQTIKDKLKVVFMENYNVSLAEVIIPAANVGEQISLASKEASGTSNMKFMLNGALTIGTLDGANIEIFEAAGDGNNFVFGLTKDEVYEYYRNGNYNARDIYEQNPVVNRILNALIDGTVPNIKSEGREIFDSLTVYNDEYFVLRDFNDYVRAQAELEKLYRDQKAWTQASLMNIANVGRFSSDRTVREYADDIWYIKAKKE

SEQ ID NO: 18360 - protein, 600 aa, Lactococcus lactis
MYYYNPWNLDYKQPFGAIKVGNSMSLRFATDQPSVLVTCVIRRDFGKRYEFSMTKDSGGDFRLTIPFDEEPGLYFYHFEIVESSDLGETRRFYGCSGIGGEGLLYTDENDVKPYQLTVFEKEDQAPSWYREAVFYQIFPDRFYNGNENGQINHPKPNSFIYGRKTDNPFYVKEENGDIARWDFFGGNLRGIIKKIPYLKELGINAIYLNPIFSGTSNHRYDTNDYLKIDSMLGRQEDFEELIQLLHQEKMHLILDGVFSHVGKNSLYFNINGDYGDDEGAAKNPDSPYFDWFKFENYPFEYKSWWGIKDLPEIDKDNDSFRNFIYGEKNSVLAKWNALGIDGWRLDVADELPDSFIKGIRENLDSYSDKILIGEIWEDASNKISYGKRRNYILGGSLQAAMNYPFRDLIINLLNGHRSSQDVAHQLMTLQENYPKDIFYNNLNNLGTHDTERILTMVGEKNLSVALAMLFVLPGIHCIYYGDEAGLSGGKDPENRKYFPWDNISPNVYNVYKSWTQKRLSENSLKYGEFSTFFTDRLLGILRYTDSEVFVELINPSEDELNIEVQEITFLQNLKFLPELKKLLTEKVISGKTNLELKMKI

SEQ ID NO: 18361 - protein, 615 aa, Lactococcus lactis
MFPILGILAVFQFIAIAGQALFLATAITKLWQGPLFSHTIPWVLGFFACFLSREIINFGRSKALDKLAYQLATKLRGDMLDKFFRLGPVAIANLGSGSAATPVITGIDQVENYIKLVLSKVLNMMIIPMLILIPVYFLDWQSGIVLTLTFPFAIIFMILLGYAAQGRAERQYKTFQYLSNHFLDSLRGISTLKYFGLSKDYSNSIYKTSEDFRKETMGALRIAMLSTFALDFFASLSVAVVALFLGLRLMSGDILLFPALAALILAPEYFLPLRDFASDYHATLNGKNALAAVNEVLSTEENTLSVLTEKVTWSANSQLQLTELGKIYDTGRGISNVILSVNGFKKIAIVGNSGSGKSTLLSMLAGFLKPTAGEIKLNEQSLTSLTDENYRQSVQFIPQKTYIFAGTFRENLAFYEPDSTDDEIKAAAKLAGLESLIDEIGLDGQIGASGRTISGGQAQRVALARAFLSHTRNILFLDEPTAHLDIETELEIKANILPLLENKLVFIATHRLHWLSSMDLVIVLNEGQVAGIGTPEQLLSENTYYQKLLSQMRGVDDDKNLLDNETSESVKDQEEKESERSNFSSVNDKSTDSSVSQARQIMGVRNNEIKKYFVR

SEQ ID NO: 18362 - protein, 573 aa, Lactococcus lactis
MKLKNILFGNDWISPFLKKNRSGFILSIFLGTITISMAGLLMFSSGYVISKSATKPENILMIYVPVLFVRIFGIGRPVMHYVERLTSHNWILKITSLLRKKLYLRLEKTAVTLADRYRLGDLLGVLNEDIGNLQDLFLRTLFPVLIAGSLSIALIIAGGFFSLWFALGLALFLGFLIVILPLISLKFTVKLDEELKIYRNQLFSHLTDDILGLQDWVLSGRKEDFLTAYRGSELSARKIQAKLLAFGRRRNLFLQVVYGALVIYLMIWSSGALRLGDAPNYIAAVSLAAFPLFDAFSPLSDAVVETQRYGDSIIRLNDLPDQDEEVRTEEIVSTDLVINNLQFSFEENKKIFDNFNLEVKQGEHIALLGRSGVGKSTLAGLIRGDLVPQSGSIQFSGVEPSKAKNVEEKIGVINQSPYLFATSLRSNLTLAKLNASDAEIWEALELVGLRKMVESLPQKLLTPVDEAGERFSGGERQRLALARVLLSDVDVVILDEPTVSLDPITENQLLSLFFEQLRDKSIIFITHHLLGVHHMDRVLFLENGSIKFDGKPASLLENNPTFKELYQLDLGNE

SEQ ID NO: 18363 - protein, 224 aa, Lactococcus lactis
MSKETKALTINPQLAAFQEELLKSYDKANLSAKKGQTLFVGSSLMEIFPIEKWEEAGEVTFSHYIYNRAVRATTTSFLLEHIESQIFNLEPSKIFINIGTNDIGFEIPEEEFLNNYDQILSQIESKLPQTQVYVMRYYPINTVDFGQDSDEKTLFETRSNKKFQKASDKIKKLADNHHFHFIDVNDGLSDENGNLKKELTFDGAHLNPAGYQLVLENLKVYLEE

SEQ ID NO: 18364 - protein, 584 aa, Lactococcus lactis
MANRIEGKAVDKTSIKHFIKLIRAAKPRYLFFIIGILAGIVGTLIQLQVPKMVQPLVNSFGHGVNGGKVALVIALYIGSAAVSAIAAIVLGIFGESVVKNLRTRVWDKMIHLPVKYFDEVKTGEMSSRLANDTTQVKNLIANSIPQAFTSILLLVGSIVFMLQMQWRLTLAMIIAVPVVMLIMFPIMTFGQKIGRTRQDSLANFQGIASESLSEIRLVKSSNAEKQASKKAENDVNALYKIGVKEAIFDGLMSPVMMLSMMLMIFGLLAYGIYLISTGVMSLGTLLGMMMYLMNLIGAVPTVATFFTELAKASGSTGRLTELLDEEQEVLHQGESLDLEGKTLSARHVDFAYDDSEQILRDISFEAQPNSIIAFAGPSGGGKSTIFSLLERFYQPTAGEITIDGQPIDNISLENWRSQIGFVSQDSAIMAGTIRENLTYGLEGDYTDEDLWQVLDLAFARSFVENMPDQLNTEVGERGVKISGGQRQRLAIARAFLRNPKILMLDEATASLDSESESMVQKALDSLMKGRTTLVIAHRLSTIVDADKIYFIEKGQITGSGKHNELVATHPLYAKYVSEQLTVGQ

SEQ ID NO: 18365 - protein, 420 aa, Lactococcus lactis
MAEHLAPLIDNQSRVALLSENSVEMAVVLFALLGLSKEVLLLNRHLTEYELADQIKELKIDKVFTSDLLTEKVTDSISFSEIWTSNPCPVSLSADFPDEKIAVIMNTSATTGKFKSVPITWGMISNHVKASKETLGAYDNDNWLVILPMFHVSGLSIIMRTLYNATSATVVDKFDENQLLEMINSGKINMVSLVPTLLTRIADKLHSNNLRLILLGGEFIPQPLIKKCQELGLPIYKTYGMTESFSQSVTFNILDFPDKTSSVGRPLPGVEIEIRQADLAGVGEIWLKSPMLMKAYLGQKPYGTAFETGDIGYLDTDGFLYLLNRRKDIIISGGENIYPKEIEDLVYSLPEIKECALVAKPDAKWGQVPILFVSGNISQEKLENFLTEKLAKYKRPQSITFMDELPKNASGKILRKELKG

SEQ ID NO: 18366 - protein, 450 aa, Lactococcus lactis
MKVAKFGGSSLASASQIKKVFDIVQADKQRKFIVVSAPGKRSGADTKVTDALIAYYKAYKSADEKGIHYYQNWIIERFREIYDELGLKSPVINQIAENINHLAQLDLDNVFTYDTFLAAGENNNAKLVADFFNHSGLPSRYVHPSDAGIMVSSDPGNARLLGGAYEHIKYLNELEETLIIPGFFGITKEGEVCTFSRGGSDITGSIIAAGVRAELYENFTDVNGIFAAHPGIVKNPAYISELTYREMRELAYSGFSVLHDEALVPAYRAHVPLVIKNTNNPDHPGTKIVVQRETKGSPVVGIASSSAFSSLYVSKYLMNREVGFGRKVLSVLENLGVRFEHMPTGIDDMSIIIRSRYLTQPISKALISNLTESLHPDEVYIDRDFSIITIVGEDMKEHVGVTARATAALSKQGISIAMLSQGSSEVSVMFIVKEKYEKEALKAIYSAFFD

SEQ ID NO: 18367 - protein, 222 aa, Lactococcus lactis
MKFKAVIFDMDGVLVDTERYYLQRREEFFGGHGISISHLTPSDFIGGNMKDIWPRILQGSFDEEKASELQEDYEQFKENHPMPYAELLFSDVPDILEFLRQKEVKIALASSSSMFDIKQMLDIHQLNSYFEVVVSGNDFKQTKPNPEIYQSTMKKLGVTPSETLIIEDSEKGIQAGEAAGATVWAIEDKRFGMNQEKADLKVDSLTAIQKLLTESSLKMIKA

SEQ ID NO: 18368 - protein, 325 aa, Lactococcus lactis
MTFAKITQVAHYVPENVVSNDDLSKIMDTNDEWIYSRTGIKNRHISTGENTSDLAAKVAKQLISDSNLSPETIDFIIVATVTPDSLMPSTAARVQAQVGAVNAFAYDLTAACSGFVFALSTAEKLISSGAYQRGLVIGAEVFSKVIDWSDRSTAVLFGDGAAGVLIEAGASQPLIIAEKMQTDGSRGNSLLSSYADIQTPFASVSYESSNLSMEGRAIFDFAVRDVPKNIQATLEKANLSAEEVDYYLLHQANSRILDKMAKKLGVTRQKFLQNMQEYGNTSAASIPILLSESVKNGIFSLDGQTKVVLTGFGGGLTWGTAIINL

SEQ ID NO: 18369 - protein, 73 aa, Lactococcus lactis
MAVFEKVQDIIVDELGKEKEEVTLETSFEELDADSLDLFQIINDIEDEFDVEVDTEADMKTVADLVKYVENNK

SEQ ID NO: 18370 - protein, 308 aa, Lactococcus lactis
MTKTAFLFSGQGAQKLGMARDLYDQYETVKATFDEASQALGYDLRALIDNDEEKLNETKYTQPAILTTSVAILRLLSENGIKPDLVAGLSLGEYSALVASGIIDFQEAVKLVAKRGQYMTEAAPTGSGKMVAVMNTDPALIEEICQKAAEFKGGIVSPANYNTPAQIVIGGEVEAVDYAVELLKEAGVRKLIELKVSGPFHTAILKPASEKLALELDKIDFRPFELPLISNTSAKVMENDEVKGLLTRQVMEPVRFYESVETMQKLGATRFIEVGPGRVLSGFIKKIDKNAEIANVENLASFEALINQ

SEQ ID NO: 18371 - protein, 243 aa, Lactococcus lactis
MEIKNKNVFVTGSTRGIGKAIALQFAKAGSNLIINGRSAISEELLAEFTAYGVKAVGISGDISKSEDAKQMVAEAIETLGSVDILVNNAGITRDGLSLKMSEEDFESVLKINLTGAFNMTQAVLKPMTRARSGAIINISSVVGLMGNAGQANYAASKAGLIGLTKSIAREVAARNVRVNAVAPGFIESDMTEVLSDKVKDAMKGQIPMKRFGMPEEIATATQFLAEQEYMTGQVLTIDGGVSM

SEQ ID NO: 18372 - protein, 409 aa, Lactococcus lactis
MTNRVVISGYGVVSAIGNSPEEFWNNLKAGKTGIGPITHFDAEATGISVAAEVKEFPFDKYFQKKDARRMDTFSLYAVYAALDAMEMSGITEENTNFDRLGCIMASGIGGLEQSQKNSQAIVAKGPRKGVAPLYVPLAIANMATGNVALRTGARGVSRAEVTACAAGANSIGSAFREIKHGYADAMIAGGAEAAICELGIAGFANLTALTKETDPEKACIPFDKNRSGFVMGEGSGVLILESLEHAQARGANILAEIVGYGNTNDAFHMTTPSGVGAENAIKLALEEAGASPADVDYVNAHGTSTHANEETESKAIHNVIGDKAYVSSTKALHGHALGATGAIEAVATVQALLNQYAPVNAGTTELDEGMTINVVLGEGKPADINLALSQDFGFGGHNAVLAFKKWTGE

SEQ ID NO: 18373 - protein, 144 aa, Lactococcus lactis
MTEVNINVTEIMEALPHRYPFLLVDRVIDIAEDEITAIKNVTINEEFFQGHFPQYPVMPGVLIMEALAQAAGVLELSKPENKGKLVFYAGMDNVKYKKQVTPGDQLVLHAKFIKRRGPIAVVEAEATVDGKLAAKGTLTFALGR

SEQ ID NO: 18374 - protein, 455 aa, Lactococcus lactis
MFNKILIANRGEIAVRIIRAARELGVGTVAIYSTADRDALHVHLADEAICVGPARSTESYLNMNNILSAAVATGAQAIHPGFGFLSENSKFARLCEEMNIKFIGPSAKVMDMMGDKINARAEMIKAGVPVTPGSEGEVHTTDEAVKIAEEIGYPIMLKASAGGGGKGIRKVNNVEELVPAFEAAQAEAQAAFGNGAMFIERMIFPARHIEVQILGDSQGNVIHLGERDCSLQRNNQKVLEESPSVAIGHTLRNEITAAAVKAAQHVSYENAGTIEFLLDESSGKFYFMEMNTRVQVEHPVTEFVSGVDIVKEQIRVANGNELSVKQEDVTFSGHAIECRINAENPKFNFAPSPGKITNLFLPSGGVGLRVDSAMYSGYSIPPYYDSMIAKVIVHGENRFEALMKMQRALLEFDVEGVITNVDFQLELISDPHVVAGDYDTSFLGNVFLPEYQKED

SEQ ID NO: 18375 - protein, 380 aa, Lactococcus lactis
MTSIKTKVIHGGISTDKTTGAVSVPIYQTSTYKQNGLGQPKEYEYSRSGNPTRHALEELIADLEGGVQGFAFSSGLAGIHAVLSLFSAGDHIILADDVYGGTFRLMDKVLTKTGIIYDLVDLSNLDDLKAAFKEETKAIYFETPSNPLLKVLDIKEISAIAKAHDALTLVDNTFATPYLQQPIALGADIVLHSATKYLGGHSDVVAGLVTTNSKELASEIGFLQNSIGAVLGPQDSWLVQRGIKTLALRMEAHSANAQKIAEFLETSKAVSKVYYPGLNSHPGHEIAKKQMSAFGGMISFELTDENAVKDFVENLSYFTLAESLGGVESLIEVPAVMTHASIPKELREEIGIKDGLIRLSVGVEAIEDLLTDIKEALEKK

SEQ ID NO: 18376 - protein, 334 aa, Lactococcus lactis
MRRFSSKYYTKKPLKSHCLIKFVIIIIEKLRIPLSHSSLEILLKNKGTIMNYKFISWNIDSLNAALTGTSERAALSLAVVKNLAQAQPDVLAIQETKLPSTGPKKAHLEVLEELFKGYKIVWRSSVEPARKGYSGTMILYKETLPEPVITFPEIDAPEPMDAEGRIITLEFPDFFVTTVYTPNAQEGLTRLDLRGIWDDNYRNYLTSLDAQKPVFACGDFNAAYTEIDLANPRGNHNSAGFTDQEREKFGQLLEAGFTDTFRQLHGQVEKFYEEGRSIYTWFAQRAKTSKLNNSGWRIDYWLVSNRLAQAVKVSEPLDSGERLDHVPILLEFEL

SEQ ID NO: 18377 - protein, 243 aa, Lactococcus lactis
MKFSGKKVLITGAASGIGLAQTKVFLAEGAEVVAVDLQEFTDESIINSKNLSVKILDVSDAQSVEKLADEVGSIDVLLNTAGVLDAYKTLEETDFAEWQRILSTNLNSMYLMISAFLPKMKAQKSGVIINMASVAGLIAGGGGVAYTTSKHAIVGLTKQLALDEAQHGIQVAAIAPGAINTPMNAADFTENNGQMAQWVADETPAKRWASPREVADLTLFLASPQASYMSGAIVPIDGGWTIK

SEQ ID NO: 18378 - protein, 340 aa, Lactococcus lactis
MKKVAIVGIRGYSGLELFRIFYYHPEVEVTKIYATSHYGEKLSEHFPQLEGLTDLTISEFNEEEIMAECDAVFFATSAGVSQKLALTFIDNNFPVIDLSGDFRLADLEIYNKWYKNTNLKNEYLLSGQYNLADIGQAKANYIANPGCYATATLLALYPLVKNKMIDLDSIIVDAKSGLSGAGKGLSDASHFVNVVDNMSMYKINSHQHIPEIAQQLKIWNSNFQALQFSTSLIPVSRGIFVSSYAKVAADFDFETIKNAYEQVYATKNFVRIRRQMPHLSDVIGTNFCDIGLAYNPVTNVLSVVSVIDNLMKGAAGQAVQNFNQLFGYDESLGLKFMPSL

SEQ ID NO: 18379 - protein, 396 aa, Lactococcus lactis
MKEIKGTIASPKGFLADAVHAQLKYKNLDLGLILSQVPAAIAGVFTTNKVCAAPVLIDRQIVKKGQARAIICNSAVANAVTGEQGYANALKTQKLLAEKFELKAEEVAVCSTGVIGVQLPMEKIATGISKLSQNEGTAAYFAKAILTTDTQTKTINFEAEIGGQIVNMAGVCKGSGMIHPNMATMLAFITTDAKIAQALLQKTLSEIIETTFNQITVDGDTSTNDTVLLMANGQAKNNEILEGSSDYLLFKEMLAKVCQSLAKQIAADGEGATKLIEVTVKGAPNDLTARFIAKKIVGSSLVKTAIFGADPNWGRIISSIGQVANFEVSDIELKLQDELVLYHSTPVDFDAAFLSEKLKEDKIEIIADLNAGSGLGQAWGCDLTYKYVEINALYTS

SEQ ID NO: 18380 - protein, 377 aa, Lactococcus lactis
MTNLFENYGRLPFSLIKGEDQYLFDDRGNKYLDFTSGIGVMNLGYSFEKGKVAVKAQLDSLSHLSNLYQNPLQEDVAEKLSQNHSYKAFFCNSGTEANEAALKLTHLIKKDQKILAFTDGFHGRTFGAMSATMQEKIQAGFSPLLPNFVASPFNDVVALEQILEKEKIGAIIFEIIQGEGGVLPISPDFVEALKSCQQKGILLIIDEIQTGIGRTGKLFAFEHFDFEPDIFTLAKALANGIPTGAMLAKNKYASYFSAGKHGSTFGGNPLAMASANEVLKEIDSDFLEKVTDKGIFFLKLLTEKLSVKATVKSIRGLGLMIGIQLTDEKKVPEVLALLRENGLLALSAGHDVIRLLPPLVMTKVELQKGAELLEKIL

SEQ ID NO: 18381 - protein, 283 aa, Lactococcus lactis
MRDSQNTAQTLTESLKYFLKYRDQTVVIKYGGNAMIDEKVKESILKDILLLKTVGIKVVLVHGGGPAIGELLEKYEQKSQFVQGLRVTDKKTAQLALTALAGKVNKSLVQDIIRLGGNAIGVSGIDGKLIEAKPISEDLDYVGEITAIHPEIIERINQTDAVPVIASAGIGLDGEIYNVNADTAASRIAGALSAEQFILLSDVRGLYGNFPDEESFIDEINLTNLEKLVKEKKITDRMIPKIEAIKYAMFEGLGQAVLLDGRVPHALLLELFTDKGQGTMINH

SEQ ID NO: 18382 - protein, 333 aa, Lactococcus lactis
MFQGRSFLKEIDFSKDELLYLIDFAIHLKKLKKEHIQHKYLLDKNIALIFEKTSTRTRAAFTTAAVDLGAHPEFLGPNDIQLGKKESISDTAKVLGSMFDGIEFRGFKQSDVEILAKDSGRPVWNGLTDVWHPTQMLADFMTIKEHFGHLQDLTLAYVGDGRNNVANSLLVTGAILGVNITIISPESLQPALEIQKLARKYAMKSRSKISIRTDLNGLENADIVYTDVWVSMGEEAQTAKRIKLLKSYQINQKVVEKIINKNFIFMHCLPSFHDLNTEVMKEIKENYNLNELEVTDEVFNSKNSVVFEQAENRMHTIKEVMAATLGDLFIPKI

SEQ ID NO: 18383 - protein, 924 aa, Lactococcus lactis
MYLKKMEIVGFKSFADKTKVEFDKGITAVVGPNGSGKSNIVEALRWVLGEQSAKALRGGKMPDVIFAGTEKRRALNYAEVIAHFDNSDHYLQGQDENEEVVITRRLYRNGDSEFLMNGRKCRLRDIHDLFTDTGLGRDSLSIISQGRIESVFNSKPEERRAIFEEAAGVLKYKNRRNETESKLNSTQDNLDRLEDIIFELNSQLVPLQSQRDTALRFQELEAERSDLSLSVLVGQLESKKAKYDQTELDLAQVAQELASLSTRKKVYDEQVSQLRTERQKVEAEQEKLQADQLNFSNLKSDLTRKIELFDVQKDSSEKSAAEREERLENLKSRLEITQQNLAEVQKKSELLLTEKNDLDKLLTELSADLATLSESPEVVMERLRDEFVQLVEEEAQISNEIVRNKAEITDLSRRQSEQDESVRENLTKFEKISQDLSEAQENLNTVKKEIETLLAKFEEGNQAEKKQAELERLAQNKMYDYLQELNQHKARLTSLQNIRESHSNLFAGVRAVMQNASQIGGVIGVVSDLLTFDPKYTTAIDIALGGGSQNVVTEDENAAKRAIAFLREKRLGRATFLPLTTIKGRDFNGLNRIQNMTGFVDLAINLVSFESRLHKAMSSLLGTTVIVDSGENATAIARAMNYNVRIVTLDGTQINPGGSYAGGAGKRNSTTFTSVEISNLEKQTKLSEEQLKISEKEVQKAQSARQELLKEIELLKTQGEEKRFVEQSLNLKIEQLTEQKVALEQLTNLSANQEATGNLLELTKENEHKVEVLAKITERKAEIEKQLEEVKTNSQAHKALQSEKTSALNQAQLRQSEVVSELKFTKADEKRLLTDLSALTEEKNQLIALLNPVQFDETERNNFSKQLTEVEERLSQINVRMVSLKFEREDLAAQMEDLEHHNQDFIQQTQELNTKKTRYEMQLE

SEQ ID NO: 18384 - protein, 446 aa, Lactococcus lactis
METNQSLKKKMAARHITMIALGGAIGAGLFKGSSSAIAAAGPSVLIAYFIGGIVLYFVMKSLEKLVLSSKDPHGLSGLVQPYLGNHTADFTDWVYWSMWMINIIAEAVAAASFLQLWFANVPTWVFVLIIALLTSLINLFSVALFAETEYWLAFIKISVVILLIIFGVFLVAKQIFDTNLVTTFSGMTAHGGFAPHGFKGVINSLLIVIYSYGGSELIAITVSETEDPKRAIPKAIRGVIGRIISFYIIPMFLLLVIYNWQTLATSSMSPFVMVFNKMHIPFAGDIVNLIIILALFSSINSGIYASSRLLYFRLKNRQGKMAQRMAHLNKHHVPQRAVIFCSGTLYIGVVLSYFVGDRLFNYLAGSLSYTVLAVWILISLAGFGLSLKTKSLSGRTMSLLALIALFLILIGILFTNPIGVTVFTAILYFIIFISYQKKNDSVSNLN

SEQ ID NO: 18385 - protein, 324 aa, Lactococcus lactis
MSYSNLKLFSLSSNHELAQKVAKEIGIELGKVSVGAHSDGETVVHIDESVRGDHVFILQSTSDPVNDNLMELLIMMDALRRASAASINIVLPYYGYARQDRKARAREPITSKLVANMLQIAGADRLITFDLHAPQIQGFFNIPVDHLMGSPLIAEYFRRQLVSAGDDIVVVSPDHGGVGRARKLANFLKAPLSIIDKRRPRANVAEIMNIIGDVQGKKCILIDDMIDTAGTITLAANALKELGATEVYASCTHAVLSGPAIERINNSAITKLVVLDTIEMPEERQSEKIVQLSIAHLLADAIIRIHERRPLSPLFELHLPSEQI

SEQ ID NO: 18386 - protein, 453 aa, Lactococcus lactis
MENKMPKDFFWGNSTSSMQTEGGWNEGGKGPSVYDVNTVGRSAKDWQVTNDNYHHYSQDLDLMKEMNMNMYRFQISWSRIVPDGDGEFNEEGIAFYNRLIDDLLARGIEPMICLYHFDMPLNLAEKYNGFLSRKVKEAFVRFGQEMMKRFADKVKYWIVFNEHNLYFADGFEHYSGVLKKELTLSDMYTVFHHTMLAHCELTQFLHENFEAKIGGMLATTEIYPATFSPKDNLYLRKFDEFYNRNLCDVYAFGHYSHEVMTYVKNQNIQMDFQKGDEEILKNGISDFISFSYYRSILLDASQLTENDAPNSYLTKGMKLNPLLEHNQWDWSIDPEGFRRILSRLYNEFGLPVFPIENGIGQSEIWDGKTKIADDLRISYHQKHLEAMKKAIFTDGVEVMGYLGWGLIDIPASSGAIDKRYGAVYVDSKSHKRIPKKSFHWFKNVFASNGDHLD

SEQ ID NO: 18387 - protein, 720 aa, Lactococcus lactis
MRSQSFVITGMTCANCVNTVSKTLNQSDKIMEATVNLATEKAKIVADDNISDQEIINLVEKAGYGAIVNDKAHQEKIARQAAKKARNLALSFWIALILTLPLVVAMFADIFGVHANWVMFLHEPIVQLILATPVQFVIGWRFYVGAYHALRNKSANMDVLVALGTSVAYFSSLILAVFMSQANALNFESSMVIITLVVMGKLLEHNAKEKTTQAITGLMSSRANFVHTESTDLAIEEVQMGQVIRILPGEKVPLDAMILSGKASFDESILTGEALPVVKMDDEVIFEGTINLDGEVKAVVVHDLNDSTISRMVKMMSEAQGSKPNIQKLADKISGIFVPVVLVIALITFIATWAVSGILLTAIMHSVAVLVIACPCALGLATPTAIISGTGLAAKNGLLIKNANALELAGLVKTVFFDKTGTITTGEFELTDFKLLTESEKVTDSFNSIEEKLASDKFKLLASLEAHSNHPLAKSLKFQGDLYELTDLSELAGRGLSAKINGQEYFAGNDKLMTDLNLSVPETDDTVIYLANKEKLLAMAVFSSSLKDDALKTIQTLQKRGLKTVMLTGDNQNSAEKIQKLVHLDEVKSGLRPEEKAEIVQNSPNSMMVGDGINDAIALASATVGLAMATGSDIAMEAGDVTVTSGQLHKISTFFEVAKKTISKIKQNYFWAFVYNVIGIPLAAFGLLNPMLAAAAMSLSSVSVILNSLLLTKTKIKNVE

SEQ ID NO: 18388 - protein, 435 aa, Lactococcus lactis
MFDYIIIGAGPGGLGLAYRLKTKDNKIGIIENDKWGGTCPNYGCDPTKMMMAVVEAKSRVEQLKGQGISGELNIDWKGLKSRKLNITDPYEKSTFTGLKNAGIETIYGSAAFNDQGKLEVEGKTYQAKTYIIATGSRPRLLDIDGKEFLKTSNDFLALEEFPAQISFLGSGPISLELAQIAKAAGSDVTIISRKKARVAHFDEEMGQEFINYLKAQGIKFIEDISVDKVEKVADGFLLTDGTDFEHKTDLVIAGVGRQPNSDKLNLEKVGVETDAKGIKVNEYLQTSNSKIYAMGDVLSKNQPHLTPVSSFEGAYLGENLVKDEPQKIAYPAIPTIIFGTAKLAEVGHLAGEGIHTKTLDLSSWYTYKRINDPLAKLKVALNEKREIVGASTVSSVADEVINLINILIQQKMTLADVEKMIFTYPTVASDLEYFY

SEQ ID NO: 18389 - protein, 695 aa, Lactococcus lactis
MSNKTHSSNHDEMMSEHHHNHEIMDMEHENHEMHNMHNMDNMHDMDNMDMMNHGGHMMHMGDMSKKLKVAIILMIPLLLISPIAGFTILKFPGSEILQLILGTIIFFYSGTPFFSGAKGELKSRKPAMMMLITMGITVAYAYSVYATIMSLNGHMGMNFWFELATLIVIMLIGHLIEMKAIMGAGDALKDLASLVPKKAHLKSGKDVELSELKVGDLLLVKENEKIPADGLILSEALVDESMITGESRAVNKKTNDLVYGGSLNQNQPFEMKVTTLGKDSFLNQVAELVKKAQAQKSNLENMADRVAGYLFYAALIVGIFSLIFWTISSNFSFALLLAVSVFVIACPHALGLAVPLVVSRLTSISAKNGLLIQNRTSLEKINTIKYALMDKTGTLTDGKFIVRNVIDFTDETDILQIMAALEGSSTHPIAQSIVAAAKPLGNLKVEAVENIPGVGIKGQVNQNFYQIVNYKYLRENQLSYDEQKIAQYLDLGLTVSFLINEQQDVLGFIALGDSPKADAKAFINGLLAQGITPVMLTGDNKETAKKIASALNIPEFRAELKPEDKAEIVKEYQKKAGVLFIGDGVNDSPALATATIGFAIGAGTSVAISTADVVLVNSNPSDVLDMINISKRMLRKMKQNLWFGAGYNIIAIPVAAGILYPFTGIYIDPLIAAVLMSISTVIVSINAMGLRYDKK

SEQ ID NO: 18390 - protein, 294 aa, Lactococcus lactis
MNVSLWYNSSMNLIDGKALAAKMQAELKVKVDKLKEADNVPGLAVILVGEDPASQIYVRNKARQATAIGLNSSVVRLPETVSEQELLDLIEQYNQSEQWHGILVQLPLPEHISEEKVLLAIDPEKDVDGFHPMNMGRLWSGNPLMIPSTPAGIMEMFREYDVELSGKRAVVIGRSNIVGKPMAQLLMMADATVTIAHSKTENLRELTKEADVLVVAIGRDRMIKAEDVKEGAVVIDVGMNRDEDGKLHGDVDFDEVKDVASLITPVPGGVGPMTITMLMEQTVRAASRKMNENK

SEQ ID NO: 18391 - protein, 285 aa, Lactococcus lactis
MDTKILKLEDFLTEFYESAEFPTGLAESAKYSLLAGGKRIRPLLFLNLLEAFDLELSKAHYHVAAALEMIHTGSLIHDDLPAMDNDDYRRGQLTNHKKFDEATAILAGDTLFFDPFFILSTADLSAEIIVALTRELAFASGSYGMVAGQILDMAGEGKELTLAEIEQIHRLKTGRLLTFPFVAAGIVAQKSTDEVEKLRQVGQILGLAFQIRDDILDVTATFAELGKTPGKDILEEKSTYVAHLGLEGAKKSLTGNLSEVKKLLTDLSVTDSSEIFKIIEQLEVK

SEQ ID NO: 18392 - protein, 555 aa, Lactococcus lactis
MLQEISIKNFAIIEEIHLSFESGMTILTGETGAGKSIIIDAMSLLLGGRASSDFVRHGANKAEIEGLFFFDKTPELKAVLLELGFEEVDSEIILRREIFANGRSVCRINGQMVNLATLRQVGELLVDIHGQHDSQELMNPKSHLRLLDEFGDEAFDQIKNNYKLKFENFKNLRQQLNLRQKNEQEFAQRIEILQFQAEEIEAAEINLEEDEQLVNRREKLNNIKNIADSLSSAYLALDDEDNDYSSLNNIRTTMTELDKISNFDNDYQELADKTAESYYVLEEVANQIQRIMSDLEFNPAELLQIEDRIMTLTTLKKKYGPELSDVMNYLEKVQLELSELTGSENDSENLENSVKVAQVQLIEASKKLNEARHKIAKEVEKDIKHELSELYMEKADFKVSFEGAKFSANGNEHVEFFIQTNPGEGFKPLAKTASGGELSRLMLAIKSSFSRRENKTAIVFDEVDTGVSGRVAQAIANKIYKIARHGQVLAISHLPQVVAIADRQFYIEKASTDDITTSTVRKLNAEERVNEIAKMLAGEDLTKEALAQAKRLLSK

SEQ ID NO: 18393 - protein, 370 aa, Lactococcus lactis
MPETTTILYRGGVFMRAARFYDRGDIRIDEINEPIVKAGQVGIDVAWCGICGTDLHEFLDGPIFCPSAEHPNPITGEVPPVTLGHEMSGVVNFIGEGVSGLKVGDHVVVEPYIVPEGTDTSETGHYNLSEGSNFIGLGGNGGGLAEKISVDERWVHKIPDNLPLDEAALIEPLSVGYHAVERANLSEKSTVLVVGAGPIGLLTAAVAKAQGHTVIISEPSGLRRKKAQEAQVADYFFNPIEDDIQAKVHEINEKGVDAAFECTSVQPGFDACLDAIRMGGTVVIVAIWGKPASVDMAKLVIKEANLLGTIAYNNTHPKTIDLVSTGKIKLDQFITAKIGLDDLIDKGFDTLIHHNETAVKILVSPTGKGL

SEQ ID NO: 18394 - protein, 253 aa, Lactococcus lactis
MSKIAAVTGAGQGIGFAIAKRLYNDGFKVAIIDYNEETAQKAAKELGENSFAIKADVSDREQVISALNAVVDKFGDLNVVVNNAGIAPTTQIETITPEQFHQVYNINVGGVLWGTQTSTALFRKLGHGGKIINATSQAGVVGNPNLMLYSSSKFAVRGMTQIAARDLAEEGITVNAYAPGIVKTPMMFDIAHQVGKNAGKDDEWGMQTFAKDIAMKRLSEPEDVANVVSFLAGPDSNYITGQTIIVDGGMQFH

SEQ ID NO: 18395 - protein, 540 aa, Lactococcus lactis
MRAHEILNNPFLNKGTAFTMKERQELGLIGLLPPTVQTIEEQAEQTYEQYLTKPSDLEKRHFLMEIFNTNRTLFYYLFNKHIVEFNPVVYDPTIADTIENYSHLFVDPQYAAYLDINHPENITETLKNAAGDREIRLIVVTDAEGILGIGDWGTQGVDISVGKLMIYTAAAGIDPASVLPVVIDAGTNRKELLEDHLYLGNHQERIYGDQYYSFVDQFVETAESIFPKLYLHWEDFGRSNAATILNNYKTKIPTFNDDIQGTGIVVLGGIFGSLDITGEKLTDQVYLCYGGGSAGAGIAGRVHAEMVSEGLSEEEAYKHFFMIDQQGLLFDDMEDLTPAQKPFAKKRADYKDAGDMTDLLNVVKTVKPTILVGTSTNPGAFTKEVVEAMCANTERPVIFPISNPTKKMETTAEQVIEWSDGKAFVATGVPSGTISYKGVDYQIGQANNSLIYPGLGLGMLASEAKLLTDEMIGAAAHSLSGLVDPGKPGAPVLPPFEFVADVSIKVAEAVAKKAQEQGLTESKETDMAKAVRDLKWYPEY

SEQ ID NO: 18396 - protein, 231 aa, Lactococcus lactis
MVNIYLVRHGKTMFNTIGRAQGWSDTPLTAAGEQGIIELGLGFKEKGIKFDRAYSSDSGRTIQTMGFILANSDNEGIPYTYDKRIREWCFGSFDGGYDGELFDGVLPRIFTETGNHHTDEFPPDEVIANAIFEVDTAGWAEPWEKLSGRIMDGFTDIAKESEAKGAKNIVIVSHGMTIGTFVKLAHPELPRPHGLDNGSVTHLSFEDGKFTIGKVGDMSYREIGSEKLAKK

SEQ ID NO: 18397 - protein, 722 aa, Lactococcus lactis
MSLKQLKDVTYFKLNNEINIPVNGSIPLAKDKEAITAFFKENVEPNRYEADTYIDKLNWLVKEEYLEAEFLEKYKPEFITNLRKELSKFEFHFDSFMAAYKFYNQYAMKNNDGSLYLEDFEDRVLMNALYMADGDEKLANNLAFAMINRRYQPATPTFLNAGRKRRGEFVSCFLLQLTDDMNSIGRTINSALQLSKNGGGVGLNLTNLRAAGAPIKGYDGVAAGVVPVMKLFEDAFSYANQLGQRQGAGVVYLSLFHPDIMEFLSTKKENADEKIRVKTLSLGVTVPDKFYELVKKGETMYLFEPYFVEKYYGKPFAEVDITAEYDKMVANPEIRKTSINARELEQELSKLQQESGYPYIVNVDTVNQANPVDGVISMSNLCSEILQVQTPSVLNDDQTYKVVGTDVACNLGSTNVLNMMTSSNEFGTSIEAMVRALTFISETSNLDTVPTVRKGNDEMHAIGLGAMGLHSFLAQNQIHYDSKEAVEFTSVYFMLLNYYTLVASNKLAVEKGSSFKNFEKSAYADGSYFDKYLTHDYFAAVSSKVQELFKGIAVPTIEDWTALRDTVKTSGLYNSYRMAVAPNGSISYINDCSSSIHPIVNRIEERQEKKVGKIYYPAAGLATETIPYYKSAYDTDMRAVIDVYAAATEHVDQGLSLTLFMRSTLPEGLYEWKVANNKMTTRDLSILRNYAYKKGIKTIYYIRTFTDDQEEVGANQCESCVI

SEQ ID NO: 18398 - protein, 605 aa, Lactococcus lactis
MCGIVGVVGSKNATDILMQGLEKLEYRGYDSAGIFVNGQETAAKLVKSVGRIADLRGKLGIDVSGTAGIGHTRWATHGKPTEDNAHPHTSTSGRFILVHNGVIENFVELKNEFLMNDTFKGQTDTEIAVHLIAKFAEEEGLSTLEAFKKALSLIQGSYAFALMDSEDAEVIYVAKNKSPLLIGLGEGYNMVCSDAMAMIRETSEFMEIHDKELVVLTKDNVTVMDYEGNVLSRESYTAELDLSDIGKGTYPFYMLKEIDEQPAVMRKLIATYANEDGTMKVDQDIIKGIQEADRIYIIAAGTSYHAGFGAKMMLESLTNTPVELGLASEWGYDMPLLSQKPFFIFLSQSGETADSRQVLVKVNELGLPSLTVTNVPGSTLSREATYTMLIGAGPEIAVASTKAYTGQIATLAFLAKAVGEAEGEVKAKEFDLVKELSLVAQSIEATLSEKDEIAAIVADLLPTTRNAFYIGRKQDYYVAMEASLKLKEISYIQCEGFAAGELKHGTISLIEKGTPVLALISNNEEVAAHTRGNVMETVARGASAITIVEEGVAREDDTIVVNQVHPYLSAISMVIPTQLIAYYASMQRGLDVDKPRNLAKAVTVE

SEQ ID NO: 18399 - protein, 635 aa, Lactococcus lactis
MILLQGNGIARTFGDDVLFENINFSLQDHSRIALVGRNGAGKSTLLKIIAGVEEASRGTVSKTKDLTMNYLAQDTGLNSSRTIFAEMLSVFDSLRQMEKQLRQMELQMGELAGDELTALMKRYDALSEEFRMKNGFTYESEIKSVLNGFRFDDAMWEREISSLSGGQKTRLALAKMLLERPQLLILDEPTNHLDIETLAWLENYLKNYEGSLLIVSHDRYFLDKVVNEVLELSRGELTRFSGNYSRYVEQREQKLLLELKNFEKQQKEIAKLEDYVARNLVRASTTKMAQSRRKKLEKMERLDAPTSDDKSANVTFTPEKTSGNVVLTVSEATVGYEDNRLSGPINIDERKGESLAIVGPNGVGKTTLIKSIVGQIPFLAGQAKLGANVTLGYYDQEQGRLTASNTVLDELWNEHRLLNEVEIRNMLGAFLFSGDDVKKTVGMLSGGEKARLLLAKLAMDHDNFLVLDEPTNHLDIDSREVLENALIDFPGTILFVSHDRYFINRVATKVLEIAPEGSTEFLGDYDYYVEKKEEVQAESNSSENGEPIESLAQQDFTAQKEAQKNRRKVEREIKACEEKLADLEAKIAALLLEMQENTADFVKLGELPAEIDLFNDEKDEIEMTLLEAMEELENL

SEQ ID NO: 18400 - protein, 758 aa, Lactococcus lactis
MNPLLQGMNEKQAEAVQTTEGPLLIMAGAGSGKTRVLTHRIAYLIDEKMVNPWNILAITFTNKAAKEMRERALSLTPRAQDTLIATFHSMCVRILRRDADHIGYNRNFTIIDPGDQKSLMKRILKEANLDPKKWEPKGLLNAISNAKNDLLDESAYEAQTSARHPYEMVVARVYKIYQKELRKAESMDFDDLIMQTLRLFDENPDVLSYYQGKFQYIHVDEYQDTNHAQYQLVKLLASRFQNICVVGDADQSIYGWRGADMQNILDFEKDYPKAKVVLLEENYRSTKTILDAANNVIKNNLKRRPKELWTQNDAGDKIVYFRAGNEQEEANKVSEIITSGIRSGRSYADYAVLYRTNAQSRTIEDSFVKSNIPYTMVAGTKFYSRKEIRDVIAYLNVVANPADNMSFERIVNEPKRGVGPGALEKLRRFADSRGLSLADSSFDIMLSDIRGKAAGEIYNLAMAFDLLRTHSESSTITELVEEMLERTGYVKALQMMPSIENQARIENIEEFLSVTKGFDEKSEIPLDEETGEPIVETGLDKLSRFLNEVSLLSETDAYEEESDQVTMMTLHAAKGLEFPIVFLIGMEENIFPLSRVNEDIDELEEERRLAYVGITRAEETLYLMNANQRVLYGKTNYNRPSRFISEIDDELLEYAGIARKANSSFNASYKSGGFASGISMSDALHQRKAVINPTAAQATINNSETEDWQIGDTAIHRKWGEGMVLGISGSGKNMELKINFPEVGMKRLLAAMAPIEKK

SEQ ID NO: 18401 - protein, 502 aa, Lactococcus lactis
MKIWTKLGLLTLVGLSLTSCGSNTKNTKGQSSSSQKVETSAGASKSNIYADPSTLSDKYDVIIVGSGGAGMTAAIEAKDAGMNPVILEKMPIAGGNTSKASAGLNASETSVEKAQGVADSNDKFYEETLKGGGGTNDKALLRYFVDHSAGAVDWLNTNGIVLDNLTTTGGMSVSRTHRPHDGSAVGGYLVKGLEENITKRNIPLFVNSDVTKITEKDGKVSGVKVKIEGETKDISSKAVVVTTGGFGANKKMIAKYRPDLKDYVTTNAAGSTGDGITMISELGGELVDMDKIQIHPTVFQKTGYLVSESIRGEGAILVNQKGKRFFNEMDTRDKVSAAELKQPGKYSYVIFGEGTKDKVKAVEQYISKDMVVEADSIKGLADKLDINEKALTSTIDGWNKAVSTKKDEDFGRTTGMTTEVSGKYYAIKVAPGIHHTMAGVKINTNTQVLKKDGSPIQGLYAAGEVTGGLHGGNRIGGNAVADIVIFGRQAGTQSAAYAKTSN

SEQ ID NO: 18402 - protein, 323 aa, Lactococcus lactis
MKINNKKVVIVGAGAVGSTYAHNLVVDDLADEIAIINTNKSKASANSLDLLHALPYLNAAPKNIYAADYSDVSDADIVVLSANAPSATFGKNPDRLQLLENKVEMIRDITRKTMDAGFDGIFLVASNPVDVLAQVVAEVSGLPKHRVIGTGTLLETSRMRQIVAEKLQINPKSIHGYVLAEHGKSSFAAWSNVTVGAIPLTTWLKKYPNPEFPTFDEIDQEIREVGLDIFMQKGNTSYGIAASLARLTRAIFRNESVILPVSAYLTGEYGQFDLYTGSPAIIDRTGVRAVLELELTQEEQEKFKASTVLLKENFDSIKEKCTL

SEQ ID NO: 18403 - protein, 252 aa, Lactococcus lactis
MSRKPIIAGNWKMNKTLSEAQAFVEAVKNNLPSSDNVESVIGAPALFLAPMAYLRQGSELKLAAENSYFENAGAFTGENSPAAIVDLGVEYIIIGHSERREYFHETDEDINKKAKAIFAAGATPILCCGETLETFEAGKTAEWVSGQIEAGLAGLSAEQVSNLVIAYEPIWAIGTGKTATNEIADETCGVVRSTVEKLYGKEVSEAVRIQYGGSVKPETIEGLMAKENIDGALVGGASLEADSFLALLEMYK

SEQ ID NO: 18404 - protein, 197 aa, Lactococcus lactis
MKLLEDRIHTDGQVLGQDILKVDRFLTHQVDYQLMKEIGKRFAQVYANAGVTKVVTIEASGIAPALYAAESLNVPMIFAKKAKNVTMNDDLLITEVYSFTKKLTSTVQISSKLIEEGDKVLIIDDFLANGQAALGLVHLMEQAKAEVVGLGMVIEKSFQDGRQKLLDQGMKLTSLARIEKFEDGKVIFAPADDKDFD

SEQ ID NO: 18405 - protein, 168 aa, Lactococcus lactis
MIIGIWAEDEAGLIGEADKMPWSLPAEQQHFKETTMNQVILMGRKTFEGMNKRVLPGRISIILTRDETYQSDNEKVLIMHSPKEVLDWYHKQNKDLFITGGAEILALFESELELLYRTVVHEKFKGDTYFPSTFDFGRFKLVSEKFHDKDERNSYTFTIKKYEKVKQP

SEQ ID NO: 18406 - protein, 427 aa, Lactococcus lactis
MSIEEALEWIHSRLKFNIRPGLSRVSALLELLGHPEESLSMIHVAGTNGKGSTVAFTRSIFMQAGLKVASFTSPFITTFGERMSINALPIADDKLIYYVEMIQPLVAELDKDAELTGITEFEIITAMAFKYFSDEQVDLAVIEVGLGGLLDSTNVIKPVVSGITTIGLDHIDILGSTIEEIAAQKAGIIKPGIPVVVGNIELKALRVIWEVARKNTARVYQFPYDYRTEVEEHEHFNFFSGQEAILDIEKSLVGLHQIENAGMAIELSLVYASKVGIELTEDVIRSGIREAFWPARMEKLGEKPLILLDGAHNVHAMNRLLENLSSEFPDKKITIIFSAITTKDISQMIKMLQTVKNSHLILTTFDYPKALNLGDFQRLEEEGVELAPSWELALVRAQKNLAEDDLLLVTGSLYFSSQVREFLKKEK

SEQ ID NO: 18407 - protein, 428 aa, Lactococcus lactis
MTVNIAILGFGTVGTGLPTLISENKEKLSKILDEEIVISKVLMRDEKAIEKARAQGYQYDFVLTLEEILADSEISIVVELMGRIEPAKTYITKVIKAGKNVVTANKDLLAVHGTELRALAEKHHVALYYEAAVAGGIPILRTLANSFSSDKITHLLGILNGTSNFMMTKMSEEAWTYDQSLAKAQELGYAESDPTNDVDGIDASYKLAILSEFAFGMTLSPDQISKSGLRTIQKTDVEIAQQFGYVLKLTGEINEVESGIFAEVSPTFLPKSHPLASVNGVMNAVFIESDGIGDSMFYGAGAGQKPTATSVLADIVRIVKREKDGTIGKSFNEYARPTSLANPHDIVNKYYFSVETPDSTGQLLRLVELFTSEDVSFEQVLQQKGDGHRAVVVIISHQINRVQLLAIQDKLKEEVDFKLLNYFKVLGD

SEQ ID NO: 18408 - protein, 360 aa, Lactococcus lactis
MSWQNNLRSVSPYIAGEQPELTDIIKLNTNENPYPPTSVAQLFNERYKTKNLRLYPSTDAKSLRKKLADYHHLEVEQVIIGNGSDEVLSLSFLTFFNSQSPLLMPDITYSFYPIYCELYRIPFQKVPVDDDFKVLIKDYCIENGGIVIANPDAPTALALNLKDIEEILKKNQNSIVLINEAYIDFGGETCLPLLKKYDNLVVVQTFSKSRSLAGIRLGVAYGSAEAISHLYDVKNSFNSYPIDSLAQIIGEASLMDEHYFQKNIQKIIKTREVFKDNLVNLGFEVTDSKANFVFVHHPKVKAEELFKALYEAKIIVRHWNQPRIDDWLRITIGTNKEMNKVIEFLKGYLKKNEEIDEWKK

SEQ ID NO: 18409 - protein, 431 aa, Lactococcus lactis
MLKQIDYQGKLEEIAEKFQGRKTELSKEVNKTVQQIVEDIQKSGDTALFNYAKKFDGYDVNTSNLLVTPMERETGLEQIDEDYFRILRRTKSQIEEFHKHQLGNSWNIFKENGVIMGQIARPLERVALYVPGGTAAYPSTVIMNAVPALLAGVKEIIMITPVKTDGKVNPNILAAAEVCGIETIYKVGGAQGVAAVAYGTESIPKVDKIVGPGNIFVATAKKICYGVVDIDMIAGPSEVLVIADETANPKYIAADLMAQAEHDKLASAILVTTSEKLVQQVDEELNRQVQNLERSEIIESYISNYGGAIVVKNIDEAFDVSNQLAPEHLEVLTSEPLTQLPKIKNAGSIFIGEYTPEPLGDYMSGSNHVLPTGGTAKFYSGLGVYNFIKYLTYSYYPKEVLAAFKEDVETFAKSEGLTAHANSISVRFDEM

SEQ ID NO: 18410 - protein, 200 aa, Lactococcus lactis
MTRISHITRNTKETQIELSINLDGTGQADISTGIGFLDHMLTLLTFHSDFDLKIIGHGDHETVGMDPHHLIEDVAIALGKCISEALGNKLGIRRYGSFTIPMDEALVTCDLDISGRPYLVFHADLSGNQKLGGYDTEMTEEFFRVLAFNAGITLHLNENYGQNTHHIIEGMFKSTARALKQAVSIDEAKVGEIPSSKGVL

SEQ ID NO: 18411 - protein, 259 aa, Lactococcus lactis
MLTKRIIPCLDIKNGKVVKGINFVSLREIGDSVELAKIYEEQCADEIVFLDITASFEEREIIGELIGRAARELSIPLTFGGGIRSIDDFRRILARGADKVSVNSAAIENPELIRQAANELGVQCVVVAIDAKKRADHRGYDVYIKGGRENAGLDLVDWAKKCERLGAGEILLTSMDKDGTKTGYDLEMLNDVCTAVNIPVVASGGCGKISDIVEVFQNTRSDAALVASLFHYGEATVDEVKDELIKNNIPARIIKKETL

SEQ ID NO: 18412 - protein, 212 aa, Lactococcus lactis
MRPDFHKQELIPVIVQDYQTNQVLMLAYTNEVAFEKMLETGETWFWSRSRQKLWHKGEESGHFQKIKGMRLDCDQDTLLVFVEQIGNACHTGTYSCFYDELIPFDDSDIFSELEKQIIDRKLHPVEKSYTNYLLGEGIDKVLKKVGEEASEVIIASKNSDKGELLGEIDDLLYHLFVLMNQQGISLEEVRQKAKERHQLEGNKKEFHTRTAD

SEQ ID NO: 18413 - protein, 320 aa, Lactococcus lactis
MSKKIVTLAGDGIGPEIMSAGLSVLKAVSKKIDFEYELEAKDFGGIAIDKHGHPLPEETLQAVKNADAILLAAIGHPKYNNAKVRPEQGLLALRKELGLYANVRPLKIYPALKKLSPIRNVENVDFLMIRELTGGIYFGQHELADDKARDVNDYSADEIRRILHFAFKSAQSRPRKLLTSVDKQNVLATSKLWRKMADEIADEYPDVRLEHQLVDSCAMLLITNPQQFDVIVTENLFGDILSDEASSLAGSLGVMPSSSHGFNGLALYEPIHGSAPDIAGKGIANPVSMILSIAMMLRESFGQEDGATMIEKAVTQTFTD

SEQ ID NO: 18414 - protein, 460 aa, Lactococcus lactis
MSGKTIFDKLWDQHVIAGNEGEPQLLYIDLHVIHEVTSPQAFQGLREAGRRVRRKDLTYGTLDHNVPTQDIFNIQDLISKKQIDTFTKNVKEFDVPAETHGGKGQGIVHMVAPESGRTQPGKTIVCGDSHTATNGAFGAIAFGIGTSEVEHVLATQTIWQVKPKRMKIEFQGHPQKGIYSKDFILALIAKYGVDAGVGYAVEYSGDAISDLSMEERMTICNMSIEFGAKIGLMNPDEKTYDYVKGREHAPKNFDEAVSKWEKLVSDSDAQYDKILSLDVSQLKPMVTWGTNPGMGLEFGEKFPEINNDLNYERAYQYMDLKPGQTASAIDLGYIFIGSCTNARLGDLEEAAKIIGDRHIADGLTGIVVPGSRPVKEAAEAQGLDKIFKEAGFEWREPGCSACLGMNPDQIPEYVHCASTSNRNFEGRQGHNARTHLCSPAMAAAAAIAGKFVDVRTLVTD

SEQ ID NO: 18415 - protein, 710 aa, Lactococcus lactis
MPTSTKSKTKTTTKKKTTRKRVTPGKNLVIVESPAKAKTIEKYLGRNYKVVASVGHIRDLKKSTMSVDIENDYEPQYINIRGKAPLINSLKKEAKAAKAVYLASDPDREGEAISWHLAHILNLPLEEKNRVVFNEITKDAVKNAFKEPRQIDVDLVDAQQARRVLDRLVGYSISPILWKKVKKGLSAGRVQSIALKLIVDRENEINAFIPEEYWSIDGEFKKGTKKFKASFWGIDGKKHPLKTNEDVIKVMERLDGPDFNVDKVEKKERRRNAPLPYTTSSMQQDAANKLNFRTRKTMMVAQQLYEGLTLGSQGHQGLITYMRTDSTRISPVAQSAAHNYIADQFGEKYSKHGSKVKNASGAQDAHEAIRPSNVFNTPDAIAKYLDKDQLKLYTLIWNRFVASQMVAAIFDTVKVNLSQNGVIFIANGSQVKFDGYLRIYNDSDKSNMLPEMEENETVKKANVKPEQHFTQPPARYSEATLIKTLEENGVGRPSTYAPTLETIQKRYYVRLSAKRFEPTELGEIVNKLIVEFFPNIVNTEFTAEMEKDLDEVEEGKRQWIEVVDQFYKPFAKELENAEEGMEKIQIKDEPAGFDCDVCGSPMVIKLGRFGKFYACSNFPDCRNTKAIVKEIGVKCPLCHEGNIIERKTKKNRIFYGCDRYPDCEFTSWDKPIGRDCPKSGHFLVEKKVRGGGKQVVCSNDECDYQEEKQK

SEQ ID NO: 18416 - protein, 280 aa, Lactococcus lactis
MIEQEKYTLNDGHLIPKIGLGTFQIRGYEGVEQILTAIQSGYRLLDTSTNYDSEGAVGEAIRRSGIPRSNFFVTTKLPGKYHHFEDALKMIEESLLRTGLSYFDLYLIHWPLPKRDNYVEAWKALIAAKKRGLVRSIGVSNFEEDHLDKIIQETGVIPAINQNEIHPYWPQEKLLKINKKYGILTEAWSPLGRGSKELEESLIQNIAQKYGKDTGQIILRWQVERGIIPIVKATSPEHQRRNIDIFDFSLSSEEINKITALKQENGRVDNQDPNEYEEFV

SEQ ID NO: 18417 - protein, 609 aa, Lactococcus lactis
MAFSKKTRQEAITKIQNEEMDLLVIGGGITGAGLTLQAAAAGMKVAVLEMQDFSEGTSSRSTKLVHGGIRYLKNFDVEVVSDTVSERAVVQGIAPHIPKPDPMLLPIYDDEGKTTFDMFSVKIAMDLYDRLAGVDEDSPYANYTISPEEVLRREPLIKKKGLQGAGVYLDYRNNDARLVIDNIKKAVEDGAQAISKMKVIDFIYTDGQISGIRARDLLTDQVIEVKAKLVINTSGPWVDKIRYLNFTRPIVPKMRPTKGVHLVVDAAKLPVPQPTYFDTGKHDKRMVFAIPRENKTYFGTTDTDYHGDFTDPKVTQEDVDYLLDVINFRYPEANITINDIEASWAGLRPLLGGNSGSDYNGGDNGAVSETSFNAVVEAVLRYKNKTATKAEVEHLLNNMESSLSEKGDAPSSVSRGSSLERESDGLITLAGGKITDYRKMAAGAMELICQLLEEDFGLKYEPIDSKKYQISGGEFDPTKVEEVVAENMKVGVAAGLTEEEAKYIADFYGMNALQVFAYASEMEAYEGLSLAESARLCYALEDEMILTPVDYLLRRTNHILFMREGVDAIKVHVVNAMADDLGWSAEEKAEQEKALEEALRESDLSDLKK

SEQ ID NO: 18418 - protein, 498 aa, Lactococcus lactis
MTETSYIMAIDQGTTSSRAIIFDKHGKHIGSSQKEFTQYFPKEGWVEHDANEIWNSVQSVIAGAFIESGIKPVQVAGIGITNQRETTIIWDKKTGKPIYHAIVWQSRQSADIANGLKEAGHEELFHKKTGLIVDSYFSATKIRWILDHVEGAQERAERGELLFGTIDTWLLWKLTDGDAHYTDYSNASRTMLYNIHELKWDEEILKILNIPASMLPEVKSNSEVYGVTKGFHFFGSEVPISGMAGDQQAALFGQMAFEPGMIKNTYGTGSFIVMNTGEKPHISKNNMLTTIGYGINGKVYYALEGSIFVAGSSIQWLRDGLKMLERASDSEEVALQSRSQDEVYVVPAFVGLGAPYWDQEARGAMFGLTRGTTKEDIVKATLQGIAYQVRDVVSTMKEDTGIDMSVLKVDGGAANNEYLMQFQADILNIPIQRAGDLETTALGAAFLAGLAVGFWKDLEELKESYEPGKIFQTQMQEERREELYAGWKKAVNATRAFK

SEQ ID NO: 18419 - protein, 340 aa, Lactococcus lactis
MTFKELSNKINIKDVRELNHLNDEQQEKKEKRDKELEAIIKGEDDRILLVIGPCSSDNEAAVLEYAHRLLKLQKEVEDKIFIVMRVYTAKPRTNGDGYKGLIHEPDADGHTDLINGIKMVRDLHYKVITETGLTTADEMLYPENLPLVDDLVSYYAVGARSVENQQHRFVASGIDAPTGMKNPTSGNLKVMFNGMYAAQQSQDFLFGNAEVETSGNPLAHAILRGGQDENGKNHPNYYTDNLLESIEIYEKMGLQNPFIVIDTNHDNSGKKYMEQIRIVRQTLVNRNWDEQIHKYVRGFMIESYLEDGRQDKPEVFGKSITDPCLGWDKTEELINEIYNS

SEQ ID NO: 18420 - protein, 759 aa, Lactococcus lactis
MTMKKSIIAFPRIGSNRELKFALEKYFRKEITEEELQTVAKEIRLENWKSQKEAGIDSPISNDFSFYDQTLDLSIALGAIPGSYKNLELSELDTLFALARGFQDEQNDVKARPMKKWFNTNYHYLVPEINKDTIIKANFSKLLNEYKEAKSAGFETRPTIIGPYTFLVLADYKSGATKDTVLSDVIVAFQTLLKELNQLGVEWLQIEEPALVLDQTEEEKKLFVSIYEELLKSKNNLNILLQTYFGDVRDSYKEIIKLDFDGIGLDFIEGRDSLALIQKYGFPKKKILFAGLVNGKNIWRNNYQKTLELLTALDEVADIVINTSCSLQHVPVTIKNETKLSKEILKHFSFATEKLNEIDEISDIYFNKNTSFLKKNVELFENERVRENSKLKQKLDKLTEKDFTRQPSLVERRASQSQSLNLPVLPTTTIGSFPQTAEVRKVRLQNKRGELRQADYDTFLEEKIKECLKLQEDIGLDVLVHGEFERNDMVEYFGEKLEGYVFTQKAWVQSYGTRCVKPPIVWTDVTRPEAMTVRWSAYAQSQTSKPVKGMLTGPVTILNWSFPREDISLKASTLQLALAVQEEVLDLEKAGIKIIQIDEAALREKLPLRKSDWYKEYLDWAIPAFRLVHSKVKPETQIHTHMCYSEFEDIIPSIDAMDADVISFEASRSELSIIDALKAHHFKTLVGPGVYDIHSPRIPSVKEIQNQLEKILDKLPIEQVWVNPDCGLKTRGNAETIPSLRHLVEATRVLRKEKVVYDK

SEQ ID NO: 18421 - protein, 910 aa, Lactococcus lactis
MKKIRKTLENTKRATTFVDNNEINARLEFAKTSTKEELFQKFKTSNKGLSEEQVEISREQYGDNTITRGKKTSLIKRLYQAFINPFTIILFVLALVSAFTDIILAAPGEKNPQGLIIITTMVLISGILRFVQETRSGNAAENLLKMITTTTNVHRLESGSQEIPIEEVLVGDIIHLSAGDMVPADLRIIQAKDLFISQASLTGESEPVEKLDLATDEKDDSITESVNLAFMGSNVISGSAYGVVIATGDATIFGEMAKSVTEDSTKTTFEKGVNSVSWVLIRFMLVMVPFVLLINGFTKGDWMEAALFALAVAVGLTPEMLPMIVTTCLAKGAVTMSKEKTIIKNLNSIQNLGSMNILCTDKTGTLTQDKVVLMRHLDIHGQENIRVLRHGFLNSYYQTGLKNLMDLAIIEGAEAKQDKNPELGGLSSKYTKVDEIPFDFERRRMSVVVKSNTNGATSKTQMITKGAAEEMLDICTLVEDKGNVVHLTPELRAYILKKVDELNEEGMRVILVAQKTNPSPIDTFSVQDESEMVLMGYLAFLDPPKESTAKAIKALNKYGVSVKILTGDNDKVTRSVCKQVGLPVDKTILGSDIDQLDDNELAKVAKEASVFAKLSPQQKARIVTTLRNSGNSVGYMGDGINDAAAMKSSDVGISVDSAVDIAKESADVILLEKDLMVLEKGIIEGRKTYANMIKYIKMTASSNFGNMFSVLIASAFLPFIPMLSIHILLLNLIYDFSCTAIPWDNVDEEYLVVPRKWDASSVSKFMLWIGPTSSVFDITTYLLMFFVICPATFGPFSSLVPGSVAYIGFIALFHTGWFVESMWTQTLVIHMIRTPKIPFLQSRASAPLTILTFMGIIGLTIIPFTSFGHSIGLMALPINFFPWLILTVVMYMMLVTIFKKIFVSKYGELL

SEQ ID NO: 18422 - protein, 608 aa, Lactococcus lactis
MEKSTDKMSVRESWQVFKFIFKFLLPFKKYFVWAFVFSVITTALASLMPFVLSVFMDSYLTPMKATDQIIFYFAGLYLILAIINSIAFFFKWNYLQNGSIFVNQYIRKKVYRKIHQLGMRYFDQKPTGWLITRITNDTDLFDFWQTLFNALTSLLSIIIAFIALFIIDHQIALVMLLILPLLILAVLIYQKVSTKVYQAMLAKRSELNTKLNEYISGMRIIQQFRQESRLGNEFEKTNDEYYGYRKRVIQINGILLSPLVNFLMAISIVVVLLMYSNRSLHAVVEAGLIYAFISNVQIYFNPISGLMDSLSNFSNGLVASSRIKTIMEEKEFAPQQGISTSVSKNVDEKFTDRKSVSNSPIIQEGKIEFRNVSFSYDGEHQVLKNISFIVNPGETLAFVGHTGSGKSSIINVFMRFYEFTEGQVLIDDQDIRSYSKEELRKKIGLVLQDSFMFVASVTDNIKMMNPQITDQAAKEAARFVQADKFIKDLENGYETKVIEGGAAFSAGERQLINFARTIVRNPKILLLDEATANIDTETEALIQEGLINMRQNRTTMAIAHRLSTIKDADQILVLNKGEIIERGNHDQLLELNGYYADMYRIQTLQKEL

SEQ ID NO: 18423 - protein, 605 aa, Lactococcus lactis
MKIFKDLWWFFKAERKGYGVGLLALFIVSLTHLIPPLIIGKIIDHIVKRNLTLPLILSFSGILLITALVEYGFRFLWSKNIWGEAFKLEKIIRSRLFRHFLRMDTLFYQRNRTGDLMAHATNDLQAIQSVAGLGVLTWADSLMTGGMTIIAMLLFIDWRLTIIAVLPLPLLALVSKVLGDKIHVSFEHAQETFSEMNDKVQESITGMKAIKSFGEEEQDMADFQVKLDNIDKAFIRVNWIDSMYDPLITLIVGLSYTLTILLGGYYVVHHVLTIGQLVAFMTYIGNLVWPMFAIGVLFNVIERGRASYSRVEKLLAQKAESKISEGTLKMPKEGQLLFDIESFTYPNENEGRNLEKVQFNLKEGHVLGLVGRTGAGKSTIIKLLMREFDHYKGHITFVDHDIMDYQLDEYLPAIGYVPQEHFLFSMSVRDNIRFAKMSASQEEVEIAAKTAGIHDDIIAFPEGYDTLVGERGVSLSGGQKQRLSIARALLIQPKLLILDDALSAVDAKTEQLILSNLKALRHESSTLVVSHRLSSVMEANEILVLDEGKVIERGLHEDLIKSGGWYAQMWQMQQIESHLTANDEDENLLTGSSVNREGEENGEIY

SEQ ID NO: 18424 - protein, 419 aa, Lactococcus lactis
MKTPFVTKEQLEQITKEFPTPFHLYDEKGIRQKARDLHKAFAWNKGFKEFFAVKATPTPAILKILHEEGCGVDCASYVELLLSEKCGFDGSEMMFSSNDTPAEEFQFANQLGATINLDAYEDIEFLKNLTDFIFPETMSLRYNPGGVFAMGTKIMDNPEESKFGMTKAQLIQGIKDLQKLGVKKFGMHSFLASNTVTNDYYPELANKLFKLALEIREETGITLDFINLSGGIGVNYRPDEEANDIAKIGQGVHEAYDEVLRANGIENLKIYTELGRFMLAPHGHLITKVLHIKETYRKYVGVDASAVNLMRPAFYDAYHHITVAGKEKDEATEIYDITGSLCENNDKFAKERAFPKIEIGDLLVIHDTGAHGFSMGYQYNAKLRSSEVLLQEDGKTRLIRRAEKPADYFATLDGFDFTI

SEQ ID NO: 18425 - protein, 457 aa, Lactococcus lactis
MYTVGDYLLDRLHELGIEEIFGVPGDYNLQFLDQIISRKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENPTSNTSDQEILNKIQESLKNAKKPIVITGHEIISFGLEKTVTQFISKTKLPITTLNFGKSSVDETLPSFLGIYNGKLSEPNLKEFVESADFILMLGVKLTDSSTGAFTHHLNENKMISLNINEGKIFNERIQNFDFESLISSLLDLSGIEYKGKYIDKKQEDFVPSNALLSQDRLWQAVENLTQSNETIVAEQGTSFFGASSIFLKPKSHFIGQPLWGSIGYTFPAALGSQIADKESRHLLFIGDGSLQLTVQERKLQVQVSQPSSSHMNSYS

SEQ ID NO: 18426 - protein, 270 aa, Lactococcus lactis
MAIILITGASSGIGYQTAELLAQNGHKVYGAARRMDKLEKLKSVGVEPIYLDITNEESCRKLVDTIIDNEGQIDILINNAGYGSYGAIEDVPLEEAKRQFEVNLFGLAALTKLVLPHMRHQKAGRIINISSMGGRFTTYFGAWYHATKYALEAFSDALRMEVKPFGIDVSLIEPGGIKTNWGLIAADHLAESAKGGTYEEAALKTATSMRKQYSGNMMSDPKIISKTISKAVSSKRMRARYLIGFGAKPLVFLHTILPTRIFDWLIMRAS

SEQ ID NO: 18427 - protein, 237 aa, Lactococcus lactis
MINTKNLNVFYNENKVLKDIQLEVIPGRITGIIGPNGAGKSTLIKAILNIVPHSGEILINGEVSKKQLKKIAYVEQKSDIDHTFPIKVKECVSLGTYTGLKLFQKLGAKEWSRVSEALQKVNLLDYENRQIGELSGGQFQRVLLARCLVQEADYIFLDEPFVGIDSISEKIIMDILQDLKHQGKTILIVHHDLSKVKEYFDDIIILNRELIAYGPINENFSQKNLKKAYGDNIFIGD

SEQ ID NO: 18428 - protein, 1046 aa, Lactococcus lactis
MKPIYLEMNYFGPHENSVVDFRLLDESPIFLISGDTGAGKSTIFDAMTYALFGTTTGDRDAKEMRSQFATADDRTSVTFYFKQGNLLYRIERSPEQKLSKKRGSGSTLQKSTAKLAIVDRVKGIEKNNIAINPKNVGEEITRLLHLNAEQFKKIILLPQNDFSRFLKSSTPDKEAILKRIFGTYIFTSFSNEIKAKNSEMNAVYLEYDRKQQNLYESSIWNPIELKELEDAAEQEKLDLVTSLWKDRVARKNEIEGQTFEQEEKVISIEIAYKSALELENQFKNLNNLENDYQQNIIEKSAIFEENSEYLKKLKWAFPLKESIHELEQDIKQSKSVKNNIAGIISEKAKDEILLKKLTNEKEDLNKQQENINENKKVAEKIFIQIQLSLQVEKKQSKVEELKLEQADNLTLLESFKANLGQAAENISTLQDDVISDDYFINKREERNQLELTFRGKLIPTFQKVKHSKDDIVGLELKLKENTIALSENKDNLEKAKFAYNEKLKGRRRLMIAQLQSELQEGEACPVCGALEHPFTETIEESSYKELGNLLKEIDESQKKQTVLLEKNKQLQQLKTELKTSLDLKKIEADEFEKELSILYSEFIADYSQIFPDSFDEVSIDESLLNLTKSLELEEVKNDETKVKLADLESKKLELQEKVKDFEYSNQEFNRQIENLNAEITEIGITETSYNLIRKRNRLMEKADLFEKHLSELMAQLSDIKIKISSQTASLNSFESQEATLLERISANKEKIKEKFSEQEAFTTEFQILKEWAYDDDLIQISQKVEQYKADKARLKVEIKNIQQLIQNKKRPNLALIEEEKKQTNENYVFLQKKLVSAENEVEQAKSILSELKKVIKQQDKDASKKSAITKLYNAISGRASEDKLRLETYVVQNYLEKILDYANLHFINQLSNNRYRFELAGEGNNRRMDHGLDINIYDNETGAARSADTLSGGETFIAALSIALALSEVVQNTANGVQIEALFIDEGFGSLDQETLQKAMQALEQIGENRLVGVISHVEEMKATIGQRIIINKMGDGRSNIKSVIK

SEQ ID NO: 18429 - protein, 325 aa, Lactococcus lactis
MADKQRKKVILVGDGAVGSSYAFALVNQGIAQELGIVDLFKEKTQGDAEDLSHALAFTSPKKIYSADYSDASDADLVVLTSGAPQKPGETRLDLVEKNLRITKDVVTKIVASGFKGIFLVAANPVDILTYATWKFSGFPKNRVVGSGTSLDTARFRQALAEKVDVDARSIHAYIMGEHGDSEFAVWSHANVAGVKLEQWFQENDYLNEAEIVELFESVRDAAYSIIAKKGATFYGVAVALARITKAILDDEHAVLPVSVFQDGQYGVSDCYLGQPAVVGAEGVVNPIHIPLNDAEMQKMEASGAQLKAIIDEAFAKEEFASAVKN

SEQ ID NO: 18430 - protein, 502 aa, Lactococcus lactis
MNKRVKIVSTLGPAVEIRGGKKFGESGYWGESLDVEASAKNIAALIEEGANVFRFNFSHGDHPEQGARMATVHRAEEIAGHKVGFLLDTKGPEMRTELFADGADAISVVTGDKFRVATKQGLKSTPELIALNVAGGLDIFDDVEIGQTILIDDGKLGLSLTGKDAATREFEVEAQNDGVIGKQKGVNIPNTKIPFPALAERDDADIRFGLSQPGGINFIAISFVRTANDVKEVRRICEETGNPHVQLLAKIENQQGIENLDEIIEAADGIMIARGDMGIEVPFEMVPVYQKLIISKVNKAGKIVVTATNMLESMTYNPRATRSEISDVFNAVIDGTDATMLSGESANGKYPRESVRTMATVNKNAQTMLKEYGRLHPERYDKSTVTEVVAASVKNAAEAMDIKLIVALTESGNTARLISKHRPNADILAITFDEKVERGLMINWGVIPTMTEKPSSTDDMFEVAEKVALASGLVESGDNIIIVAGVPVGTGRTNTMRIRTVK

SEQ ID NO: 18431 - protein, 340 aa, Lactococcus lactis
MKRIAVLTSGGDAPGMNAAIRAVVRKAISEGIEVYGINHGYAGMVAGDIFPLTSASVGDKIGRGGTFLYSARYPEFAQVEGQLAGIEQLKKFGIEGVVVIGGDGSYHGAMRLTEHGFPAVGLPGTIDNDIVGTDFTIGFDTAVSTVVDALDKIRDTSSSHNRTFVVEVMGRNAGDIALNAGIAAGADDICIPEKEFKFENVVNNINKGYEKGKNHHIIVLAEGVMTGEEFATKLKEAGYKGDLRVSVLGHIQRGGSPTARDRVLASRMGARAVELLRDGIGGVAVGIRNEELVESPILGTAEEGALFSLTTEGGIKVNNPHKAGLELYRLNSALNNLNLN

SEQ ID NO: 18432 - protein, 341 aa, Lactococcus lactis
MNPQKIAVLGPGSWGTALSQVLNDNGHEVRIWGNNPEQMAEINEKHTNTRYFKDVVLDEKIKAFDRLDLALEDVDAILFVVPTKVTRLVAKQVAEVLKHKVHILHASKGLEQGTHERISTILEEEIPAQLRGEIVVVSGPSHAEETIVRDITLISAASKDHDEAKYAQAIFSNDYFRLYTNTDVIGVETAGALKNIIAVGAGALHGLGFGDNAKAAIITRGLAEITRLGVAMGAEPLTYSGLSGVGDLIVTGTSIHSRNWRAGDALGRGEKLADIEKNMGMVIEGVSTTKAAFELAQQLGIDMPITETIYKVLYENLDAKTGILDIMRRETRAENEFINNK

SEQ ID NO: 18433 - protein, 313 aa, Lactococcus lactis
MKQNIIPTKARKVRKAVIPAAGLGTRFLPATKAIAKEMLPIVDKPTIQFIVEEALKSGIEDILIVTGKAKRPIEDHFDSNIELEQNLLEKGKTELLKLVEETTDINLHFIRQSHPKGLGHAVLQAKAFVGNEPFVVMLGDDLMNITGNETPLTKDLINDYEKTHASTIAVMKVPHDDVDKYGVIDPNGEVSKGLYNVERFVEKPNVDEAPSDLAIIGRYLLTPEIFDVLETQVPGAGNEIQLTDAIERLNKTQRVFAHEFTGKRYDVGDKLGFVETTIEYGLEHPQIGANLKNYIIEKAKELSQDDSKNITKK

SEQ ID NO: 18434 - protein, 319 aa, Lactococcus lactis
MDLKNNFWKDYPELEKELVQVQQLMKSHVTIKNSDVKSAIFDIFDAGGKMLRPAYLLLFSGFTDLSESERLALAASVEMMHTATLVHDDVIDHADTRRGVATLSAKYGPEIAVYAGDYLFIAVFRLMSEHSLELSNLTKNIGSIERLLGGELGQLNHHFNLQQTLDDYIENISGKTGELFALSASVAPLISKNNTLTKRAYKIGMNIGISFQIMDDYLDYASTAQTLGKPVLEDIKQGIYSAPVLFALQENNALVSELIKNEKFDEVYDFIKTSDALEKTKALAKSYTLSALNLIDKLPKGKNRELIAEITRKLLERTL

SEQ ID NO: 18435 - protein, 311 aa, Lactococcus lactis
MTENNRLSVKLPGLDLKNPIIPASGCFGFGEEYAKYYDLNKLGSIMVKATTLHPRFGNPTPRVAETASGMLNAIGLQNPGLEVIMAEKLPWLNENFPDLPIIANVAGSEEDDYVAVCAKIGDAPNVKVIELNISCPNVKHGGQAFGTDPDVAAALVKACKAVSKVPLYVKLSPNVTDIVPIAKAVEAAGADGLTMINTLMGVRFDLKTRKPVLANITGGLSGPAIKPVALKLIHQVAQVVDIPIIGMGGVESAQDVLEMYMAGASAVAVGTANFADPFVCPKIIEKLPEVMDQYGIDSLENLIQEVKNSKK

SEQ ID NO: 18436 - protein, 1064 aa, Lactococcus lactis
MPKRNDIKKIMIIGSGPIIIGQAAEFDYAGTQACLALKEEGYEVVLVNSNPATIMTDREIADTVYIEPITLEFVSKILRKERPDALLPTLGGQTGLNMAMELSKIGILEELNVELLGTKLSAIDQAEDRELFKELCERIGEPLCASDIATTVDEAVEIADKIGYPIIVRPAFTMGGTGGGICDTEEELREIVANGLKLSPVTQCLIEESIAGYKEIEYEVMRDSADNAIVVCNMENFDPVGVHTGDSIVFAPSQTLSDNEYQMLRDASLNIIRALKIEGGCNVQLALDPHSYEYRVIEVNPRVSRSSALASKATGYPIAKMSAKIAIGMTLDEIINPVTNKTYAMFEPALDYVVAKIARFPFDKFENGDRHLGTQMKATGEVMAIGRNIEESLLKAVRSLEIGVFHNDLQEAQDADDEILYEKMVKTQDDRLFYVSEAIRRGIPIEEIADLTKIDIFFLDKLLHIVEIEDQLKVNIFEPELLKTAKKNGFSDRQIAKLWNVSPEEVRRRRQENRTIPVYKMVDTCAAEFESSTPYFYSTYEWENESKRSSKEKIIVLGSGPIRIGQGVEFDYATVHCVKALQALGKEAIVINSNPETVSTDFSISDKLYFEPLTFEDVMNIIDLEQPEGVIVQFGGQTAINLAEPLSKAGVKILGTQVEDLDRAEDRDLFEKALQDLEIPQPPGATATNEEEAVANANKIGYPVLIRPSFVLGGRAMEIINNEKDLRDYMNRAVKASPEHPVLVDSYLQGRECEVDAICDGTEVLLPGIMEHIERAGVHSGDSMAVYPPQTFSQEIIDTIVDYTKRLAIGLNCIGMMNIQFVIFEEQVYVIEVNPRASRTVPFLSKVTNIPMAQLATQMILGKNLKDLGYTEGLAETPDMVHVKAPVFSFTKLAKVDSLLGPEMKSTGEAMGSDVTLEKALYKSFEAAKLHMADYGSVLFTVADEDKEETLALAKDFAEIGYSLVATQGTAAFFKENGLYVREVEKLAGGEDEEGTLVEDIRHGRVQAVVNTMGNTRASLTTATDGFRIRQEAISRGIPLFTSLDTVAAILKVMQSRSFTTKNI

SEQ ID NO: 18437 - protein, 878 aa, Lactococcus lactis
MQPYNQSVNEVLEETKSQFEGLSPKEVKNRQAKDGFNELKEKKKTSTWELFIDTLKDPMVIILLLVAFVQLFLGEFVESLVIFIVLMINSVVAVVQTKRAESSLDALRQMSAPSAKVLRNGEKTSIPARELVVGDIVSLEAGDFIPADGRLIDVQNLRVEEGMLTGESEPVEKFSDVIEGEVALGDRKNMVFSSSLVVYGRADFLVTAIAEQTEIGKIAQMLETAEAKQTPLQQKLEKFGKQLGWVILALCALIFAVQILRLFTTNQTADMQKAVLDSFMFAVAVAVAAIPEALSSVVTIVLSVGTNKMAKQHAIMRNLPAVETLGSTSVICTDKTGTLTQNKMTVVDSFLPTQGSKELTDLTQADQKLLLNAMVLCNDSSFSQEGQLLGDPTEVALIAYSDKIGYPYQDLREKSPRLAEFPFDSERKLMSTINDFEGQKTIFVKGGPDVLFNRCNQVFLDGKVQEFTPELKEKFQAQNEAFSQKALRVLAYAYKPVSDNKTELTLTDENDLILIGLSAMIDPPREAVYDSIAEAKKAGIKTIMITGDHKTTAQAIAKDIGLMNEGDMALTGQELDALTEDELRENLEKISVYARVSPENKIRIVRAWQNEHQVTAMTGDGVNDAPALKQANIGIAMGSGTDVAKDASSMILTDDNFVSIVSAVSIGRVVYDNIKKSISYLFSGNLGAIIAIVFALVVGWVNPFTALQLLFINLVNDSVPAIALGMEKAEPDVMEKAPRQLNEGIFANGLMRVILIRGSLIGIAAIISQYVGQKTSPEMGVAMAFTTLILARTLQTFAARSNSQNILKLGFTTNKYVLMAVTFCLALYSLTTLPFLREIFSIPAAFGWSQWIVAAGLAVIAVICMEILKSIKGVFEKH

SEQ ID NO: 18438 - protein, 408 aa, Lactococcus lactis
MPVKIKIEHLTKIFGKRIKTALTMVEKGEPKNEILKKTGATVGVYDTNFEINEGEIFVIMGLSGSGKSTLLRLLNRLIEPTSGKIFIDNQDVATLNKEDLLQVRRKTMSMVFQNFGLFPHRTILENTEYGLEVQNVPKEERRKRAEKALDNANLLDFKDQYPKQLSGGMQQRVGLARALANDPEILLMDEAFSALDPLIRREMQDELLELQAKFQKTIIFVSHDLNEALRIGDRIAIMKDGKIMQIGTGEEILTNPANDYVKTFVEDVDRAKVITAENIMIPALTTNIDVDGPSVALKKMKTEEVSSLMAVDKKRQFRGVVTSEQAIAARKNNQPLKDVMTTDVGTVSKEMLVRDILPIIYDAPTPLAVVDDNGFLKGVLIRGSVLEALADIPDEDEVEEIEKEEENK

SEQ ID NO: 18439 - protein, 1090 aa, Lactococcus lactis
MMKKQGRQLNILNGLFLKNTKEQEEKVLSAEIQKSQVDLKDKKETLPVRQREVELMLGRNSYSSGLRTYKQLLEKYLQHSEKYSVDLGEYKKAYLKLNSNLKDFNLLSQKIADKKQDYNSEMIKYEEVKKKYEQSLKEYQEITKEYENVINDRKAAQKKFEENSLALKNINDEVQNLIDKKSVKNDAFIEIKEKLAVEQEEFKAAESQLNGIVSVYELLKKNYQEKKATFEESRKKYHHANTIKNDWEMLIKDFEKTKSNKEKFEQNLQAIDDKVKATEEEANISNEIYNFVEPSLVAMTEKYKEHKKVYEAAAIAYNISKKGYDAEYAKFSELKENFQEINSLKNPSQTVIGYITRDMEAAKNRVDNLAKDFYPLEEKFNLQKNIFEQISTSYVLVKNLVDEKKGKSKVSNGTLTETLNAQKKITMVLEVLKSKYGLLNHQRGQSEEAFKVISQQYEELEKEFQKEQSSFSKIKEYYTAFETRYNSTKESYDIAKEKLAQSEENLEIVKKAYSDIAGLLRVATVNKESILEEYKNSEKEFNRLTDTKEGFEFEVQNNFTGLDETYQKGEQLCLNLTEQAKTWHDDYPQYSHSYKTILPEYTKVNSQLEKLSQQYEVVFNDYQNLNKSSEIVRTQYQQEMQRYNADQELYNQVSQEFNHCLDLRNVVLKKDNEFETALNNLNQFIFKNNTLTFPIGEATGSNFIDEFNIPEIEVSESSSKLTNKFELSQWTETYQNLYALVDSISKELKQALTEYQNQLSIFIKVGGKRVIDLGNSDIAYRGTNIESYLERLAINFKEWQSEYVKREQVFSLLVKNYRQYLEESVKLNENIARMSESKNGLQEIINAINSLPNYMDIYSTSYRNVELLASALGAEVSDLTHLRNIDELKEIINKVYFEHVLALIDENLENTINHFSEIRSSYDQSIINLRKQLDEMEKITGIPTRKVMIESSLPNDLDLKSYFTGALNENVKQLFSTIISSSSFINSVKKVNQFKRVQNLLSVNEGGNAIILPEVPIAFDKKELEFSLVIATIKNIDAPVKVEKLESAYVKPEKPENLADKPSYVEDIVEVEKIEKQHQKIDTEPLKALA

SEQ ID NO: 18440 - protein, 599 aa, Lactococcus lactis
MTVLDKVNDPTDIKALTPLELEELATNVRDAILNRVSQYPGGHLGPNLGVVEMTIALHKVFNSPVDKLIWDVSHQSYPHKVLTGRKEFFTDKDKFSGTTGYTDPEENEHDFIRVGHTSTSIATAMGYALARDVQGKKENIVAIIGDGALSGGLAFEGLDGAGTLNGNLIIIVNDNEMAITENHGGIYQHLADLRASKGTSANNLFKSFGLDYRYLEEGNDIQSLIVLFESVKDINRPIVLHIHIEKGHGYKPAVENKEGMHQVFAPFDIATGQPVNSSTNIVRSYNNVFLDFMEEKLAKGDNLIAINAAIPMFFGLSQFAKNHPKNYVDGGIAEQYTVTLGGAIAAAGTRAIIFQNATFLQRAYDQLNHDLALNKEPAIVIISNSQIGGTNDTHQGSFVYSQTSNIPNVIDLAATSEEDLFAMLNWAYNQHEHPVFIHLPEHTLENRPTKITDFSKPQYEVVKSGEKVAILGLGAMLEKAENVAEELEKSGFNPTVVNPFFANLLDVAALDKLSETHGLFVTIEDGTKDGGFGQKVATYLASKGIKTLVYGADTEFIDAVPKEELYNRYHIRPELMATDIIEATKESKGPNFFKKIFSK

SEQ ID NO: 18441 - protein, 475 aa, Lactococcus lactis
MELKFQENFLWGAATSGPQTEGRFKKQHDNVFDYDFDHYQERFWGGIGPDTASNFFNDFREDIKLMKAAGLKSIRTSIQWSRLIDDLEKNTVNEKAVDFYNAVINEFIAQGIRPMINLNHFDLPVELLKTYGGWESPHVVDLYAGFAAKCFAEFSDRVSDWFTFNEPMVVVECAYLLGFHYPDIVDGKKAVQVAYHLQLASSLAIEQYRKINKNPEGRIGIILNLTPSYPAAEKIEDLKAAEMADLWQNRLFLDASIKGEFPEELVSLLQEENVLWQSEAEDLKRIKENKVDLLGVNYYHPSRVQEPEYSSDSLAQDWRPDKYYASFNKRGVRMNADRGWEIHPQTIYEIAKRIQEDYGNISWFISENGMGVENEEHFKDEEGQIQDDYRIIFTTEHLFWLHKAIQEGSNCFGYHVWTPIDCWSWRNSYKNRYGLISLNIHTQVKTLKKSAYWYKNLTDSSLLQVPDSILEKYNQ

SEQ ID NO: 18442 - protein, 515 aa, Lactococcus lactis
MNNWWKKAVIYQIYPRSFKDSNDDGIGDINGIIEKLTYLEKLGVDGIWLSPIYQSPMVDNGYDISDYYKIDPLFGTMADFEALIEKAKQLNIRVIMDLVVNHTSDQHLWFKESKKSKNNPRRDFYIWRDQPIGEFKNWTYDSSTQQYYFHLFSPQQPDLNWENEEVRKEIHKMMNFWLAKGISGFRLDVIDLIGKKPEQEITVNGPKLHDYLKEMNLATFGKKDYLTVGEAWSSSPELAKLYSGPNRHELSMVFGFWHLLTSAGNGDKWKKLPLNVPKLKEAMTAWQKLTPNEAWNSLFLGNHDLPRIVSFWGDEGTYREKSAKAFAILFHLMRGTSFIYQGEELGMTNFPFENLSAINDVESHEYFTDRKKEGQSEEEIIKVLREMSRDNARTPMQWTSDEKAGFTKGKAWLSINPNTKIINADQAVSDSNSVFYTYQKLIKLRHQENWLIEGDFELLESADEIFAYLRKTTTRTFLVVANLSNSSQRFESSFVKKNEIISNDSFPDLLTDIEI

SEQ ID NO: 18443 - protein, 433 aa, Lactococcus lactis
MRKLSPTFIYFFGALGGLLFGYDTGVISGALLFIEKESWQVSSWAWMEGWITAAVLMGAVIGAVVIGPMSDRFGRKRLLLLSAVIFFVGALGSGLSNSAELLIISRVILGMAVGSASALVPTYLSELSPAKIRGGVSTMFQLMIMTGILLAYISNYALKGVSGNWHWMLGLATVPAALLFIGGLFLPESPRFLVRHDNEAGAREILGMINDDPNSIEAEISDIQLMAKEEKQGGLQELFGQMSRPVLIMAIGLAIFQQVMGCNTVLYFAPSIFVAVGFGASAALLAHIGIGIFNVIVTYIAMRVMDKVNRRWMLNFGAWGMGISLVLMSVGMILAENAHIGFGKYLAVIALTVYIAFFSATWGPVMWVMIGESFPLKIRGLGNSFGAAVNWAANWVVSLTFLPLLSFFGTGKIFLIYAACCFLSIWFTSKKSY

SEQ ID NO: 18444 - protein, 501 aa, Lactococcus lactis
MTYVLGIDLGTSSLKGILMDEVGNLITTKSAEYQIDTPKQGYSEQRPEYWIVALESVLTGLSVEISDFGQQLAGISFSGQMHSLVVLDDNNKPVYPAILWNDVRTSKQCQEITDRLGQRLLEITKNIALEGFTLPKILWLQENEPEVWSRVKKIMLPKDYLSLWLTGNIYTEFSDAAGTLLLDIEKKQWSEEITDAFNIDRRILPELIESTDRTGFVKAEIAERYKLTNEVKVFAGGADNAAAALGVGLINEEVGLISMGTSGVVSAYEPKIADYKGKLHFFNHTVPGACYSMGVTLAAGNSLNWYKETFGKGLSFNELLSEVYTVSPGSEGLLFTPYIVGERTPHFDSKIRGSFIGISAHHEQKHFSRAVLEGITFSLRDSKDIMEKTKNKKFKRLISVGGGAQNPDIMQMQADIFNSEMIRLTVEQGPGLGACMIAAFGCGLFDSLEAVTKAFVHYKEASFIPNPKNVARYEQIYQIWKQVYKNTSEISHQLVEFNDEG

SEQ ID NO: 18445 - protein, 180 aa, Lactococcus lactis
MHPHLKEVLFTREQIAERVKELAEVVSRDYEGKNPLVVGILKGSIMFTVDLLKELSIDAEVDFMDVTSYGYGISSSGEVRILKDLSTVAHGRDILIVEDIIDTGNTLLYLKKLLTGRQAHSVKIISLLDKPSGRKVDIDADYVGFEVPDAFIVGYGIDYAERYRQLPYIGIFNEEFLIKD

SEQ ID NO: 18446 - protein, 529 aa, Lactococcus lactis
MVKYLKEFKFENFMVFLLITIDIALAVLSSVFLANVLNSLIAKEMNQFFLWLAIDIILWMVDSFVQGARDVWKEIAIQKQLNAVRRDIIEPLTEISYSDFEKNSKEDYNSWLNNDTKLLYDNGFHQIYFVYTGIVAMLFSGIAIIFFHWVLLLTTLLVGALLFYFPKMFKQSVERDTEQVSELANDALATSTDYLRGYEVLYHNKQLGLMQERTMGKFNQLATANVKLIFTRAWMQYSLLGTSMLGQFLILAVAGFLIMNGQIGIGVVMSVGNLSGTVTNYSKSVANSLILLNATGKLLEKYGKITDESKVTDGEEVTAFESKLELKNLAVAFPDGQKIEYPEIVIEKGKKYAIIGDSGSGKSTLINLLVGNKQDYEGEILLDGKDYKGINRKSLPHFMSVIMQFPYLFKETVEENLTLGRKISPDIFDKSIRIACADDFVFNKLDTVYDKNLSGGQQERLSVARELMGSKPILVMDESTASVDKKTALAVEKNILENPDLTVIMITHHLYDETQSYLDEVIHLGQEIA

SEQ ID NO: 18447 - protein, 338 aa, Lactococcus lactis
MSENAYAKSGVDVEAGYEVVSRIKKHVAKTERLGVLGALGGFGGSFDLSVLDVKEPVLISGTDGVGTKLMLAIQADKHDTIGIDCVAMCVNDIIAAGAEPLYFLDYIATGKNIPEKLEQVVAGVAEGCLQAGAALIGGETAEMPGMYDEDDYDLAGFAVGVAEKSQLIDGEKDVEAGDVLLGLASSGIHSNGYSLVRKVFSDFDLNESLPELDQSLIDTLLTPTKIYVKELLPLIKQNKIKGIAHITGGGFHENLPRMFGNSLSAEIVEGSWNILPIFKALEKYGDIKHEEMYEIFNMGIGMVIAVAPENAEALKKVLNAFEIGKMVKRQDSAVVIKK

SEQ ID NO: 18448 - protein, 867 aa, Lactococcus lactis
MDIEKMTTTMQEALGSAQQIAQVRHHQVIEVPHLWRIFVQPNSFGANFYKDLGIDLDDYTNLIEKEIDKINSVEGSNITYGQNLSPDLFQIFTEADKIAQKMGDEYLSTEIILLALFELKQNPLTSYLVSHGLTKAKAQAAIEKLRGGDKVTSQNAEETYKALEKYGVDLVAQVKSGKQDPVIGRDEEIRDVIRVLSRKTKNNPVLIGEPGVGKTAIVEGLAQRIVRKDVPENLKDKTIFSLDMGALIAGAKYRGEFEERLKAVLNEVKKSDGQIILFIDELHTIVGAGKTEGSMDAGNLLKPMLARGELHLIGATTLDEYRKYMETDKALERRFQKVLVTEPTVEDTISILRGLKERFEIHHGVTIHDNALVAAATLSNRYITDRFLPDKAIDLVDEASATIRVEMNSLPTELDQANRRLMQLEIEEAALKKERDDASKKRLEIIRGEIAELREENNQLKAQWEAEKKEVGNISEKRNELEHARHELEEAQNEGNLEKAAALRYGKIPEIEKELKAIEEKAKSDDLSLVQESVTEEQITEVVGRMTGIPITKLVEGEREKLLHLPETLHQRVVGQDEAVEAVSDAIIRARAGIQDPNRPLGSFLFLGPTGVGKTELAKALAENLFDSEEHMVRIDMSEYMEKHSVSRLVGAPPGYVGYDEGGQLTEAVRRNPYTIILLDEIEKAHPDVFNILLQVLDDGRLTDSKGVLVDFKNTVLIMTSNVGSQYLLDNVGENGEISEETTENVMSQLRAHFKPEFLNRIDDTILFKPLALEDIKNIIVKMTSQLSHRLEEMDVQLELSEEVKVWIAENAYEPAYGARPLKRYLTKVIENPLAKLIIGGKIPPKSKVIVTLVENKIDFDIQTIAE

SEQ ID NO: 18449 - protein, 250 aa, Lactococcus lactis
MSNNIENKVVLITGASSGIGQATAELLAKKGAKIVLAARRENRLQELADKIKKAGGQAIYQVTDVTNPEESKKLVQYAKENFGKIDAIFLNAGIMPSSPLSALHVEEWENMVDINLKGVLNGLAAVLPEFTAQKSGHVITTSSVAGLKAYPNGGVYGATKWAVRELMEVLRMESAQEGTHIRTATIYPAAINTELLNTITDKDAAEGMTALYEQYGISPEAIARIVAFALEQPEDVNVSEFTVGPTTQPW

SEQ ID NO: 18450 - protein, 348 aa, Lactococcus lactis
MKSVYFVEKNKMQVREFPKAQLVKETDAIIKIVRACVCGSDLWWFRGISERQPGPVGHEAIGLIEEVGTGVKNFKVGDFVIVPFTHGCGHCPICLAGFEANCPNAKDGVNGGYQGEFYRAINTDGALVKIPGQPSDYSDDQLASLTALADVMPTGFHAAKAADVHEGDTVVVFGDGAVGLCAVISAKLLGAKRIIAMSRHEDRAALARDFGATDIIDERGEEAIQKIMSLTNGYGADAALECVGTKQAIESAFQAVRAGGRVGRVGVPHDVDYNEWIDSLFWKNIQLGGGVASVARWDKEILLEAVLSGEINPGRVFTAEFSLDEIQKAYEAMDQRTAIKSLLRISEV

SEQ ID NO: 18451 - protein, 311 aa, Lactococcus lactis
MLKTTFANAEFANPFMNASGVHCMTTEDLEELKASQAGAYITKSSTLEKREGNPLPRYVDLELGSINSMGLPNLGFDYYLDYVLKNQKEKAQEAPIFFSIAGMSAAENIAMLKKIQESNFSGITELNLSCPNVPGKPQLAYDFEATEKLLKEVFTFFTKPLGVKLPPYFDLVHFDIMAEILNQFPLTYVNSVNSIGNGLFIDSEAESVVIKPKDGFGGIGGAYIKPTALANVRAFYTRLKPEIKIIGTGGIETGQDAFEHLLCGATMLQIGTALHKEGPAIFDRIIKELEEIMDKKGYQSIADFHGKLKSL

SEQ ID NO: 18452 - protein, 623 aa, Lactococcus lactis
MADFIAQNLSKSVGEKMVFNKINFIIHDLDRIGLLGVNGTGKTTLLNVISGLSGFDGDRTPFDHPQNYKITYLTQEPDFNPKATILDTVLDDSLPQMRAIKNYEAALLDYENLAKLERAQSGMDALNAWQVEADVKTILTKLQLPDSATLIESLSGGQKRRVQLAQALVNDSDLLLLDEPTNHLDVETIAWLQNYLKNSRRTVLFVTHDRYFLDNVATRIFELEDAGLKEYQGNYQDYLAKKAEDEEREAAASHKAKQLYQSELTWIRKSPQARATKQQARIDRFEDLKDSMKTSKNLGDLELNIASSRLGKKVINFKNAAFSYPDRPIFKDFELIVQGHSRLGIVGDNGVGKSTLLNIIDGELALTDGILEIGETVKIGYFSQEIRGLDENKRMINFLEEVASAAHNSSGENISIVNLLEQFLFPRSSHGTLISKLSGGEKKRLYLLKILLLQPNVLLLDEPTNDLDIATLTVLENFLGSFPGAVLTVSHDRYFQDKVSNELLAFEDGQINHYFGAYSDYLAVKTEEKSADKAVSKIESPISTDKTENTDKTKLTYMEKKEWETIESQIAEIEERISQIDTEMNENGSNTELLLDLQKELDNKTKELEEKYERWEYLSERAD

SEQ ID NO: 18453 - protein, 358 aa, Lactococcus lactis
MNISEEVRPGANRYVSGQGILQDLESYLASFNKLAIITGEKSFQVFQDFYPKDLSYPVFHYDGSASIENGKKLAKEIGQSDGLLAIGGGRLIDTCKVVAQELNCELIIIPTLVSNCAPYTPVAALYHPDHTFDKVGYLNKVSYLTLVDYDFLLATPHDYFVAGIGDTLAKWYEMEGIVRQVSQEELSASVRLGFASAKEIFKILFADSKAALNDLAEQKVTPAFGRIVDTIIELSGTVGGFAGTYGRMSGAHALHNGLSLCSETHPILHGSKVAYGVLVQLAYTGDTSEIEKLLPFYKENHLPASLAEINLPFDLEKLQAVAKFAASPVESYRLIDSKVTDEKIISAIKALEALVSKK

SEQ ID NO: 18454 - protein, 260 aa, Lactococcus lactis
MKLNKIKVIVAGFRGKMGATAVQMILNAQNFELMALLGKKEEVSEAFGVPVFSRKEDLIGFDADIWLDLTAPEAAYKNTRFALENGFRPVVGTTGFTDDEVADLIKFSREKELGGLIAPNFALGAVLLMQFSKQAVKYFPDVEIIELHHDGKKDAPSGTAVKTAELMSEERLAHHQGAVDEKEALAGARGADLEGMRIHSVRLPGLVAHQEVIFGSKGEGLTLRHDSYDRSSFMTGIALGIRKVMTVSELKYGLEHFLDL

SEQ ID NO: 18455 - protein, 275 aa, Lactococcus lactis
MKDHYRIRLGIFEPDQKAKAVVQLVHGFGEYTSHYLYLINELVNAGFVCLMHDQRGHGVLAAANPKLQGRARAYESLISDVLEVRKIIGKKYPKLPVYLFGHSMGGNISLNVLLRNIENQKLYQKAVIESPWLALTNPPAVPLQRLAGFLGKISPKIRVRTGLKVEAISHRNDLVDLVTKDGIYHELLSLRLFSQIMEAGRFAQSQAGNLKIPTLLFCGESDQICSPVAIRSFANNAGKNLELIEIADGYHALHLDTEAENFIERTKDFFLKENF

SEQ ID NO: 18456 - protein, 314 aa, Lactococcus lactis
MDKKKGILLVALGTPRSCEADDVRDYLKEFLGDPLVIQKPRWLWLPILNGIILKVRPQKSAEMYKKIWTDEGSPLMIYTVAQAKQLQDMREDFDVRFAMTYGEPRIDKVIAEMKESGVEEITVLPLYPQYSLTTVEPVIQQVKKIDDKIKVIRDFHKVESYSDLLAESIREKWQANDYDKLVLSYHGIPLSYVTKKKDAYEEQCKETTRLVVSKLGLREEEYEHTYQSKFGPEKWLEPATIDRVAELPKENAKKVLICSPAFVADCLETLFELEIENKEVFVENGGETFDFVHPFNDSLDFTRVLSEVVDQNRL

SEQ ID NO: 18457 - protein, 410 aa, Lactococcus lactis
MRKKFYQMSPKERLDSLNLSEDTQEVLSEMALDTNILNNLIENQISEFELPMGLAQNFVINGKEYIVPMVTEEPSVIAAASNGAKIAESFTAKIDERLMRGQIVFYDVKKPEEIIKKISECKNEIFEQAKLSYPSIIKRGGGLREISSRLFSSEKFISVDFKVDVKDAMGANIINSILEGVAELFRGWFSEEKILFSILSNYATESLVKVSCEISVDALSKKTNGLEIAQKIAVASQYSKIDPYRASTHNKGIMNGINAVILATGNDTRAISAAIHAYAAKEGTYQGLAKWEVHAEKLFGELEIPLPVATVGGGVKVLPKAQAAMEILGITDARELAKVIAAVGLAQNLAALRALVSEGIQQGHMSLQARSLALSVGAKADEIAVISQQLRQEKVMNQEVARRLLNSLRN

SEQ ID NO: 18458 - protein, 379 aa, Lactococcus lactis
MKEIVIIDALRTPVGRYDGALAEYSAAELGTHVVSNLLSKHENIKSDVEQVIFGNVLQAGNGQNIARQIAIHSGLSNTVPASTINEVCGSGMKAVILAKQLLQLGEAEVVIAGGTESMSNAPIIKNRKTQEETLSMLNDGLVDAFSGISMGIIGETIAEQFDISRADQDAFAQNSQEKAVAASQAGIFKEEIVAIGEVGVDETPRPSSSLEKLATLRTAFKENGTVTAGNSSPVNDGASAVILATKDYAEKHGIPYLAELVDSTEVGIDPAIMGVSPIEAIKKLINRSELELSDIDLFEINEAFAASSLAVNRELGLNESQVNIYGGAIALGHAIGSSGSKILTTLSYALKREQKRYGIASLCIGGGLGLAVLLKNPNL

SEQ ID NO: 18459 - protein, 384 aa, Lactococcus lactis
MKVGIDKLGFFVPNTFVDMRDLANARNVDPAKFQIGIGQDEMAVNPATQDIITFAANAAASILTEEDKKAIDMIIVGTESSLDESKASAVVVHDLLGIQPFARSIEMKEACYATTAGLTLARDHVLLNPDTKVLVIASDIAKYGLNTGGEPTQGAGSVAMLITADPKILALNNDNVALTQDIYDFWRPFGQAYPSVDGKFSNETYIDAFAKIWKEYSHRTNLKFEDFAAIAFHTPYTKMGKKALLPMLESEKPANAEELMEQFEHGIVYNRRVGNLYTGSLYLSLISLLENSDKLSAGQRIGLFSYGSGTVAEFFSGELVEGYENHLLKIEHQSMLDARTRLSIPEYENMFNQYLDLNHNISFNDETDYSVSEVVDNHRKYKKR

SEQ ID NO: 18460 - protein, 1649 aa, Lactococcus lactis
MQRKYKFKLVTFIMLLSLLPTINFNGFSSESKKENVKINYLEKMLSSQGVSAATQTLINSQSVSPSGTTFNGNSVSQPNRTPLPQNSVEDAIMPNSFGWQQTIANLTLPTNQVTAVQNGTIIGSYPTTDAGVQQALYAMYSATNASTSDFGLYYGANTTLSNSLLKAVVSNPSATNMTFSTLKGHAKSLTWISNPADLLTSSNSSQPSGTNYTGTLPSNVYFGVPTIFRNVTVAASGDNIYAQGNAFATTNGSWITGAPNIYGGTDNSDISGNTNLYIGATGSIAGWNIYGGNASAATISGNTHVTIAQSSSTINSVTGGSASGTTISGNTNLDISGAIASQITNIYGAGIGTSNSPVNVNGNVTTYVNSTNGGARYQLYQGGTVYGNISGSIYNTLSGAGGWTGATSNINGAGGPASTFNGGSFQGNIGTSGAGNVISNSYNTSSFTTGQALFTGGNAGTGASYAQATNSTTAAQGILYANITNYIKSAFTTGTAGAVYGIVGGNGHDSLKISPSQWGLGSQTGLDSAVGVTDAKAYGQIPSTTVVSNAQKITSNAIYGDVYTWLQSGVMSTTSGGGANDWTGYSYGASSNGYLQGQSVLEAGTANADNSVGGAGVVYCSAMGGTAETTLAAQGTVAYGKTDTSSAINSGWDLWGGGGTVWTYRQAFLQNGNSYLIHNNDIARWTYGGQSNGSQVGNSYNILNGAIVDTLEGGGYTATTKWGNTTAQVNQGQVNWFLSGGSWGDLYNTGSATVNVYNGYINAITGGNYGQAGVETIAGDSTVNVYGGDFSGSPRTGTKQLCGGPFFNGASSILGNTALNVDLTGSTGSSFQLPSGTYLSGGAGYNNTVTHVGSGVNNSISVNISANAASGNVLNGAVIYGDGQSTGSNSTYTNVGTINMTINADGNTVGSVYATNYVAMPASGQRYNTNIKIGDGTTISGTITSGGSSDNLTDAIAVANNNKSAITLGNSTSHNPITINGSLINFNSAEITEKAVVNVAGSFKNGGGATAANHAATYSKHGSIQMDIDSTLGITSTSSVVSASQLVAYPNATLSTPYVQTSGLINLSDLDLSTNKGNLFWKPIGNPPTSISNTYNGAYWGTQAAFPILTFNGGDTSTKSGAVNISPNNFSGVDSAKNYAFLGDYTMSSLSTPSNPTWIGYVVPGQVRVYNTTGDADSGNWQHHLKSNVTTGNPVAGQTMQAWASVASDTDASSIKVMYVMGYSDSTTAPFSFTAKAPYYIKSRTATAFDGKVLNNYPSTNPNFDVNAGTTGATRNFSTRDYFVGNQQDGTNDQAIYGSYIVQNVATDNTTSLSAGNYILPNKGSAINASSLTQAQLQKIVGLKGVGVMTDITMSGDPLSSINNAGNTIQDPTTSDTNVKDKSYAEIPVSWTLGKSSTNSNIVVVPQAAVISSDSQTALNVYDASITSDDAHDLKDQKDLYGNWTYALAFKADGTIEEPVISSPSNLVTTLQTIQANNPIIDGDGNIRPVTYTYNGLSKDITLNLTFGSISLSTPNSYDFGTLDVSPKPLISWATSPASDVVVTDTRTGSALKPWYVSVAQTQDLKGLTNNNNLASYLFFKDSTGSKVITSDALQIYANTSPTTGTFKLNQNWNSTSGEGIQLNIPVDHQEKGTYEGELTWSLNNVPSN

SEQ ID NO: 18461 - protein, 357 aa, Lactococcus lactis
MSKRLLILEDGTIFEGESLGANLDVTGELVFNTGMTGYQESITDQSYNGQILTFTYPIVGNYGVNRDDYESIHPTCKAVVVHEAACRPSNWRMQMSFDEFLKAKNIPGITGVDTRAITKIVREHGTMKASLVQARDEVEHQMSQLQATVLPTNQVETSSTTTAYPSPNTGRKVVVVDFGLKHSILRELSKRECNLTVVPYNTSAQEILEMEPDGVMLTNGPGDPTDVPEAIEMIKEIQGKIPIFGICLGHQLFSLANGAKTYKMKFGHRGFNHAVREIATGRIDFTSQNHGYAVSSENLPEDLMITHVEINDDSVEGVRHKHFPAFSVQFHPDAAPGPHDASYLFDDFMDLMDNFKK

SEQ ID NO: 18462 - protein, 310 aa, Lactococcus lactis
MSVKNGLVQLENLTSMEKLSVDEVMGLIKRASAFKAGTAEFDLEKQTFASNLFFENSTRTHHSFHIAERKLGLDVLEFDAQASSISKGETLYDTVLTLDALGVDICVIRSGVEHYYEELVNSDNIHCAIVNGGDGSGQHPSQCLLDLMTIYEEFGKFEGLKIAISGDLTHSRVAKSNMMMLQKLGARLYFTGPAAWYSEEFDDYGHYANLDRILPELDVHMLLRVQHERHDSGESFSKEGYHNHFGLTEERAKMLKPTAIIMHPAPVNRGVEIADSLVESPQSRIVQQMSNGVYTRMAILEAILAGKKAK

SEQ ID NO: 18463 - protein, 173 aa, Lactococcus lactis
MARKEIIDEITMKRAITRITYEIIERNKELDKLVLIGIKTRGVYLAKRIQERLQQLEGLEIPFGELDTRPFRDDKQAQEDTTEIDIDITGKDVILVDDVLYTGRTIRAAIDGIVKLGRPARVQLAVLVDRGHRELPIRADYVGKNIPTGRDEEIIVQMSEHDGNDSILIKRED

SEQ ID NO: 18464 - protein, 413 aa, Lactococcus lactis [sequence omitted]

SEQ ID NO: 18465 - protein, 297 aa, Lactococcus lactis
MSAKETIEKLQNARIITALVTPFKENGQINFGAFPKLIEDLLANHTEGLILAGTTAESPTLTHDEELAIFAAVNKIVDGRIPLIAGVGTNDTRDSVEFVKEVAELGYIDAGLAVTPYYNKPSQEGIYQHFKAIATASDLPIILYNIPGRVVTEIQVETILRLAELENVIAIKECTNTDNLAYLIEKLPKDFLVYTGEDGLAFHTKALGGQGVISVASHILGQEFFEMFAEIDQGSIQKAAAIQRKILPKINALFSVTSPAPIKTVLNAKGYEVGGLRLPLVACTTEESKIILEKIGN

SEQ ID NO: 18466 - protein, 358 aa, Lactococcus lactis
MTQYNIAVVGVTGAVGTRMLEQLEESTLPIETVRALASKRSAGKIVEFKGQELVVEELTEDSFENIDIALFSAGGSVSEKYAPYAVKAGAVVVDNTSFFRQNPNVPLVVPEVNAHALEKHNGIIACPNCSTIQMMVALEPIRQAYGLERVIVSTYQAVSGAGQSAINETNRELQEALDGKALTELSAEILPSAGDKKHYPIAYNALAQIDVFTDNDYTYEEMKMTNETKKIMEDDSIAVSATCVRIPVLYGHSESVYVETKKVADIAEVKRLISEFPGAVLEDDVAHQIYPQAINSVGRRETFVGRIRRDLDAANGIHLWVVSDNLLKGAAWNSVQIAETLHERGLVRPTHELKFELK

SEQ ID NO: 18467 - protein, 316 aa, Lactococcus lactis
MTEFITLGEPLVVLASENQDISLDVAEHFSKYLAGAELNVAIGLSRLGHKGIYLSKVGEDSFGNFIIESVKKAEIETTYLTKDKNYSTGFYLKQKVSEGDPKVDYYRKNSAAANLSIAELKALDLSGIKIAHLSGIFPALSETSLKTFQAFNQKLNEADILTIFDPNLRPVLWDNQEKMIRTINDLAKQSQIILPGINEGEILTGSSEPEKIANFYLEQSPLTKIVVVKLGADGAFVKLKNGEQYFVSGFKVAKVVDTVGAGDGFAVGLESALLEGKTLKEAVKRACAVGALAVQSSGDSEGYPTKEELKAFYKEM

SEQ ID NO: 18468 - protein, 300 aa, Lactococcus lactis
MTKVSVIGSISMDLVTRTNRVPNAGETVFGEDFAMVPGGKGANQAVAFARLSPNEVSMIGAVGKDAFGESILQNFKENAVLFENVGTVPQTTGIAQITLYDDDNRIIIIPGANNEVLPSYLADLWEKIKESQLVILQNEIPHETNLAIAKFCKENAIKVLYNPAPARKTDLEMIDFVDYITPNEHECKELFPNLALEEILKKYSNRLIVTLGSEGVIFHDGETLQKIPAIKAKVVDTTGAGDTFNGAFAFGLTENLSISDSIRLAVVASHLSIQKFGAQGGMPKLSEVKAKLKELEINLY

SEQ ID NO: 18469 - protein, 431 aa, Lactococcus lactis
MVISRYSRPEMAEIWSEENKYKAWLEVEILADEAWAELGEIPAADVKKIRENATFNVERILEIEKETRHDVVAFTRSVSESLGEERKWVHYGLTSTDVVDTAYGYLYKQANDILRNDLKNFAEIVKNKALEHKYTVMMGRTHGVHAEPTTFGLKLATWYSEMKRNIERFERAAKAVEAGKISGAVGTFANIPPFVEAYVCEKLGTRPQEISTQVLPRDLHAEYFQTLALIATSIERMATEIRGLQKSEQREVEEFFAKGQKGSSAMPHKRNPIGSENMTGLARVIRGHAITALEDVSLWHERDISHSSAERIIAPDTTELLDYMLNRFGNIVKNLTVFPENMKRNMDATFGLIYSQHVMLMLIEKGMTREAAYDLVQPLTAKSWDEQVMFRPLLEENEQIRQYLNDEDIDKAFDYNYHLTRVDEIFERVFD

SEQ ID NO: 18470 - protein, 226 aa, Lactococcus lactis
MRKTKIVVPIMLTELAELEKVSVSDYRTADIVEWRADFLSADEILEMAPKFFEKFKESKILFTLRTVREGGNIQVSEKKYLQILKEILTYNPAYIDVEFFTHGPSFAALKDFRDKMVLSYHNFDEVPSDLTNRLIKMHEEGTAFVKVAVMPERECDVLDLLQITRDMTLEYGDHFISMAMGDLGRLSRISGYLTGSCWTFASLENSSAPGQISLKETEYILDILEK

SEQ ID NO: 18471 - protein, 477 aa, Lactococcus lactis
MPFSKDFLWGGATAANQCEGGYNQGGRGLANVDLVPHGKDRFPIITGEMKHLEFDEEHFYPAKEAIDMYHHWKEDLALFAEMGFKTYRMSIAWTRIFPKGDEQEPNEEGLQFYEDIFRECQRLGIEPLVTITHFDCPVHLIKEYGGWRNRKMVGFYENLARAIFTRYKGLVRYWLTFNEINMLLHAPFMGAGLVFEEGENKEQAKYLAAHHELLASALATKIGHEVDPENKIGCMLAAGDYYPFDCNPENVFEAQKQNHDNLFFIDVQSRGKYPNYLLKRLEREEITLPIEKGDLEILAENTVDFISFSYYASRVAKVKDEDADKSAGNIFESVKNPYLEASEWGWQIDPLGLRITMNSIYDRYQKPLFIVENGLGAVDKPDENGFVADDYRIDYMAAHIKEMKKAVELDGVELLGYTSWGCIDLVSAGTGEMSKRYGFIYVDRDDYGKGSLKRTPKKSFNWYKKVIASNGEDLTNE

SEQ ID NO: 18472 - protein, 580 aa, Lactococcus lactis
MSVLEKIDSPADLKKVSNQELEELASEIRTAVLHKVSNIGGHVGPNLGVTELTIALHKVFNSPIDKFIWDVSHQTYPHKILTGRKNGFTDGHFHDITPYTSQRESEHDFFTVGHTSTSIANALGYAKARDLTNDKGNIVAVIGDGSLSGGLAMEALNNAGDFKGNLIILVNDNQMSIAENHGGLYRNLAELRATNGQAENNFFKTFGLDYKYLENGNDIESLIHLFEEVKDIDHPIVLHIHTEKGRGYQPALENKEAFHWHMPFDLETGQSKVIDSGKSYSSVMLDYMDKKVSEGLPLVAINAAIPGIFGLKQFAAKYPDRYIDAGIAEQFTITFGGAMAAAGARPIIFHNSTFVQRAYDQFWHDLAINEEPAIVIVKGGVISGSDETHQGSSAMTWISNIPNIKYLAPTSEEEFISILDWALEQHEEPVVIQMPEHGLESRPTVLTDYSTPSYQMTKSGEKVALLALGGLYSHGEKVAKVLAENGINATLINPLFINDLDQAFLENLVENHQVIATIEDGILDGGFGQKVASFLGKYDVKVLNFGAKREFNDSVPVTELYNRYHLTPELMVADILSLLK

SEQ ID NO: 18473 - protein, 545 aa, Lactococcus lactis
MKKIKTNDFHKMVGYQIYPKSFKDTNGDGIGDINGIIEKIPYLRELGIDFIWINPIYKSPQVDGGYDISDYQVIDEMFGSLEDFKKLLDKAHENGLKVIMDLVVNHTSDQHPWFLESQKSKDNPYRDYYLWEDASPNQMPNDWISFFGDSTWAYDEKTKQAYFHVFAKEQPDLNWKNPKVRQEIYDMIRWWLDLGIDGFRLDAISHIQKMPWNYKIKSWKGDGPWVPFMNVAGIETYMSDLKAIFDEYGALTVGEASGVRSKQAPDWTDEAGYINMIFELEHNVRKSNGNGQGSIYGYKKVIMRWQEDLLERGWNALYIENHDQPRSIDTFGDGSIESAKALAVSYMLLRGTPFIYQGQEFGMTNFPFTDAKQLRADEIKKKYEMLMTELSANQALAEVTQNSREHSRTPMQWDNSKNAGFTSGQAWMEINPNFSVISSRTNQELIELYKKLIELRHQEPAISEGSIKFHFKRHPQVLVYERAEFLIIVNLADKKAHLDFTKIDSFTDSSAESSVINYQQVLGSSNQKFQEKMVLSAWEYRVYKK

SEQ ID NO: 18474 - protein, 524 aa, Lactococcus lactis
MKNKLLLLLVTLLATCALSACQKANSKDSSVKKAAVSQKVDRSLYRNFYEIFTSSFADSNHDGEGDLNGVTQHLDYLNTGKSNSTTDLKVQGLWMTPIFASPSYHGYDVTNYEEINPKFGTMADFENLIAQAKKRGIAVILDMPFNHTATDNIWFQKALSGDKKYVDYYNWSDTAEEGYSLASNGKYYESEFDKSMPDLNLANPEVKKEIAKITKLWLDKGVSGFRLDAVGFYFSNDDKKTTAFTKWLTDTVKKQNPKAYLVGEVFSTASAIDDIYQSGIDSLFDFPNALQSSSSPINSALVLGEGSLFGQQIEAWDQEIHADNPKAIDAPFLSNHDTDRSATLLSSLSMQKMAAQTYLLMPGNPFIYYGEELGLTGSGIDQNKRLPMPWNAAGTDSPKADISVPGATEIATTDGGSVAQQEANPNSLLNWYKKILRVKAKYPEIATDRLKNISVSEESLSVINYGKDLTIINNFSDTENVTMKLPKSVVGTKITDQLSVSSSQAKLTDGKLTIPAYSTVILKK

SEQ ID NO: 18475 - protein, 541 aa, Lactococcus lactis
MNSHLNGVVNMKENWWQKTVVYQIYPRSFMDANGDGVGDLQGIISKLDYLEKLGIGAIWLSPVYQSPMDDNGYDISDYQAIADVFGTMADMDELLMEAKKRNIQIVMDLVVNHTSDEHKWFVEARKSKDNAYRDYYIWADEPNGLQSTFSGSAWEFDEESGQYFLHLFSKRQPDLNWGNPQVHQEVYDMMNFWIDKGIGGFRMDVIDLIGKEIDQEITGNGPKLHEYLHEMNQATFGQKNLLTVGETWGATPEIAELYSDPKRQELSMVFQFEHITNAYLDEGEKWDKKEFSVSKLKEILAKWQALEKGWNSLFWNNHDLPRIVSNWGNDGKYRLKSAKTFAILLHLMKGTPYIYQGEELGMTNYSFELIEEVNDIESRNMFAERLAAGHSENEIMDSIRRVGRDNARTPMQWTAGENAGFTDGKPWLAVNPNHEEINADQAMSDPDSVFYTYQKLIELRKQHDWVIYGDFKLIDSEADVFAYLRTYKGKKYLVVANLSDEENQFKTGFVCRDLLIHNENFLPELSQIKLKAWEAFACEVE

SEQ ID NO: 18476 - protein, 584 aa, Lactococcus lactis
MNKAAIYHRPESEFAYLYAKNLMHVRLQTQKSDVEKVELFYGDPYSWEGLDNPETQYWASQKVEMKKYLSTNISDYFEAEITVATKRVDYLFVITGLDGEKVVYTDQGMFDYDESLVTKKYGAFRLPYFHESDRFKAPEWVKETVWYQIFPERFANGDTSNDPEGTKAWNPQDVPDRQDFYGGDLQGVIDHLEHLTELGVNGIYFTPIFQAFSNHKYDTEDYMEIDKQFGDKELFKTLVKEAHARGIKVMLDAVFNHIGDTSAQWQDVLKNQEKSKFADWFHVNSWPATYTPTDDFENAENATYDTFAFTPHMPKLNTANPEVEAYLLKVADYWISEFDIDAWRLDVADEVDHTFWKKFRTTCDAAKDDFYILGEVWHSAQPWLVGDEFSAVMNYAYTDAIKDGLITKKISLEQMVSNINTQLTLYRKQVNQMMFNVLDSHDTPRILTVAKNNKNLMKLVETFTFMQPGVPCIYYGDEYAVTGGMDPECRKVMPWEEKDQDLEMFDFFKNLIALRKQYQGILSDSEVEWKIVDSENGIVKFERGSLKAIFNIGEKPAYFSADEVVFSNLVDQNNILQYGFVIYK

SEQ ID NO: 18477 - protein, 315 aa, Lactococcus lactis
MAKRIVVALGGNAILTSDPTAQAQSMALNKTAEQLMPLIKDNDVEMVVTHGNGPQVGNLLLQQLESNSVKNPAMPLDTAVAMTQGQIGYWMAQAFTEALANNGMSDVPFVSIVTRTVVDANDEAFKNPTKPIGPFYSQEEAKNIQTQYPDWKLIEDSGRGYRRVVPSPLPLKIVEANAIKPLLESSALVTVSGGGGIPVIEKNKGYQGVEAVIDKDFTAAKLAELVDADELVIFTSVGNVFLNFGKPNQKALGVVPVSEMRQYLEEGYFAAGSMKPKVAAAVAFVENTGKHATITSLENVENFVKSGAGTRIVPD

SEQ ID NO: 18478 - protein, 340 aa, Lactococcus lactis [sequence omitted]

SEQ ID NO: 18479 - protein, 253 aa, Lactococcus lactis
MEKEAVLTVSDLSLYYSKKKALNTINMTFYKNEITALIGPSGCGKSTLLRSINRMNDLIPTVTITGAIDYKGKNIYSPKVDTVDLRKEIGMVFQQPNPFPFSIYENVVYGLRLKGVKDKALLDEVVENSLKAANIWDEVKDILHSSALGLSGGQQQRVCIARILAVNPEIILMDEPTSALDPISAARVEETMLELKKDYTIAIVTHSMQQASRISDRTAFMLDGNLIEYNDTKSIFLNPEKQETSDYISGKFG

SEQ ID NO: 18480 - protein, 197 aa, Lactococcus lactis
MRIYFVRHGKTEWNLARRLQGQKGDSPLLPESYEAIERVHKFLEPIEFDKVLSSPQKRALITADLLTNQSVSTDKRLSEWNFGELEGWFISDAIAKYPKEMHDSRFELDQFDGSVFGAESVSSVLNRFDSLAQDLLNSKMDNVLLVGHGASGTAGMRHLAGFPIAELRSVGGLANNTVTVLESNAGHFDLKIWDKQL

SEQ ID NO: 18481 - protein, 162 aa, Lactococcus lactis
MSIILIGFMGAGKSTVAKLLTENFTDLDQLIEEEIEMTIAEFFELFGEADFRKIENEVFELALQKNIIIATGGGIIENPKNLEALDREAGVVFLTADFETLWERISMDLQNVRPLAQDKKAAQLLFEKRKNDYAKVADLTIDVTDKSPEQIVEEIREKWGIN

SEQ ID NO: 18482 - protein, 430 aa, Lactococcus lactis
MKLKINSQGLKGRLKVPGDKSISHRSIMFGSIAKGKTVIYDILRGEDVLSTIEAFRAMGVEIEDKGEVITVHGKGISELKAPEKALDMGNSGTSTRLLSGILAGLPFETTLFGDDSLSKRPMDRVATPLQLMGAEITGQTDKVKLPMTIKGSTHLKAIDYVLPVASAQVKSAVIFAALQAEGLTKVVEKEKTRSHTEEMLVQFGGELKVSDKTILVPGGQKLVGQKVVVPGDISSAAFWLVAALVVENSELILENVGVNETRTGIIEVIQAMGGQLEILEQDNVAKAATLKVKASQLKGTEISGDLIPRLIDELPIIALLATQAQGQTIIRDAAELKVKETDRIAVVANALNSMGAKIQPTDDGMIIQGGTKLHAPENSINTLGDHRIGMMAAIAALLVKNGEIELERAEAIQTSYPSFFDDLEQLSENI

SEQ ID NO: 18483 - protein, 388 aa, Lactococcus lactis
MRYFTAGESHGPRLTAIIEGVPAGLSLSAEDINIELKRRQGGYGRGGRMKIESDQVEITSGVRHGKTIGSPITLNVTNRDFKNWEQIMAAQDVEDKIKKQRRLTKPRPGHADLVGGMKYEFEDLRNVLERSSARETTMRVAVGAVAKKLLHELEIEIANHVVNFGGREITSPENLSVQDIRQTAGLSDLSIFDESQAEELRNYIDQIKKAGDTIGGIIETRVEGVPAGLGSYVQYDRKLDAKIAAAVVSINAFKGVEFGLGFEAGKRPGSQVMDEIIWSEDKGYTRSSNQLGGFEGGMTNGEQVIVRGVMKPIPTLYKPLMSIDIESHEPYKASVERSDPTALPAAGVVMENVVATVVAQEICDKFDSDTMNELRDAVASYKKRLSEY

SEQ ID NO: 18484 - protein, 356 aa, Lactococcus lactis
MKLNVNLPEHPYDVIIENGALANIGTWVSSLWKKQKIVLISDNHVNGLYGQKVVDQLEKVGFEVATFEFPEGEASKNLLTAENAWNFCAEFGLTRSDGIIALGGGVTGDLAGFVASTYMRGIHFLQIPTSLTAQVDSSIGGKTGINSKMAKNMIGTFTQPDGVLIDPEVLQTLGQREFREGLGEVIKCALIADKDLWNLLTDLSADDLVKKLDKIEEIIYRSCEVKRKVVVDDELDNGVRLYLNFGHTIGHAVENTAGYGKVMHGEAVAIGMVQISKIAELKGLMPKGITDQIRKMVKKFGLPDEYQPWDEELLFKALTHDKKARGRIIKTVIVPEIGTAKINEVTFEEMKDYLKK

SEQ ID NO: 18485 - protein, 286 aa, Lactococcus lactis
MNINGYTRMAAVVANPIKHSLSPFIHNLAFDLTNENGVYLAWEVEAEKLPAIVDNVRTLDMYGLNISMPYKTEITPFMDELSPAAELIGAVNTVVNQSGKLIGHNTDGIGFFNSLEKYHFNIQNKQMLILGGGGAAIAIIAQAALSGAKKIVVAARKSASYIPLKEKLEKLSVKTGIEILLTDLSEADRLQKELKQTDLLVNATSVGMDGESLPLEKSLVLPEKLLVVDAIYKVRETPFLRWAKGQGAQTENGLGMLIGQAAESFYLWTGKKMPVAEITLEMEKEA

SEQ ID NO: 18486 - protein, 469 aa, Lactococcus lactis
MSSGKITQIIGPVVDVEFGSDAKLPEINNALIVYKDVNGLKTKITLEVALELGDGAVRTIAMESTDGLTRGLEVLDTGKAVSVPVGEATLGRVFNVLGDVIDGGEEFAADAERNPIHKKAPTFDELSTANEVLVTGIKVVDLLAPYLKGGKVGLFGGAGVGKTVLIQELIHNIAQEHGGISVFTGVGERTREGNDLYWEMKESGVIEKTAMVFGQMNEPPGARMRVALTGLTIAEYFRDVQGQDVLLFIDNIFRFTQAGSEVSALLGRMPSAVGYQPTLATEMGQLQERITSTKKGSVTSIQAIYVPADDYTDPAPATAFAHLDATTNLERRLTQMGIYPAVDPLASSSRALTPEIVGEEHYEVAMEVQRVLQRYKELQDIIAILGMDELSDDEKILVGRARRIQFFLSQNFHVAEQFTGQPGSYVPIDKTVHDFKEILEGKYDEVPEDAFRGVGPIEDVLEKAKSMGY

SEQ ID NO: 18487 - protein, 289 aa, Lactococcus lactis
MGASLNEIKTKIASTKKTSQITGAMQMVSAAKLQKAESHAKAFQIYAEKVRKITTDLVSSDKEPAKNPMMIKREVKKTGYLVITSDRGLVGGYNSNILKSVMNTIRKRHANESEYTILALGGTGADFFKARNVKVSYVLRGLSDQPTFEEVRAIVTEAVTEYQAEEFDELYVCYNHHVNSLVSDARMEKMLPISFEESGQQKPSLETFELEPDRETILNQLLPQYAESMIYGSIVDAKTAEHAAGMTAMRTATDNAHSVINDLTIQYNRARQASITQEITEIVAGASAL

SEQ ID NO: 18488 - protein, 500 aa, Lactococcus lactis
MAIKANEISSLIKKQIENFTPDFEVAETGVVTYVGDGIARAYGLENAMSGELVEFSNGVLGMAQNLDATDVGIIVLGDFLSIREGDTVKRTGKIMEIQVGEELIGRVVNPLGQPVDGLGELNTGKTRPVEAKAPGVMQRKSVSEPLQTGLKAIDALVPIGRGQRELIIGDRQTGKTSVAIDAILNQKGQDMICIYVAIGQKESTVRTQVETLRKLGAMDYTIVVTASASQPSPLLYIAPYAGAAMGEEFMYNGKHVLVVYDDLSKQAVAYRELSLLLRRPPGREAYPGDVFYLHSRLLERAAKLSDDLGGGSMTALPFIETQAGDISAYIATNVISITDGQIFLENDLFYSGVRPAIDAGSSVSRVGGAAQIKAMKKVAGTLRLDLASFRELEAFTQFGSDLDEATQAKLNRGRRTVEVLKQPLHKPLAVEKQVLILYALTHGHLDDVPVDDVLDFETKMFDFFDANYAELLNVITETKDLPEEAKLDEAIKAFKNTTNY

SEQ ID NO: 18489 - protein, 382 aa, Lactococcus lactis
MSFKNPVGIIAANRLPIGKINGFYKKISPETLYQNLIKQQFNKNLLLKKADIDYIILGNVTNQGGNLARRCALKAGFSSQVPAFTIDQQCGSGLTAMISSANYIISGEASVICTGGVESTSQANIVLDSESYQPINRFKMAPEPYEDFDMGTIADMTALKYNIPRSVQDLYALNSHKKATQAIEGKLLENEVFPYQDEGFTISSDQTVRPKSSMEALSKLTPAFTTNGTATAGNSCPINDGASSIILSSTNNPFDFQGYYLGQTTIALSPSDFLLGPIKATEKLLQKFNLKLNDIEAIELNEAFASQAILFQNYFKLDDIKLNAYGGSLAFGHPYGATGGILISRLLNRLNQVQKPCLGIATLCVAGGMGISVLIGNQWYQK

SEQ ID NO: 18490 - protein, 248 aa, Lactococcus lactis
MNKRTILITGATRGIGWAIAQKAAQANHKVILTGRDPLSLKSRAEELKKKFPKTEIQAIPLDVSNRSSVANAAKLIKDIDILINNAGITADSTFKKMSPEIWDEVISVNLTGVFNSTHALLDKINQGGQIITLTSKSALFGNFGQANYAASKAGIIAFTKTLAKELQKSMIRVNSVSPAAVTDMTLPVLKSLKETYGQNIPDEWKMGSSSDVANFIINDLIESEMTGKIFSINGSEIGYWQEPTFHKL

SEQ ID NO: 18491 - protein, 1196 aa, Lactococcus lactis
MAGHDVKYGKHRTRRSFSRIKEVIGLPNLIEVQTLSYKNFLDEGLANVFKEMFPIDNFAGTMELEFVGYEMKTPKYTVEEARAHDANYSAPIYVTFRLVNKETGELKTQEVFFGDFPLMTEMGTFINNGSERLIVSQLVRSPGSYFHLKADKNGLESFGHTTIPNRGAWFELDTDAKGIGYVRIDRTRKLTFTTMLRALGFGSDEEILELLGETQLLTDTIAKDVHKNPADTRVEEALKDIYDRLRPGEPKTADSSRGLLVARFFDPKRYDFAPVGRYKFNKKLALKNRLLGLTLAEPIVDPETGEILVNTDTLVTRDVLDLIEPLLDNGLGNFVVEPSDDAVIPEPITLQSIKVYSPKDPERVVTLLSNGNPDAECRVLTPADVISNISYWLGLAEGIGKVDDIDHLGNRRIRSVGELLQNQVRIGLSRMERVIRERMSSSENENITPQGLINIRPVTASIKEFFGSSQLSQFMDQHNPLSELSHKRRFSALGPGGISRDRASYEVRDVHYTHYGRMCPIETPEGPNIGLINNLSSYAKVNEYGFIMSPYRRVDRVNGVVTDEVEYLTADEEDNYTVAQANSPLTEDSRFANETVMARHTGNNIEVEASTADYMDVSPKQVIAVAAACIPFLENDDSNRALMGANMQRQAVPLIDPHAPWIGTGMEHQTARDSGAALIAKHAGVVEYVDGNEIRVRRTSGELDIYNITKYRRSNSGTSYNQRPLARLGEKVEKGDIIADGPSMENGEMALGQNPLVAYMTWEGYNFEDAVIMSERLIKDDVYTSIAIEEYESETRDTKLGPEEITREIPNVGDEALKNLDESGIIRIGAEVKDGDLLVGKVTPKGETDPTPEERLLRAIFGEKAREVRDTSLRVPHGGGGIVHDVRVFTRENGDELPSGVNKLVRVFIAQKRKIHVGDKMAGRHGNKGVVSNIVPMEDMPYLPDGTPIDIMLNPLGVPSRMNIGQVMELHLGMAARTLGIHIATPVFDGASDEDIWDTVKEAGMADDAKTVLYDGRTGEPFDNRISVGVMYMIKLHHMVDDKLHARSVGPYSLVTQQPLGGKAQFGGQRFGEMEVWALEAYGAANVLQEILTYKSDDVIGRTRAYEAIVKGERIPKPGLPESFRVLVKELQSLGLDMKVLDADRNVLDLRELDEDEVMTRPDNTEITPEMLEAQEAIVAQAEAEEEALINADTEK

SEQ ID NO: 18492 - protein, 627 aa, Lactococcus lactis
MTRIQDDLFATVNAEWLENAEIPADKPRISAFDELVLKNEKNLAKDLADLSQNLPTDNPELLEAIKFYNKAGDWQTREKADFSAVKNELAKVETLNTFEDFKNNLTQLVFHSQAPLPFSFSVEPDMKDAIHYSLGFSGPGLILPDTTYYNDEHPRKKELLDFWAKNTSEILKTFDVENAEEIAKSALKFDALLVPSANTSEEWAKYAELYHPISTDSFVSKVKNLDLKSLIKDLVKTEPDKVIVYEDRFYESFDSLINEENWSLIKAWMLTKIARGATSFFNEDLRILGGAYGRFLSNVQEARSQEKHQLDLTESYFSQVIGLFYGKKYFGEAAKADVKRMVTAMIKVYQARLSKNEWLSQETAEKAIEKLDAITPFIGFPDKLPEIYSRLKTTSGSLYEDALKFDEILTARTFEKFSEDVDKTSWHMPAHMVNAYYSPDSNTIVFPAAILQAPFYSLEQSSSQNYGGIGTVIAHEISHAFDNNGAQFDKEGNLNKWWLDEDYEAFEEKQKEMIALFDGVETEAGPANGKLIVSENIADQGGITAALTAAKDEKDVDLKAFFSQWAKIWRMKASKEFQQMLLSMDVHAPAKLRANIPPTNLEEFYETFDVKETDKMYRAPENRLKIW

SEQ ID NO: 18493 - protein, 340 aa, Lactococcus lactis
MKAAVVRHNPDGYADLVEKELRAIKPNEALLDMEYCGVCHTDLHVAAGDYGNKAGTVLGHEGIGIVKEIGTDVSSLQVGDRVSVAWFFEGCGHCEYCVSGNETFCREVKNAGYSVDGGMAEEAIVVADYAVKVPDGLDPIEASSITCAGVTTYKAIKVSGVKPGDWQVIFGAGGLGNLAIQYAKNVFGAKVIAVDINQDKLNLAKKIGADVIINSGDVNPVDEIKKITGGLGAQSAIVCAVARIAFEQAVASLKPMGKMVAVALPNTEMTLSVPTVVFDGVEVAGSLVGTRLDLAEAFQFGAEGKVKPIVATRKLEEINDIIDEMKAGKIEGRMVIDFTK

SEQ ID NO: 18494 - protein, 449 aa, Lactococcus lactis
MENSTGLKSSLKTRHIVMLSLGGAIGSGLFLGSGKVIAQAGPSVLLSYILAGLTLYVVMYGVGKMVIHQDEHKAGMAGVVAPFIGDHWAHFADWVYWATWMAVLIAEEAGVSTFLAMLIPGVPLWVFALIVAVLGTAINLWSVRAFAETEYWLAFIKVAVILILIALGIYLLVINDAHLGFVADTAQKVSTKSTAPSFAPNGFSGFLTSLLVVIFSFGGSELAAITVAETENPKVAIPRAIRGVLIRIISFYVIPIFLFLHLLPWSEVLNPDAASPFATIFARVGIPHADKIVLVIIVIAIFSAVNSAIYATSRSLYSRIQGSNSYVGQRLGKLSKNQVPTNAILVSSFVLFIGVLLSAILGDGFWQFVAGSISFTISIVWILLLVAALVLYFKHKEVTNWFVKLATLVVLIALTIIFIMQIVTNPWTLSVFALVICLLSYFTYRKKKA

SEQ ID NO: 18495 - protein, 321 aa, Lactococcus lactis
MVYSDSHLKLFALNSNPGLAEKISQFTGVPLGKLSSKQFSDGEIMINMEESVRSQDIFIVQSTSCPVNDHLWELLIMIDACKRASARTINVVIPYFGYARQDRTATSREPITAKLVADMIVKAGADRLLTLDIHAVQVQGFFDIPVDNLFTVPLFADYYRKSGLFGDDVIVVAPKNSGIKRARSLAEYLESAIAIVDYEDDDKNRENGYVIGNVSGKKVILIDDILNTGVTFANAANVVREAGASEIYAVASHGLFTSGAADVLEKVDIKEILVTDSVVTNHRKPLNVKYLSAAEYLASAILRIHEGRPVSPLFEHEKPQD

SEQ ID NO: 18496 - protein, 395 aa, Lactococcus lactis [sequence omitted]

SEQ ID NO: 18497 - protein, 281 aa, Lactococcus lactis
MQRKLTLNDGNVIPQFGLGLYQLPEGTETQNIVKTALELGYRHLDTSHAYQNETSVGQAIQDSEISNSEIWITSKLWPSDYEQAPEAIERMLKRLKVKQIDLLLLHQQVGNYRKAWIALENAVKEGKVKSIGISNFDGERLVDLFNFADIKPSVIQVETHPYHQQVELQEFLKPYGTKIESWYPLGHGDKNLLEEKIFKKMAKKYNKTVAQIILRWHIQEGIIVFPRSTQKEHLAENINIFDFELSCSEIKEIRKLNKKQPYFTMTYEEQEKNFLSWKLED

SEQ ID NO: 18498 - protein, 262 aa, Lactococcus lactis
MKTIGFIGVGKMATAIISGLDKNKFKIIISGHNLTKTQKQAETLNVTATSNHEELVQESDFIILSVKPQVLPSVLSKLINHLTKDKTLISIAAGLTLSDLKHLADSENQPIIRVMPNINAQIGQSTSAIVKNEFVDDSAYATVQEIFKSTGSVHEIAEKDFSTFAAIAGSSPAFIYMFIDAMARAGVLHGIPKDQATAIVAETVRASAEMILQSGENPWSLVDKVSSPGGTTVAGVVSLEQNHFIGTVIDAISATIEKEKNL

SEQ ID NO: 18499 - protein, 627 aa, Lactococcus lactis
MIQIGKIFADRYRIIKEIGRGGMANVYQGEDTFLGDRLVAIKVLRSNFENDDIAIARFQREAFAMAELSHPNIVGISDVGEFESQQYIVMEFVDGMTLKQYINQNAPLANDEAIEIITEILSAMDMAHSHGIIHRDLKPQNVLVSSSGTVKVTDFGIAKALSETSLTQTNTMFGSVHYLSPEQARGSNATVQSDIYAIGIILFELLTGQIPFDGDSAVAIALKHFQESIPSIINLNPEVPQALENVVIKATAKDIKNRYTDVEEMMTDVATSTSLDRRGEEKLVFNKDHDETKIMPANLINPYDTKPLIDKKEDNDSQTDEKAASSEVGNKNKKSKKGLIIGLIILLLVVGGATLAWVVSTPTNVKIPNVTNSTLSQAKSKIKDAKLKVGTVHKQQSSTIAEGKVIKTDPTSGTTVRSNSSVDIYVSTGNEDIIKMKDFVGEKIDEAMATLLKDYGIDESQVTQTSVPSDSYPAGTIIKQSPKKGSSFDTKGSEKITFEVSSGKQVEVPDYKPNGQYMTYSQYQAALKAAGFTNITLDPQATTNQQADGYVYSVYPNVGTSVDPTQEIVVTYSVYTAPSSSSTTSESTTTSETSSSTTSSTSSSTTSQPSTDNNNSSKESSTTSSSS

SEQ ID NO: 18500 - protein, 399 aa, Lactococcus lactis
MSEKHLFTSESVSEGHPDKVADQISDAILDAILAQDPHAHVACETVVYTGTVNVFGEISTSAYVDIAHVVRETIKKIGYTDSENGFDYKSVGVHVSLVEQSSDIAQGVNEAEEVRDKNGQLVDPLDLIGAGDQGMMFGFATNETAEYMPLAISLSHKLVKKLADLRKSGEISYLRPDAKSQVTVEYDDNGKAKRIDTVVISTQHAASARNEEIHDDVINKVIKAVIPAELLDDETKYFINPTGRFVIGGPQGDSGLTGRKIIVDTYGGYAPHGGGAFSGKDATKVDRSASYAARYVAKNIVAAGLAEKAQIQLSYAIGVATPTSINVDTFGTGKVSDDELLAAIRKVFDLRPAGIIQMLDLLRPIYGQTAAYGHFGRTDVELPWEQTDKVEELKSVLGK

SEQ ID NO: 18501 - protein, 298 aa, Lactococcus lactis
MAIVSAEKFVQAARDNGYAIGGFNTNNLEWTQAILRAAEAKKTPVLIQTSMGAAKYMGGYKMCKLLIETLVESMGITVPVAIHLDHGHFDDALECIEVGYSSLMFDGSHLPIEENLKLAEEVIAKAHAKGISVECEVGSIGGEEDGIVGEGELAPIDDAVAMAKLGVDFLAAGIGNIHGPYPENWKGLHIDHLEKLNKALVEAMGHNVPIVLHGGSGIPDDQIREAIANGVAKVNVNTECQLAFAAATRKFVNEFDANEAEYMKKKLFDPRKFLKPGFDAITASVEERIDVFGSANKA

SEQ ID NO: 18502 - protein, 362 aa, Lactococcus lactis
MDKRLDTLLAQVGIHQDEATGALVSPLHFSTTYQHPEFGQSTGFDYTRTKNPTRATLEEALASIESGQFALATSSGMAAIVLAFSVFPIGSKIVASRDLYGGSFRWFDEQEKEGRFYFSYAKTEKEMLELIDENTDIVYIETPTNPMMVKYNIEKIANKAQAYHAKVIVVNTFYTPIYQKPLELGADLVIHSATKYLSGHNDVLAGAVIVYDEELYERLLYQLNTTGAVLSPFDSYLVMRGLKTLSLRMERATKNAQKIVTFLKKLPSVKEVLYSGLGGMISLKVTDKTKIPAILNHLGVFTFAESLGGVESLITYPTAQTHHDIPLEIRESYGLTDDLLRLSIGIEDVRDLIEDLKEALEN

SEQ ID NO: 18503 - protein, 492 aa, Lactococcus lactis
MISVKKRREIKVFLVTASIGIVVLGGQQVLADAASEMVNPKDKVLVGYWHNWKSTGKDGYKGGSSADFNLSSTQEGYNVINVSFMKTPEGQTLPTFKPYNKTDTEFRAEISKLNAEGKSVLIALGGADAHIELKKSQESDFVNEIIRLIDTYGFDGLDIDLEQAAIEAADNQTVIPSALKKVKDHYRKDGKNFMITMAPEFPYLTSSGKYAPYINNLDSYYDFINPQYYNQGGDGFWDSDLNMWISQSNDEKKEDFLYGLTQRLVTGSDGFIKIPASKFVIGLPSNNDAAATGYVKDPNAVKNALNRLKASGNEIKGLMTWSVNWDAGTNSNGEKYNNTFVNTYAPMLFNNQPIEDTEKPTLPTISISNVTASTATIQGKSTDNVRIDHYEIKIGTQSFKSTSGLQDVTGLSKKTEYNVEIVAVDPSGNRSDTARATFMTLDTSAENNTWQKDKVYVQGDRVTFNGVNYEAKWWNTGQLPDQSGDFGPWKKL

SEQ ID NO: 18504 - protein, 430 aa, Lactococcus lactis
MPSVVVVGTQWGDEGKGKITDFLSSNAEVIARYQGGDNAGHTIVIDGKKFKLHLIPSGIFFPEKISVIGNGVVVNPKSLIEEIAYLAENGVSAESLRISDRAHVILPYHKKLDFLQEEAKGDKKIGTTIKGIGPAYMDKAARVGIRVADLLDKEIFEERLRTNLEAKNREFVKMYDSEPIEFEEIFEEYYEYGQQLKKYVTDTSVILNDALDAGKRVLFEGAQGVMLDIDQGTYPFVTSSNPVAGGVTIGSGVGPSKISKVVGVCKAYTSRVGDGPFPTELFDEVGHQIREVGHEYGTTTGRPRRVGWFDSVVMRHAKRVSGLTNLSLNSIDVLSGLETVKICVAYERSNGEQITHYPASLKELADCKPIYEELPGWSEDITSCRTLEELPEAARNYVRRVGELVGVRISTFSVGPGREQTNVLESVWGV

SEQ ID NO: 18505 - protein, 996 aa, Lactococcus lactis
MMTMIDVLERKDWENPVVSNWNRLPMHTPMDLLEKQSLNGLWNFDHFSRISDVPKNWLELTESKTEIIVPSNWQIEFKDKSDVPIYTNVTYPIPIQPPYVPEANPVGAYSRYFDITKEWLESGHVHLTFEGVGSAFHFWLNGEYGGYSEDSRLPAEFDISNLAKEGQNCLKVLVFRWSKVTYFEDQDMWRMSGIFRSVNLQWLPDNYLLDFSIKTDLDEDLDFANVKLQAYAKNIDDACLEFKLYDDEQLIGECHGFDAEIGVVNPKLWSDEIPYLYRLELTLMDRSGAVFHKETKKIGIRKIAIEKGQLKINGKALLVRGVNKHEFTPEHGYVVSEEVMIKDIKLMKEHNFNAVRCSHYPNDSRWYELCDEYGLYVMDEANIETHGMTPMNRLTNDPTYLPLMSERVTRMVMRDRNHPSIIIWSLGNESGYGSNHQALYDWCKSFDSSRPVHYEGGDDASRGATDATDIICPMYARVDSPSINAPYSLKTWMGVAGENRPLILCEYAHDMGNSLGGFGKYWQAFREIDRLQGGFIWDWVDQGLLKDGNYAYGGDFGDKPNDRQFSLNGLVFPNRQAKPALREAKYWQQYYQFELEKTPLGQVFAFTVTNEYLFRSTDNEKLCYQLINGLEVLWENELILNMPAGGSMRIDLSELPIDGTDNLFLNIQVKTIEKCNLLESDFEVAHQQFVLQEKINFTDRIDSNEEITLFEDEELLTVRSAKQKFIFNKSNGNLSRWLDEKGNEKLLHELSEQFTRAPLDNDIGVSEVEHIDPNAWLERWKGIGFYELKTLLKTMIIQATENEVIISVQTDYEAKGKIAFSTIREYHIFRNGELLLKVDFKRNIEFPEPARIGLSLQLAEKAENVTYFGLGPDENYPDRRGASLFGQWNLRITDMTTPYIFPSENGLRMETRELNYDRLKVRAMGQSFAFNLSPYSQNQLAKKGHWHLLEEEAGTWLNIDGFHMGVGGDDSWSPSVAQEYLLTKGNYHYEVSFKLT

SEQ ID NO: 18506 - protein, 399 aa, Lactococcus lactis
MSIVVENSTVLSALTEKFAEVFGDTKEVEYFFSPGRINLIGEHTDYNGGYVFPASITIGTTGLARLREDKKVKLYSENFPKLGVIEFDLDEVEKKDGELWSNYVKGMIVMLKGAGYEIDKGFELLIKGEIPTASGLSSSASLELLVGVVLDDLFNLNVPRLELVQLGQKTENDYIGVNSGILDQFAIGFGEVKKAILLDCNTLKYEMVPVELRDYDIVIMNTNKPRALTESKYNERFAETREALKRMQTRLDIQSLGELSNEEFDANTDLIGDETLIKRARHAVYENNRTKIAQKAFVAGNLTKFGELLNASHASLKDDYEVTGLELDTLAETAQKQAGVLGARMTGAGFGGCAIALVAHDNVSAFEKAVGQVYEEVVGYPASFYVAQIGSGSTKLDVE

SEQ ID NO: 18507 - protein, 256 aa, Lactococcus lactis
MLKVTNLTGGYLGHPVLKDLNFEIKEGELVGLIGLNGAGKSTTIQEIIGLLTPYSGQIELDGLTLQQDLEGYRRKIGFIPETPSLYEELTLREHIEVTALAYGISVDLAFERAEKLLETFRLSDKLDWFPVNFSKGMKQKVMIICAFLVEPSLYIVDEPFMGLDPLAIQDLIDLMIDMKKSGSSILMSTHILSTAEKFCDKFIVLHEGQVVAFGTVEELRTQFNQPKASLDEIYLALTKGNIPNSKEVVEAGKSNE

SEQ ID NO: 18508 - protein, 376 aa, Lactococcus lactis
MELVQFGCEDWLNVWEKSATIDIAQSTIDSLSLEEVLAFEEDNGEAFMSQMMKEKFSYGWIEGSPAFKSEVAKLYKRVPEDNILSTNGATGANFLTILGLIGQGDHVIAQYPSYQQLYDWPKTLGAQVDYWHIKEENNWLPQIEELRRLVKSNTKLICLNNAAQPTGAIMSPKFLSEVVEIARSVDAYILCDEVYLPLDEETPYSPIADLYEKGISTNSISKTYSVPGIRVGWVATQDRDLCNEFRKIRDYTLICTGVFDDAVAALVLKHKDKVLERARKIVKGNLSILKEWVENEPLVSMVYPNAVSVSFVKFEELDPTKTEDFAIQLLREKGVLIIPGNRFDLSGYARIGYCTDETTLRQGLKLLSEFLREYQV

SEQ ID NO: 18509 - protein, 314 aa, Lactococcus lactis
MVKRIVVALGGNAILSKDPSAKAQKEALEVTAEQLMPLIKDNDRQMVVTHGNGPQVGNLLLQQLGSDSEKNPAMPLDTVGAMTQGEIGFWTVQAFTRAMANNGLEHYPVISAVTQTLVDENDPAFKNASKPIGPFYTEEQLPEIKKQFPDWELMEDAGRGYRRVVPSPKPLEIIEAKAFGPILESGSLLIASGGGGIPVIKDGKGYQGVEAVIDKDFSAAKLAEMVGADELLILTSGGDVYLNYGKENQVHLETVKVSEMRKYVDEERFAKGSMGPKVEAAVSFVERTGKTATITSLDNVENFVKSGSGTRIVP

SEQ ID NO: 18510 - protein, 354 aa, Lactococcus lactis
MTSPLITKAEVNSVFQGRSLLAEKDFTPAEINYLVDFGLHLKALKQQNIPHHYLEGKNIALLFAKTSTRTRAAFTTAAIDLGAHPEYLGANDIQLGIKESTEDTARVLGSMFDAIERRGFSQKEVEDLAKYSGVPVWNGLTDDWHPTQMIADFMTVKENFGHLKGLTLVYVGDGRNNMANSLIVTGSMLGVNVHIVAPDSLHPTKEVMDIANKFAEKSGAKPLATSNIEEGVKGANIIYSDVWVSMGESNWEERVKLLTPYRITMDMLKMTGNADNGQLIFMHCLPAFHDTETEYGKEIKEKYGLTEMEVTDEVFRSKYARQFEEAENRMHSIKAIMAATLGNLFIPAVPEDFK

SEQ ID NO: 18511 - protein, 410 aa, Lactococcus lactis
MNNGINVNSEIGKLKSVLLHRPGAEVENITPDTMKQLLFDDIPYLKIAQKEHDFFAQTLRDNGAETVYIENLATEVFEKSSETKEEFLSHLLHEAGYRPGRTYDGLTEYLTSMSTKDMVEKIYAGVRKNELDIKRTALSDMAGSDAENYFYLNPLPNAYFTRDPQASMGVGMTINKMTFPARQPESLITEYVMANHPRFKDTPIWRDRNHTTRIEGGDELILNKTTVAIGVSERTSSKTIQNLAKELFANPLSTFDTVLAVEIPHNHAMMHLDTVFTMINHDQFTVFPGIMDGAGNINVFILRPGKDDEVEIEHLTDLKAALKKVLNLSELDLIECGAGDPIAAPREQWNDGSNTLAIAPGEIVTYDRNYVTVELLKEHGIKVHEILSSELGRGRGGARCMSQPLWREDL

SEQ ID NO: 18512 - protein, 567 aa, Lactococcus lactis
MTKINASDAMLKVIEDWGVKNIYGLPGGSIDSTMNALYNRRDTLNYIQVRHEEVGALAAVGEAKVTGEIGVTFGSAGPGAVHLLNGLYDAQYDHVPVLALVGQVPTSAMNTNYFQELNENPMFADVSVYNRTVMTAEQMPAVVDEAIRQAYAKRGVAVITIPKDLGWQEIEDNYVSSANLYQKPLPLEPAAEKIQEAWKILKEAKRPLIYIGQGTRGARKEILELSKMLHAPILSSALGKGIIPDNAPAYMGSAGRVASKPGVEIASNTDAVLFLGSDMPFQSFFIPKDAKYVQVDIDGTKFGRRHQVDLAILADAKLTIKKLMEVGEQLPETNWYRAALADKENWVEWLEKRSVIDSSPLEVEPVFKAINDMATDDAIFQVDVGNVTIDGMRLLDTSKDQKFTTSGWYATMGYALPAAIGAKAQYPDRQVWSISGDGAWAMVMPDILTQVKYNLPIINVVLTNKSLGFIEAEQDDAKQPNSGIDLIGANFGASAAALGALGFDVNNLSELNEAFAKAKEANRPMVINVNIFDHRPLPVEQLQLDSAEFEKEYQTQGLIPFSKLIQE

SEQ ID NO: 18513 - protein, 377 aa, Lactococcus lactis
MNFSEAMATKYKVREILHNGAYHGAADEPLVYVMDGIARFINQETLEVVNGDKISKVIGERIFINTGATPVIPEISGIQESKNVITSEGAMELSELPKKLVIIGAGYIGLEFAGMFNKFGSKVTILEPHSTFLPKEDDDISREIFKDLKASGVEIHLGVKVEKITDSEVLAGGQTYSADKILVATGRRPNITDLNLEKAGVELSESGYIKVDDDLKTSTENIWALGDVRGGGQFYYLSTDDFRIVNNQLFGDHSRKLSDRTLVPYSVFISPTLSRIGLDEKQAKKAGVNYHLFKMAAAPIVKSKVVQDTRGILKALVDPKTDEILGATLYHEDSHEVINLVSLAMKMHTPYQILRDQIFTHPTMGEGLNDLFQNEVK

SEQ ID NO: 18514 - protein, 483 aa, Lactococcus lactis
MNKKIRVRYAPSPTGLLHIGNARTALFNYLFARHHGGDFIIRIEDTDRERHVEDGERSQLENLRWLGMDWDESPETHENYRQSERLPLYQKYIDQLLTEGKAYYSYKTPEELEADHAKQEAAGIAPHYINEYAGMSDDEKAAYIAERKAQNIEPVVRISVDEKAIYKWNDIVKGDIEFEGKNIGGDWVIQKRDGYPTYNFAVVVDDHDMQISHVIRGDDHIANTPKQLVVYDALGWEAPQFGHMTLIINSETGKKLSKRDTNTLQFIEDYRKKGYMSDAIFNFIALLGWNPGGEKEIFSREELIELFDEHRLSKSPAAFDQKKLDWLDNEYIKNADFAKVFELTKPFLVAANRFDERAEELVKLYQPQMKSADEIVELTDLFYGDFPELTDEAREMLAAETTPLALSTFRAKLAELPENDFTVENIFPLFKATQKETGVKGKMLWMPIRIAASGSMHGPELPETIALLGKEKVLAHLDAALNK

SEQ ID NO: 18515 - protein, 276 aa, Lactococcus lactis
MGIKVYKPTTNGRRNMTGSDFAEITTSTPEKSLLVSMSKTAGRNNTGRITVRHHGGGHKRKYRVIDFKRTTDNVVAKVATIEYDPNRTANIALIVYSNGVKSYILAPKGLEVGMTVVSGPEADIKVGNALPLANIPVGTLIHNIELKPGKGGQLVRSAGASAQVLGSEGKYTLVRLQSGEVRMILSTCRATIGVVGNEQQSLINLGKAGRTRHMGIRPTVRGSVMNPNDHPHGGGEGRQPVGRKSPMTPWGKPALGLKTRNKKAKSSKLIVRRIND

SEQ ID NO: 18516 - protein, 446 aa, Lactococcus lactis
MRVGLFTDSYFPQISGVATSIRTLALELEKLGHEVFIFTTTDPNADVDHERNIIRLQSIPFVSLAERKIVLKGVFAAYLIAKEYDLDIIHTQTEFGMGILGKMVAAQLRIPVIHTLHTKYEDYVYYIAKGRLIRPSMVKYIIRNFLRGTEAIICPSEMVLETVNSYGVTLPKRVIPTGIEIDRFKRDDIEPEETAKLRVELGLAENEIMLLSLSRIAAEKNIQAVIHALPDILEEFPVKLVIVGHGPYAENLKELVKELELTDKVVFTGPVENEKTAYYYKAADFFISASTSETQGLTYLEAMAAGTRVLAAKNPYLSELINDDEFGQLFIGDDDLAEVTKKAIRDLHPIDKDKFEKKLYEISAENFAKKVYLFYIDTIIEYNNLKSIEAERFPMKMEDTIRQMPVTVKRSLKREQIRAKYFARKASKLAKNLQSYVKIDKDKEQD

SEQ ID NO: 18517 - protein, 519 aa, Lactococcus lactis
MQYLIGVDLGTTATKAVLFEKNGKIVASSSQAYPLYRDASGMAEESLEEIFEAVLVTIREVSINLEDEDELLAVSFSTQMHSLIAFDENWQPLTRLITWADTRAVKYTEQIKASKNGFDIYRRTETPLHPMAPLSKFIWLEAEHPDIYQKAAHYLELKGYIFQRLFGTNKMDLSTATGTGIFNIFELHWDKEALELTGIKESQLPKVVEPYEIEENLPHEYAKKMGIQSSTKFIWGAADGPLSNLGVNAIKPGVAAITIGTSGAIRVVTDKPKTDEKGRTFTYALDKEHWVVGGPVNSGGDVFRWARDQIFDGKISFDEVTELAANISPGADGLLFHPYLGGERAPIWDANARGSFFGLNYGHNRSHMARSVLEGVIFNIYMVALSLVEVVGDLNMIQATGGFTSSELWTQILADIFEQPINVPESREAGCLAAIIMAEKALGLIEDISEIETMVGTNETYQPNPKNFEIYREISPIFIRLSRSLLAEYENIANFQRKFEEENANCKMKLATLSQAKNI

SEQ ID NO: 18518 - protein, 302 aa, Lactococcus lactis
MMKFGMIGLGKMGMNLVKNAVDHEIEVVAYDLNTKAVEEAKDYSDKITAVSTIENLLTELPASKIVWLMLPAGTPTNSTIEMLSEKLSAGDILIDGGNSNYKDNLEQNKLLTEKGIKFFDVGTSGGMAGARQGGNFMIGGDDEKSWTIIEPIFKAISMEEGYLYTGKLGSGHYLKMIHNGIEYGMMQAIAEGFEILEESPFDYDYEAVAKLWNHGSVIRSWLMELAQEQFSKDPKLDQIIGHVQSSGEGKWTVEESLDLGVPAPVIALSLMMRQRSLQEDTMTGKVVAALRNGFGGHDVEQK

SEQ ID NO: 18519 - protein, 506 aa, Lactococcus lactis
MSLSQTSRCRINFIRERILENSSNSTTETQVKRGLKSRHVSMIALGGTIGTGLFLTSGDVIHTAGPFGALTAYVLIGAMVYFLMTSLGEMATYLPTSGSFSDYGTRYVDPAFGFALGWNYWLNWAITVAVDLTAVALCIKFWLPDVPSWIFSLIALIIVFAINALSVKTFGETEYWLSAIKITVVVLFLIIGFLSIFGIMGGHIDVAKNLSVGNHGFVGGLGSFTTGGGILGVLLVAGFSFQGTELLGITAGEAENPEKSIPKAMNSIFWRILVFYILSIFVMAAIIPFTDPHLVGGNSAAQSPFTIVFERVGLSIAASIMNAVVLTSVVSAANSGMYASTRMLYSLAKDGGAPKIFSKTSKNGIPFIALLATTAIALLTFLTSIYGVSFFTFLVSASGLTGFIAWIGIAISHFRFRRAYVAQGKDVKKLPYHAKLFPFGPILALIMTVLVTLGQDPMLLFGKTWVQGVIMYAAIPLFFILYLGYKFKNKTKLIPLKEVDLSRHKD

SEQ ID NO: 18520 - protein, 695 aa, Lactococcus lactis
MIDNFHLVYHFLSVKNEKRALAFCVIIRINLKKQESEIIVGKIIELNEALANQIAAGEVVERPASVVKELVENSIDAGSSKIIINVEEAGLRLIEVIDNGLGLEKEDVALALRRHATSKIKDSADLFRIRTLGFRGEALPSIASVSQMTIETSTAEEESGTKLVAKGGNIETLEPLAKRVGTKISVANLFYNTPARLKYIKSLQAELSHITDIINRLSLAHPEISFTLVNEGKEFLKTAGNGDLRQVIAAIYGIGTAKKMRQIKGSDLDFELTGYVSLPELTRANRNYITILINGRFIKNFLLNRAILEGYGNRLMVGRFPFAILSIKIDPTLADVNVHPTKQEVRLSKERELMALISKAIDEALSEGVLIPEALENLQGRAKEKESLSVQTELPLQNNPLYYDNVRQDFYVREEATFKINKNQASNDSSEQTFDNFTENQLNTDAVSEKMTDRTVESTTEITDNSLENTVSNFEIDFDNEAKISQSSTFPQLEYLAQLHATYLLCQSKEGLYLVDQHAAQERIKYEYWKDKIGEVSMEQQILLAPYLFTLAKNDFIVLAEKKDLLHEAGVFLEEYGENQFILREHPIWLKETEIEKSINEMIDIILSSKEFSLKKYRHDLAAMVACKSSIKANHPLDAESARALLAELATCKNPYSCAHGRPTIVHFSGDDIQKMFRRIQETHRSKAASWKDFE

SEQ ID NO: 18521 - protein, 840 aa, Lactococcus lactis
MAEKISPGMQQYLDIKQDYPDAFLLFRMGDFYELFYDDAVNAAQILELTLTSRNKNSENPIPMAGVPHHAAAEYIDKLVDLGYKVAVAEQMEDPKKAVGIVKRAVTQVITPGTTIDTANSVDNNFLVAIDFKDKHYALSYMDLSTGEFKVTELSEFSAVVGEIASLKAREIVAGFTLDESQLKVFERQMNLLISEQLEIPENLLIDLSGLTALENQVASKLLAYVKETQMRDLSHLQEVEHYEIKDFLQMDFATKSSLELTANKRENKKHGTLYWLLDETKTAMGTRMLRSWIDRPLISNSAIQKRMEIVQIFLDHFFERSDLIEALKGVYDLERLASRVSFGKAVPVDFLQLANSLSNVPAIKYILGMLNEAPLEELKSQLDEIPELSGLINSAISENASRTITEGGIIKKGYNAQLDKYREALENGTSWIAKLEADEKAKTGISTLRIDYNRKDGYYFHITQSQLNSVPEHFYRKATLKNSERFGSQELTEIEEIMLEAREKSSSLEYDLFMGLRTETEQYIGRLQALAKTIAEIDCLQSLSVVAEKQGYIRPTLTDGSRIVEIKGGRHAVVEAVMGAQEYVPNDIELPEQTDIQLITGPNMSGKSTYMRQFALTVIMAQIGSFVPAETANLPIFDAIFTRIGASDNLISGESTFMVEMSEANHAIQKASSRSLIIFDELGRGTATYDGMALAQAIIEYVHDHIGAKTLFATHYHELTDLDEALDHLDNVHVATLEQNGNVTFLHKITEGPADKSYGIHVAKIAGLPQPLLERADLILQKLENKPLPAKKVADEQEQLSLFDFTENSSEIIEKIKRQNVDNMTAREALNFLWELKDSL

SEQ ID NO: 18522 - protein, 503 aa, Lactococcus lactis
MTEQKQALFTIFGATGDLAKRKLYPSLFRLFKKGELADNFAVIGTARRPWTNEYYREVVLESIKDLMNSKTEAENFASHFYYQSHDVSDSSHYVNLKDLGEKLRKQYKTAGNQVFFLAMAPQFFGTISEHLKSENILTGEGFERIVIEKPFGTSYDTAKSLNDSLAKVFSEEQIFRIDHYLGKEMIQAVSAVRFANPIFESLWNNQHIDNVQITFAEFIGVEDRGGYYETSGALKDMIQNHVLQVLSLIAMEKPEKFDESYIVKEKVKALNAIRQYSSEEALENFVRGQYIAGRFDGEDYLGYREEDSVATDSRTETFAAGKFVIDNERWSGVPFYVRSGKRMTEKGTRINIVFKKDKDNLFAENCDDQSVQNVLTIYIQPTEGFSLSVNGKAAGQGFHLEPLRLNFRHDSEFLGNSPEAYEKLFLDVLNGDGTNFSHWEEAARAWELIDVIREAWDKETSELPTYAARTMGPKAAFDLLEKNGHEWAWQPDLWYQERGYYNK

SEQ ID NO: 18523 - protein, 379 aa, Lactococcus lactis
MNNTEYYERLGVDKNASQDEIKKAYRKMSKKYHPDLNKEEGAEEKYKEVQEAYETLSDEQKRAAYDQYGEAGANGGFGGGGFGGASGFSGFGGGSGGFGGFEDIFSSFFGGGGAQVNPNAPRQGDDLQYRINLKFEEAIFGVEKQVKYNREELCHTCGGSGAKAGTHPETCHKCGGRGQINVVRDTPLGRMQTQVTCDVCNGTGKEIKEKCETCHGSGHEKVAHTVKVTVPAGVETGQKMRLQGQGDAGVNGGPYGDLYVVFQVEASDKFERDGAEIYYKMPMDFVQAALGDEIEVPTVHGNVKLKIPAGTQTGANFRLKGKGAPKLRGSGNGDQYVIINIVTPKNLNQAQKEALQAFAKASGVEVSGSGKKGFFDKFK

SEQ ID NO: 18524 - protein, 336 aa, Lactococcus lactis
MVVKVGINGFGRIGRLAFRRIQNVEGVEVVAINDLTDPAMLAHLLKYDTTQGRFDGKVEVKDGGFEVNGKFVKVTAESNPANINWAEVGAEIVLEATGFFATKEKAEQHLHANGAKKVVITAPGGSDVKTIVFNTNHEVLDGTETVISAGSCTTNCLAPMADTLNKQFGIKVGTMTTVHGYTGDQMTLDGPHRGGDFRRARAAAENIVPNSTGAAKAIGLVLPELQGKLQGHAQRVPVPTGSLTELVTILNKEVTVDEINAAMKAASNESFGYNEDQIVSSDIVGISNSSLFDATQTEVTSADGAQLVKTVSWYDNEMSYTSNLVRTLAYFAKIAK

SEQ ID NO: 18525 - protein, 897 aa, Lactococcus lactis
MKYKTESIDNIKKFYDINSKTGLTPTQVTNSRIKYGHNNFEEQSGPNIFQKLLHHLLEVMNIILILVGVLSAYLAYISNGNYTKTIVVLLIVAINVFVSIFQENRAENALAALKELSSPTSTVLRSGKRQTIPSSELVCGDLIELTAGVQVGADIRLLTSNSLQVDESSLTGESEPIDKNADLDITDEVPLGDQLNMVFSGTNILNGTAEGIVVAVGSESQMGQIATLIGEQIKGKTPLQKRIDKLAKRLAIIAFAAGILIFVINLLYGNVPFVDNLMTAVVLGVAAVPETLPVIVTLSLIYGVENMAQKKAIIRNVPAVETLGNATVIASDKTGTLTQNQMTIQKLWLSGQDSWSGGQLSSSEVSLIQNFAYASNASAQLIDGDWEIHGDPTEAAIIRFLITHDLYEPEKNPKRLAELPFDSSRKKMTVVIPHPQDNEKYLVLTKGAFDRLAPSSQHQAQHPQLLSSNNEETSTHLSNDLLSQAQKIHDIFADQALRVLALSYKIIDKVPEDLTELENNLTFLGIVGMIDPPRLESKAAVQEARAAGIKPIMITGDHALTAKAIAQQIDIYRDGDKVIDGLTLKSMTDDELSQMIEQISVYARVSPEDKLRIVKIWQEKEQIVAMTGDGVNDAPSLRAADVGTAMGIAGTEVAKSASDIILADDNFATIVAAIREGRRVYTNIKKTIYYLLSANVAEILTMLIGAIVGWGMPFTGIQLLYINVLADGIPGFGLSREKADSHIMEQPPVGVKESIFSRGVSWRIAICSTAFIITALVGFYLGRFIEIAGLTPNHQLGQTMAFVILTLASTINVYNARSNESLFTRGITTNKMIFGTTLLSLGITVLFTNVPILMNILEVAPLSMTHWLIAIILALIPTLVIEITKVILNKQGKKFIG

SEQ ID NO: 18526 - protein, 339 aa, Lactococcus lactis
MSNQEPIANYKFNYKTTANKVMKNINLSGKTIIITGGYSGIGLEMTKQLSRAGAKIIIPARRMEVAKKNLSKIKNIDILPLDLTNPESIHQFAESFLQNNSKLDILINSAGLMYLPLKRDSRGIEYHFATNHLGHYQLTLELLPALKNAKISRVINLSSRAQQMTPLLEDWNFEKIENYNPQIGYQQSKTANVLFSIKLDELGKKYGIRSFAVHPGMIPMTNIGRQNSPITPWLRYLADYFKLIHIPVFFNALKSGFDRSKYRYLKTIAQGAATPLWASTSPDLEGKGGLYCEDLNIARLMTSEEANNFSGGLRPHAIDHNDADRLWQISKNITGLDFE

SEQ ID NO: 18527 - protein, 601 aa, Halobacterium sp. NRC-1
MCGITGYIGTDPTGRIVHEGLQNLEYRGYDSAGIALAGGGSLSVHKTGGEVGDLPVPSREDGTRGIGHTRWSTHGEPTRENAHPHTDCTGDVAVVHNGIIENYAALADELRADHVFHSDTDTEVVPHLIETHLADGVSLLTAVQRTTERLTGSYALAITAAGHDGIVVARSDSPLLLGHGDTGTFVASDATAFIEHTNRVTYLRNGDIAHLTETEWTVYNDGARVSRDIEALDWSADAAGKSGYDHYMLKEIHEQPRALRQAISGRISDLGTDVTLDMELSTETLQNVAELQIVACGTSYHAGLYAKELLETHADLPVTVHVASEYELRGGRSPEDTLVVAITQSGETADTLAALRSAAQKGAPTLALTNTLGSTVTREADDALFIRAGPEIGVAATKTFVSQVATAALLTMHIGRARNAISTGDAAALRDAIRDLPGAVQQVLDQAPEIASIGREYADSDAFFYVGRRAGRPVALESALKLKEISYDHAEGFSAGELKHGPLALVTDNTPVVAVLTEYAAPERTANNVKEVQSRGADVIGLASDAGTARHADVTITLPACGPLEPVVANVALQLFAYHIANEKGRPIDKPRNLAKSVTVE

SEQ ID NO: 18528 - protein, 395 aa, Halobacterium sp. NRC-1
MQAVVLAAGKGERLWPLTENRPKPMVPVANQPILEHIVDALVSAGVTRVMLVVGSNRERVQRHFEDGSRWGIEISYVVQDRQLGTGHALAQAESVVGESFVALNGDRVIDASLVEDVWECHRESGDSAMGVTQVETPSAYGVVDLDGGTVTDIDEQPVPELVASEYINAGVYAFGPSVFAAIRRTDSYGELALTDALDEQLADHELRAVRYDGRWLDVSEPWDLVAANSALITDRRFDPPVERRKPRGSVPGDDQQAPVGGGTVCGEGVIVHPQAVVRNGVALGDNVTVGANAVIEQSILLPDSTVNPGAVVNDSIVGANATIGPNTTVEGGQTDVVLGDTVHQGVRFGALVGDNAEVGAGVTVAPGSIVGNSAVVDSATVVTGRVDDQAHVTRG

SEQ ID NO: 18529 - protein, 430 aa, Halobacterium sp. NRC-1
MRVSIVGSGYVGTTVAACFTDMGHDVVNVDIDQDIVDAINAGKAPIHEPGLDDLLATHGGDTLAATTDYEDVLETDVTFLALPTPSKEDGSIDTSIIEAAAETLGDTLREKDGDHVVVTKSTVIPRTTTETLAPILADASGKQLGADLHVAMNPEFLREGTAVEDFQNPDKIVFGSDSETAIDTLHEIFKPLIEASDATVVETGVEEAEMIKYANNAFLASKVSLINDIGNICKEFGVDAYEVADAIGLDDRISERFLRSGLGWGGSCFGKDTNAIIHAATETGYEPAMLEAAVAVNDRQPERLLSLLDDHGDVESERVAVLGLAFKPGTDDVRDSRAIPVINGLQERGANVAAYDPVAAENMRTHFPDIEYTDAPQDALADASACVVCTDWDEFAVLDDEFDAMETRVVVDGRRIIERRDGLTYEGLTW

SEQ ID NO: 18530 - protein, 218 aa, Halobacterium sp. NRC-1
MVEVDGKPILTHCFEQLVELGADGLVVVVGYRKQDIIEHYGDEFEGVPITYAHQREQKGLAHALLNVEEHVDEDFMLMLGDNIFQANLEDVVRRQQEERADAAFLVEEVDWDDASRYGVCDTNQYGEVTDVVEKPDDPPSNLVMTGFYTFSPAIFHACHLVQPSNRGEYEISEAIDLLIQSGRTIDAIGLEGWRVDVGYPEDREEAEERLAEAEDAVA

SEQ ID NO: 18531 - protein, 238 aa, Halobacterium sp. NRC-1
MKAVVLAAGEGTRLRPRTADLPKPLVEVNGKPILTHCFEILLDLGIDDVVVVVGYEKDKIIDRYGDSFRAIDIEYAHQSERLGLAHAVLTAEPYVDSDFVVLNGDNIYSANFSEVLAHHTESGADITFPVEEVSTEEATSGAVCELDDDRAVTGLVEKPAEPPSNYAPTAFYVLPPAIFPACRVIRPSERGEYELADAIDLLIYSGYSVETQPFEGWKVNVNTEADITRAEQLLHSGQ

SEQ ID NO: 18532 - protein, 642 aa, Halobacterium sp. NRC-1
MSTAPDNEGDDDPFEEQRADVDNAMVQLFDEYGRDHSFQAVVAVLASVFARVLDLAPPVLLGLAIDSVIQGNKAFLPFLPQSVVPSSKPDRLLFMGGLIAGSFLLGAAFHWIRNWGFNSFSQHIQHRVRTDTYDKMQRLNMDFFATKQTGEMMSILSNDVNRLERFLNDGLNSAFRLSVMVLAIGVYLFVVNWQLAVLTMLPVPIIALFTYRFVNAIQPKYADVRSSVGHLNSRLENNLGGIQVIKTSNTERYESDRVDDVSQGYFDANWGAITIRIKFFPALRIISGVGFVLTFVIGGIWVATGPPMFFSGTLDPGEFVTFILLSQQFIWPMAQFGQIINMYQRARASSERIFGLMNEPSRIEENPDADELVVDDGGVVYDDVRFGYDDDDAIVEHIDFQVDGGDTLALVGPTGAGKSTVLKLLLRMYDVDAGAVRVDGQDISGVTLPSLRRHVGYVSQDTFLFYGTVEENITYGTFDADREAVVDAAKAAEAHEFIQNLPDGYDTEVGERGVKLSGGQRQRIDIARAILKDPEILVLDEATSDVDTETEMLIQRSLDRLTEDRTTFSIAHRLSTIKDADQIVVLEDGEIVERGTHADLLGDEGLYANLWGVQAGEIDELPDEFIERAAKRQATVDDQDDD

SEQ ID NO: 18533 - protein, 757 aa, Halobacterium sp. NRC-1
MSSRDHPPGDGLVELRLDVPGMDCSSCAGSVADALDATAGVTAHEEQPTTGSVVVTLDESTATTPDVVAAVEAAGYDVTGTDGDRDTSRADVWTSPRALQTAVGGVFLLAGLALRFFVGDANVVLGVVAGTSLHAADVAFLVAVAAGGFKTLRNGARSARDRRMDIDFLMSIAILGALTASFAFGKPLYFEAATLAVLFSIAELLEGYAMDRARQSLRELMALSPDEATIIDPDGTETTVPADTVSIGDRVAVRPGEKIPADGVVVDGDSAVDQSPVTGESVPESKQPGDEVYAGTVNETGYLEVEVTAAPGDDTLSRIVELVEDAQSNQTDREQFVERFAAKYTPAVVALAVLTTLGSPFVLGVSWPTAVVHGLTLLVLACPCAFVISTPVSVVSAITSAANHGVLVKGGTHLEAMADVDVVAFDKTGTLTAGDLAVTDVRGLNGHRERDVLACARGLEARSEHPIADAIVDAADEAGVDAPSVTDFDSVTGQGVRATLDGQPHFAGKPALFEEHGVDLSHVHATTDGGLRAAQPDCEHADCLDLRADTIPDLQAAGKTVVLVGTADALLGVIAVGDTVRAGAADTVSRLREHGVARTVMLTGDNERTARAVGDEVGVDAVYADCLPAEKASVVADLQDEHGDVAMVGDGINDAPALAAATVGIAMGAAGTDTAIETADVALLGDAITTLPYLYELAGDTNTVIRQNIWASLGLKAALAVGVPFGLVPIWLAVLAGDAGMTLGVTGNALRLGRISP

SEQ ID NO: 18534 - protein, 465 aa, Halobacterium sp. NRC-1
MTTEQPHVVIVGAYGSAGVAAAEELVDEDVTLTLIDDGEPGGGLCILRGCMPSKEVLSAGAHRYQARHDDRLTGAVPDVDLDAVVDTKDDHVLGFAEHRRAAVHDMAEREHVTFHHDTARFVDDRTLVVDGERIEADYVVLGTGSALNVPDLPGIADTDWMGSRDVLDATEFPDSGVVMGFGYVGVELVPYLSEAADMDLTVIEHDDRPLDSFHPVFGEEILAQYREEFDVDIRTEVREEAVEETDDGGVRVRLDDGTTAEGEQLFLFTGRTPSYPAGIEETRLTPDPEWVDPATMQARDDDHVFVVGDAMGERMLLHNAKEEGYAAGRNALAVERGGDLETYDPFSHQVMFSGLGVFPFASLGLTAEAARAAGHDVVTSQRDASSDGVFKTKDAARGAARLVVDADDGTVLGYHGLHYHADVMAKTMQVVLAAGMDVREIPDRAYHPTTPEVLDGLFGDAAAEL

SEQ ID NO: 18535 - protein, 318 aa, Halobacterium sp. NRC-1
MDVVTFGETMLRLSPPGHERVEAADRMDVRVAGAESNVAVTAGRLGAETAWLSKLPASPLGRKVAATLRAQGTTPEVTWTDRDDLRQGLYFLEQGGEPRGTTVHYDRQDAAVTTATADELAPAFVERAGYLHTSGITPALSETLAATTADLLELAQETGTTATLDVNYRRGLWSHEEARDTLEALFPDVDVLFVAERDARGVLDRTGDADAIARGLADEFAFGTVVLTRGEAGALAVRNATTVTQPVFETETHDPIGTGDAFVGGYLAARVDGGDVEDALAWGAATAALKRTIPGDVALVTRADVESVLADEHSGIDR

SEQ ID NO: 18536 - protein, 659 aa, Halobacterium sp. NRC-1
MTDRIRALDDATVARIAAGEVVERPASVVKELVENSLDAGAASVDVSVDAGGTDRIVVADDGRGMTGDDLRMAVRQHTTSKLDDASGLDGVGTLGFRGEALYTIGSVAELTVTTRPRNAGDTGARITVDHGDAGSVAPAGHPAGTTVEVTDLFGETPARRKYLKRAATEFGHVNRAVTRYALANPDVAVSLTHDGREVFATTGTGDVQDAALAVYGREVAQSLRTVDADPAADSVERVHGYVSDPEVTRSTREYLATFVNGRAVTDAVLREAVLDGYGDQLAPDRYPFAVLFVDCEGVDANVHPRKLEVRFEDEAGVKAAVEAGVRDALLDAGLVRAGAPRGASKPGDAEISPEHSPTDRDAGAAGGGDAAGQSDGNGQRTAASGATSESPASAFETGGGDEAADSAASTDGTRERPGSGTESRTGRFDAPAENARLPTGAGGPEADDQDTTSERDSLPDLRVLGQLHDTYVVAEAGDGLVLVDQHAADERVHYERLQARVDGASQALVAPAELELTAGEAAVFEAALGGLRELGFDAELAGRTARVTAVPAVLADALDAELARDVLSSFLADADGTPVADAADAVLADLACSPAIKGNTSLAEGSVVALLDALDACENPYACPHGRPTIVEVDGDELAARFERDYPGHAGRRREDAGN

SEQ ID NO: 18537 - protein, 429 aa, Halobacterium sp. NRC-1
MAQTPPPESAPSTDSEPETALETARRQLQAAAEHVDIADGVIERLTHPTRVVQVSVPVERDDGTVTVYDGYRAQHDDVRGPYKGGLRYHPGVSAEECVGLSMWMTWKCAVMDLPFGGAKGGVVVDPKTLSADEHERLTRRFAAELRDEVGPSQDIPAPDMGTDAQTMAWFMDAYSMQQGETVPGVVTGKPPVAGGSHGRAEAPGRSVAIATREAINYYDIPIDDATVAVQGYGSVGANAALLLDDWGARVVAVSDVNGGVLDTDGLDTHAIPSHGNQPAAVMRHDAPNTLTNEELLELDVDVVIPAAVGNVITAANADRIQADIVVEGANGPTTSAADRILEERAVPVIPDILANAGGVTVSYFEWLQDINRRTWSPERVRDELESEMLSAWNAVRSEVDDGDLSWRDAAYVVALQRIGRAKEARGLWP

SEQ ID NO: 18538 - protein, 600 aa, Halobacterium sp. NRC-1
MERRAQRGGRRRPELAGRCLRCRAATHRPCEGSPWALALICTALGVPTPQTTITDVCDGGGVMHRPLLVTDFIDRARTYYGDETAVVATTGRRYTYSELADRADRFSAVLQAAGIDSGDRVAVLDPNTHYHLEAAYGAMQLGAIHTPLNYRLTPDDYAYILADAGADAIYADAAYADRVEAVRDQIPTTTFITDDPAAVDGDWQDADALLADADPDDYDRPDMAEDDVITINYTSGTTGDPKGVCRTHRNEVVHALLLSTHHTITDTDTYLWTLPMFHANGWGHIFAITGAGATHVCTRGVDAASVFDTIQAEAVSYLCAAPTVLNMLLDYHEAHDVAATGDADVRVATAGSAPPEATIRAVESALDWSLMHVYGATETGPLIATSDADRLLAAGGGSRAAMQKRQGIGLLGTELRVVDEHGNDVPRDNETIGEIVVSGNQVMDRYWNKPDATERAFTDRVDGYFHMGDFAVVDDTGFVSILDRKKDIIISGGENISSIELEDTLFEHDAVGEVAVVPSPHDDWGETPKAFVVPASGDPNNPGVTTTALVEYTRAELASFKTVRRVEFVDELPTTATGKVQKYELRAAEFADEESLVGQG

SEQ ID NO: 18539 - protein, 871 aa, Halobacterium sp. NRC-1
MGIVDEFQALKAETDADLLAMQVGDFYEFFAADARTVASVLDLQVSEKSNHGSSYPMAGVPVDDLTPYLAALVERGYRVAVAEQSETDAGDIEREIERVVTPGTLLASTDADPRYLAAVVREAGGDWGLAFVDVTTGQFRVTRGADRADAVTELYRFAPAEVLPGPALRGDDDFLGVLRERTDATLTLHDAGAFDAGRATHRVREQFGDGVIESLGVAADGPVVRAAGAAVGYIAAADEGVLASVSRIQPFGGGDHVELDATTQRNLELTETMTGGSDGSLLATIDHTASAAGGRRLAAWVTRPTRDRAELDRRQAAVGALADAALARDALGDVLGEIYDLERLASRAASGRADATDLLRVRDTLAALPDVADALTTTPELAESPARDVLARVDRAAAADVRAELADALADDPPKTLSEGGLLQAGYDEALDELLAAHDEHRAWLDGLADREKDRLGITHLQVDRNKTDGYYIQVGNSETDAVPDGEDGAYRRIKQLKNATRYTMAELDSHEREVLRIEAERAELERELFAALRERVGERAAVLQDVGRALAEVDALVSLAEHAAANQWVRPELVAGDGLDIDAGRHPVVEQTTSFVPNDARFDASRRFQVVTGPNMSGKSTYMRQVAVIVLLAQVGSFVPADAARIGLVDGIYTRVGALDELAGGRSTFMVEMEELSRILHAATSDSLVVLDEVGRGTATYDGISIAWAATEYLHNEVRATTLFATHYHELTALADHLDAVVNVHVAAEERDGAVTFLRTVRDGATDRSYGVHVAALAGVPEPVVDRARGVLDRLREENAVEAKGSAGESVQAVFDVDSGGFVDDAGDDGEADDPEAAAVLDELRTVELAETSPVELLGTVQAWQDRLED

SEQ ID NO: 18540 - protein, 253 aa, Halobacterium sp. NRC-1
MQGQNQQQAYDRGITIFSPDGRLYQVEYAREAVKRGTASIGVRTPEGVVLVVDKQTRSPLLEGSSVEKLHKIDDHVGAASAGHVADARQLVDFARQQSQVERVRYDEPIGVRTLTKSVTDHIQQYTQVGGARPFGVALLIAGVEGGEPRLFETDPSGTSNEWKAVAIGSNRGDIQEFLEDEYDAGLSVDDGIDLALRALNEGREDALSGDGVGVGIVDADTGTYRELAADESQSYIDDIEDAADDSDDDDDEE

SEQ ID NO: 18541 - protein, 863 aa, Halobacterium sp. NRC-1
MDAALGPPDAMAASEGDLTPMMSQYFELTRRYDDALVLFQVGDFYELFCAAAETAARICEVTLTAREDSTGQYPMAGVPIDTAEPYIEALLDAGYRVAVADQVQDPDEVSGVVDRAVTRVVTPGTVTEDELLGGADNNFVAALAGGRDADAGFGLALLDVSTGDCYATRLGDEARVRDELGRFTPAELVVGPGVDADRFADEAFVAAYDDDAFEPAAARERVADYFGGEDVLPTTAELRACGALLSYAEYTRGGAGDSQRLTYLNHVTRYSPTEHLQMDAVALRSLELFEQRSVHGTDGTALVDVLDETACALGRRKLTDWLRRPLVDSDAIAARHDAVGELVADPLSREELHEHLRDVYDIERLVSRVSRGRANARDLRALADTLAVVPEVRGLLADADARKLQSLREALDDLPEIRGLLDRAIVADPPQELTDGGVIRDGYDERLDDLRATERAGKQWVDDLEASERERTGVDSLKVGQNSVHGYYIEVTKANMDAVPEDYQRRQTLKNAERYVTPELKEREEEIVRAEQRAQDLEYELFVGIRERVAEAAERMQAVARALAAVDALASFAAVAAAHDYTKPVMGGDGIHIEGGRHPVVERTESGFVPNDTTLNDDRRVAVITGPNMSGKSTYMRQVAVIVVLAQAGCFVPAAAAELRVVDRVFTRVGASDDIAGGRSTFMVEMTELASILRAATDESLVLLDEVGRGTATTDGLAIARAVTEHIHDAVGATTLFATHHHELTADADRLPDALNLHFAATRGDDGVAFEHAVRAGAATASYGVEVARTAGVPEPVVDRARELLDAPATADGGDGGTTPTADANGQRGAAAGIVAELRDVSVAELTPIEALNVLNDLASRVD

SEQ ID NO: 18542 - protein, 323 aa, Halobacterium sp. NRC-1
MTRSTRQRERETAAKQEEEEDSEEGVRECPECGSDNLVKSSDRAELVCNDCGLVVEEEQIDPGPEWRAFNHQERQEKSRVGAPTTQTMHDKGLTTTIDWKDKDAYGRSISSKKRSQMHRLRKWQERIRTKDAGERNLQFALSEIDRMASALGVPRSVREVASVIYRRALKEDLIRGRSIEGVATSALYAACRKEGIPRSLEEISEVSRVERKEIGRTYRYISQELGLEMKPVDPKKYVPRFCSELELTEEVQSKANEIIETTAEEGLLSGKSPTGYAAAAIYAASLLCNEKKTQREVADVAQVTEVTIRNRYQEQIEAMGIHG

SEQ ID NO: 18543 - protein, 319 aa, Halobacterium sp. NRC-1
MTDARMRSREQERTDETESESTDGCPECGGLVVNDEEHGESVCADCGLVVEEDGIDRGPEWRAFDSKEKDEKSRVGAPTTNTMHDKGLSTNIDWRDKDAYGNSLSSNQRQKMQRLRKWNERFRTRDAKERNLKQALGEIDRMASALGLPDNVRETASVIYRRALEDDLLPGRSIEGVATSCVYAAARQAGVPRSLDEIADVSRVEKAEIARTYRYVVRELGLEVAPADPESYVPRFASDLGLSDEASHRARELLKTAKDKGVHSGKSPVGLAAAAVYAAALLTNEKTTQAKVSEVADISEVTIRNRYHELLEAEDTIPV

SEQ ID NO: 18544 - protein, 579 aa, Halobacterium sp. NRC-1
MRNAKIVCTLGPATNDDASVRALADAGMTVARINASHGDAAARRELIETTRAVDAQTDKPLAVMLDTQGPEVRTAPIDDDGTIHIETGSDVAFVEGDTATPDRIGISTSIAAAEPGDTVLLDDGRIEADVDRVAGDTVHATVVSGGSLGSRKGVNVPGVELDVDVVTEKDRRDLALAAELDVDYVAASFVRDADDVLAVNRVLESHGADIPIVAKIERAGAVENLDGIIDAAQGVMVARGDLGVECPMEDVPMIQKRIIAQCRDAGVPVITATEMLDSMVHARRPTRAEASDVANAVLDGTDGVMLSAETAVGDNPTRVVETMDRIVREVEGSAEYSERQEQAVPTADGTAKTDALARSARYLARDIDASAVVVASESGYTARKAAKFRPSVPVVCATPSHDVRRQLALNWGVHANYAAVAEGDATTVVERAVQAAVDSGVVASGDTVVVLVGMMTELEGASTTNTLKVHVAAETLSTGRAVVDGRTTGRTYRADSGDLSDAPENAVVLLAHGFDGEFDGDLSKIGAIVSADAGLTGYPAVIARELDVPMVGDVDVDAVPAGDLVTVDGERGVVYEADQ

SEQ ID NO: 18545 - protein, 752 aa, Halobacterium sp. NRC-1
MAVRWLEDVRADDIDSVGGKGASLGELTDAGLPVPPGFVVTAGTYRTFIEEAGIDQELFDAVGVDAEDSDALADAAARASDLILNTDFPASLREDILSSYDALDDGAAFVAVRSSATAEDLPDASFAGQQETFLNITREALLDHVKRCWASLFTERAIYYRQEQGFDHDRVNIAVVVQRMVDAEKSGVLFTSHPSTGAHEAIVEAAWGLGEAVVSGAVSPDNYVVDRDTDTVEEATVADKKVMHVKDDDTGETVSRDVPDRKRTQRVLDDGEISDLVTIGERVEAHYDAPQDVEWAIVDGDVYMLQSRPITTIEDDTDGAVANTDGGGGDAVVTGLGASPGVASGPARVVTSLDELDKIGEGDIIATEMTTPDMVPAMKRAAGIVTDEGGMTSHAAIVSRELGCPAVVGATDATTTLCDDQAVTLDGDRGVVRDGREETTTEHDPIEDARPTTPVKPMTATEVKVNVSIPEAAERAAATGADGVGLLRMEHMILSTNKTPKRYIDDHGEDAYVQELVDGIRGVAEEFYPRPVRVRTLDAPTDEFRQLEGGNDEPHEHNPMLGYRGVRRSLDRPDVFKHELSAFRRLYEMGYDNVEVMFPLVNDAQDVARARDLMADAGIDVEKRSWGVMIETPAAALAIEEIAQEGVDFASFGTNDLTQYTLAVDRNNGSVADRFDELHPSVLTLIERTIDACREHDVATSICGQAGSKPEMVDFLVETGVSSISANIDAVRDVQHEVKRVEQRLLLESARE

SEQ ID NO: 18546 - protein, 1190 aa, Halobacterium sp. NRC-1
MYIEELVVENFKSFAGTTRIPFYEDFTTISGPNGSGKSNIIDAILFALGLARTTGMRAETLTDLIYNPAHEGADGAAGPTEASVEVVLNNDAGVVSRSQVTTAAGSENVGSVDTITIKRRVKRTDDSHYSYYYLNDRSVNLADIQELLAQAGIAPEGYNVVMQGDVTGIINMTAGERREIIDEIAGVAEFDAKKRDAFEELDVVEERIGEAELKIDEKRDRLDRLADERETALEYQDLQEEKQEYEGYAKAAELEETRADLSATRADIDEQERELEGLTAELDERRDTVGRIEADLAALNAEIERKGEDEQLAIKREIEEIKGEVSRLEDTVAACEDRVQDADAERREAVVEIDRKRERIDALETDIREVKVQKASVTAEIQERRDELADIEAEIESVDTEFDELKAALADEKTALEDAKRERNDHQREQDRLLDEAKRRSEELADAEADLEDARAELPEVDATLDELADELEKATRNREQIVDVVEDLKQEKRQRQEDLAAVEDELSAAQEEYARLEAQADQSGDSSYGKAVTTVLNDDRDGVHGTVGQLGGVREQYATACETAAGGRLANVVVDDDGVGQRCIEYLKQRNAGRATFLPITEMQQRSLPSAPAMPGVVDFAYDLVDFDERYAPVFSYVLGSTLVVENMETARDLMGEFRLVTLAGDLVEKSGAMTGGSRSGSRYSFSKSGKGQLERVAERIQGLEDDREDCRQEVREIDQRLDSARDRRQDATEQVRTIQADIEAAEADREAAVERIADLETRIEELQDEREAVDAEMQTVDAEIDAQQETIAAIEAEIESLEAELAESRIPELTAEKEDIEATVVDLEGRVDELDGELNSLTLEKEYAEDAVEDLQADVADAESRKADEQARIEALNGDIEAKQAELAEKEAAVEDLEAELADLKRDREERKADLSEAEDARDEQAAAVEDARHRLERLQAAAQTLSEEVAELDDAVGEYDPAEIPDADVVAENVERLGARMEALEPVNMLAIDEYESVADTLDSLEAQRATLTEEADGIRERIARYDEQKKSTFMAAFEAINDHFHRIFSRLSAGTGGLELETPDDPFDGGLTMKAQPGDKPVQRLDAMSGGEKSLTALAFIFAIQRHTPAPFYALDEVDAFLDAVNADRVGELVDELAGDAQFVVVSHRSAMLDRSERAIGVTMQADNRSIVTGIDLSAQGAVTDD

SEQ ID NO: 18547 - protein, 663 aa, Halobacterium sp. NRC-1
MWGASLTRFLSLSAGQMGEDFISVGRVQSPTLKLIVDKEREIEAFDPDDYWELFADLRKDQTTFEAQYFYEDPADGTEAERVWNEGDADAAFDALRQAGEAVVDSVSRRTRTDDPPAPFNTTQFIRAAGSLGYSAGRAMSIAEDLYTAGYITYPRTDNTVYPDDLDERDLLEAFQQTVFGDDADSLLDQDRLSPTSGDEETTDHPPIHPTTDFPDRNQLSEDEWAVYELVVRRFFATVAAPAEWAHLRVTADADGESLKANGKRLVEAGYHAVYPYYDSSENHVPPVEEGDTLAITDARLDAKQTQPPRRYGQSRLIETMESMDIGTKSTRHNTIEKLYDRGYIENDPPRPTTLAEAVVEAAEDYADVVVSEEMTSQLEADMTAIADGETTLDDVTTESREMLDRVFDELTASRAEIGDHLRTSLKADKSLGPCPECGDTLLLRQSRTGSHFVGCDGYPECQFTLPLPSTGDPLVMDAVCEDHDLHDVKMLAGRNTFVHGCPLCAAEAADESEDRLIGPCPDCGEPHGGELAIKQLQSGSRLVGCDRYPDCEYSLPLPRRGDIEVTETYCDEHALPELVVHDGEDDDPWELGCPICNYEEYQARQRQQGLEALDGVGPKTAAKLESAGVEDVGALADADPEGIADAVSGVSADTIREWQAQAD

SEQ ID NO: 18548 - protein, 456 aa, Halobacterium sp. NRC-1
MRCVHEHVDVRGFRAPNHRVVQHFHVQVNPSRRHAHPFACAVLAAFGRGERVARCQGFYRTYPAAVQPRRMDVELLSDDVVPEHARAVKQDARAFAAEHIAPHAEEYYASGEYPWEVLEAAMDAGLVAQDIGEDYGGRGLDLTQMLAIAEEFFRADAGIALTLQLASFGAELVEEYGTPAQKDRLLTPVANNDQLTGLAVSEPEVGSNLAGMQTTAERDGDEYVLNGEKYWIGNGVEADWVTVYAKTGDTDDRYMNYSLFAVPTDTDGYEAEHIPEKMGMRASKQAHIVLDDCRVPEANLIGTEGGGFMMLTDFFNHGRVVVAGHGLGLAAAAFEEAWDFVHDRAGFGRTVSDFQSVQHSLADMRIEFESARALAYRAAEKVAAHDEPGLWAAMAKTKATEVATANAEQGMQFHGGRSNFTDRRIARVYRDVRIPVIYEGANEIQRNLVYRQSGDQ

SEQ ID NO: 18549 - protein, 266 aa, Halobacterium sp. NRC-1
MDVYGLIGNPVGHSLSPPLHAAAYDECGLDARYVTFEPAPDDAAAAIRGAGALGVAGLNVTAPFKQSAASAVATDSMAARVGAVNTIDFSGAAPRGYNTDVAGVKRAFAHHDVSLSGAQAVVVGAGGAGRAAAFALADAGATVRIANRTRAAADELAADVGGTAVGLGDLPRSLADATVLVHATTVGMDDPDTSPVSADALHDDLAVLDAVYSPVETRLLRDAAAAGATTIDGAWMLLYQGAEAFERWTGLDAPVAAMRAALRARL

SEQ ID NO: 18550 - protein, 352 aa, Halobacterium sp. NRC-1
MFEKSTWIRLPRNVVVGHGVLDDAVEVVRDTHLTGRPLVVTSPTPKTVAAENVVAQFEAVGDDPAVVVVEEATFNSVERVLGEAEAVDPGYLVGVGGGKAIDIAKLASDHLNVGFVSVPTAASHDGIVSGRGSVPEGDTRHSVSAAPPLAVIADTGVIADAPWELTTAGCADIISNYTAVKDWRLANRLQHVPYSEYAGALSQMTAEMLVDNAANIKPELEESAWVVVKALVSSGVAMSIADSSRPASGSEHLFSHQLDRIAPGKALHGHQVGVGSILAEYLHSGQEGQWMAVRDALASLDAPTTADELGVADDEVLAALTSAHEIRDRYTILGGGISEVAAREAASRTGVI

SEQ ID NO: 18551 - protein, 104 aa, Halobacterium sp. NRC-1
MEFCDDCGSMMKADDELWVCSSCGHKQPKDPSASFVVTEGQEETEVVDVSDAQDRGLPTTSVVCPDCDNDEAHWYMQQIRSADESETRFFICTECEHRWREDDN

SEQ ID NO: 18552 - protein, 313 aa, Halobacterium sp. NRC-1
MLVAAHHTRMPTHAPAPGSGDPLGLHGVVPPVVTAFDADESLDADTTADHARMVVDAGVHGVFPLGTNGEFPLLTPSERDRVVTAVVDEVGGEVPVIAGVGAPSTRQTVAHAEHAASVGADGVVVVTPFYYPLDGTAAVEHYRRVAAAVDCPVYVYHIPSKTGNELSLETLAALAEIDTLAGVKDSSKDVPWLGQAVDAHPELTFLAGSDSLLAPGLDVGCAGLVSAVANVAPELVVGLYEAYDEGDRERARARQSTVYEVRAALKRGPYMAGVKAALGLRGFDAGPLRSPLRGLDDDDRAALEADLADLGLL

SEQ ID NO: 18553 - protein, 356 aa, Halobacterium sp. NRC-1
MDAIVVSKADRTPRLVDRPRPDPTPGSVLVRTLRVGVDGTDHEVIAGTHGGFPEDADELVLGHEAIGVVADPTDTRFSAGQLVAPTVRRPRGDPTPQFDRGQPDMAAPGTYVERGIDGADGFMADYFTSPADALVALPDSLAAHGFLTEPVSVAEKAIELALASRSAFDWRPDSALVLGNGSLGLLTLAILAARDDTETLYCLGRRSRPDPTIDIIERLGATYIDSRTTPVADIPAAHQPVDMVYEATGHAKHAFDAIDALAPAGVAALLGVPAAGWTFEVPGSDLHRSLVLENKAVVGSVNSNARHFRAAADTLAALPDWLCDAIVTGVHDTAAFADAFRDGETSIKTAVQFDTR

SEQ ID NO: 18554 - protein, 258 aa, Halobacterium sp. NRC-1
MGPNGTGKTVLLSCLAGGTEPSEGSVSVFGTPVSEDGGRSLSLLLQGGASVDTLSGRETAAFYSRLHPEFTDRWRTYVDDLGIDGDLDKRIKYYSEGMKRKLELSLALSVDAPLYLLDEPTAGVDLSMVQSFHRVIRDRVADGGTVVATSHRPVDADLADRVAFVNGGGVLAVDTPEALLDGVPTVVRVVGQATAGDALAPHVVGDPFYHGDERRGFLREHATLADIREHAGDATVETVEPSYTDAFNYYVHAAADNE

SEQ ID NO: 18555 - protein, 277 aa, Halobacterium sp. NRC-1
MRMAQDTQQRAAVVEEMPEFGLGTWENEDPSACADSVRTALEMGYRHIDTAQIYENEDAVGDGIAAADVDREDVFLATKVWTSELGDGDVAPATEQSLEKLGVDYVDLLYVHWPANQYDATETLAALADLQADGVTERIGVSNFEPRHLDEAEDVLGELPFANQVEFHPLLQQEELREYADGEDIELVAYSPLARGEVFDVPEIQAVAEKHGVSEAQVSLAWVRRKGVTAIPKATGEDHIADNWASLDLELDDEDVAKIDGIDRRERQVDPEFGPWN

SEQ ID NO: 18556 - protein, 410 aa, Halobacterium sp. NRC-1
MSDKHDVIVAGAGPAGAQCARDLAERGYDVVVLEAEPEDEFPRQSNKSTAGTFASMMGAFGVPDDVVMQYTDDVVLESPHEYFVQDQPGAVLEFAEFKQWLVAAGEQQGAEYRFEARVNNPITEGGEIVGVKYDGDEEVYGDIIIDATGPAAPLAKKLGVTDLRRSNQAIGIEWEMENVAVDHEGYADLSDAMMLRLDHDLAPGGYSWIFHTGADTAKVGICYIQNESYQRFGDASKSIDDHLDYWMETDPRLADATKLAGKQHRGSAHIQLPANFSTDNFMAIGDTVPTVDPLWGEGIHKCMESARAAAITADRCFMGDDRDTSADALSIYDDLWHKRVAPNARMRLTMTQLLYLASNERYDRLMSDLQTADVGTLSGANEGGLRSLLEFVHTEDVPLLARFARDRLRA

SEQ ID NO: 18557 - protein, 252 aa, Halobacterium sp. NRC-1
MTDLAIRADGLTKRYGDEAAVDDLDLAVPAGSVYGFLGPNGAGKTTTMRLLTSLTDPTAGTAEVAGVPVTDRAALTPRIGYLPADPPVFDELTGWEQLRHVARLHGLDDGEADTRIESLLERFDLLADADRRIESYSTGMTKKVGVVAAMLHDPDVLFLDEPTSGLDPRAARTVRDTVADLSAGDATVLLSTHVLPVVDELADTIGVIDDGVLVADGDPENLKSTAREGSAADLETVFMEVTADADAPLPDS

SEQ ID NO: 18558 - protein, 316 aa, Halobacterium sp. NRC-1
MSSDDAWTAAALPDQSGRRVVVTGANSGLGFEATRAFARAGAHVVMACRSTERGEDARDDIVAELPGASLTVHELDLAALDSVAAFADWFTAEFDSLHVLANNAGVMAIPRSETADGFETQFGVNHLGHVALTAGLLGVLRRTSGETRVVTQSSGAHRRGRIDFEDLQHEAEYGKWEAYSQSKLANLLFAYELDRRLRAASASVTSVACHPGYAATNLQLRGPQAAGSRLRLLAMRAANALVGQSAEQGAWPLLYAATNPSIDGGEYIGPGGVLNMRGHPERQQPSARSRDEDTARRLWTVSADRTGVDFDLPDPA

SEQ ID NO: 18559 - protein, 656 aa, Halobacterium sp. NRC-1
MDSLDGVGTVVHEPDPALASSTNVAQFMTAHDIDDVDALRERSTTDLDWFWGELPEYLGLEFFEDYDAVRDDADDPQSTAWYPGAELNVAHNTVDRHASVDAGTRNHVACIWEGEDGTVRQQTYHDLHQQANRVANALAERGIGEGDTVGLYMPMVPEVQSILYGIFKIGAIAVPIFSGFGVEATATRIADAECSVVFTGDGFLRRGDRVTLMDTLNDAIERAGHVDHTIVYDRLGIPADSLSWTPRDEWWDDAVATQSPTFETHSMAASDPCMLLYSSGTTGTPKGIVHTHAGALVQPAKEIHFGFDQRPGDRFCWVSDIGWMMGPWSLIGNHAFAGTIVMYEGAPDHPAPDRFWQLIEDHGITQFGVSPTAIRALRDHGDEHVAGHDLSSLRILGSTGEPWDPESWRWFYDHVGGGDTPIINISGGTEVFGCFLMPLPTESLKPCTLGGPGLGMDIDIVDDDGTSVRDANERGYLVARSSSPSMTRRLWSGEDRYLEAYWSRFEDVWNHGDWAQMDADGDWFLHGRADDAINVAGRKVGPAEVEGALIDHDAVTQAAVVGVPDDTTGEAAIAYVILADAATPSAELRAELRDHVGDAHGKPFRPREVVFVDDLPKTQSGKLVRRAVASAYTGADVTDRSSIENPAVLDALRDAT

SEQ ID NO: 18560 - protein, 391 aa, Halobacterium sp. NRC-1
MSEDFYDVLGVSRDATEDEIMQAYRDQVSEYHPDVSDDPDAEEKFKKIQKAKDVLTDEETRQQYDQLGHERFEEAEKRGATGNGGGGAGGMGGAGGPFGGGMGGGAGGGMGDIFEQFFGGAGGGGGRGRSGPEQGRDLRTDLTVTLSEAYRGVSKQVTVRRPESCADCGGSGYPEDADVRTCPQCDGQGVVTQVRQTPLGRVQQRQECSRCGGEGELHSETCSTCGGQGQTRERATLTVDIPEGIRTGQTLRMDGEGAPGEPGAPNGDLLVDVTVEEHPDFERDGDDLHHRHAVSFPQAVFGAEIEVPTLDGAATFDLDAGTQSGETFRLKGKGMPRLRRRGNGDLYVTVQVVTPESLSDEQRDALEQFAEAGGEEIDVEQGFFEKLKNSF

SEQ ID NO: 18561 - protein, 629 aa, Halobacterium sp. NRC-1
MASEKILGVDLGTTNSAFAVMEGSDPEIITNEEGDRTTPSIVAHDDGELLVGKPAKNQAVQNPDQTIASIKRHMGEEDYTVALGDDEYTPEEISARILQKIKRDAEEYLGQDVEKAVITVPAYFNDRQRQATKDAGEIAGFDVERIVNEPTAASMAYGLDEDRDQTVLVYDLGGGTFDVSILDLGGGVYEVAATNGDNDLGGDDWDHAIIDHLADNFENEHGIDLREDRQALQRLTEAAEEAKIELSSRKETTVNLPFVTATDSGPVHLEQDITRATFESITEDLIERTVGPTEQALEDAGLSKSDIDDVILVGGSTRMPQVQAQVEDLVGQEPKKNVNPDEAVALGAAVQGGVLSGEVDDIVLVDVTPLSLGIEVKGGLFERLIEKNTAIPTTASKVFTTAADNQTSVQIRVFQGEREIASENELLGDFHLTGIPPAPAGTPQIEVTFEIDADGIVNVEAEDQGSGNAESITIEGGAGLSDEQIDEMQEDAEAHAEEDEQRRRRIEARNEAETAIQRAESLLEENEELVDEDLEADVNDAIDDVQAVLDEDEPEIDALETATEELSDTLQEIGKQAYQQQQDAQAGAAGGAGGMGGMGGMADGPGGAADADGDDEEYVDADFEDVDEE

SEQ ID NO: 18562 - protein, 368 aa, Halobacterium sp. NRC-1
MRDRLLDANAENNKYQQKLERLSHENKKLKQSPLFIATVQELTDEGAVIKQHGNNQEALTEVTDELRATLEPGSRVAVNNSLSVVRQLDDEADVRARVMEVDDSPDVGYEDIGGLDDQLREVRETVELPMKDPGLFETVGINPPSGVLLHGPPGTGKTLMAKAVASQTDASFIKMAGSELVHKFIGEGAKLVRDLFQVARDHEPAVVFIDEIDAIASKRTDSKTSGDAEVQRTMMQLLSEMDGFDERGDIRIIAATNRFDMLDRAILRPGRFDRLIEVPHPNVGGREKIFRIHTRAMNVADSVDFGELAADTGDLSGADVKAICTEAGMFAIRDDRTEVRMQDFQSAREKLDQDSEPAAATDVSRTFA

SEQ ID NO: 18563 - protein, 883 aa, Halobacterium sp. NRC-1
MRFTRLSLSNFKCYADAAVSLDPGVTVIHGLNGSGKSSLLDACFFALYGTTALDTTLADAVTIGAETAEIDLHFEHAGGDYHVHRRIRASGGRAQTAACVLETPTDRIDGVTDVEAHISGLLRMDAEAFVNCAYVRQGEVNKLINAAPSTRQDMIDALLQLGKLEEYRQRAGDARLGVEDVKSNVEGQLDRLADQIADKEAADPHDRLASHNTALAEVTADIEHFEAEREQARQTRDDAADVLERYEESRTALADVEETIADVREAVAEAERERETLADRVSDHRERASDLDDEAAALAADLGLDDPDAEDASAERDAVADQREAVAERVREVAPAVSRLTEQADSAADDAATLDERAETLREEAAALDAEADDAAAKRDDAAARIEALDADIEAAMAAFDDAPVAFGAAEAFLDDATAERDELRERVATLRADRQSAADRVAEAEALLDEGKCPECGQPVEGAPHVERVTDDRERVAELDAELADVEDELDAVAQRVDRGESLVAAEDRVDDLEQQRERAVERRDEQADIADAKRDQAAEKRDRAADLDAEAEDARADAAAKRDAADEKRETLAALNADQTALKERLDALADLVDRLEAAADAREAAQRLAEKRAALAAQNEQRRDRLSELRERKRTLDSEFDADRIETARADKDRAEDYLEQVEPKLQALREDRDDLQAKIGAAENAIAELESLREEHERVQSRHQDLQAVHDEVTALETMYGELRAELRQQNVSKLERLLNETFELVYQNDSYARIELSGEYELTVYQKDGEPLEPAQLSGGERALFNLSLRTAVYRLLAEGIEGDAPLPPLILDEPTVFLDSGHVSQLVELVESMRRLGVEQIVVVSHDDELVAAADDVVRVAKDATSNRSRVSTPEHI

SEQ ID NO: 18564 - protein, 901 aa, Halobacterium sp. NRC-1
MGNTELSEFMHESDGADDPGEDAIQEEAAVVAGDADPVVNEVLTAEADALPDATGEVELMVTQVDYTIEGSGDRERPVLHVFGRTTDDEAEHVRVHGFRPYFYAPTATLSEDDLTDDVITGTEDGYESIRGEALTKIFGRTPRDVGNIRDAFDHYEADILFPNRLLIDKDITDGVRVPARRADDGALYVHHDEIAACEVAADLRVNTFDIEVNDRNGFPEDGEEPVVCLTSHDSYRDEYVAWLYAAPDATVDAPTAVPGYDPLTDDADIDVRVFDTEEAMHDAFLSYIEDTNPDVLTGWNFDDFDAPYLIDRLDELDPRTDHDLDSDRLSRVSEVWTSGWGGPNVKGRVVFDLLYAYQRTKYSELDSYRLDAVGEQELGVGKERYPGDIGDLWEDDPERLLEYNLRDVELCVEIDRKQSIVAFWDEARKLVGCKLEDATTPGDAVDMYVLHKAFGNFVLPSKGQQDAEEFEGGAVFDPITGVRENVSVLDLKSLYPMSMVTINASPETKVDPEEFDGDTYRTPTGVHFRKEPDGIIREMVDELLTEREEKKARRDDHEPDSEDYERYDRQQAAVKVIMNSLYGVFGWDRFRLYDRAMSAGVTSTNREVIDFTEQAAEEFGYEVAYGDTDSVMLELGDDMTKAEAIAESFDIEDHINAAYDEFAREQLHADDHRFQIEFEKLYRRFFQAGKKKRYAGHIVWKEGKDVDDVDITGFEYQRSDIAPITKRVQKEVIDLVVREGDVDAVEEYVHGVIEEFQEGDADLDDIGIPGGIGKRLDNYETDTAQVRGAKYANLLLGTNFDRGSKPKRLYLAKVHPDFWGHVEDEQGIDTSTSDRYREFRRDPDVICYEYADQIPDTFVVDYDKMLDKTLKGPIERILEALDLSWDEVKSGQTQTGLGQFT

SEQ ID NO: 18565 - protein, 247 aa, Halobacterium sp. NRC-1
METAPLDGDVAVITGASSGIGEATAHALAENGATVVLAARSEETLTEIADTITATYDTAAHAVPTDVTDRAAVDALVETAVEEYGSLDLLVNNAGLARGDDVAALTDDEYRQMMAVNCDGMFYATRAALPHLTDADGTIVFLGSFAGQYPRPSNPVYAATKWWTRGFAHSVEARYGDDGLGVTVVNPTEVRTRFNDEDGTAFEEAYDEAEVSRPTDIADAIAFAATQSAPTVASEIDMYRQDKFSEF

SEQ ID NO: 18566 - protein, 267 aa, Halobacterium sp. NRC-1
MKYEGWPDEGELVVGKVDDIEDFGVFVDLEQYQDKRGLVHVSEVASGWIKNVRDHVNEDQTVVAKVLGVDESAQQIDLSLKDVNDHQHSDTIQEWKNEQKADKWLTLAFGEDMADDQFRRIANGLLADFGSLYDGFEQAAIHGHEALADTALEDDEIDAIVETARDNVSVPYVTVTGYVSLQSPDGDGVDTIKDALQAAEGNGEVPDEVDLDVTYVGAPEYRLRVQAPNYKTAESALEAAGDRAVDSVTAHDGSGAFHRERQLDDDA

SEQ ID NO: 18567 - protein, 188 aa, Halobacterium sp. NRC-1
MDRLKQSLLDAPIIEKDGYHYFVHPISDGVPMLEPELLREIVIRIIRKAELDEVDKIVTPAAMGIHISTAVSLMTDIPIVVIRKREYGLPGEVALSQETGYSENEMYINDVHEGDRVLVLDDVLSTGGTLRAITDALEQTGADVADVLAVIKKAGPNELDDTDMDVRTLINVDVADGEVVVVDDQGDH

SEQ ID NO: 18568 - protein, 334 aa, Halobacterium sp. NRC-1
MRATPPHRRMKATARAHPIQGLVKYHGMRDESLRMPYHDSISVCTAPSNTTTTVEFDPDRDADQYVVDGDTVTGHGADRIRSVVDAVRDRAGFDHRVRLESQNSFPTNIGLGSSSSGFAAAALACVRAAGLDLDLPTVSTVARRGSASAARAVTGGFSDLHAGLNDADCRSERLDAPAEFASDLRIVVGEVPAYKETESAHAEAADSHMFDARLAHVQGQLAEMRDAVRAGDFQRVFETAEHDSLSLAATTMTGPSGWVYWKPETLSIFETVRELRADGVPTYFSTDTGATVYVNTTASHADEVEAAVADCGVDTAVWEVGGPAHELDERDAIF

SEQ ID NO: 18569 - protein, 372 aa, Halobacterium sp. NRC-1
MDDGTIETFKAFRSQFNGDRGPYKGGIRYHPGVTRDEVKALSGWMVYKTAVADIPYGGGKGGIILDPEEYSDSELERITRAFATELRPFIGEDKDVPAPDVNTGQREMNWIKDTYETLEDTTAPGVITGKALENGGSEGRVNATGRSTMFAAREVFDYLDRDLSDATVAVQGYGNAGSVAAKLIADQGADVVAVSDSSGAVHNPDGLDTRAVKAFKTETGSVSGYEGATEELSNEALLTMDVDLLVPAALENAIDEDLAHDVDADVVVEAANGPLTPDADDVLTERGVTVVPDILANAGGVTVSYFEWVQNRQRFQWTEDRVNEELEAIITDAFDAMTDAHEDAGTPNLRTAAYVVAVQRVVDAYEGSGSWP

SEQ ID NO: 18570 - protein, 380 aa, Halobacterium sp. NRC-1
MNFSTRVTSVEPSATLAVSTLASELEADGVDVVDLSVGEPDFDTPESIVDAGKAAMDAGHTGYAPSNGVPELRDAIAEKLQGDGLDYEAGNVIVTPGAKQALYETFQAVVDEGDEVALLDPAWVSYEAMAKLAGGELNRVDLAPHDFQLEPALDDLADAVSDDTELLVVNSPSNPTGAVYSRAAMEGVRDLAVDHDITVISDEIYQRVNYGPAHVSLAGLDGMFERTVTINGFSKAYSMTGWRLGYLAGPEALVDQAGKVQSHSVSSAANFIQRAGVEAIRHTDDAIDEMVAAFESRRDLLVDLFAEHGTDVSTPDGAFYLMLPVADDDQAWCQDALKDAHVATVPGSAFGAPGYARLSYAASTDRLEAAVDRLAAEGYL

SEQ ID NO: 18571 - protein, 298 aa, Halobacterium sp. NRC-1
MDSVLVADDVAKSYGDAAALRGVSLSVSEGEVFALVGPNGAGKTTLVRCLTGTTTPDGGRVELLGEPPQDAQKQRLGLLPQSFSPPDRLTAAELVGYYAGLYADSRAPDAVLESVGLDPDDATRYGDLSGGQRRRACVAAALVNDPDVLFLDEPTTGVDPAGRHALWSVFEGLAADGTTIVLTTHDMAEASALADRVGLLADGDIAATGTPADLVAAHAGSPRLVVDTDADPELAGFDCTRTDAGLVFEGVDPTAVGEIAAALDDADVAFDALSWREPSLEDAYLALAGDAERGEVVQ

SEQ ID NO: 18572 - protein, 395 aa, Halobacterium sp. NRC-1
MTDARVAGVGLTHFGVHPERTSRDLFAEAGLAALDDAGVAREDVAAVHYGNFMGELSEHQGHQGPLVAEALGLDVPATRYESACASSGVALRRAVRDVRNGEADVVVVGGAERMNNLETAESTDALAIAADGLYEVRAGMTFPGAYALMAASYFEQFGGSREDLAHIAVKNHANAVDNDRAQYQQAITVADALESPPVAEPLHLYDACPVTDGASALVLVSESYADTHDVSAPVAVTGTGQGGDKMALQDRQNMATSPAATDAATEAYADAGVSADDVDVAEVHDCFTIAEVMATESLGFFDPGAGITAAREGVTTKDGRLPVNLSGGLKAKGHPVGATGTSQVAELTRLLRGDHVNSEHVADAQTAVAHNAGGTVASAVVHVLETVADTEADAA

SEQ ID NO: 18573 - protein, 397 aa, Halobacterium sp. NRC-1
MGFRDANSKGQTDKAYHMDFTRSAEHDQIAEMVAEFVDEEVKPRAATIDKADEFPADLVAEMSDLGLMGMPFPEEYDGAGLDYHTYATALSEIARGSGGLGTVVAAHTSLAGNMVYEYGSDDQKHDYLAPLSRGDDIGAFALSEAGAGSDVPAMETTAQRDGDAYVISGEKLWISNGSVADTVTVFAKTDPDAGHRGISSFIVRPAEDDGFIVAGTEDKLGDKGCPTAELRFDDMRVPADRLLGEEGDGFKHALETLNGGRITIAARSVGLARAALDDAREYAQDRDQFGQAISDFQTIQHKLADMDTKLQAAELLMHKAADLKIRGESFIKEAAQAKLYASEISREVANEGIQIHGGYGYTKDFDAERYYRDAKLNEIYEGTSEILRNTIANELLE

SEQ ID NO: 18574 - protein, 390 aa, Halobacterium sp. NRC-1
MLCRSALYCWHPGTPSRGAMIAVGDGSTPQPLLYSPTLARPRVMDGRQSHQPTASDREWCHSAVQDVSRTFALTIDALEEPMATRICVGYLLCRVADTVEDATAMPPTEQAQLLETYDAALDPDCGTTVAEFQAAVGDHVPSEPNADWRVVANTTRVVSAFESLDDAAKAAIRPTVREMATGMASFVQRYADAGGLRIQSPTELEEYCWYVAGTVGELVTELLARDAPSDAAAAMRENARSFALLLQLVNVAKDVRPDYEEENNVYLPQEWLDDHDLAPEDVADPEHAGRVASVVERVTDRARGYVADAQRWLEVMPTSQGNTLAAWAVPFLLAVGTMRELGNRPADVVREGDVKVDREEVHAVIGLVADDFDRSAIDSVRERIATESLS

SEQ ID NO: 18575 - protein, 286 aa, Halobacterium sp. NRC-1
MRSLADTETIGVVGAGTMGAGIAQVAATAGYTVVMRDIEQEYVDAGFDSIESSLDRFVSNDDLSEADADAIVDRITGTTDLAELADCDVVIEAAVEDMEIKQDIFRDLDDALPEDVVLATNTSTLSITTIASVTDRASRVVGLHFMNPVPIMTGVEVVVGEKTDADVVAFAHALAEDLDKETWESDDKPGFVTNRILMPWINEGVRAFDEGVASKDDIDTGMKLGTNVPMGPLELADHIGLDVCLDASETLHEELGDRYKPAYLLQRKVDAGDLGKKTGAGFYTYD

SEQ ID NO: 18576 - protein, 287 aa, Halobacterium sp. NRC-1
MADVIDAVFDAIADAAPEVRAGLPDHRATRDDQNASGDTQLEADVWADDLLFDRTESIEGVNWYASEERDAVVTVGDAEGGYAVALDPLDGSSNVKSNNPCGTVVGIYDQPLPAPGSSLVAAGFVLYGPTTTMVVARDDTVRESLVSETGATTDLGPVELPADPTVYGFGGRVPDWTPAFESFVRDVEDDLKLRYGGAMIADVNQVLVYGGVFGYPGMESAPDGKLRAQFEALPIAYIVETAGGASSDGTQSLLDVAPTRLHERTPTFVGTDDVIAALDAALPDHTN

SEQ ID NO: 18577 - protein, 287 aa, Halobacterium sp. NRC-1
MISVQRLEKRYGGVTAVDGVSFDVGAGEVFGLVGPNGAGKTSTLKMLCGLVEPSAGDITVNGFDAGDTAMRRTLGFLPEESPLYDEMTPRSYLRFFADLYDVDRATANERIEAALDRLDLDARDRPVGDFSKGMTRKVAIARSLVNDPDVLVYDEPASGLDPLTTNTVIEFTRELAADGKTIVFSAHDLHHVESVCDRVAIMRDGQFAATGTLADIRDEHGEVSYRVFTDVDVDDARPSNGRYVTTVDSMADVDAIRAAAADAGGGVVDIRTDESTLEDVFLDVTGA

SEQ ID NO: 18578 - protein, 857 aa, Halobacterium sp. NRC-1
MTTRTARIDVGGMSCANCSGTVEDAVGALDGVTDATANFATDAATVTYDPTAADLAGVCAAISDAGYTPITADTTIPVHGMTCANCAQTIEDAVADAPGVLDVSANFATDDAHLTYVPAAFDRDAVHAAITDAGYDPIDADSDTGASTQTAADEARDAERRRQRIRLAFGAVLSAPLLFFVADTFLFGGAVVPDSFTVGGLTIPFGWAEFALATPVYVVLGRSFLSNSYAALVRNGTANMDVLVALGSTTAYVYSLASLLGVLAGGGLYFDTAALILVFITLGNYLEARSKSQASDALRELLEMEANTARLVDADGETREIPADDVEVGDRLKVKPGEQIPTDGVVVSGESAVDESMVTGESVPVSKAPGDDVVGATINENGVLVVQATKVGADTAIQQIVTTVRDAQSRQPDIQRLADRISAYFVPAVIANAVFWGAVWWFAPGLLADVVSALPLWGLVSGGPAAVGTGEFAVVVFASAVLIACPCALGLATPAATMIGTSIGAKHGVLFQGGDVLERVTELDAVVFDKTGTLTTGAMELTDVEAVAAVPDGGTATRSDAAVDEDAVLRLAAAAESNSEHPLGTAIVAGAEDRGLDVPAVDAFENVPGKGIVATVDGRRVRVGNRALLTSADIDPAPAADAMERLEREGKTAMLVAVDDRVAGVVADADTVKPEAAATVDALQDRGLDVHMITGDNERTARAVAADVGVSPEHVRAGVLPGEKADAVDAIQAGDADAMMVGDGVNDAPALATAHVGAAIGSGTDVAIEAADVTLMRDDPADVIQAIRIGEGTLAKIKQNLFWALGYNTAMIPLASLGLLQPVLAAGAMAVSSVSVLTNSLLFGRYTPDEDYSLLGR

SEQ ID NO: 18579 - protein, 325 aa, Halobacterium sp. NRC-1
MSDSTIRTYSSDQRQTDNDETVSTPDEDVLTCPECGGQVIDDEEHGESVCVDCGLVVEENGIDRGPEWRAFNSTEKDEKSRVGAPTTNMMHDKGLSTNIGWQDKDAYGNSLSSNQRQKMQRLRKWNERFRTRNSKERNLKQALGEIERMASALGLPKEVRETASVIYRRALSEDLLPGRSIEGVATAALYASARQLSTPRSIDEVANVSRIDEMEFKRTYRYIVRELSLEVAPADPAQYVPRFASDLDLPDEVERRSRELISNAQADGVTSGKSPVGLAAAAIYASSLLTNHKVTQSEVSEVTDVSEVTIRNRYQELLEATEAAA

SEQ ID NO: 18580 - protein, 503 aa, Halobacterium sp. NRC-1
MTYQHYINGEWVDGDGTETFDSRNPANGETLGTFQRGTTTDVEAAIAAADDAEDEWQSLSRIDRAEYLWDIYHELKDRHQELGEVVTKECGKEISEGKADVTEAWQMVEWAAGDARHPKGDVVPSEIPEKDAYMRRQPRGVVGCITPWNFPVAIPFWHMAVALVEGNTVVWKPAEQTPWCGQIIAEMFADAGIPDGVFNMVQGFGDAGARIVDHDDIDTVLFTGSAEVGEEVARTVADDPGKLAACEMGGKNGIVVTEKADLDIAVHAAVMSSFKTTGQRCVSSERLIVHEDLYDEFKQRFVEIAESVAVDDPLDEETFMGPAIEPAHVEKIQTYNDIAREEAENVLVDRTELGDDEIPDGHEDGNWVGPFVYEVDYDPDLRSITEEVFGPHVALIEYSGDIERAVEIHNDTPYGLAGAVISEDYRQINYYRDNAEVGLAYGNLPCIGAEVQLPFGGMKKSGNGYPSAREVIEAVTERTAWTLNNSKDIEMAQGLSADINTDE

SEQ ID NO: 18581 - protein, 379 aa, Halobacterium sp. NRC-1
MNHELPDEHALIQETVREFCAAEIEPIAGDIEAEHRFPTEIFDALADLDMLGVPISDEYGGLGGDQLMYATVTEELGRVSGSIGLSYAAHVSLGAKPIELFGTAEQKREWLRPLAEGDYLGAWALTEPTSGSDASDMSTTATRDGDDYVLNGTKQFITNASVAGSVVVKAVTDPDAGYDGISTFIVDPADDGFEVTAEWDKMGLNASPTCEISFDNCRIPADRLLGEEGDGWTQTKKTLDGGRISIAALSTGLAQGAYTAASEYATDREQFGQPISRFDAVRNTLVDMHRKIERARLLTRRAASKYDAGESVTRESALAKLDASEAAREVAEDAVQTLGGYGYTTDFAPQRFFRDAKLMEIGEGTSEIQHLVIGRELGL

SEQ ID NO: 18582 - protein, 405 aa, Halobacterium sp. NRC-1
MDDTPAFETLAVSHGESPRETRHGDVVSPIHLASTYAVQELDTDLSLEGVDPDDGQFLYSRLNNPTRHALERRLAALEGGDHGFAFGSGTAAIATAAFAAVEPGDHVVAFDDLYAGTRRMLETLFEGNLGVAVSFVDATDPDAVADAIRPETAFVWMETPTNPRIKLCDIAAIADITDDAGVLFGVDNTFLSPYFQQPLALGADVVAHSTTKYLNGHSDAVGGALVTNNDALADSVEFLQQVGLGNMLAPFDAYLVLRGIKTLAPRMRDHEANALAIAEYLADHDRVTAVHYPGLDSHPQHDLADAQQSGYGGILSFELDGDLADAKRFLDALDEFNLAVSVGGVESLVELPAGMTHEPIPKPDREAMGITDSLIRVSVGIEAIEDLIADLDRGFEAVRSTTPTA

SEQ ID NO: 18583 - protein, 453 aa, Halobacterium sp. NRC-1
MDDINPATGARIDTYETDTAADIEAALARAADAANDWRDRPIRERERHVAAAGDVLRENTQTYAELITAEMGKPITQARAEIEKCAAVCDHYATHASAYLQPDGHPSPAGADVQTVYEPLGPVLAVMPWNFPFWQVFRFAAPALAAGNVALLKHASNVPGCAEAIADVFEAAGLPAGVFQTLLVGADAVEDVIRDDRVRAATLTGSEPAGSAVAATAGETLKKTVLELGGSDPFVVLDDADVAAAAASGAWARTLNSGQSCIAAKRFIVHTDVYEAFRDAFVSEIDSLTVGDPTREETDVGPQASAAGLDTTHEQVRASVDAGATVVTGGQPSDREGAFYEPTVLTDVPAGCPADTEELFGPVAAVFEVPDEAAAIAKANATAFGLGASVWTADRDRGRRVARAMDAGCAYVNQPVTSDPRVPFGGIGRSGYGRELAGAGIRAFVNRKTLWVE

SEQ ID NO: 18584 - protein, 546 aa, Halobacterium sp. NRC-1
MPHDRRSYLRTSSAVIASLLAASTPTSAADTPPEWDPDTVYTDGDQATFDGYVWEAKWWTKGDKPGADEWGPWNQLRPVDDSPTDPGGPTASFTTSESVIEPETTVTVDASNTVGDVDNYEWAFGDGTTASGVTASHTYDAAGEYTIELTVTTGDGTTDTTSATLLVADGGAPADGRVVGYYMQWAQWDRDYFPGDIPLDKVTHVNYAFLTVREDGAVDYIQENAAMRVLEPKSWHDHTGFDDLVDDPETSFLFSIGGWNDSTYFSNAAQSQASRERFADTAIEIMRTHNFDGLDIDWEYPGGGGNSGNVVRDGDKQRYTELLQTVREKLDVAEDEDGKRYQLTTALSADPEKNTGLDHAANAEALDFLNVMTYDYHGAFNDYTNHQAPLYGTEADPSPNADEFYVDASMSFWLDTAFDPAQLSLGLPFYGRSFGNVASSDNNGLYQPFDGTPDGTWGQDNGIKEYWDITQNLAPSSDYETFWDDTAKVPWLYSPSKNVLVSYDSPRSVEAKTAYAAQHDIGGMMFWTFSGDKNEVLLDTVRDAWQ

SEQ ID NO: 18585 - protein, 572 aa, Halobacterium sp. NRC-1
MPHDRRSYLRTSSAVIASLLAASTPTSAADTPPEWDPDTVYTDGDKATFDGYVWEAKWWTKGDKPGADEWGPWTQRRPVDGSPGGPTAAFTVTDTTVEPGTAVTVDAGDTTGSVDSYEWAFGDGTTAAGVTASHTYDAAGEYTIELTVTTGDGTTDTATQQITATTSPGDDEFKVVGYYPSWKGTDDYDFYPADVPFDQVTDVLYAFLDVQPDGTVVLPDSDVDHESLLASFASLKQDRAADTRLKLSIGGWGLSPGFEDAAADQASRERFATTAVDLMRTYDFDGIDVDWEHPGPRRGKCECGSAQGPANHVALLETVRDRLNDAEVEDGRTYDLSVANGGSDWNAALINHREVAAVVDDIYMMAYDFTGVWHGTAGLNAPIYGTPPDYPPSGDAQQYTLETTLTIWKEQGYWVDWMEWEDHGDPVDDPGTLVLGMPFYGRGCNVENGIWDTFSLSEWQQGDPKYQNDVIPPGTWNDLRGPDDANTGAFDYGDLAANYEGADAWTKQRNEQGGVPYLWNDSEGVFISYDDPTSIAAKVELAVAEDLGGVMIWELSQDYDGTLLETINQHTP

SEQ ID NO: 18586 - protein, 837 aa, Halobacterium sp. NRC-1
MSDTDLNATRRDVLKSGAVAAVGLSGGGLLSTLQEADDSDTAGDAVTSFLGEDQVVKTACSPNCRGKCPLDVFVRDGQIKKVEQQVPAAKTFKRGCTLGMTHLQRVYNADRLKYPMKRTSWSPDDPQPDQRGADAQFERIAWDDALDLVADGIQRAKREYGPRSLLWHSGSGDGGITGYRRLKELVGGLQDDFTYGIDTNVGQGFNRVTGEGGVFMPPTNTADDWVNAETIIIWGSDIFASQFQMDAEWILDAKRNGAKLVVVDPVYTNTAEKADLWLPIKPGKDTHLALAMMQYIFEHDHYDEAFLRSRTNAPALVRADDGTLLDPASVTATPPEDGIVVFNTETGSPEVVPAETNGPFALFGEWTIDGTTVHTGLTALREQASSYPPQAVADTAGLAAADIETAADWLATRGPGGIMPSYGVGRYLYGHVFGQTYATLLALTGDYGRHGNIHAQHPSYDGSYLETGDWNDPDGAAGVDTYGYNRVLDLLANGDPVQTKFMYGMNSNMLGNQFPERDRWLDAMSNLDTVVWADIYHTPTTRQADIILPAAHWFETEDLLTTYTHPNLSYRTKAHDPLWEARDDYYIMAGLAQRLGHGDKFPDDKHDVLDRFVKNDDRLSWDALRETGTVATDETPTVAYTDEFGTESGRITVYDDDAPVEEGPALPDDGVSLEVPKPLEARTADDWAHADEYPLLFMQKHSKWRIHSQWANVPWLREINTEPQLDIHPKDATRRGIDDGEYVRVHNDRGSVVVRAKYNDGIQPGLVNTDQGWWARDFVDGHLQDLISAETAKVGRTFAFYDCRVEVTRAADEHQSNEYTQHNPRGSSGTATDGDSS

SEQ ID NO: 18587 - protein, 262 aa, Halobacterium sp. NRC-1
MTNYGLVIDQERCIGCQSCSLTCKQENNVPMGQFWNRVLTQGGDHVDTPSGDYPEGGDGGTLEMTYQPTACQHCENAPCVKVCPVNATYTRDDGIVEIDYDKCMGCRYCMAACPYNARVFNWDEPEHRPEDGTGDVAERPQGVVEKCTFCSHRVEDGLDPACVVNCPADARIFGDLDDDDSTVSKYIAEYDTHQLLDEKGTDPSTYYINGEMSPGRPWKSKKLESELDDDEAAKAARRRSGSVENGYDVTPHVPAETAGGDD

SEQ ID NO: 18588 - protein, 273 aa, Halobacterium sp. NRC-1
MTLTKRVIPCIDVDLDDDGEPAVYTGVNFEELAYTGDPVEMAKRYNEAGADEFVFLDITASAEGRETMLDTVSAVADEVFIPLTVGGGIRDTDDIRETLRAGADKVSINSGAIADPSLVDRGAKAFGSQCIVISVDARRRFDEQGQHYTQVDGESCWFECTVHGGREGTGMDAIEWVQEAQRRGAGELFVNSIDADGTQDGYDVPLTAAVCDAVSTPVIASSGCGAPGDMADAYDAGADAALAASIFHFDEYSIAETKETLADAGYPIRAPDA

SEQ ID NO: 18589 - protein, 328 aa, Halobacterium sp. NRC-1
MTNQRTTRDGSHGTESVPTQRSRESTDEDHGCPECNGDLVTDEDRGETTCGECGLVVEEDGIDHGPEWRAFNAQEQDEKSRVGAPTTNMMHDKGLSTNIGWQDKDAYGNTLSGRQRRKMQRLRKWNERFRTRNSKERNLKQALGEIERMASAFGLPDSVRETASVIYRRALGEDLLPGRSIEGVATSALYAAARQANTPRSLDEVASVSRVDRGEIARTYRYVARELSLEVAPTDPASYVPRFCSDLELSGDVERRARDLLAAAADAGITSGKSPVGLAAASVYAAALLTNERVTQNEVSTVANVSEVTIRNRYHEILDAGGEPGVEA

SEQ ID NO: 18590 - protein, 255 aa, Halobacterium sp. NRC-1
MLLSVPGWYQVVMFNPNNGSEFARNRARLDDTPNPYEPEVGSLPEGDRSQAGSDTVNKTGTTIVGLTTQDGVLMASDMRASLGGRVISNKNVQKVEEIQPNAALSISGSVGGAQSFIRSLRAEANLYEARRGEYMSIDALSTMASNLLRGGPFFRVVPILGGVDDDGGHVFSLDPAGSSMSDTYTAQGSGMPYALGVLEQEYSEDLTMADAEQVAAHAVKSASERDTASGNGIHITKITHDGLTTVGHKEFDALL

SEQ ID NO: 18591 - protein, 561 aa, Halobacterium sp. NRC-1
MKFGSFATFAADIEATDADLDVVALVAELFDAADSDLDVVARFVQGRVFPAHSETKLDIGPQLCYTALSRAAGRNVDADDIEARLAETGDIGAVAGSLDLGGQTGLAAFGGGDDHADGLTVSGVADELAALAAAAGDGSQSEKVTLLFGLFNQCTSREARYLARLVLGEMRIGVGEGAVRDAIAEAFDVPTAAVQRALQVSNDYGLVAETARDSGTDALDAMGLEVGRPVQAMLAQAGTVTDALDEWHEAAVETKFDGARVQVHYDGDDVVLYSRNMENVTGALPELVEFVENNVTAPVIIDGEAVAADEDGDPLPFQEILKRFRRKHDVAAMREEISVELHAFDCLHAPSADGGEDLLDAPFSDRHRRLRSVVDDASAVSEVLVTDDADEIAAFEATALEGGHEGIMLKNPAAPYTPGDRGKDWLKRKPDVETLDLVVTGAEWGEGRRASVLGTFLLSARDAAGDGFETIGKVATGLTDEELAALSDRLEPHVRSEDGQTVDIEPAVVLEVGYEEIQASPTYSSGYALRFPRFVSVREDKTPTTADTIERVERLAAQQQQ

SEQ ID NO: 18592 - protein, 383 aa, Halobacterium sp. NRC-1
MDRVAIIGASMTAFGDRDAWLLALLAEAGDAALTDAGVDGDDVDHLYVSNMASGEFEGQTGVPNALAHDLAAMPAYTARIDQTSSSGGAGIYAAWQSVASGASDLTLLVGGEKMTHRTTGEATDVIASLTHPVEYKHGVTLPSFAGLTARKYLAQYDAPRESLGKVAVKNHRNGLDNPHAQFRKEVDLETVLDSPMVADPLRLYDFCPITDGSAALVLCPESVAAEYTDDYVVISGVAGATDTHVVHERDDPTTMRGVVESAEQAYEMAGRGPDDIDVAELHDMFTILEFLQSEDLGFFEKGAGWKAVRDGVTDRDGDLPINTSGGLKSKGHPLGASGVAQAYELYQQLLGTAGDRQVDAEVGLACNVGGFGNCVTTTILEQP

SEQ ID NO: 18593 - protein, 480 aa, Halobacterium sp. NRC-1
MEQNAIQRRERPFVAGEWVSDGEPLPVSDLADGGTFASVAAADTSDAERALSAATGVHADLRETTVPERVEWLESIADGIRRREDELAEVIVREAGKPISSARGEVQSAAERFDRAVGELRHLTGEYRTGTTAGHEDWQAIVKHEPMGTVLCITPYNYPLSTMALQVAPAIAAGNAVIVKPASKTPISGAILADIAADAGLPDGAYNFVPGESSVIGDPLASDARVDAIAMTGSSGAGEHVARQSGITRLHMELGGNAPAIVFEDADLDAAADAATAGSLKYAGQRCSAVSRVLAHESVHDELVSRIDDAMAEWSIGDLFDTDTTLGPLVSADQADWVAELVDDAVDRGATVVRGGERHVEDGVHYYEPTLLADVPRDARIVDEEQFGPVCAVTTVTDEDDAVRTANGSELALDAAVFTADHDRAMRVAERVNAGAVRINGAPSHGLGDVPFGGNDASGIGREGLDSTIHEFVREKSIIL

SEQ ID NO: 18594 - protein, 667 aa, Halobacterium sp. NRC-1
MSNDTDTPELEARLTDQDEFTPPESFVEQANVSDPGIYDEFDATWPECWTDAADLLDWETPYDQVLDDSNPPFYEWFPGGGLNASANCLDRHLDERGDEAAIEWVGEPADEANRTYTYAQLHREVNEFAAGLREMGVGEDDIVTLYMPMVPELPIAMLACARLGAPHSVVFAGFSADALSTRMNAADSEYLVTCDGYYRRGDPLDHYAKTLDGLDGVSHAVSDVVVVDRLGANGDGFDHDRPAAHHDYDAVVAAHDGASVSPVERDATDMLFLMYTSGTTGQPKGVTHSTGGYLSWAAWTSQAVLDIKPSDTYFCSADIGWITGHSYIVYGPLALGTTTMLYEGAPDHPDKDRLWELVESYEATQLYTAPTAIRSFMKWGVEYPDAHDLSSLRLLGTVGEPINPRAWTWYYTHIGDESCPIVDTWWQTETGGMMVTGLPGVSTMKPGSAGRPLPGVDARVIDTDGDDVAGGRAGHLTIQKPWPGMLQTLYENDERFIDEYWRVYSDTDSGDSADWVYFPEDGAKVDDDGYITVLGRVDDVVNVSGHRLGTMEIESAIVDVPGVAEAAVVGGDHDLKGEAVYAYVLTTDDHDASDALRERIVASVEDAIGPIARPEAVVFAPELPKTRSGKIMRRLLEDIANDADLGDTSTLRNPDVVETIQDQLAGD

SEQ ID NO: 18595 - protein, 527 aa, Halobacterium sp. NRC-1
MVVSPTYLRPVTFAQSRNAFAVSHRPFDMANDSSTDGRFSEKLRVPEALTFDDVLLRPAESRVEPDDADVATRVSTNVELEVPVLSAAMDTVTESRLAIAMAREGGLGVLHQNMDTDRVVAEVERVKRADELVIDRENVVTAAPEQTVEAVDEMMDRSDVSGAPVVDDDDTVRGIISATDIRPYLEVGESDAVREAMTDEVITAPEDITARDALELMYEHKIERVPIVNDEQHLVGLVTMQGILERREHGSAARDQNGRLRVGVAVGPFDTERATAVDEAGADVLFIDCAHAHNLNVIDSAREIKASVDADVVVGNVGTREAAEAVVDFADGIKVGIGPGSICTTRVVTGSGMPQITAVSQVADVAAPAGVPVIADGGIRYSGDAAKAIAAGADAVMLGSYFAGTDEAPGRVITMNGKKYKQYRGMGSVGAMQSGGSDRYLKDDDEDEEYVPEGVEAATPYKGSLASELHQLVGGIQSGMGYVGAESIPAFKADAEFVRVSAAGQTEGHPHDVMITDEAPNYSPQGE

SEQ ID NO: 18596 - protein, 395 aa, Halobacterium sp. NRC-1
MRTTHLNPMIPERRPREGILKDGPAVTPSMELRDLSDHVEYRAGRGIEEVARELGRDPSEFVKLSSNENPHGPSPKATIAIREAATGVHRYPKAVHADLTGALADRWDVGDDQVWVANGGDGALDYLARATLDPGDSVLVPSPGFTYYGMSARFHHGNVAEYDVAEGADGFEMTADAVVDAYDGERVVYLTTPHNPTGARFTLDEIVAVADRTDEDTLVLVDEAYGEFTETPSAVTLFDGQPAGGHAPRDDIAVLRTFSKAYGLAGIRLGYAVVPDSWADAYARVQTPFAASVIACQAGVAALDDDDHVEATTDSVAWGRDYIHDELAARTYESHGNFVLANVGDAGRVAEAAKREGVLVRDCTSFGLPEHVRITIGTRSETERAVAVLNEVCDT

SEQ ID NO: 18597 - protein, 529 aa, Halobacterium sp. NRC-1
MSRRPSPNADVCVIGAGPAGGLIADRLASDGHSVVVLEAGPRFDAADRERRMERSIRPAHGPASVWEMGGPRDAYASTGDRYYPLNAARVKGVGGSTLHWQGMVMRLHEQDFRLASATGVGADWPFDYDTLKPYYAAAESALGVSGASDNPFAPPREQPHPQPAFPPSYSDSLFADACESLGIATHSVPNARLSAGRETRRACVGYGTCQPVCPSGAKYDATVHVDRATDAGARVIDEAPVQRLEHDAAGDRVTGAVYATPDGTTHRQSATEFVLAAGGIETPRLLLLSDSDRYPDGLANSSGLVGRYFMDHLFAGAGGTLDEPTRQNHVGFNTTESHQYYDRPDGSRGAIKLEFLNYAGPSPAEMALSGDDWGDAMCDRIRDASGTHIAVGGLVEQQPRPENRVRLHPERTDVHGNPVPDVVWSLSAYERRTIERANEIQREILTELGADIEWTVGPEDTGPAFHHMGTTRMGTDPAESVVDPRLRTHDLSNLSVASSSVFPTAGAMNPTLTIAALALKAADHIAARL

SEQ ID NO: 18598 - protein, 426 aa, Halobacterium sp. NRC-1
MDVSIVGSGYVGTTIAACFAELGHTVVNVDVDADVVAAINDGDAPIHEPGLAERIDAHAGTRLRATTDYEAVRDTDVTFLALPTPAREDGSIDTSIMESGAASLGEALAGADDHMVVVKSTVVPGTTEDVVESALVSAGFDDPLLAMNPEFLRMGSAVDDFRHPDKVVFGARRDAAYDQLHAVFEPLLADAGDATVVETGLREAEMIKYANNAFLASKVSLINDLGNICKELGVDAYEVADAIAEDDRISGRFLRSGVGWGGSCFPKDVAAITAAAKDAGYEPAMLEAAVEVNDRQPERLLSLLDGHVDVAGERVAVLGLSFKPGTDDIRGTRAVPVIDGLQDREADVVAYDPVAAEKMAEQRPEVTYADSAAGALADAVGAVVVTDWDEFAALDDEFDAMAERVVVDGRRVVDPQADLTYDGLTW

SEQ ID NO: 18599 - protein, 240 aa, Halobacterium sp. NRC-1
MQAVVLAAGEGTRLRPLTEDKPKGMVEIAGKPILTHCFEQLVALGAEKIVAIVGYRKQNIISHYGDEFDGVPITYAHQREQNGLAHALLKAEEHVNEDFMLMLGDNIFRANLEDVVNRQQEERADAAFLVEEVDWDEASRYGVCDTNDYGEIQEVVEKPDDPPSNLVMTGFYTFSPAIFQACKLVQPSDRAEYELSDAIDLLIKSGRTIDAIPMEGWRIDVGYPEDRDEAEERIDAVSNE

SEQ ID NO: 18600 - protein, 493 aa, Halobacterium sp. NRC-1
MRDEVTLQATTNPDRPALVDAATDRTWTYDALDSAVDATAGSLAALGVTPGDRVAVLLETRPAFATLVFAAARLGAVLVPLNARLSQPELATQADAVAPVAVICGRDTATAADRLDAPAVRVADDATVRPLSGTDPDAVTPVDSAWDDTRLLLFTSGTTGDPTAVRLTYRNLAASAAASAARLGVLPDDRWLCPLSMYHTGGVSVVLRTALYGTTAVLTRTPGFDAAAVGDALETHDCTGVSLVPPMLDRLVEADAVPDSLRFALVGGAPTPPELVERACAAGVPVCPTYGATETASQAATLHASDAPAHPESVGRPLLGTTVTVVEPDTHTPVPDGQAGLLAVSGPTVTPGYAGEGTAPRCEHGLLTGDRGWIDADGFLHVGGRASDEIITGGENVRPEAVAAVLREHPAIEAVAVVGVPDDAWGDRVGALVVPADDTADVSVASLRAFCDGRLAGYKHPRVVAAVDALPRTASGTVDRQAAVAELRDDAAP

SEQ ID NO: 18601 - protein, 440 aa, Halobacterium sp. NRC-1
MTVTIVGAQLGDEGKGGVVDLFGDATDVVVRYQGGDNAGHTVVAGGEEYKLSLVPSGVVRGKTGVLGNGCVINPETLFEEVDALRERGLDPDVRLAKRAHVILPFHRELDGAEEAAKADSDSEIGTTGRGIGPTYEDKIGRRGVRVGDLLNEDALRDRLEYLVDAKRAIYEDVYGFDASETDGAFDIDAIHEQCLAYADRIRDEDLAVNAGDYLADRIADGDNVMLEGAQGTSLDIDHGNFPYVTSSNPTAGYAATGSGLGPTTVGQGEIVGIIKAYLSRVGSGPMPTELDGDQAEYIREEGGEYGTVTGRPRRVGWLDMPMLRHAARANGFTGIAINHLDVLAELDEVNVGHAYERDGERIHTLPATTEAWRDCDPVMKSFDGWSAFDPAVVADAGYSALPDNAQAYVEYVEAELDTPAYVLGVGPGREESVIRQNPFE

SEQ ID NO: 18602 - protein, 370 aa, Halobacterium sp. NRC-1
MGLEEDIESLEEEIANTPYNKSTEAHIGRLKAKLAEQKEKLEAQQSGSGGGGGYAVEQHGDATVALVGFPSVGKSSLINAMTNADSEVGAYEFTTLNVNPGMLEYRGANIQLLDVPGLIEGAAGGRGGGKEILSVIRGADLVIFVLSAFEIEQYDRLAEELYNVNIRVDAEPPSVTVRRKGKDGIDVNTSGELELDSDTVKGILRERGFINANVTIRGNPSVDRLIDGVMDNRVYMPSLVTVNKVDLIEPSYAGTMKDALRDHGVSPDDAIFISAAEEKGLDVLKERMWRALGLIRIYMDKPGRGVDREEPLIIRRGETVDDAVQKLGGTLDERFRFARVTGPSAQHDDQQVGRDHVLEDEDVLRVVARR

SEQ ID NO: 18603 - protein, 391 aa, Halobacterium sp. NRC-1
MRDGRDPAGMPSERAAAVTPFAAMDVLERAADRADVIHMEVGEPDFAPPAAATEAAVDALRAGDDDYTTSRGRRSLRDAISGYYAAEYGVSVPAERIVVTPGSSPALLTVLLATVDPGSAVVLSDPHYACYPNFVRLADGVVRTVGLAPDAGFQPAVSDYDAAIGDDTAAMLLNSPGNPTGAVIDGESLSALVALADRTDTAVVSDEIYHGLAFDAAAHSVLEYTDDAFVIDGVSKRYGMTGWRLGWVVCPRRYVDTINAIAQNTLICAPSFVQAGAEAAIRHGTDWLDGVRADYRTRRDILCAAAERWGFDPGYTPAGAYYMLLDVSRLGAAPAVADALLETAGVAVTPGPDFGANATEYVRASFAVSTDAVREAVARIDAVLASATTLT

SEQ ID NO: 18604 - protein, 398 aa, Halobacterium sp. NRC-1 [sequence omitted]

SEQ ID NO: 18605 - protein, 330 aa, Halobacterium sp. NRC-1
MTTTSSAPGKVYLFGEHAVVYGEPAVPCAIERRAHVTVSEREDSRLRVCSGDLSIDGFTVEYSGDRDAGGTPDVDVPAPIVDAAMGYVDAAVEQARAAADAPTAGFDVTIDSEIPLGAGLGSSAAVVVAGIDAATRELGVELDAREVADRAYQVEHTVQDGEASRADTFCSAMGGVVRVSGDDCTTLDAPALPFVIGYDGTSHDTGELVAGVRALREEFGFVADTVTAIGDLVRRGEAALADGDVATLGRLMDINHGLLSGLGVSGRTLDAMVWAARDGGADGAKLTGAGGGGSIVALDAGSGAETALSLTPDCEAAFRADLAREGVRVE

SEQ ID NO: 18606 - protein, 347 aa, Halobacterium sp. NRC-1
MSQEARERAVLAAVRERRQQVNDAIDDDLPVAEPERLYEASRYILEAGGKRLRPAVLLLTAEALADTSDTPPYREFPDCIGGHVDVMSAAVSIEVIQSFTLIHDDIMDDDDLRRGSPAVHREYDTETAILAGDTLYSKAFEIMLETGAPPERGLRAMRTLAETCTHICEGQAMDIDFETRGDVVTDEYLEMVELKTAVLYAAAATLPGLLLSADEETVEALYNYGLRVGQAFQIQDDVLDLTVPSAELGKQRGSDLVEDKTTIITLHAAEHGVDVDGLLDAEDPADVTEAAVQAAVQALQDAGSIQYASDLAEDLVEEGKAHLEVLPENEARHRLEQIADYLIERGY

SEQ ID NO: 18607 - protein, 586 aa, Halobacterium sp. NRC-1
MDDELRERVRRAAERAALFNALKHGSDAQVGAIMGPMMGEHPDFRAHGDEIPGVIAPVIEDVNGMSDDEQRARLAELAPEDVEELDSEDEGDDHALPALPNAEAYDEVRMRCAPNPNGPWHVGHARMPSVIGTYKQRYDGSFVVRFDDTDPETKRPDLDAYDQILEDLSYLGFEADEVLTASDRVETYYEHARRLIGMGGAYTCSCPGAEFSDLKNSGEACPHRDKDPETVADEFEAMVDGEYNSGEMVLRVKTDITHKNPALRDWVAFRMVDTPHPRDAASGYRCWPMLDFQSGVDDHRTGVTHIIRGIDLQDSAKRQRFLYEYFGWEYPEVVHWGHVQLDAYDVAMSTSTIKERIAAGELEGWDDPRAPTMQSIRRRGIRGAAVVDAMVELGTSSSDVELAMSAVYANNRDLVDDTAPRQFLVRDGFEARGEGPEESHEAVEVPVDDGPDEATPQVHPEHPDRGDREIPVGERVLVEATDLPAAGDRVWLKGYGPVRYDGERFAFLDADIDIVREEGVDVVQWVPAEHNVDVRLRTMDGDVTGYAEPGFADRDADEIVQFVRVGFARVDAHRDGGASVAYFTHP

SEQ ID NO: 18608 - protein, 161 aa, Halobacterium sp. NRC-1
MTDHDERTFVMVKPDGVQRGLIGDIVTRLETKGLKMVGGKFMRIDEELAHEHYAEHEDKPFFDGLVSFITSGPVFAMVWEGADATRQVRQLMGATDAQDAAPGTIRGDYGNDLGHNLIHGSDHEDEGANEREIALFFDDDELVDWDRDASAWVYEDLADHD

SEQ ID NO: 18609 - protein, 393 aa, Halobacterium sp. NRC-1
MSGNDDADDAADRFQTRAIHAGQAPDSETGALMTPIFANSTYVQDGPGDHRGYEYSRTGNPTRTDLEANLASLEGGEHGRAFASGMAAINTVLNLLAAGDHVVAGDDVYGGTHRIFTQVYEDYDIDFDFVDTTDHDAVREAMGEATELLWVETPTNPLLNVNDIGALADIAHEHDALCAVDNTFATPYLQRPLEFGADIVSHSLTKYLGGHSDLVAGALITDDDDLDEQFGFYQNSVGATPSPFDCFLVLRGTKTLGVRMDRHCETAMELAAWLADHEHVSQVHYPGLESHPDHELAAAQMDGFGGMVSFELDATLEAASAFVEETDVFTLAESLGGVESLIEQPAAMTHAAIPKAEREAAGLTDGLIRASIGVEHVDDLKADLQQAIEAALQ

SEQ ID NO: 18610 - protein, 177 aa, Halobacterium sp. NRC-1
MGTETATLGGGCFWCTEAAMEELAGVTDVTSGYAGGDTADPSYRDVCSGTTGHAEVVQVEYDTAELAYEDVLEVFFTVHDPTTVDREGPDVGSQYRSIVLPHDDQQHERATAFVDELAAADAFDGSIVTEIEPLETFYPAAEKHQNYFEKNPDAAYCTVNVAPKVSKVREQFGARTE

SEQ ID NO: 18611 - protein, 340 aa, Halobacterium sp. NRC-1
MDKAADAGLLGPGIPMAYGGAGYSPVEVAIIVEELFAADPGIGLCVASAGFGAEAITAFGTDDQKRRFLEPVTAGDAIMGSAISEPDTGSDVASVSATAEKDGDEWIIDGNKMWITNGSVGDYFVVLCRTDPDASGRYEGFSQIVVESDRDGFTAEKITGKLGIRASDTAELVLDAVRVPEENLIGTRGGGFLQLMQFFDETRTTVAAQGVGIARGATERALAYAQEREQFGQPVADFQAIQHKLAEMQTKTEAARTLTRKSAWSVDHRDDQLTALASMAKSFASRIAVEVADEAVQIHGGAGYVNDFDVERFYRDAKITQLYEGTTEIQKNVIAREMMD

SEQ ID NO: 18612 - protein, 416 aa, Halobacterium sp. NRC-1
MTESGPLENMLAQMEQAREYVDIDDGIYERLKSPERTLSVSLPVRMDDGSVEVFDAYRCQFDSARGPYKGGIRYHPTVSEEEVSALAGWMTWKTALVDLPFGGAKGGIVCNPKELSDNEIEQLTRRYTEGIRRMIGPETDIPAPDMNTDPRTMAWVMDTYSVYQGYAVPEVVTGKPPEIGGTDGRVEATGRGVSIITEETFEYFDTDIQDADVAIQGFGNVGSVTADLLSERGANIVAVSDVTGAIHDPTGLDIADVQAYADANGGRLEGYDAEPISNDDLLTLDVDALIPAAIEDVITVDVAERLAADVIVEAANGPTTFDAAQVLSDRGVPVVPDILANAGGVIVSYLEWVQNSQQYSWDVEEVNRDLRQRLTGAFDEMLVAYEDRNIPTLRTAAYTIALERSADAHEFRGLFP

SEQ ID NO: 18613 - protein, 461 aa, Halobacterium sp. NRC-1
MSDTRIDAADREALQANLVRSHAAGAGSELDTAAVRALLVTRLNALAKGYSGIRERVLDVLVGLLNEGVHPVVPSRGSLGASGDLAPLAHMSRVLIGEGQADVAGERMPAAEALAAADLEPVTLQAKEGLALINGTQLTTGVAALALVDAERVLRSADTAGALTTEVTMSTTASCAPAIHEVRPHDGQAVSARHIRNLTAGSEVLDHHRDCDRVQDAYSIRCLPQVHGAVRDALDHLRAAVATELNSATDNPLVFAGDRVGPRASGTDRAAVVSGGNFHGEVLALRLGYAASALAELAAISERRTDRLLNPETQEPHLEPFLAPDSGLHSGLMIPQYTAASLVNDLRSLGQPTLDNASVSGAQEDHVSMSAGAAYNFREAVEKAATVVGVELLCGAQGREFLDPDLALGAGTAAAYDLVREVSEPVAGDRALADDMAAVGDLVRAGLVEDAVARALDAPLA

SEQ ID NO: 18614 - protein, 398 aa, Halobacterium sp. NRC-1
MAIRTLDDLAAANRAIGVRVDINSPLTAAGGLADDARLRAHVDTLAELLAADARVAVLAHQGRPGGDEFARLERHADRLDALLDAPVSYCDATFSTGARDAVADLAPGEAVVLENTRFYSEEYMAFAPERAADTALVDGLAPALDAYVNDAFAAAHRSQPSLVGFPEVLPSYAGRVMEAELDALSGVADTPTPRTYVVGGAKVPDSVEVAAHALSHGLADNVLVTGVVANVFLAATGVDLGRASTDFIHERDYGTEIARAADLLAAHNDALHLPVDVAVERDGARCELSTDALPPAGDEAVCDIGSDTVDAYADVLADSETVVVNGPAGVFEDDLFADGTRGVFDAASEVEHSIVGGGDTAAAIRRFDITGFDHVSTGGGAAINLLTDADLPAVAALR

SEQ ID NO: 18615 - protein, 394 aa, Halobacterium sp. NRC-1
MNGNRFGRLFEVTTYGESHGPGMGVVVSGCPAGVALDERMIQDELDRRKPGQSMITTSRGEPDEVSIQSGLQDGYTTGTPIGMTIENKDAESGKYEPFVTAPRPSHGDYTYSAKFGTRNWGGGGRSSARETVNWVAAGAVAKAVLAQSDHDVRVKAHVNQIGEIEAPDVSFEDIREHSEDNEVRCADPETAERMRALIDDYQERGDSIGGSIYFEARGVPRGLGAPRFDSVPARLGQALFAIPATTSVEFGLGRDARSVAGKQRNEDWTVADGDEDHVVADEGDPIPAGNDHGGLQGGITTGEPIYGEASWHAPTSIPKTQATVDWETGEEKAVTVTGRHDPSLPPRAVPVVEAMLYCTILDFMLLGGRINPDRLDGHPGQYDTDYHPSSPRNE

SEQ ID NO: 18616 - protein, 439 aa, Halobacterium sp. NRC-1
MPWAALLAGMHATVSPSRVRGRARAPPSKSYTHRALLAAGYADGETVVRDPLVSADTRATARAVELLGGAAARENGDWVVTGFGSRPAIPDAVIDCANSGTTMRLVTAAAALADGTTVLTGDESLRARPHGPLLDALSGLGGTARSTRGNGQAPLVVDGPVSGGSVALPGDVSSQFVTALLMAGAVTETGIETDLTTELKSAPYVDITLDVLDAFGVGASETAAGYRVRGGQAYAPSGAEYAVPGDFSSASYLLAAGALAAADGAAVVVEGMHPSAQGDAAIVDVLERMGADIDWDTESGVITVQRSELSGVEVGVADTPDLLPTIAVLGAAADGTTRITDAEHVRYKETDRVAAMAESLSKLGASVEERPDELVVRGGDTELSGASVDGRGDHRLVMALAVAGLVADGETTIAGSEHVDVSFPDFFEVLAGLGADTDG

SEQ ID NO: 18617 - protein, 615 aa, Halobacterium sp. NRC-1
MYEHDVIVVGGGGAGLRAAIAAQEEGADVAIVTKLHPVRSHTGAAEGGINAALRDGDSWEDHAYDTMKGSDYLGDAPAIDTFAKTAPDEVIQLEHWGMPFSREDDGRVSQRPFGGLSFPRTTYAGAETGHHMLHTLYEQVVKRGIEVYDEWYVSELAVTDEDNPNDRECHGVVAWDVQSGEIAGFKASDSVILATGGIGQAFDHTTNAVANTGDGVAMAYRAGVPVEDMEMIQFHPTTLPSTGVLISEGVRGEGGILYNGEGERFMFEHGYATNDGELASRDVVSRAELTEINEGRGVDDEHIYLDMRHLGEERITDRLENILHLAEDFEGVNGLEEPMPVKPGQHYAMGGIETNEFGETCVSGLYAAGECACVSLHGANRLGGNALPELIVFGALAGRHAAGKEMADPLIETGPSDALEHDELSVPTGAPDGDAGVAEPATDGGAQGAVDTRAPTDVVADTATTEEERIEALLGREDGVNHADVRADLQQSMTENVNVFRTEDGLKQALADIQDARKRYQDVYVADKSRTFNTDLQHTIETRNLLDVAEMITIGALARDEFRGAHWRKEHQERKDDEWLKHTMVSWNDGDPDLWYRPVLLEGHDDTYEPKTRSY

SEQ ID NO: 18618 - protein, 292 aa, Halobacterium sp. NRC-1
MSTKPSQSETETETDTEPATTGHQQRRLDDKRARADDRDEAAAQAETEFDGETVELKVFRYDPEIAGKEEPRFDTFTVPFETGMTVLDALIFARDSYDSSLTFRHSCRQAVCGSDAFFVNGSQRLGCQTQIEDLEWPVRVEPLPHSDVVKDLVVEMDHFYDQMESVDPFFDPDDLPDGELEEQRQSRQNRENIKLSTRCIWCGACMSSCNIAAGDNKYLGPAAINKAYRFYMDDREGSEKRQERLEIIEQEHGVWRCQTQFSCTDVCPKDIPLTEHIQELKREAVKENLKFW

SEQ ID NO: 18619 - protein, 659 aa, Halobacterium sp. NRC-1
MDVDDIHSIAVLGAGNMGHGIAEVAAMAGYTVRLRDISAELVQDGYDQIEWSLGKLAESDQLTEAAADAALDRISTHVEVSDAVDDVDVVIEAVPEKMEIKTDVYTEVEAHAPADAVFATNTSSLSITDLSEVTERPARFCGMHFFNPPVRMELVEVISGAHTDDAVLECIESLAADFGKTPVRVRKDSPGFVVNRILVPLLNEAAWLVHDDEATIAEVDSTTKYDMGLPMGAFELADQVGIDVSHDVLDYMQDVLGTAYEPCPVLVDHVEAGDLGRKSGAGFYDYGDDAAGADVPTDAIRADIADRLTAVMANEVAKLVGGGVADPAEIDEAVMLGAGYPEGPAKMADAAGITYLHETLVAAHEATGQARYEPADTLAEMAAAGESFHGRGDEDADGRREFDAVSVSVDGNVGHIELDRPHRMNTISGELLADLSDAIDVLGDDDDVRAVLLTGAGEKAFSAGADVTSMAGNADPVEAVELSRMGQQTFGKLEAADEPVVAAIDGYCLGGGMELATCADMRLASERSELGQPEHDLGLLPGWGGTQRLKHIVGEGRAKEIIFTADRFAPETLADYGFINEVVTTEAFEERAWELARDLAAGPPIAMKYTKRAMRAGRDDTDAGLEIEAQSFGQLMNTQDLMEGVSAFSADREPEFNGE

SEQ ID NO: 18620 - protein, 521 aa, Halobacterium sp. NRC-1
MSNLVTNVQTSATELPDHPAVVYDDHTHTYSDLWERTGQFAAALRDHGVTPDDRVALYLPNLPQYVTAFHGALRAGCVVVPMNPQYKTREIEYLLSDSGASVVVALADGASTVEDVRAETAVDTVVTVGGDADVGTPFEAFLDTGSDDTVAPRDDDDLAVQPYTSGTTGQPKGVQLTHHNLASNAEQSMDIVPDGLQPADRKIGVLPLFHIYGMTVGMNAALFAGATFYPMPRWDTEDAMSLVADAELTLFDGVPTMYNDIITHPNAEEFDLSSVRRCTVGGSGIPTEVLRKFEELYTAKIDEGYGLTETSPVTHFNSPNWGRRVGSIGKPLAGIDARIVTDDFESVPPVDEGPVDESDHDMDDITGELVVSGPNVMAGYLDLPEANRKAFTEADGKRWFHTGDLGYHDADGYFYIVDRKTHMINTAGYNVYPREVEELLFEHDAIADAAVVGVPDERRGETVKAYVVRAPDTDVSADEIREFCLTNLAEYKHPRTVEFVEQLPRTTTGKIKKHELVPDED

SEQ ID NO: 18621 - protein, 255 aa, Halobacterium sp. NRC-1
MTDRSVVSGTAIVTGASSGIGRATAERLAADGARVVLCSRDHADVDAVADAIRTDGGTALPVECDVTDRDAVDALVEATVHEFGGLDVLVNNAGASFVAPFDDISRNGWDRIIDVNLGGTYNCTQAAAEQLKRDGGGAVVNVASVAGQEGSPHMSHYAAAKAGIITLTRTLAAEWAPAGVRVNCIAPGFVATPGLDAQMGVSAADIDRREVARRIGTSAEIADAIRFLASPAASFVVGETLTAAGVPQGEEVPSP

SEQ ID NO: 18622 - protein, 470 aa, Halobacterium sp. NRC-1
MSEDYRTEQDSLGEMQVPADAYWGAQTQRAIENFPISGIAFGRRFVRALGVVKKAAAQANRDLGLVDDERADAIVAAADEVIAGEHDDQFPVDVFQTGSGTSSNMNANEVIANRAAELLGEEIGDRVVHPNDHVNYGQSSNDVIPTAMHVASLDALVNDVKPGLETLAAELDDKADAFDGVVKTGRTHLQDATPVRLGQEFGGYRTQVEKGIDRIEAVAPRLSELALGGTAVGTGLNTHPEFPETAAGYISEETGVTFREADNHFEAQAAHDAMNEAHGALRTVAGSLNKIANDLRLLASGPRNGLGEIEQPENQPGSSIMPGKINPVVAEAVNQVHKQVVGNDAAIAAGAAEGQIDLNLYKPVLAHNFLQSADMLANASAAFGEKFVAKLEANEAACEAQVERSMALATALNPTIGYDKASEVAKAALKEGKTVTEVVVEKGYLSEAEAADVLDPEGMTHRGILSGDDT

SEQ ID NO: 18623 - protein, 327 aa, Halobacterium sp. NRC-1
MGNADLRQLAAIEETPFADLEGSVVAVDAHNWLYKYLTTTVQWTGADVYTTSDGTEVANLVGAVQGLPKFFEHGLTPVFVWDGGVTELKDDEIADRREQRERYEEQLDDAREAGDAAEAARLDARTQRLTPTIHETTRELFDLLDIPQVEAPAEGEAQAAYMTRTDDAVDYAGSDDYDCLLLGSPVTLRQLTSSGHPELMDFDATLAEHDLTWEQLVDVGILCGTDFNPGIDGFGPTTALDAIGEHGDLWDVLAAEGEHVAHGDRIRELFLNPDVTDDYVIDPDVSPAIDAARAFVTDEWEVDADAVARGFERIDAAAAQTGLDRWT

SEQ ID NO: 18624 - protein, 800 aa, Halobacterium sp. NRC-1
MGDADEPWREFFGFEAPYDQQADAIGAAIEAGDSDGFLAMEGPCGTGKTMAALTAGAHLVRNTDSYERVLVVTPVKQQLEQFVADLRTMNAGLDDPLDGVALVGKRDLCPYEREDKFPDDAGVHERCEDLRESTAGLVEGDDGGEFDGQDARDLTELPAAETPDEPWWDPAAGRALARSARADASQTLSQTPLRTAGTDAPYVPHQPTAPEDMADGDPPLMCPFEADWYGRDKGSPVGFETGQHNVVTSADVLPAGVDHGTCPHRVQQVLLDHAEVVVGNYNHLFDPQTRGLTDHLIDDSTFVVVDEAHRLEERVRDLLSDRLGRHTLTRARNDCRTLLTRANQSRENRQQVTDHLASHDCSLDAVEAMVGFLDDVLEWLDDRVARYLAAEGFDPDRPGSLPERDHEIPLRDPESEQPDALTQWAEQHGHTGDAWRSLAATGTAVQAILDDDGDRSAVAGPVGVTLQRWWERDHATYFREVELEHVPKESGRAGAAWAESYTPALVMFNCMPARALRETLSEVGGGVLMSATLEPLDVFREVAGLDRLAAGAGDSDPRPVVERRYDLRFPESNRASFLVDATPFTAHNRGDPEPGTDNPTRDEYRYVLRTVARQPGNVLVCMPNYREAAWAAAYLSDGVVEKDVLVDESSSNAATDDLKATFFAGDGKVLVTSTRGTLTEGVDYDGAKLGACLVVGVPLVNVGSPRIRAVRRAYADAFGDDHAFEYALTVPAVRRARQAIGRVIRGPEEVGVRVFAGGRYVEDARHSVFEYLGPGERAEFTTLTPSFLGSQLDAFRSESD

SEQ ID NO: 18625 - protein, 297 aa, Halobacterium sp. NRC-1
MTEIIDGDAVAAQLRADLTGAVETLETAGVTPRLATVLMNDKQASETYVSMKQQDCEEVGIAAEDVRIDPEASADTLFDTVAELNAREDVHGILVQDPTPDHVPDERVLSAVDPAKDVDGFHPENVGKLVGGTPRFKPCTPHGVQKLLAHQGVDPDGAEVVVVGRSNIVGKPLANLLAQKAAGGNATVTICHSHTDDLAAHTRRADVVVAACGVPELIDGDMLSGDPVVIDVGINRVDADTEKGYELVGDVDYDSAEAAASAITPVPGGVGPMTRAMLLYNTLAAASEQTGVAVALP

SEQ ID NO: 18626 - protein, 343 aa, Halobacterium sp. NRC-1
MTTVGVLGATGAVGQRFVQLLAGHETFELSVVTASPDSAGETYRDAANWGLDTPVPESIAELPVQPTTPAAIPDDTALLFSALPSDVGAEVEPALCEAGFVVSSNASNERRAGDVPLVVPEVNADHLGLIDVQRDARGWDGALVKNPNCSTITMVPTLAALTEFGLDRVHVATLQAVSGAGYSGVTSMEILDNVVPHIGGEERKMETESRKLLGEFTGAEVQHHDAVVSASCNRVPTLDGHLENVFVETSDHPAPADVAAAFEDAPTLDLPSAPDPLIETFTAPERPQPRLDRMRGDGMAIAAGGIQTTDTGIQYNCLAHNTIRGAAGASILNGELLAREGWV

SEQ ID NO: 18627 - protein, 425 aa, Halobacterium sp. NRC-1
MEYEAVADLAPDRRVALFERDAGVDAVRSDVAEILDRVESEGDVALRALASEFDDVEVGNLDVTDEMERAADAVPDDVYDAIEDAAANIRAFHEAQLPDDWRESFAAGRELGRRFRPVRRVGVYAPGGTAAYPSSVLMGVIPAVVAGVEQVAVATPPAETINPVTLAAAHAAGADRVYQVGGAQAIGAFAYGTETVDTVQTVVGPGNKWVTAAKAEVRGDVEIDFLAGPSELLVVADETAEPAFVAADLLAQAEHDPNASVVAVTDDEATAAAITDAVAARLDDRERADTIRAALDNEASGVFVARSMSEAVMFAEEYAAEHLSIQASDDEALLDRIDSAGSVFLGGYAPVAAGDYAAGTNHVLPTNGTARVTGGLSVDTFLRSTTVQRLDREGLAALRETVTTLADAEGLEGHAASVDARFEDE

SEQ ID NO: 18628 - protein, 691 aa, Halobacterium sp. NRC-1
MTRVRVTLRDAADRTADAPAVGPGQLSFTAETRQQIGVAEGDAVTVTGSEDTVATVGPDTTAIAASSGLAGADVLRNVGPTDTVTVAPADPSPAAELTVAPATSSTLEGDADALARALAGRHLVADDRIAVPLFSGTVVVTLDVEDTTPGGPVTVTADTAITLTGHAADSGHADAEHATPADTRVGGLDDERGALRRLVVAPLVADSYAAIGVRPPAGVLVHGPAGTGKTTLVRAVAAAADLAVESVAPEDAGDRDALAAVLDAARDAEPGCVVFVESLAAAAPDPTADGASGRGSPSALGWLLDRVRGHDTVVVVGETTDPDAVDPALRRGGRFDAEVRVGVPDPAARRAILDVHTDGVRLADAVSLDAVADRTHGYTGADLTAVLVDAATRAAGSAAGPPVIRQRDLEAALDAVGPSTLRDASVQTPTTTYQDIGGLDRAKREVVRTVEWPQRYPALFERLDAAAPTGVLLHGPPGTGKTMLAKAVAASTDANFLSVDGPELMNRYVGESERGVRDLFERARRLAPAVVFLDEVDSLAPARHDTDTGASERVVSQLLTELDGLSPRGSVAVLAATNRRESVDPALLRPGRIETQVAVPIPDQDARAAIFEVQLDGVATGRIDTTALAAATTGYTGSDIAGVVREGALLAMEDHLRETEFDATDASGLVVTQRHLRRAIETTAPSVDGAG

SEQ ID NO: 18629 - protein, 759 aa, Halobacterium sp. NRC-1
MKLTVKPLKQKDAGRGLAAVDRDSMDELALENGDYVVIDGQGDHGRAVARVWPGYPEDDGDGVVRIDGRLRKEADVGIDDQVTVEPADIKPAGGVTVALPQNLRVRGNIAPMVRDRLNGRPVTAGQTIPISFGFGGMSTISGQQIPVKIAETEPSGTVVVSNDTEIQLSERPAEEIAPGAGEAAETGDPTPNVTYEDIGGLDGELEQVREMIELPMRHPELFQQLGIDPPKGVLLHGPPGTGKTLIAKAVANEIDAHFETISGPEIMSKYYGESEEKLREVFDEAEENAPAIVFVDELDSIAPKRGETQGDVERRVVAQLLSLMDGLEDRGDVTVIAATNRVDAIDPALRRGGRFDREIEIGVPDQDGRKEILQVHTRGMPLVEDIDLDDYAESTHGFVGADIESLAKEAAMNALRRVRPDIDLESDEIDAELLESISITEADFKRALNGIEPSALREVFVEVPDTTWADVGGLTDTKERLRETIQWPLDYPDVFSEMDLQSAKGVLLYGPPGTGKTLLAKAVANEANSNFISVKGPELLNKYVGESEKGVREVFEKARSNAPTVVFFDEIDAIAGQRGRATSDSGVGERVVSQLLTELDGIEALEDVVVVATSNRPDLIDDALLRPGRLDRHIHVPVPDADARRAILDVHTRDKPLADDVDLDVVAQRMDGFVGADVEALVREATMNATREFINSVDPADASDSVGNVRVTMAHFEAALGEVTASVDADVKENYEEIEQRFNTADTPTDDEPASGAFR

SEQ ID NO: 18630 - protein, 374 aa, Halobacterium sp. NRC-1
MDLSAEQRRMRESVREFAVEEIRPVAAEADRTQSFPEEVWDDLGELGVTAMTTPASYGGLDVDSLTYSVVNEQLAYGALSVATALSVHCLATSCIAEFGDDDQQERWLPEMADGRPVGAFALSEPDAGSNPAQMSTTARRDGDEFVLNGKKQWITNGKRSGVVIVFAKIDGDDDKITQFLVPKDADGLTVGPKEDKLGLRASDTTSLLFDDCRIPASNQLTEAGRGLSAALHILTGGRIGIASQAVGLSQAALDAALAYADDREQFDQPISEIQTIRHKLADMETQVQAARLLSRDAARMADAGEDHQTAAAKAKYFASEAAVDVTNEAVQIHGGYGYTKDFDVERFYRDSKITTIYEGTSEIQKEVIARGLID

SEQ ID NO: 18631 - protein, 821 aa, Halobacterium sp. NRC-1
MELAVHDATEDGAGYATAASSWVVVEPEFVVDVTDIRSFVQCPRLYYLNKLSGLPLKYPVTKGTIVHEVFGDLLRGRDLEASVAQRVDEAGLELGLLGRSRAEVEADVRDNASAIEGWLQQGRLTDEDEWRSEYTLVSERFGIKGRCDAIRRGMPVELKTGKNTNREPRFHDKVQAACYALMLDEHGVPADTGTLLYTKNAAVDRSEASGDLSPAKEFSIGRGFLEFVVRERNHLAALEASDGPPTGYEADAKCDYCFEQDTCMVVSGRLDQESKAGRIGDPVPAEERAYFDELYDAIEAERGAIHDEYRKLWEQSPDERAADDRAVVGLSPAEQTELPDGRWRLTATRPGSAASKIREGDRVLASDGDPVAGRAEMARVERLDADRVEVTTDEPVSLCRLDVYPSELSVDRMLTALHDAVLKSDQRRTDLLFDRASPRFEGGDHDLIPNNDAQNAAVNRALNAEDFALVHGPPGTGKTYTIATLVQAFVARGDRVLVSAFTNRAVDNALDALRQQGHEDIVRVGTETGVRADMQDLRLDRSGDPGERAAALRSAPVVAATTATCGSRILRELEFDVVLVDEASQLTEPDTLAAINRGARFVLVGDHEQLPPVVRSGGRLSKSLFERLHETYPEASVMLDQQYRMSQRIQAFSSREFYDGQLRPASSEVAGQRLTDVGVDPGGAVHGGVTFYDVPGTDDAHVDPAEADRVADVVTAYVDAGLDPGEIGVIAPFRAQVAEIGRRTPAGVAVDTVDRFQGSSKEVIVVSFVARGTLEGPIFEDHRRVNVALSRAKKSLVLVGDERALRSEPLYDRMIDWADME

SEQ ID NO: 18632 - protein, 458 aa, Halobacterium sp. NRC-1
MDRETAEPDVRSMPGEKAAEWVNFHHNHAAPSTYVYDFVWDITEDAIGPFCTDVDGNVLMDFTSHVAAAPFGYNNPKIMDRLESFDLVDPLKMAGQDFYAGGGTDPESPEIPTATQLLDRLTDITAHYDLDTVFLSNTGAEAVENAIKICYNNGGHRALTFDGAFHGRTLGALSLNRSKAIHRKGFPEIGGVVSVPYCTCEGECSCGWKTNGPGGNVAADKLHHDRGVIDPEEVAYLIMEPQQGEGGYRVPNDDFIADIADIQRTHDIPVISDEIQAGLGRTGELWGIDHTEIEPDVITSAKGLRVGATVANEDLFPSETGRLSSTWGAGDIVAAAQGVATIDAITSDGLLDHVVARGEQTTDRLHDADPDFVTDVRGRGLMLAVEFDTKKRREAVVNACVKRGLLVLGCGHKTVRLLPPLDVTEREIDIAVDILLEALDDPDVRHAGTSKVEGEPTA

SEQ ID NO: 18633 - protein, 477 aa, Halobacterium sp. NRC-1
MARDVWHSRLGFIMAAVGSAVGLGNLWRFPWMTSENGGAAFLLVYLGVVLCVGVPGLLAEFVIGRRSRRSPVGAFSSLSDSTLWRVFGHLSVVIAVVLLSFYSVVGGWILRYFGASLTGAYFSNPGQYFATVSYGLDAVGFHLLFLAITGLIVVRGIKRGIENATKLMMPAVVVLLIVLAAWASTLDGAGAGLAFYLSPDVELLEADLLGILPAAAGQALFTLSLGSGTMITYASYLDEERSLAADGAAIAVLNTCIGVLAGLVVFPLLFALVGDAGTGGPGALFVGLANAFVAVPYGRAVGAVFFAVVSLAAISSSISMLELPVSFLVDEYGVSRRRATALFVGVFTVTGSATALSPGLFDFVAGTLVDLLMTAGLIGFLLFTGWVVGQNAVTEYELGAGAVASALSTPWLYAVGVVIPVFLIFTLVSGIAAALGVSITAVELWGVTISQPRLFAGLSVVIAVVSFLGLRRPASVA

SEQ ID NO: 18634 - protein, 610 aa, Halobacterium sp. NRC-1
MFEKVLVANRGEIAVRVMRACDDLGVDTVAVYSDADAHAGHVRYADEAYNVGPARAADSYLDHDAIIDAATRAGADAIHPGYGFLAENAEFAGKVEDTDGVTWVGPSADSMRQLGEKTSARKTMREADVPIVPGTTDPVESVADIHEFGEEHGYPIAIKAEGGGGGRGMKIVRSADEAEDQLESAEREGEAYFDNANVYLERYLENPRHIEVQILADHHGNVRHLGERDCSLQRRHQKVIEEGPSPALTDELREEIGTAARRGADAAGYYNAGTFEFLVEEDTEREPGDLLGPETEFYFLEVNTRIQVEHTVTEALTGVDIVKWQLKIASDDELTFEQDDVALDGHAVEYRINAENAADDFAPATGGELETYDPPGGIGVRVDDGLRQGDDLVTDYDSMVAKLIVHGSDREECLARSRRALAEYDIEGIPTIIPFHRLMLTDDAFVGGTHTTKYLDRDIEESRISDAQAEWGTTTASESSADENVVERDFTVEVNGKRFEVNLEERGAAQFAAPEADTGGGGPPEPAGGADDGETVVEGDGETVTAEMQGTILDVAVSEGDAVDAGDVLVVLEAMKMENDVVASHGGTVTQVAVSEDDSVDMDDVLVVID

SEQ ID NO: 18635 - protein, 423 aa, Halobacterium sp. NRC-1
MHTHHMDGARCKRMHPVSKRQHAPDSETDGVYAERGSRSDCMKLHEYQAKEVFADAGIPTPESALATSVDEAVEVADALDYPVAVKAQVHVGGRGKAGGIKLAENTAEAREAAESILGMDLKGYTVDRVLVEEAVDFTNELYVGVTMDRSEGAPVVMVSERGGVDIESVAEEAPEDIVREHVDPSFGLQAYQARNAVYDAGIEQDVAGDVAKIVQGVYDLWADSDATEVEINPVMVTSERDVVAADAVMKLDEDALFRQPAFADMEEDAAEDDLEAKANEYGFDYVRLDGNTGIIGNGAGLVMTTLDLVDYYGGQPANFLDIGGGAKADRVANALDMVFSDENVDSVVFNIFGGITRGDEVAKGINSALEQFDEIPTPVVVRLAGTNAAEGREILNDDLVTVEETLEGAVQRAVEYADEEDIQ

SEQ ID NO: 18636 - protein, 289 aa, Halobacterium sp. NRC-1
MSILVDDDTRVVVQGITGGEGKFHAEQMIEYGTNVVAGAVPGKGGQEVAGVPVYDTVNQAVVAENADASVVLVPPAFAADAVFEALDTPLDLVVAITEGIPSQDMAKVYKRLSEVDTRLLGPNCPGIITPGEAKLGILPGNIFEAGNVGLVSRSGTLTYQVVDSLTARGVGQTTAIGIGGDPIIGTDFIDALELFEADPETEAVVMCGEIGGEDEEAAAAYIDEHMDTPVAGFIAGRTAPPGKRMGHAGAIVSGSGTGTADSKISALNDAGVPVGDTPEEVADDIEELL

SEQ ID NO: 18637 - protein, 1234 aa, Halobacterium sp. NRC-1
MPGYDRATARLADAGVPLVVKSTGDAYAVEDTTVAAEDRDTVYEYLDRGGSANVANCLRFLGDRYSGTEFAYDDPVALPTEGVYHPDHPGIDYDGLRATFDPDAPTVAVWFYESHWTHENTRYVDGVVHALESQGANALPVFCNPATDTDEQEDAEWVTDQWLLADGEPVVDAVVSSFMFSLSMDERGRSASDEGDAAEDVFLDRLGVPVLQTVTTMRSRSRYESADTGVMGFELALSVALPEFDGNVITHPISGKERTDDDAGIGTAPKQHFPIADRVEHAASLAVNWARLRHLDNDEKRVAVVLHNYPPSDDGIGTAFGLDTPESTVNLLDELDARGYSLGGKTPPEGQALIEQLTSQLTLDDRWVAPEDVRERSVDVVSTDEYAAWWADTDPEFRANVVAEWGEPPERPFAIPGVEYGNVLVTVQPPRGFGMDPEKVYHDSDLQPPHDYYAFYAWLREEFGADAVVHLGTHGSLEWLPGKTVGLDAESAPDALLGDLPNVYPYIVNNPGEGTQAKRRSYAAVVDYLTPVMSNAGTYDELAELEELASRYREAGAGAGADAESHIADRIREQVADLDLAVELGIEGEISEKADVRGPDAAGSSLAEGAVDGDTVGIEALVERVHEYVTDVKTTQIRLGLHTMGEPPADDRLVEYLVALTRLENPGAPSLRESVAGVLGVDYGTMLDSPGEYSEALGMTYAEAADEVYETSVDLVETLAAEGFDVPASNVAAGPDDEVNMNLLVVDIDTIGDARAKSGAHDDLRAVLAFICEEAAPRVFGAESEIPQTADALDGEYVEPGGSGAPTRGGVDLLPTGRNFYTLDPRKVPARTAWDVGKEVADGVAQRHQEDEGEYPEEVGVVAWGTPTVRTRGETIAQVLGLMGVRPVWTDAGRVDDVEPIPLGDLGRPRIDVTTRVSGLFRDAFPQAAGVVHDAVDAVVDLDEPHDMNYVKKHVEAEAAELEAEGVENPEQAAKRRVFTTRPGGYGAGTNKAVDEGEWDDRSDLADVYVQWGGYAMGSRGRVSEAHDAFERRLGNVDATVKIEDTMEQDEFDSSDWYAFHGGFITAVAEESGAEPASYVGDSSDPDNVDVYTNEEKVRKAMRARVLNPEWLDSMEDHGYKGAGDLSSTVDVTLGWDATTGVVSDTLWADVAEKYAFDEDRQEWLRDVNPWALSSITDTLLEAIERDLWGADDETAERLRDLHLQVSGDLEARASGEHDTPADGDERETPLHDD

SEQ ID NO: 18638 - protein, 124 aa, Halobacterium sp. NRC-1
MSFDVPDDLQYLESHEWIDPATGRVGISEFAQDELGDVVFVELPSVGDALDQHDELGVVESIKAVSDLYAPVSGEVTAVNDALTNEPELVNEAPFGDGWLVEIDFDSDDLEATLDSDDYRAQIA

SEQ ID NO: 18639 - protein, 445 aa, Halobacterium sp. NRC-1
MTSVGIDAIEIHTGKLKLDLAETFAPEMGDDPEKYTKGLGLHASSFPDAYEDIVTMGANAAHRLLERKGLEPADVGRIDVATESAFDNSKPVSTYIAGCLEQVYDGDFHHANKGERKFACIAGTQSLDDAVNWILAGRNRGRGALVIATDTALYARDSSGEATQGAGAVAMWITEDPDIVELSTEQGYGSADETDFLKPNQQFPSVDGKRSMQVYLARMRESLQDFERATGASHPDDYAFIPFHTPFPGMVRKAAVLGYRHMIRGTDIEEELAADIGRQPRRERFDSDDAFEDAISEYVDGLTDTDAYREWYDAAIQPTLSISSQVGNWYTGSVHLARFSALKHAAENGIDLAGKRLLVASYGSGAQAEIHSETVQDGFTEAVAASTIDEQIEQRYDISFAEYEQVHDRHNHEKSVELEPFTQPDAEFVFDGWGPMNERKYTYVE

SEQ ID NO: 18640 - protein, 1051 aa, Halobacterium sp. NRC-1
MSSEDLSADDLTLPVKRVTGDSLEDRLTANAYHNILPARYLRKDTDGEHVESQEDLFERVAKNIALAEVVFESDDPVTATPSQLKPDHPRRDELAAEVFGSDVDPDSETATVELTDSNINKFAYDTVVPELDDPEVREHVEGVAAEFQDLMASLSFMPNSPTLMNAGDELQQLSACFVDSPDDDITDIHQTAKEAAEVFQSGGGMGYAFWQLRPYGDTVGSTGGIASGPLTFMETFDQMCETIAQGGARRGAQMAVMRVSHPDVVEFIHAKNKDVSLAQTLKLNDPDDYTYTEFSEALEEARDLIDEDGRVPEHLRNAVEGHLSNFNISVGVTDGFMEALEAGEEYTFTNPRTGEAHIATEETKEMYSRYGLGHYVTPGEELTLPAEELWSRIVEGAHENGEPGVIYLERVNDEHSFDVEEHPDHRILATNPCGEQPLEEYEACNLGHINLSTLAAQDAPDWRVWSQTHDFDTLEAGVSRFLDEAMDTDAFQRRIEMGTRFLENVVTMSDFPVPEIEQKVSEMRKIGLGVMGLAQLYIQLGVKYGSEEGNEIASQLMQTINHDSKTASHELALERGSFDEWDNSKFAAPTEYADWFEHHTGEDAADWADGYPIRNHNTTTIAPTGTTSMVGNTTGGCEPIYNVAYYKNVSDDVQGDEMLVEFDDYFLRTLEDNDIDVQAVKEEAQTQMANNDFDGVDGLTTVPDAIGELFVVTSDLSGKDHAAVQTACQNGVDSAISKTCNFPNDASVEDMDEVYRYIYDNGGKGVTVYRDGTRSKQVLTTRADNTEFSGLDEEEAAAAMVDTIQETFGGIEGFLENDDIQDAFGADLRELFATGDDAAFDEEDFAEKQPRPDLLHGVTQRVDTGYGKLYVTINENPERERPFELFANTGNSGGFTGSFTEALAKTISVALRSGVDPDEIADKLQGIRSPKVAWDKGEQVNSIPDAFGTALRRYLNGDVDRAAYPQQQHLTEIDADDAAHHETDGGAAESLGGPQGPTGAGESADAQQQSQDATQSLIDAGESPECPECGAMTLYYSEGCKTCESCGWSEC

SEQ ID NO: 18641 - protein, 394 aa, Halobacterium sp. NRC-1
MDVHFATVRSTNSSEGTLDVLIDGQAVTIEDNTEGDRSVGDLVEVWIDKGGRVAVEEVGRASPSVGVIREAIGGNEYLVERNGRVEVCESLDAENPEEGATVKIYGGKVTATISDEVIAPKGIEDRFGEQNRSKAYLKDPEEISEVDSGYDDVGGLTDTIEEVKDVVEIPLRESDKETNRFNKHGVEPDTGILFHGPPGTGKTLLAKAVAKETGSSIYLVNGPEIISKWYGETEDIIREIFSNAKKKKRAIIFIDEVDSIAPDRGDTKQFQRKIVAQLLTELDGFEPLNDVVVIGATNALNEVDSAIIRPGRFDRKIKFSKPTQTERMEIIEKITKDVDFGESVDLQLFAESTDGWTGADLSGVISRAVTISIRREGDLVTQDDLFRAIKGAGE

SEQ ID NO: 18642 - protein, 236 aa, Halobacterium sp. NRC-1
MREDDTHLPTGCGALDELLGGGVERGTVTQLYGPPAAGKTNVALTTAVTTAAAGGLAVYVDTEGLSLARFQQLLEARATDPEAASANVIVSDAHDFDEQAQAVRDTADFADRADLIVVDSVTGFYRLARGGDDTTGDALRQVADQITHLLSLARKHDLAVVVTNQVFTDVDNDSDRARPLGGHTLAHWTGTVLRLDRFRGGTRRATLEKHRAKPDGEHAQFQITDGGIDAASADDY

SEQ ID NO: 18643 - protein, 742 aa, Halobacterium sp. NRC-1
MNEVQLEVAKAYPNDSGRGIARLDPDTLLHLKLSPGDIIEIEGAETTAAKVWRADRQDWNTDTIRIDGFTRQNAEVGIGERVKIRKADAEKADTLVLAPPEEASVQFGSDAAGMVKRQILKRPVVARDIVPVMSSTNHPFMRSPGQAIPLIAVETEPEGVCLVTEDTDVELREEPISGFERTGGGITYEDIGGLENEIQRVREMVELPMKHPQIFQKLGIEPPQGVLLHGPPGTGKTLLAKAVANETSASFFSIAGPEIISKYYGESEQQLREIFEDAKDDSPSIIFIDELDSIAPKREDVTGEVERRVVAQLLTMMDGLEGRGQVIVIAATNRVDAVDPALRRPGRFDREIEIGVPDEIGREEILKIHTRGMPLSDDVNLSTLADDTHGFVGADIESLSKEAAMRALRRYLPEIDLDEEDIPPSLIDRMIVKREDFKGALSEVEPSAMREVLVELPKITWDDVGGLTEAKNNVKESVEWPLNQPEKFTRMGVEPPAGVLLYGPPGTGKTLMAKAVANETNANFISVRGPQLLSKWVGESEKAIRQTFRKARQVAPTVIFFDELDSLAPGRGQTGGNNVSERVVNQLLTELDGLEEMEEVMVIAATNRPDIIDPALIRSGRFDRLVQVGQPGIEGREQILKIHTQDTPLAADVSLRELAERADGYVGSDLANIAREAAIEALRDDEDADDVGMAHFRAAMENVRPTITDDLMEYYDQVEDQFKGSQGPNVNSRQGSEHIGFQ

SEQ ID NO: 18644 - protein, 512 aa, Halobacterium sp. NRC-1
MDELAGTSVAVIGAGFGGLSTACYLADAGADVTVVEKTDQIGGRASTLERDGFRFDMGPSWYLMPDVFEEFFASFDSHPSDYYGLTRLDPHYRIFFKDNEGRRPGRDAPGLNVDTDGDTIDVTPDREQVKQVFDAYEPGAGDVLDDYLAQAKENYEVGMEHFVKTDRPRVRDWMDPKLAEYARGLTLLGSMQDHVEQYFDHPKLQQVMQYTLVFLGGSPDTTPALYNLMSHVDFGLGVYYPEGGMGGVVDGITALARELGVEFRTGHPVSAIKGRRGGFKLDTEPGDAVLADVVVSDADYAHTEQALLPAQKRQYDADYWDARTYAPSAFLLYLGVEGDVEPLAHHTLVLPSDWDTHFAQIFDDPAWPDDPAYYLCVPSKTDDTVAPDGHSNLFALVPVAPGLDDTPAVRESYRDLVLDDIAENTGVDLRDRIVVEERFSVSEFADRYNSHQGTALGLAHTLRQTALFRPPHRSTALDGLYFTGANTTPGIGVPMCLISGEVTANNVLADAR

SEQ ID NO: 18645 - protein, 192 aa, Halobacterium sp. NRC-1
MLVTISGPPGSGKSTVASTLADHLSYEHISGGDIFRGLAEDRDLTLAEFNELAEEDPQIDKDLDRRLRETARGRDDIVLESRLAGWMAGEYADIKIWLDAPMSVRARRIAEREDKTPAAARAETEAREESETQRYEEYYAIDFDDITIYDLSVNTARWGPDAVTDIVLDAVDAYQAERDEGPTPIENVRYQF

SEQ ID NO: 18646 - protein, 536 aa, Halobacterium sp. NRC-1
MPHQSQPGFLLPAIQHHSMQGSLPGERDVTVVGGGFGGLAAAAYLARAGASVTLLEQHDTVGGRAGVLERDGFRFDTGPSWYLMPDVFERFFDHFDHDPHDFYELTRLDPQYRVFWTDGDSATIEPNRRNAHELFESYEEGAGDALATYLDRAATNYDLAMNRVVYPDRTAFRDYASTDMLPLASRLRLFGNMDDYVSRFFDHPKLRQLLEYTLVFLGGAPHNTPALYSIMSHVDLNGNVFYPEGGIAGVVDALAELAVEQGATIETGVGVNAISGRRGEFTLATDDGTRTTDLVVNNANPAYAERELLDTGGRDHAPDYWDDQTYAPSALMFYLGVEGDVEPLAHHSLVLPPDWDGHFAQLFDDPGWPDDPAFYLSVASKTDDTVAPDGHEAVVILLPIAPGLDDTPEIRAQYRDRLLGTLAAQTGVDLRDRIVVEESACVSEFSEQFGDPGGTALGLAHTLFQTGPLRPGKRDGPDGHYYVGAYTNPGIGMPMCLISGEHVTKAVIDDDPAASGSTDPLAVPGEFNFDTPTTAD

SEQ ID NO: 18647 - protein, 272 aa, Halobacterium sp. NRC-1
MFPGASTADESNPGADADYVVVGAPLDVSTSFQPGTRFGPGELRTYAATFEDYHHRTGTHFSALSVTDYGDVRAWNDVPAYLEYLNGVVTDISWNDATPLLVGGEHTVTVAAVRALNPDVFVALDAHLDLRAALDGDPLSHSTVTRHALDVADEAIVVGARAGSEEEWERAADSDVTVIEPSAVADWTPAFGDADVYLSVDIDAADPGYAPGTGTPEPFGMSPRELRAAVRAVAPHAVGFDVVEVNDRDDGQAPTLGAKLLREFVHTHHADG

SEQ ID NO: 18648 - protein, 436 aa, Halobacterium sp. NRC-1
MNGNTGVVSGVRVSHETASLDELAAASAASTEAALDALLEQPPVEEAFVLQTCHRVEAYVVTADQASGRRALGGAGFNPAGGGAISMGHEDSLRHLLRVAAGLESLVVGEDQILGQLRDAYDAAKDAGGIDHVLREAVTKAMHVGERARTETAINEGATSLGTAAVRLAERKTQLADARAVVVGAGEMGALAAKAFASATVAEIVIANRTPARAVRVADMVSVPAEATTLADARGRLDAADVVVTATGSPEHVLPASAFADAGDTVVVDLAQPRDVAPGAGGHDGVAVHDLDDLEAVTAATRERREDAAREVEAMIETEFERLLTQYKRKRADEVIARMYESADRLKSREVQTAVHRLEAESGSLSADEREVVESMADALVSQLLAAPTKSLRDAAAEDDWSTIATALELFNPEFEDGMPFDASRGGDAASAESED

SEQ ID NO: 18649 - protein, 1042 aa, Halobacterium sp. NRC-1
MTEDSRTILLIGSGPIQIGQAAEFDYSGAQACRALQEEGARVVLVNSNPATIMTDPEMADAVYIEPIEPDAIAEVIEQEDPDGVIAGLGGQTGLNVTAALAEQGVLDEHDVDVMGTPLDTIYATEDRDLFRQRMADLGQPVPASTTIALGDDETATDIDEGALRERVDDAVEAVGGLPVIARTTYTLGGSGSGVVHDFEALVDRVRTGLRLSRNAEVLVTESITGWVELEYEVMRDAGDSCIIVCNMENIDPMGIHTGESTVVTPSQIIPDDGHQEMRNAAVAVIRELGIQGGCNIQFAWRDDGTPGGEYRVVEVNPRVSRSSALASKATGYPIARVTAKVALGKRLHEIDNEITGQTTAAFEPAIDYVVTKVPRWPNDKFPEVDFELSTAMKSTGEAMAIGRTFEESLLKALRSSEYDPSVDWATVSDDELAADYLQRPSPDRPYAVFEAFERGFTVGDVNDHTGFREWYLQRFQNVAAASAAASEGDVATPAALGYTNSAVAALASDGGDVAVDDVAATAPERTFKQVDTCAGEFAASTPYYYSARSQGSTGSDVRADRDAHSVVIVGGGPIRIGQGVEFDYCTVHAVRALREAGIDAHVVNNNPETVSTDYDTSDGLFFEPITAEEVADVVEATNADGVMVQFGGQTSVDVGAPLEAELERRGLDCEIMGTDVDAMDLAEDRDRFNRLLDERDISQPDGGSATSVAGALELAAEVGYPVLVRPSYVLGGRAMEIVHDDDELRRYVEEAVRVSPEKPVLVDEFLADAVELDVDAVSDGEDVLVGGVMEHIESAGVHSGDSACVIPPRGLGDDILARVREVTTEIARALDTVGLLNVQLAVQDGEVYVLEANPRSSRTVPFVSKATGVPIAKLAAKVMAGESLADLDASEGVPEQYSVKEVVLPFDRLPGSDPRLGPEMKSTGEVMGTASDPGMAYWKAQVAASNAPVPGSTAVVDLLVEGLGERFEVVTVKDVPAAIRRGEVEFLVSDDRDALTAAVEAEIPYVSTVAAAEAMREGIAAADGAREAMPVADRPVNDETWG

SEQ ID NO: 18650 - protein, 353 aa, Halobacterium sp. NRC-1
MSDAYLALETGDVVEATARAPGMARGELVFTTAYTGYEESLTDPSYEAQVLTFAYPLIGNYGVRPERTESDRVHPSAVVARELTDDVADWLRTEGVPAVDGIDTRDLVLDIRDGGAMQVGIAAGPDASPATARAQLADCPRLSARTEIGAHVSVDTAETHGNGDTTVALVDCGAKRSIIDAFVARGATVHRLPYDATPADIAAVDPDLLFISNGPGDPANFDAAEHLVDEYIGTVPIAGICLGQQIVARALGGDTEKMDFGHRGVNQPVLDHDSGRVVMTTQNHGYTVADPGDLTVTQVNVNDGTPEALDSAPLDVLTRQYHPEANPGPHDTRGFFDDVLAMADASYTPATAD

SEQ ID NO: 18651 - protein, 213 aa, Halobacterium sp. NRC-1
MRDSMSEADRSSPGSGKTDREDETAENATQDVIAVTPDDERTGLANRLDAHTGDGVRHRAFTCLLFDEDGRVLLAQRADRKRLWDTHWDGTVASHPIEGQSQVDATRQRLAEELGIEPHQYDKLEITDRFEYKRRYLDEGLEWEVCAVLQATLHDTSFDRDPEEVGGAMWVDYEDLYENPRYYRQLRLCPWFEIAMRRDFEGDADPVPDGTRA

SEQ ID NO: 18652 - protein, 295 aa, Halobacterium sp. NRC-1
MSRVVAAGHVNWDVTLRVDALPEPDGEAEIVSQRRSGGGSAANVACALAGFDIDAGLVGSVGDDEHGLLAQRELQAAGVDLAGLRVVDGLETSVKYLLVDSRGEVMVLGNDGANEAVAPGDLDPAVVGADCEHVHLTSQRPATAARLTALAREHDATVSFDPGRRLRDRDYGDALARTDILFVNDNEAGAVLDDDGGPTAPDSDRVVVVKHGSEGATVHTPSGSVTHPGFAVDPVDTTGAGDAFAAGFVAVVLDGGDHERALEFGNACGALAAQHEGARTAPTRADAASFLDSQF

SEQ ID NO: 18653 - protein, 422 aa, Halobacterium sp. NRC-1
MSYDKIEVPEGGAKVSYDEAADELDVPDTPIIPIIHGDGIGKDVGPIAQDVLSAAAEATGHDIEWMEVYAGESAREMYDENLPEETVEAIREHRVAIKGPLTTPVGAGFRSLNVALRQTLDLYANVRPTYYLDGVPSPMKAPEEMDMVTFRENTEDVYAGIEWEAGTDEAEQVRSFVEDEMDFDDVMHDGDIGIGLKPISEKGSKRLVREAIDYAIENDRDTVTLVHKGNIMKFTEGQFGDWGMEVAEEEYPDDEVFAAPDSLWEEQDEVDIPEDAVMVEERLADAMLQWMQLRTDEFDVLAMPNLNGDYLSDAAGAQIGGLGIAPGANFGAGRCLAEPVHGSAPKRAGQDKANPTALILSGRLLFEYIGWDDASTLVRDAVEDTIESGTVTYDLARQRDDAEEVSSTTYAEAVIDRIEDLA

SEQ ID NO: 18654 - protein, 405 aa, Halobacterium sp. NRC-1
MPDDASDLADRVQAGDLRLYELDDETDADTAAAARRAVLERETDADTDALGAFAFDADQAADTAVENLTGGAQLPLGVAGPVALSGGAADGEYYLPMATTEGALVASVNRGCSAITAAGGANARVTKTGMTRAPVFRVADVTEGAEVAQWADDNTDALAAAAESTTSHGELTDVTPYVVGDNVYLRFRYDTKDAMGMNMATIATEAASELVEDETPAELVAVSGNLCTDKKPAAINAVEGRGRTVTADVTIPQDVVEERFDTTPAAIEEANTRKNLIGSAKAGSLGFNAHAANVVAAVFLATGQDAAQVVEGANAITTVEARDDALYASVNLASLEVGTVGGGTTLPTQREALDVLGVRGGGDPAGANADALAEIIAVGALAGEINLLAALASRRLSAAHADLGR

SEQ ID NO: 18655 - protein, 509 aa, Halobacterium sp. NRC-1
MTDATTTDVLVLGSGIAGCGAALAAAREGASVLVATKAQQPADASTDWAQGGIATTRDDPESLKRDILAAGDGEADPEAVDALVGDAAAAVEDVLVDTLGVPFDGEEGFDYAREAAHSAARILHVDAATGHHILGPFLRHLDAHENVDMLEDAAALDLITDEGAVTGALLDRNPRTGDRAETGVPVFAGSTVLATGGIGDLYRRSTNPRGSTGDGVAMAALAGADVTDAEYVQFHPTAYDDADPFLVSEAVRGEGALLRNADGERFMPDYHEDAELAPRDVVARAVAAERDATGEVRLDVSPLAFAEEFPGLAEACADRGVDWETGIPVAPCEHFLCGGVAVDTVGRTSLDRLFAVGECARTGVHGANRLASTSLLEGLVWGLRAGETAAGDDRAPAPSEPPELRDRDPDLPDGFAAEKFRRLRRVMDEHVGLRRTGADLQRAQGVLRRLKGEVDSYARTRTSRDLYQLRNAAVVGLLIARAAGENPESAGCHHRSDEAAAEEAPDAGH

SEQ ID NO: 18656 - protein, 508 aa, Halobacterium sp. NRC-1
MQAALVILDGWGLGDHDRRDAVRAADTPTFDEYAERGAFGTLTTSGRDVGLPDGQMGNSEVGHLTIGAGRVVKQAYTRIEDAIAAGDLCGNDAISGALDHVADTGGTLHVMGLVSDGGVHADQQHIHALVECAAGRGVEAAVHAFTDGRDTSPTGGEDYLADLEAVADEHGTGDVASVSGRYYAMDRDQNWARTKRAYDAITRSDGVAHHAAAAVDAVTDSYERGDTDEFVEPTTIEGGAALSDGDAVVFANFRADRARQLTRLLADIHPADWDADGIETNPPAVPVVTMTEYDETFDCPVAFPAAEPTDTLGAVLAAHDHTQLRVAESEKYAHVTYFLNGGREVAFDGETRTIVDSPDVPTYDEQPAMSAPAVTDTVLDALAGDDPDVLVLNYANPDMVGHTGDFDAAIEAVEAVDRELGRLVPALNDAGAHAFLTADHGNADDLGTPADPHTAHTFNPVPFVSLPPASGDTAAVRDGGALRDIAPTLLDVLGIDRPTVMTGASLLE

SEQ ID NO: 18657 - protein, 249 aa, Halobacterium sp. NRC-1
MTDRAIEARALTKRYGDTTAIERIDLAVPSGSVYGFLGPNGAGKTTTMRMLTTLVEPTSGTATVAGVEVTDRASVVPNIGYLPEEPPLHAELTAREQLRYIAGLRDIPDPRAEQRITDLLERFSLGDDADRRISTYSKGMKQKTGIIQAMLHDPDVLFLDEPTSGLDPRAARTVRDTIADLTAGDATVFLSTHILPVVDDLADTVGVLYDGSLVTEGPPDALKQRAEAGDERTLEDVFLTVTGGIDGAA

SEQ ID NO: 18658 - protein, 322 aa, Halobacterium sp. NRC-1
MVRARHFDERALALQRRGWMPGYPPFKGQEGSQVGAAHALAGDDWLFPTYRSNAMQLARGVPASDLLLFRRGRAEFHSDHDHNVFPQAVPIASQIPHAVGAGMAMSYTDSGQASLAYFGDGATSEGDFHQGMNFAGVFDAPVVFFCENNNWAISLPRERQTASDSIAAKADAYGFEGVQVDGNDPLAVYETVTDALAGARDGTPILVESLTYRQGAHTTSDDPDRYRPEEEDLPAWRTADPVDRYADYLHDQGVIDAGFVEECFDAAADEIDDAVETAEAAGAPAVDELFDHVYAERTPRIDDQKAWLESWLETHDPQEMEF

SEQ ID NO: 18659 - protein, 199 aa, Halobacterium sp. NRC-1 [sequence omitted]

SEQ ID NO: 18660 - protein, 510 aa, Halobacterium sp. NRC-1
MTDAYVGAIDQGTTGTRFIVFDQHGDVVANTYEKHEQHYPEPGWVEHDPLEIWENTKSVVTAGLSAAGLDADDLAAIGITNQRETTVVWDAASGRPIHNALVWQDRRTTSRVESLEENGKIERIREKTGLEADAYFSATKTEWLLDEAEPLKLSSARASSLRDRARDGELLMGTIDSWLIYNLTGEHITDVSNASRTMLYNITDLEWDDWLLEEFDIPREMLPEVRPSSDEAVYGHTDPDGFLGAAVPVTAALGDQQAALFGQTCFDAGDAKNTYGTGSFYLMNTGEDAVSSEHGLLTTIGFQLSGEPVQYALEGSIFVTGAAIEWLEDVDLINNAAQTAELASSVDTTDGVYMVPAFTGLGAPHWDGRARGTLVGMTRGTRKAHIVRATLESIAYQTRDIAAAMEADSGVSTTTLRVDGGAVKNNFLCQLQSDIIQTDLARPEVDETTALGAAYAAGLAVGYWDSLDDLRENWRVDRSFEPEMDPSEADSKYGRWEDAVDRSLAWATED

SEQ ID NO: 18661 - protein, 570 aa, Halobacterium sp. NRC-1
MAQEPHVVVVGGGSTGAGVARDLAMRGLGVTLVEQGNLTHGTTGRMHGLLHSGGRYAVSDQASARECIIENRVLREIATHCVDETGGLFVKRPEDSEQYFQEKLAGCEACDIPTKVLSGAEARQLEPHLADDVEKAIWVPDAAIDPFRLVVANAASAQEHGARIETHSTVTDVVVEDGAVVGVEVEHATGAGKRVHGTEGGTEVIRADHVVNAAGAWAGRLGEMAGVDVEVRPSKGVMTVMNTRQVDTVVNRCRPKGDADIVVPHETTCILGTTDEEVADPEDYPEQQWEVDMVIDELAELIPMLDDARTVRSFWGVRPLYEPPDVDSDDPTDITRDYFLLAHDDRDDLPGMTTIVGGKLTTYRMMAEEITDHVCERLGVTADCRTADVALPGSADNTALDDYMTEFGLRSPVAQRSVDRLGSRAGSVLDTDDPNPTICACEAVTRAEIQDAIEQSGTDLNAVRIRTRATMGNCQGGFCAHRLANELHTAGYDDATVRASWDELLAERWRGQRHALWGDQLSQAMLSYALHATTQNRGHDPADADTEIDFTAFDAGPLAADGGPEGAHGN

SEQ ID NO: 18662 - protein, 427 aa, Halobacterium sp. NRC-1
MAIESEVLVIGGGLAGITSALAAADAGADTRLVSYKQSTLRNASGLVDVLGYTPSGDGPVVDPFDAIPSLPDAHPYRTVGVDTVRDAMAFFDAHAPRYQGHHTDANALVPTHGGTVKPTARYPASAAAGLASDDRDTLLVGFETLPDFNADHAAAHLESAGVPFDVRGVTVPFPGDLRAGAKVTRYAGLLDANPQVSVDGTERPLRLALATRVADAAADADRVGFPAVLGDDDPAGVRDALADHLGAAVFEVPMGPPSLPGLRLSDHLFGALEAAGVRIETGNPVVDADTTAGGVETVYVEKNGARIPNSADEYVLATGGLVGKGIDSDRDAVYEPIFDCRIAHSDDRYAWFDDDAFGDHAFAQFGVRTDDTLRPRDDDGAAAHANLRAAGAVLGGYNFAAEHSGSGVSIATGYAAGTAAAEAIHDE

SEQ ID NO: 18663 - protein, 212 aa, Halobacterium sp. NRC-1
MARFGVDEAGKGPVLGSMFAAAVAGDPAAVPDGVADSKRLSADRRAELDDRVRASMRVGVAEVPVDRIDDPETDMNTLTVAAQADALGRVVADGMAGYVDAGDVNEQRFGRRVANRVAADVAVTAEHGADDEYDLVAAASIVAKVARDAHVDALAAAFDADIGSGYPSDSTTREFLAAYVREHGELPECARASWQTSRDALGAAEQSALDEF

SEQ ID NO: 18664 - protein, 600 aa, Halobacterium sp. NRC-1
MPDADTTDDPGDLRTPIVAVLGHVDHGKTSLLDKIRGSAVIEGEAGAITQHIGATAVPLDTVSEVAGSLVDPTEFDLPGLLFIDTPGHHSFSTLRSRGGALADIAILVVDVNDGFQPQTEEAIRILKDTGTPFVVAANKIDTTPGWNPNPDAPVQGTYDDQSDRVRSDLDDALYELIGEMSDAGFSSDLYWRVQNFQKNVGVIPVSAETGEGVPDLLTVLMGLAQRYMKSEMEVTIDGPGAGTVLEVKDEQGFGTTVDVILYDGTIRSGDTVVVGAQPEPIVTDVRALLKPGDLAEMRTEKRFGNVDRMQAAAGLKVAAPDLDDAMAGAPIRVVGDRDVADVVTEVEAELAEVAVETGEEGIVVKADTLGSLEALVSALEEAEIPVMSAEVGDVAPRDVAMATTVDSEKHRVLLGFNVDVLPAAAENAERESVRVFNSDVIYQLVEDYEAFVDAQEREQKEAVFDNIVRPARFRILKDHVFRQNDPAVVGVEVVSGTLKRNTPVGGIEGNDLDRAGIVKGIQDQGEDVDEARAGNRVSVSIDGPTVGRDIKEGDELWVDLPEKHAKVLDQELTSDLPADEREALKSYLDIMRKRDPFWGK

SEQ ID NO: 18665 - protein, 411 aa, Halobacterium sp. NRC-1
MSRSPSLPDRPTLDVDPESTPAERLNALQDHYVDIVAVNGELQAQLDDVEARREELREEVNRLQRENETLKTASLYLATVEDLPEDGSAVIKQHGNNQEVLTELSPRLADTLEVGDRVAINDSFSVQRVLDDETDARAQAMEVDESPSVTYADIGGLDDQLREVREAVEDPLVNPEKFDAVGVEPPSGVLLHGPPGTGKTMLAKAVANQTDASFIKMAGSELVRKFIGEGSRLVRDLFELAEQKDPAIIFIDEIDAVAAKRTDSKTSGDAEVQRTMMQLLSEMDGFDERGDIRIIAATNRFDMLDSAILRPGRFDRLIEVPNPNPDARERILEIHAGEMNVADSVDFSDLAADTAEFSGAQLASLATEAGMFAIRDDRDEVHRQDFDDAYEKLVAEGDTESSGPRYPSYIQ

SEQ ID NO: 18666 - protein, 414 aa, Halobacterium sp. NRC-1
MADEHRQPEVNIGLVGHVDHGKTTLVRALSGEWTDQHSEEMKRGISIRLGYADATLRRCPDCDEPECYTVAETCPEHDTATEIERTVSFVDAPGHETLMATMLSGAALMDGAVLVVGANEPVPQPQTEEHLMALDIIGIENIVIAQNKVDLVDAEEARQNYEEIQAFVEGTVAEDAPVVPVSAEQEINVDLVIDALQTEIATPDRDPSADPLLYAARSFDINRPGTEWGGLLGGVIGGSLVDGELEAGDELELRPGREVEEGGKTEWRPVTTDVRSLQAGGEDVDSASPGGLLGVGTGLDPSLTKGDALAGQVAGPPGSLPPTWESFEMDVDLLERLVGAADGEQIDDISTGEPLMLTVGTATTVGSVTSARDGECEVALKRPVCAPAGAKIAINRRVGARWRLIGVGTLTESE

SEQ ID NO: 18667 - protein, 369 aa, Halobacterium sp. NRC-1
MFTDRDAFAGSITLVDDDMAIDWFVDRAAADRISANPVLAFVFGDEFGVDYETARDANRPVQADPQWIDGLLEEYFDEDDEEMLDLVDVRSPAELTVSLDDIVLTDDQEAEMSKVAKAIEHRDYLATIGLNEVGKLLFVGPPGTGKTSTARGLAHQLDLPFVEVKLSMITSQYLGETAKNVEKVFEVAKRLSPCILFMDEFDFVATTRTGDEHNAIKRAVNTLLKSIDEISLVTDDVLLIGATNHPDELDAAAWRRFDEILSFPRPDEGMRADIISLVTSEVDIADFDPAALAAETSGLTGSDLRLVLREAVLDALVEDRTELTQDDLMAAISEFEDRDHLRNLDTLEDALDDTHSDHTHDDHPAPNPE

SEQ ID NO: 18668 - protein, 410 aa, Halobacterium sp. NRC-1
MRAAGSRPVNRWLDVGRCGSFKERGALAFGMAATTTPVIAAAYRTPQGKDGGVYADTRSEDLSVTVIDHILAETGLTGDHIDDLQWGVAQQRTEQDNNVARVIALLSELGENVPAASINRWCASSMEAIMRAADAVRAGQRDAVIAGGVENMSRVPMDGDSYAHLHPGLSEQYNVPELEMGMTAEEVAERHGITRTEQDEYALQSQRRAAEATDAGRFDDEIVPVQTDSGLVEEDEGIRPDTTLEALGELPTVFKSDGSVTPGNASQISDGAAATLVTSEAFARDHGLDVLARVGDHNVAGVNPEVMGIGPVPATRGLLDRTGEDIDEFDLVELNEAFASQTLYSRDELGIDNDRFNVNGGAIAVGHPLGASGARLPVTLIHEMNKRDAGKALATLCVGFGQGAAISFER

SEQ ID NO: 18669 - protein, 650 aa, Halobacterium sp. NRC-1
MDPRDAEREYDDHVIARQTLSRTFEDAAERHADSPAQAYKGGVYDRSLAPEVVDPAPDGGVETLSYDALRDIVRTLAAGFRDLGVTAGDRVGVFAHTRMEWAQCDLAVLAAGGAVTTVYASSSPAQIAHLLGDSGAVGVVVENDALRQRVREVESDLDDLEFVATMDTPSDDTRPLSAVYDRGRDAFDPDAYQGWIDDRDPDDLASLIYTSGTTGTPKGVALTHRNFHANLNQSRRRFGPRPDRGDAPAVTSDSRHLSFLPLAHVLERLSGHFLPLASGAQVCYAESPDTLREDFGLFEPTSATSVPRVYEKLYDTIREQAADSPVSERVFEWATRVGRAAHTTDDPGIGLRAAHALADTLVFSDIRDALGGEIEFFISGGGSLSPELCALFHGMGLPILEGYGLTETSPVLAVNPYEDPIVGTIGPPVTDTELTVDETIASPEQRQRCDGAAGELLARGPQVFDGYWGLPDATDAAFVTREGKEWFRTGDVVELRPDGYVRFLERAKQLLTLSTGKNVAPGPIEDAFAASPLVAQAMVVGDGQKFVSAILVPNFDAVSEWAASQEIALPDDRDAICRDERVRARIQSAVDDVNTGFEPYERIKQFRLVATEFTEANDLLTPTMKKKRHHIRDRFADAVGDVYDDSEFST

SEQ ID NO: 18670 - protein, 656 aa, Halobacterium sp. NRC-1
MMRSVGAVGEPLVVMCVACPRRGGCVVTVVAAAKSCWCRGVSRNLNPGLCPARRVSVRHSGSCILWCGLPSGRVAAVSLPSDPRRFQRIYIEWQSIYLLNMAQQQRMQGQPMIIMGDDAQRVKDRDAQEHNISAARAVADAVRSTLGPKGMDKMLVSSMGDVTVTNDGVTILQEMDIDNPTAEMIVEVAETQEDEAGDGTTTAVAIAGELLKNAEDLLERDIHPTAIIKGYNLAAEQAREEVDNVAVDVDPDDKDLIRSVAETSMTGKGAELDKELLSSIIYDAVNQVAVETNDGGIVVDAANINIETQTGHGVNESQLLRGAAISKDPVHDQMPAAVEDADVLLLNEAIEVEEAEADTSVNIESPDQLQSFLDQEEKQLKEKVQQIADTGANVVFCQKGIDDMAQHYLAKEGILAVRRTKKSDIEFLTNVLDASVVTDLDAASEADVVAGSVTRDSDDELFYVEGESEQAHGVTLLLRGSTDHVVDELERGVSDALDVSAQTLSDGRVLPGGGATEVEVASRLRDFADSVSGREQLAVEAFADSLELVPRVLAENAGLDSIDTLVDLRSAHENDDDEHIGLNVLSGDLEDTFEAGVVEPAHAKEQAVTSASEAANLVLKIDDIISAGDLSTDKGDDDGGAGGMGGGMGGGMGGMM

SEQ ID NO: 18671 - protein, 224 aa, Halobacterium sp. NRC-1
MAQDIKPTRKNLMEIEDRIDLSERGHDTLEQKRDGLIMEFMDILDQSQDVRSGLEGDYETAQQKINMARAMEGDVAVSGAAAALEEYPEITVESMNIMGVVVPQIESTKVKKSFDKRGYGILGTSARIDEAADAYEELLESIVLAAEVETAMKKMLTEIETTKRRVNALEFKLLPELHEGKEYIDQKLEEKEREEMFRMKKVKDKKEAQEEAADEAAAAESTGA

SEQ ID NO: 18672 - protein, 471 aa, Halobacterium sp. NRC-1
MKEYQTITEVSGPLVYVETDEPIGYDEIVEIETPNGDVKRGQVLESSDGFVAIQVFEGTEGVGKDASVRFLGETLKMPVTEDLLGRVLDGSGNPIDGGPDIVPDDRVDIVGEAINPHAREYPEEFIQTGVSGIDGMNTLVRGQKLPIFSGSGLPHSDLALQIARQASVPEEEAETDDDEGSEFAVVFGAMGITAEEANEFMDDFERTGALERSVVFMNLADDPAVERTVTPRMALTTAEYLAFEKDYHVLVILTDMTNYCEALRQIGAAREEVPGRRGYPGYMYTDLAQLYERAGRIEGKEGSVTQIPILTMPGDDDTHPIPDLTGYITEGQIMMNRDLNSQGVTPPVNVLPSLSRLMDDGIGEGLTRADHGDVSDQLYAAYAEGEELRDLVNIVGREALSERDNRYLDFADRFEAEFIDQGFKTNRDIEETLDLGWELLSMFPKTELNRVDEDLIEDHYVEDVADEATAD

SEQ ID NO: 18673 - protein, 556 aa, Halobacterium sp. NRC-1
MNDVVYVGDEGLMGEVIEIEGDVTTIQVYEETSGIGPGQPVDNTGEPLTVDLGPGMLDSIYDGVQRPLDVLEDEMGAFLDRGVDAPGIDLDTDWEFEPTVEAGDEVAAGDVVGTVDETVSIEHKVLVPPRSDGGEVVAVESGTFTVDDTVVELDTGEEIQMHQEWPVRRQRPTVDKQTPTEPLVSGQRILDGLFPIAKGGTAAIPGPFGSGKTVTQQSLAKFADADIVVYIGCGERGNEMTEVIEDFPELPDPQTGNPLMARTTLIANTSNMPVAARESCIYTGITIAEYYRDMGYDVALMADSTSRWAEAMREISSRLEEMPGEEGYPAYLAARLSEFYERAGYFENFNGTEGSISVIGAVSPPGGDFSEPVTQNTLRIVKTFWALDSDLAERRHFPAINWDESYSLYKDQLDPWFTDNVVDDWAEQRQWAVDILDEESELEEIVQLVGKDALPEDQQLTLEVARYIREAWLQQNALHDVDRYCPPEKTYAILSGIKTLHEESFEALDAGVPVEEITSIDAAPRLNRLGTTPDDEHEAEVAEIKQQITEQLRELY

SEQ ID NO: 18674 - protein, 300 aa, Halobacterium sp. NRC-1
MEYVEARRAAIEQRITEAVGGVEPTELGDQLEHVVLAGGKRVRPTLTVLVCEAAGGAVWTGAAEAAAVRENAALSAGGEDALDYAVGVELVHNASLVVDDIIDRSELRRGSASAWAEYGYGPGIVASDGLLGEAFALFSRDPRAMECVTDSLVELGEGEAIELVARPETEREYMELARRKTGALFRAAAELGAIAADADGRAVERFGEYAERVGVAFQIRDDVLDATADSDALGKPAGVDEALDRPSIVQVTDRSPDALNRLAGEQSERALGALAELELPDGEAKDYLQYLAEFVVERDA

SEQ ID NO: 18675 - protein, 261 aa, Halobacterium sp. NRC-1
MELGLDGDVAVVTASSSGLGKASAAALAREGADVVVCSRDEERVVAAAEEIGADAAGSVRGVPADITDGADVAAVVETAVETFGGLDHVVTSAGGVPSGQFTAVTDDDWTDAFELLVMSVVRTLDAAHEHLVAGDGGTVTCITSTSVSEPIEGLVLSNAVRRGVVGLAKTVAREWAPDVRANVVQPGPHETARIEELVSAAVARGEADSYEAGLAGWSEEVPLDRLGEPSELGDVVAFLASDRASFVTGASVPVDGGRLWG

SEQ ID NO: 18676 - protein, 831 aa, Halobacterium sp. NRC-1
MDPDLADDYISHPDQLQEAAEEALRVYDLPVDVSLGQAHVRVHGLAEHTDIRAIRAEHLNTMVSIQGMVRKATDVMPKIQRAVFVCQRCGTDTEVPQGDAGFQEPYQCESCERQGPFKLDPDRSEFVDSQKLRIQESPEGLGGGETPQSIDVHVEDDATGNVTPGDHVTVTGVLRLDQSEEATDSPVFEHYMEGSSVVIEDAEFDELNISEADKEEIVALSDHEEIHEEMVDSMAPAIYGHREAKLAMMLQLFSGVTKHLPDKSRIRGDLHMLLIGDPGTGKCVRGDTTVALADGSEREIRDLVEANLDDPRPVDDGVWDGVDVAVPSLAADGRLVQRRATKVWKREAPETMYRVRTAAGHRLTVTPSHPLFVAGSHGPDAVRTEDLEVGQLVGVAPDGDGSGQVAPDGGVIRDAQPAPVGDAETVAWSAIESITEVEPDEEWVYDLEVEGTHSYLTDGVVSHNSQMISYVQNIAPRSVYTSGKGSSAAGLTAAAVRDDFGDGQQWSLEAGALVLADNGVAAVDELDKMADDDRSAMHEALEQQKISVSKAGINATLKARCSLLGAANPKYGRFDQYEPIGEQIDLEPALISRFDLIFTVTDQPDPEEDAALADHILQTNYAGELNTQNEELANANYSEAEIESQTEDVAPAIEPGLLRKYIAYARRTCFPTMTPDARQAIEEFYVDLRSKGADEDAPVPVTARQLEAIVRLAEASARLRLSDSVEKSDADRVIGIVQSCLQDIGVDPETGEFDADVVETGQSKTQRDRVKNIKALIGEIEEEFDDGAPVEEVLDRAEEIGMDAGKAEHEIEKLKERGELYQPNTDHLRSI

SEQ ID NO: 18677 - protein, 287 aa, Halobacterium sp. NRC-1
MQHPHRCPECDGTIRETDTEHVCADCGLVVTDAPIDHGPEWRTFSDDPDHAPERTGAPLTRSRHDRGLSTEIGYSARLTGRKRRKFARLRRQHKRATIPSKADYNRIYGFTEIRRLIGTFGIGTGLRDQACTLFASAQTAGLLHGRTIEGFAAAGVYATCRTNGVTRTLDEIAAAARATRPELTTAYDAMNRDLGLPTGPIDPREYLPRYADALSLPARIERQARELVAALETDGLVAGRNPSGVAAGCLYTAATETDHAVTQSAAAAVADVTPVTLRATYQNLTDA

SEQ ID NO: 18678 - protein, 801 aa, Halobacterium sp. NRC-1
MTRDSCTLCGLPTPEPPVTGGDDVDGAFCCRGCMEVARTLEDPAAMDDAGAADSLDTGADTTDVDGEAAFLSVSGMHCATCEAFVEAQATDTEGVRAASASYPTETLKVTYDPETVDREAVRAAVDGLGYSATERDGDAAADDDESEVGRLLVGGFFGMMTMLWYVLFLYPAYLDVPSAAQLLDLGGLAGSYLLANVWLMATVVLAYTGYPLFRGAYVSLRAGHPNMDLLVGIAAGAAYVFSTATILTGGREVYFDVAIVVVLAVTVGDYYEGRVKRAAAGRLADLTEERVDDATRRRADGATETVAIEELQAGDEVVVGTGERIPVDGVVTSGSATVDESLVTGESTPVGATPGDDAVGGAVVTDGRLVVAVGDDAASTLDRVVRVLWDVQSARPGVQRLVDRVAAVFVPLVVVLAGVAGGWHLLAGGAAANEALLVGLSVLVVSCPCALGLATPLAVARGVQEALDGGVVVTDVSAFEAAPAVDTVVFDKTGTLTTGEMRVRDVVGDDGVLARAAAVEQYADHPVAAAITDDATPAGDIDDFERVPGRGVAGSLAVRPDGAAAAADAPRVVAGNRALFDDRGWRVPEAYAERAGDARANGNVPVFVGWDGEARGVVVAGDRPRDEWTDVVSTLDADGRDVVVVTGDDPEAAARFRDHDAIAAVFAGVPPEGKTEAVRSLRADGDTVAMVGDGVNDAPALAAADLGVALDHAALAADAADAVVTTEDLGAVPRVFALTDATNGRIRQNLAWAFCYNAIAVPLAVAGVLNPLFAAGAMTVSSLLVVGNSTRSLLDDGVAGP

SEQ ID NO: 18679 - protein, 281 aa, Halobacterium sp. NRC-1
MLLSGSSSQSLAAALAAATGERLGDVTYDSFPDGEQLVTVPPAVDGERAVIVASTPTSDAHIEVLQLQDAARDAGASEIITVLPYMGYARQDDAFDPGQPVSARAVARAISTGTDRVLTVNPHEDGVLECFDVPAAGVDAAPQLAAPLPADLTDPVFLSPDHGATDLATSVRDAYGTGVTDHFQKVRHSGSDVTVEPSEIQTAGRDVVVTDDIVATGTTMSEAITALDDPARVFVATVHPLLAGSARLKLARAGVEAVYGTDTIECAVSEVSAAPAIADAL

SEQ ID NO: 18680 - protein, 455 aa, Halobacterium sp. NRC-1
MNVFGSSGTRGVANEELTPGFVLRVAKAAGSVWRADRVAVARDTRTTGRMLENAAVAGLQSIGVDVDRLGVVPTPATQAYAERAGVPAVMVTASHNPSQYNGVKLVGSDGVELAVADLERVERAFTTEQFDNAAWDGVGADREVASAGRDYRAQLSDAVDRAAIAAADLTVALDPGHGAGALTSPTFYRELGCDVVTVNAQPDGHFPGREPEPVREHLGDLGALVRAADADVGIAHDGDADRAIFVDETGEYIEGDATLAALAEAELDAGDTTVSAVNVSQRLVDVCDRTGATLELTPIGSTQIMTRIRELEAEGDHVPVAGEGNGGIIFPEYRMTRDGAYTGARFLELLADGTPASEVVAPYDDYHNVRVNVDYDTEAQRGALLDAAEARALDADADRTTIDGYRLDYGDAWVLVRPSGTEPVVRIYAESTDHERAESLAEAFAADLRAARADA

SEQ ID NO: 18681 - protein, 419 aa, Halobacterium sp. NRC-1
MALVLPNQSTETGQWVEIRWQRSPWKRLLRKSYSRRGRSSAHVRTGVPVTETIHRAPDDTYRVLDENGELVDGAEVPDLTDDELVEMYRYMKLARRFDERAVSLQRQGRIGTYPPLSGQEGAQIASAMALADDDWIVPSYREHGASLVRGLPLKDTLLYWMGDERGNAIPAEENIFTVAVPIASQIPHATGMGWASQLKDESDTAFMCYFGDGATSEGDFHEGLNFAGVYDTPNVFFCNNNQWAISVPREQQTATDTLAQKAAAYGFEGVQVDGMDPLAVYQVAHDAIEKAKDPDEDEMRPTLIEAVQYRFGAHTTADDPSVYREESEVEAWKDKDPIPRLETFLVETDRLDDAAIESIEADIEDAVADAIEAAEETPRPDPASMFENVYAEMPQRLEQQLEYFQSIRDEYGDEALLED

SEQ ID NO: 18682 - protein, 297 aa, Halobacterium sp. NRC-1
MGEDVGQNGGVFRATEGLYEEFGDDRVIDTPLAESGIIGSAVGMAAYGLKPVPEIQFSGFMYPGFDQVVSHMSRLRTRSRGRFTLPMVLRAPMGGGIRAPEHHSESKEAFYAHEAGLKVAMPSTPYDAKGMLIASIRDPDPVVFLEPKKIYRAFREDVPDDPYEVELGDAAVRTEGEDVSVFTWGAMTQPTVEAAENLDRIDVEVVDLRSLSPIDFDTIIESFKKTGRAAIVHEAPNTGGLGAEITATIQEEALLYQEAPVERITGFDVPFPLAALEDYYLPEPARIAAGIEEAFDF

SEQ ID NO: 18683 - protein, 478 aa, Halobacterium sp. NRC-1
MAREFTLPDVGEGVAEGELVRWLVDEGDTVTEDQPVAEVETDKAQVEVPAPVDGTVQELHWAEGDVVPVGDLFVTFDVDGEASATADDGDESGDEAASATSEASGRTFAPPSVRTLARELGVDLDSVEGSGPSGRITDGDVRAAAEGGEDTTEPATEATSATERVDEDDTAASAGSQEPAGREKTLAAPATRGVARELGVDINDVPAVEQRDGEAFVTAEAVQAYAEGGQAAQGEAGGAATREFVAGGETTEPYRGIRRTIGEQMAESKYTAPHVTHHDTAVIDSLVETRSKLKARAEAEDVKLTYMPFVMKAVVAALKEFPVLNSELREDDEEIALKQDYNIGVAVATDAGLMVPVVEHVDQKSMLEISTEMNDLVEQARERSIAPADMDGGTFTITNFGAIGGEYATPIINYPETAILGLGAIDERPVAEDGDVRAAQTLPLSLSIDHRVIDGAEAAQFTNRVMEYLTDPELLLLE

SEQ ID NO: 18684 - protein, 474 aa, Halobacterium sp. NRC-1
MVVGDISTGTDVAVVGAGPGGYVAAIRAGQLGLDVTLVEKDAYGGTCLNYGCIPSKAMITASGVAHEAGHAEEMGVYADPDVDVAEMVDWKDGVVDQLTGGVEKLCKANGVNLIEGRAEFAGSDKLRVVHGGDGQGSETIEYEHAIVSTGSRPIEVPGFDFGDDPVLDSRQALAMAELPSSMVIVGGGYIGMELSTVFAKLGVDVTVVEMLDGILPQYGDDIARPVRQRAEELGIDFHFGLAADSWTDTDDGIVVTAADEDGEETEFETEKVLVAVGRQPVTDTLNLDAVGLEPNDDGRLETDHEARTDVENVFAIGDVAPGPMLAHKASKEGEVAAEVIAGEPAALDYQAVPAAVFTDPEIGTVGLTEDDAAAQGFDPVVGTFPFNASGRALTTGHDDGFVEVVADEESGFLLGAQIVGPEASELVAELGLAIEMGATLEDVASTIHTHPTLSEATMEAAEHALGHAVHTLNR

SEQ ID NO: 18685 - protein, 581 aa, Halobacterium sp. NRC-1
MVLIVTQVLNRIAFNQRVIMAQQMGNQPLIVLSEDSQRTSGEDAQSMNITAGKAVAESVRTTLGPKGMDKMLVDSSGEVVVTNDGVTILKEMDIEHPAANMIVEVAETQETEVGDGTTTSVVVSGELLSEAETLLEQDIHATTLAQGYRQAAEKAKELLDDAAIDVSADDTETLEKIAATAMTGKGAENAKGVLSDLVVRAVQSVADDNDVDTDNVKVEKVTGGAIENSELIEGVIVDKERVSENMPYAVEDANIALVDDGLEVQETEIDTEVNVTDPDQLQNFLDQEEEQLKEMVDALKDAGANVVFADSGIDDMAQHYLAKEGILAVRRAKSDDFTRLSRATGATPVSNVNDIEAADLGAAGSVAQKDIGGDERIFVEDVEEAKSVTLILRGGTEHVVDEVERAIEDSLGVVRVTLEDGQVMPGGGAPETELAMQLRDFADSVGGREQLAVEAFADALEVIPRTLAENAGHDPIDSLVDLRSQHDGGDTEAGLDAYNGDVIDMESEGIVEPLRVKTQAIESATEAATMILRIDDVIAAGDLAGGQVGDDDGDDGPAGGPGGMGGGMGGMGGMGGMGGAM

SEQ ID NO: 18686 - protein, 186 aa, Halobacterium sp. NRC-1
MTDPKETINIENVVASTGIGQELDLQSVAMDLEGADYDPEQFPGLVYRTQDPKSAALIFRSGKIVCTGAKSTDDVHESLRIVFDKLRELSIKVEDDPEIVVQNIVTSADLGRQLNLNAIAIGLGLENIEYEPEQFPGLVYRLDDPEVVALLFGSGKLVITGGKEPKDAEHAVDKITSRLEELGLLD

SEQ ID NO: 18687 - protein, 282 aa, Halobacterium sp. NRC-1
MRIAVPNKGRLHDPTLALLDRAGIGVEDGADRQLYADTVDPALTVLYARAADIPEYVADGAADAGITGHDQLRESDVDCVEERLDLNYGSCRLVLAAPEDGDVTAPADLDGATVATEFPTITRAYFADTTATPEIVEVTGATELTPHVEMADAIVDITSTGTTLRVNRLQVVDEVLSSSVRLFAHEDVHDDPKVQQVETALRSVLDAHGKRYVMLNAPADRLDDVKAVLPGLGGPTVLDVDEPGTVAVHAVVPERDVFEAISELKAVGASGILVTEIERLVD

SEQ ID NO: 18688 - protein, 427 aa, Halobacterium sp. NRC-1
MTTAPAISSRLDDPESARETGRAKIDWAFEHMPILSALREEFDANQPLAGETIGMAMHVEAKTAALVETMADAGAEIAITGCNPLSTHDGVSAALDAHESITSYAERGAEGEAYYDAIDAVLAHEPTVTVDDGGDLVFRVHEDHPELIDTIIGGTEETTTGVHRLRAMDDDDALEYPVFAVNDTPMKRLFDNVHGTGESALANIAMTTNLSWAGKDVVVAGYGDCGRGVAKKAAGQNANVIVTEVEPRRALEAHMEGYDVMPMAEAAEVGDVFLTTTGNKNVITRAHFERMDDGVVLANAGHFDVEVNLDHLSELAVSEREAREGVREYELADGRRLNVLAEGRLVNLASPIGLGHPVGVMDQSFGVQAVCVRELVANREEYAAGVHNVPDELDIEIAEIKLAAEGVEYDALTDDQAEYMDSWQHGT

SEQ ID NO: 18689 - protein, 247 aa, Halobacterium sp. NRC-1
MFKAIVSADTLQETLDSVSVLVDECKIHLDDDTLSIRAVDPASVGMVDLDLAATAFESYEADGGLIGVNLSRLEDIAGMADAGQLIQLELDEETRKLHIQIDGLEYTLALIDPDSIRQEPDIPDLDLPAHVAIEGRDIDRAVTAADMVSDHIALGVDTGDDLFYVNAEGDTDDVHLELAPDQLIDLDAGDAHSLFSLDYLKDMNKAIPTTAEVELELGDEFPIKLHFDIADAQGHVTYMLAPRIQSN

SEQ ID NO: 18690 - protein, 457 aa, Halobacterium sp. NRC-1
MDEVISFGTDGWRAPLSEFTSDRVRIVAQGVADHLAADGGAGDTVAVGYDARDTSAGFAADAADVLAANGFDVVLPERDCPTPAVSHAIVERDLAGAVVITASHNPPEYNGVKFIPADGAGALPSDTDGIMANLGTPAAGDPTGEIRRVDFTGPHVAHCRRLVDASLDGLTVVYDAMHGSGRGVTGDALEAAGADVIRRRCTQDAAFGGTPPEPTPEHLAGLADAVDEHDADLGIANDGDADRVAAVTPERGVLDGNWFYVLAYDYLLESGTGPAVRTVSTTGHVDAVAAAHDCEVVEVPVGFKWVAAAVDDHDALFGGEESGGYTMRGHVRQKDGVLMGLLAAAAASETALDDRIDAIEDAHGEIHQDKTSVDCPDDRKQAVLDGLDAALPDSVAGVAVDSVNDTDGFKIVLADGSWLLVRPSGTEPKMRVYAEAGSAARVAALLDAGRELVAPVV

SEQ ID NO: 18691 - protein, 322 aa, Halobacterium sp. NRC-1
MTDAAGGRQEIWVEKYRPERLEDVVGHPDITERLQSYVDRDDLPHLLFAGPAGTGKTASSVSIAKELYGDDWQDNFLELNASDERGIDVVRDRIKDFARSSFGGHNYRVIFLDEADALTDDAQSALRRTMEQFSNNTRFILSCNYSSKIIDPIQSRCAVFRFAQLGDDAVAAHLREIAETEGLEHTDDGIDALVYAADGDMRRAINALQAASATGDSVNEETVYAITATARPEEIETMVTEALGGDFAAARATLDDLLTNRGLAGGDIIDQVHRSVWEFDVEEAAAVRLLDRLGEADYRIAEGANERVQLEALLASVALNAE

SEQ ID NO: 18692 - protein, 196 aa, Halobacterium sp. NRC-1
MTDRTAAVTRETAETDVAVTLDLDGDGEHTVDTGIGFFDHMLAAFAKHGLFDVTVRCDGDLDVDDHHTVEDVGIALGAAFSEAVGEKRGIQRFADRRVPLDEAVASVVVDVSGRAVYEFDGGFSQPTVGGLTSRMAAHFWRTFATHAAVTLHCGVDGENAHHEIEALFKGVGRAVDDATRIDQRRAGETPSTKGDL

SEQ ID NO: 18693 - protein, 232 aa, Halobacterium sp. NRC-1
MLSVRNLVHRYGDTVAVDGVSLDVADGECVVVTGANGSGKTTLVRHCNGLLEPDDGEVLVNGTPVGEDLVAARASVGMVFQNPRDGFVGATVGADVAFGPENLGRPREEIDARVADALDAVELGGRRDERVADLSGGEQERVAIAAALAMRPDHLVLDEPFTGLDWPARQSVLDRLRALHAAGTSLIVVTHDLRDVWTLADRVVAMRDGEIALRGDPADVRGALPDAGVRPP

SEQ ID NO: 18694 - protein, 326 aa, Halobacterium sp. NRC-1
MELPHRPRRLRRDGVRDLVSETMLTPADLVAPVFVDATADERTPIPSMPGQERVPLADAVDRTREILDTGVEAIVLFGIPASKDDTGSRAYADDGIVQEATRRITSETDAYVITDVCLCEYTSHGHCGVVEADADTDPTLTVKNDETLSLLAETAVSHAEAGAEMIAPSAMTDGMVDAIRTALDDAGFSDVPIMSYAAKYESAFYGPFRDAADGAPSFGDRRHYQMDPANRREASREVALDVEQGADVLMVKPALPYLDVVSDVRREFDRPVAAYNVSGEYAMLHAAAEKGWLDLESVAHESLLSIKRAGADLIITYFAEDVAETL

SEQ ID NO: 18695 - protein, 445 aa, Halobacterium sp. NRC-1
MNRETSRELYDRSLDVLVGGVNSTVRAAPQPYPTFVQSGDGGHVIDADGNRYIDWVMGLGPLLLGHDLPQPVTAAIQRRASDGPLFGTPTEIEVEHAEFVARHVPSVELLRFVNSGTEATVSAVRLARGYTGRNKIVVMQGGYHGAQESTLVEGDADHRGPSSAGIPPAFAQHTIPVPFNDADAVTEVFETHGDDIAAVLVEPILANKGIVEPVAGYHETLRDLTHDHGALLIWDEVITGFRVGGLGCAQSEFDITPDVTTFGKIIGGGFPVGAIGGRTDVMEEFTPTGDVFQAGTFSGHPVTMAAGLETLQYAAENDVYEHVNRLGGRLREGLAAVVAEHAPAYTVVGRDSMFKVVFTRDGDAQSGACTDGCRQDPDCERHAACPKTGADVGDAAVQRWNRVFRPQLLDAGVLLSQNQFESQFVSYGHTEADVDETIEAYRSAL

SEQ ID NO: 18696 - protein, 396 aa, Halobacterium sp. NRC-1
MSSQQIRLATRGSDLALRQAGEVVDTLEDRRHDVELVEVETEGDRVTDALISDLGKTGAFVRALDQEVMEGTVDAAVHSMKDVPTEVPEDLVVAAVPHRENPADVLVTPDGTDLEDLPAGSVVGTASLRRGAQVQAHRPGLDVEPIRGNVGTRVEKLLAPALHREHERRTEAEKEAQSRDAREQRRGDYTADIEAGVENLDTEDGEEGAADDGDDTASSSEFEQSVTEWFDSLTPLQQSAMERDPDTEYDALVMARVGLERTGLLHHVGIEELSTGTHVPATGQGALCVTARRDSDVVDTLRDALEHVRTRVEVTAERVVLEELGGGCIAPIGVHALVQGDTIRTAVQVFSQDGSEQVGETRELDAEQYATDARELAADLRDRGAADLIEDARTEA

SEQ ID NO: 18697 - protein, 304 aa, Halobacterium sp. NRC-1
MTKVSIVGAAGTVGAAAGYNLALRDVVDELVFVDIPDKEEETIGQAADANHGVAYDANTDVVQGDYADTAGSDVVVITAGIPRQPGQSRTDLAGDNAPIMEDIGSSLAEHNDDFVTVTTSNPVDLLNRHLYESGDRDRHSVVGFGGRLDSARFRYVLGQRFDVPVQNVDATILGEHGDAQVPVFSKVRVNGTDPAFSADEREEILADLQESAMNVIEKKGATQWGPATGVAHMVEAILNDTGEVLPGSMVLDGEYGLDDVGLGVPVKLGSDGVEEVVEWELTADERDLLDEAAEKLSAQYDEIA

SEQ ID NO: 18698 - protein, 353 aa, Halobacterium sp. NRC-1
MGNTTDELLDDITFDADEPDRAEIVSMGERTSVRMLKAALAARGVDATFLEPGTTDWPIVTNERGEVDADATAAGVDRLAGRLGDTVPVITGFLAEDPQGNVTTLGRGGSDTTAVMLGRYLDADEVVIVTDVEGIMTGDPQVVEGARNVGRITVDELRNLSFRGAEVIAPSALSFKDDALDVRVIHYQHGDLLSGGTRIEGTFESMIDMRDSPLACLTVAGRAIRNRPGITSALSTALSDSDINVDAVASGMDSMTFYVDESVAERAENILHQEVIAVSELSSVTVTDDIAAIRVLGGELPNRPGVLCRIIDPLADRNINVIDIISSATSVAVFVSWADREPALDVVQNGFGS

SEQ ID NO: 18699 - protein, 804 aa, Halobacterium sp. NRC-1
MTHATSATSDMVAAALDRALTDHEDDIDSDARDRILTEATRNAYDDATTDERYDALLGALTGRIDRHPAYKTVAGRVLRERLERRLVDDYDPATRDAATRQAFRDGIQRGLDADLLDERMGDYDLNRLADAITPARDDRLDYMAMDTLRQRYFLREPDADPFELPQPFWMRVAMGVALREDPADREEYAIEFYDALSTLRFVHSTPTLFHAGTTHAQLSSCYLTTVPDDLDGIFDAYKEHAKLSKWSGGLGNDWTPLRAAGSLIESTGVESTGTVPFLKISNDVTAAINRSGKRRGAAAAYLACWHLDFPAFCDLRRNTGDERRRTHDMNTAAWIPDLFMERVRADKQWTLFSPKETGDLYELYGSDFAERYREYEAMADDGDIQRFERVDATDLWRTMLTRLFETGHPWLTFKDPCNVRSPQDHAGTVRSSNLCTEITLNTSEEETAVCNLGSVNLARHLDDGDIDREQLSETVETAMRMLDNVVDLNFYPTENAERSNMRHRPVGLGVMGFHDALQQMRVPMASDDALDRADALQEYVAYHAIGASADLAAERGTYESYEGSKWDRDVFPQDTVDRLESERGREIPVPREERLDWSDVRQRVATHGMRNSNTMAVAPTATISTIAGTTPSIEPVYSNLYVKSNMSGDFTVVNDRLVADLEERDLWTEELRDKLTYHDGSVQELDAVPEDVQELYRTAFEIDPRHQLRLAARRGVWIDQSQSVNVFFPETDGSKLSEVYQTAWELGLKTTYYLRTLGASQIEKTTLDMDEYDDTQFRGDDDGEDADGDGDLPSVEDPTCEVCQ

SEQ ID NO: 18700 - protein, 293 aa, Halobacterium sp. NRC-1
MYVGVHPLRMADYATDVLVTADWVDDHLDQFRSDDPDHRLVEVDVDTEAYEESHAPGAIGFNWETQLQDQTTRDILDKDAFESLLGSHGITEDSTVVLYGDNSNWFAAYAYWQFKYYGHDDVKLLDGGRDYWMDNDYPTSEEPPSFSATDYDASGPFEGIRAYRDDVENAIDKGLPLVDVRSPEEFSGEILAPPGLQETAQRGGHIPGAENISWAATVNADGTFKSADELRSLYADQGIDGDETTVSYCRIGERSSIAWFALHELLGYDNTVNYDGSWTEWGNLVGAPVETGE

SEQ ID NO: 18701 - protein, 257 aa, Halobacterium sp. NRC-1
MSDNWVVTPDWLDEQDDASVRVVDVRDAWEYDGIGHVPGAVNVPFDAFRSADGPQGMLPPAGEWAAVLSAAGVERGDTLVAYDDTHGVFAARFLVTALYHGHDDVAVLDGDYSAWVREHETTTGTPEVDETTYEPGERGVDVFVGTEAVADAAASDAAVVVDTRDPGEFADGHIPDAVNVTWTAFVDDDTRGLKSRAAIEDVLAEHGITREDRVVLYCNTARRISHTFVVLRWLGFTDVSFYEGSVRAWTAAGRSLV

SEQ ID NO: 18702 - protein, 518 aa, Halobacterium sp. NRC-1
MTDDRSTDERRTADRDFEVDLDDVLDDEDDDEGLFDDLLSGEPIFENKEVLRPSYTPHELPHRNDQINNMATILVAALRGETPSNILIYGKTGTGKTASAKFVSQELEKTSKKYDVPCEVEYINCEVTDTQYRVLAQLANTFIDQNRAFVDARIADLSDLRAQADDDPNALEIGGSPGDDRTGNESSEGSDVSDSFSDLRERFDSVAEIDDRIDSLEADKAEMEQVPMTGWPTDRVYATFFDAVDYVERVAVIMLDEIDKLVEKSGDDTLYNLSRMNSELDNSRVSIIGISNDLKFTDFLDPRVKSSLGEEEIVFPPYDANQLRDILQHRSDVAFKADALSDDVLPLCAAFAAQEHGDARRALDLLRTAGELAERDQAENVTEDHVRRAQDKIELDRVVEVVRTLPTQSKLVLYAILLLEDNGVHNVNTGEVYNIYKTLCDELDADVLTQRRVTDLISELDMLGIVNAVVVSKGRYGRTKEISLSVPVEETEAVLEADSRLSDIEDITPFVQARFENN

SEQ ID NO: 18703 - protein, 431 aa, Halobacterium sp. NRC-1
MGHDHGLHTNSVHAGQRVDPATGARAPPLYQTTSYAFEDSADAAGQFALERDGYIYSRLMNPTVETLQDRLAALEGGVGAVATASGMAALDLATFLLARAGDSVVAASDLYGGTVTYLTHSAQRRGVDTTFVDVLDYDAYADAIDADTAYVLVETVGNPSLITPDLERIADIAHDNGVPLLVDNTFATPALATPIDHGADIVWHSTTKWIHGAGTTVGGALVDAGSFDWDAHAADYPEIAQENPAYHGVTFTDRFGDAAFTYAAIARGLRDLGNQQSPFDAWQTLQKLETLPLRMQQHCRNAQLVAEHLRDHPNVSWVNYPGLADHDTHDNATTYLDSGYGGMLTFGVEDGYEAAQSVTEETTLASLLANVGDAKTLVIHPASTTHQQLTPEAQRAGGVRPEMVRVSVGIEDPADIVADLETAIEAAVGSA

SEQ ID NO: 18704 - protein, 1012 aa, Halobacterium sp. NRC-1
MATRDLRSDDPSTDPDADYDYTSDSVERPGLVDDLRERVDGDVRFDSYTRQLYATDASIYEALPVGVVFPTSTDDVAAVVSYCADRGIPVLPRGGGTSLAGQAVNEAVVLDFKHAMNGFVGFDPEAETARAQPGITLAALNDELAAHGLKYAPDPAWGDKSVLGGAIGNNSTGAHSLQYEKADGYLESAEVVLADGTVTTLGWVDTDDLDALADPDGDLEARIYADLRRLLDEEADRIRERFPDLKRNVSGYNYDRLLADAEAHGAVNAARLLAGSEGTLGIITEAEVSLEPVPAETAVAMLTYDDVRDAMQDVAPVLDHDPSAVEVMDDVFLDLARDTDEFADVVGLLPDGTDSTLLVEFYADSPAEARRRVADLLADRLPSATPAADPPGATTTDAPVHAVDALEAYDDDRQAHFWKMRKAGLPILLSRTSDEKHYPYIEDTAIPADHLPAFVADFQAILDDLDTVASYYAHAGPGVLHVRPLVTLADEAGVAKMAEIADRVTDLVVEYGGAVSGEHGDGRARSQWNRKFYGEDLWASFRRTKAAFDPDWILNPGPVCGDAAGEIDMTDHLRVAPDDEFDAGFDPALNWDTENGFRGMTELCHGCAGCTGHQDTTGGVMCPTYRAANEETLSTRGRANMLRSAMNGHLPADPLDDEFLTEVLDLCVGCKGCKLDCPSGVDMAKLKTEVKHASHQADGVGVLDRLFGHTEALFHLGSALAPVSNWATALPGAGALAEKTLGIAAERDLPTFRRESLRAWFDARGGSRVPEAAAEHTVLLAPDPYTNYSTVAVGKAAVRVLEAAGVHVALPDGVGTSGRPAYSRGLIDRTRRIARENVAALAPKVADGWDVVYVEPSDAVMVQDDYHDLLSSAPAASVAANTYGVCEYLDRHGLDAAAGFDADGESLAYHGHCHQKAQQRDHHAVGVLRRAGYEVDPLDSTCCGMAGSFGYEAEHYSMSQAIADILADQVADSDADTVTAPGSSCRSQLSERDDVDTDGAPPHPVQKLADAL

SEQ ID NO: 18705 - protein, 485 aa, Halobacterium sp. NRC-1
MTGGGDPVVRRDRFSGGPARSFLSSMDGDGRIFEADLAVDRAHVVMLAEQDVIGDEAAAAILGALADVEAAGFDALPPGEDVHEAIETAVVEAVGRDGGKLHTARSRNDEVAACIRYRLRADLLDAIEVVVALRSALADVAAAEAETVMPGFTHLQPAQPTTVAHWALSYAGTLARDTGRLCDAYGRTNESPLGAAAFAGTTFGVDRERTAALLGFDGVVANAADAAASRDFLLEAVSALASVAVTCSGLAADVVFFANRGFVEVSDDYASTSSIMPQKKNPDTMELVRATAGDAVGAQQALATTLQGLPRAYNRDLQRATGHAWTAVDGVTSAVEVAAGVVATAGWPADDLEAAAGEGFSTATGVADALAAGGLPFRTAHEVVALAAERGCEGATLDAVAAATEAVTGEPLSAVVEPAAVADALDPVGSVAARDSAGGPAPAAVEAAVADVRDGIDADEAALAAERASLADAADALAAEVSGYV

SEQ ID NO: 18706 - protein, 396 aa, Halobacterium sp. NRC-1
MPSGTVALAFSGGLDTTVCVPLLKEEYGYDDVIGVTVDVGQPDAEFAAARETAAALGVEHHVVDATAEFAALCFDAVRANATYQGYPLGTALARPVIADAILSVAEAEGCAALAHGCTGKGNDQLRFEAVWRASDHDVCAPVRELGLTREWEIEYAAERDLPVEAGNEGEWSIDTNLWSRSVEGGHLEEPDYQPPADIYAWTDAPSGETGTVDITFEAGVPVAVDGTAMEPVALIEALNDRAGSYGVGRTDMLEDRMLGLKVRENYEHPAATTLLAAHKALEGLVLTKAERDFTAAVSQQWAQKAYEGVVEHPLMDALNGYLDETQSAVSGTVTIAFEGGRARPIARESEHAVYSADAASFNTETVAGIEQADATGVAKYHGFQSRLANAAFDGNK

SEQ ID NO: 18707 - protein, 732 aa, Halobacterium sp. NRC-1
MQFFPKPSPYDNQRAAMDAIRDALDGGTNVLFEGACGTGKTLAALAPALSHAQAEDKTVVITTNVHQQMRQFVREAREIHATEPIRAVVFKGKGSMCHIDVDYEECQVLRDNTHELVDATRDKRQLEERQRALLDEAQDGDTEAADARQAVMDELEAVESELAALQDGNVCERYRQNLVGNTDEFYQWLYDDVRTPEDIYGYAEEAGFCGYELLKDGIEGVDLAVCNYHHLLDPGIRAQFFRWLGRDPEDVVVVFDEAHNIEDAARDHAAETLTEQTLDSALDELQDTSDQRAAAAERVLGAFRDALVETYEDALRPGGDGPADTKSAVESNWVDVPVANDDRRDDLTLAFLQSYTGPGITEDVTDALGLGEYLDGEYEDAYRNGDATTRRECHVLAAAEFVEAYVERGGEFGQYPTAAVRRDDRTEAVYGRAERYTCIPREVTTDLFDAVHASVLMSATLRPFDVIGDVLGLDDPVELAFGLQFPEDRRRTFAVDTEPLFSSNREDRATQQAVAGALRDAAAYTPGNCLFFFPSYAEAKRYHDLLADCDATRYLDEPGVAADDLREAFVADGDGALFTSLWGTLAEGVSFDGDDARTVAVVGVPYPHLDARTEAVQDAYAQAFADRDADQGLRSDRQDAGWRYAVEIPTVRKTRQAMGRVIRSPEDFGVRMLVDRRYTAASRTGMQKYSVNPTFPPSERAEMVDVDPEKLRFSLLNFYGDLGAYGGDPPAP

SEQ ID NO: 18708 - protein, 386 aa, Halobacterium sp. NRC-1
MGRDSARRLLSTPSRRRPSAATSFTFSVLYTRLYAWGGTTRRYMPESDLEELPGVGPATAEKLRDNGFDAFQSLAVANSAELSNTADIGESTAADVIQAAREAADVGGFETGATVLERREQIGKLTWNIPEVDDLLGGGVETQSITEVYGEFGAGKSQVTHQLAVNVQLPTEYGGLHGRAVFIDSEDTFRPERIDDMVRGLSDETLQAAMEAHEIEGSTDDEDTLTELVDAFLDKIHVAKGFNSNHQMLLAEKAKEIASEHEDGDWPVRMLTVDSLTAHFRAEYVGRGELADRQQKLNKHLHDLEKVGNLYNAAVLVTNQVQSNPDAFFGDPTKPIGGNILGHKSTFRMYLRKSKNDKRIVKLVDAPNLADGEAVMRVQDEGLKPE

SEQ ID NO: 18709 - protein, 337 aa, Halobacterium sp. NRC-1
MGEMGFYAPNLDGYGLPNVSETAYGLLMQELEACDSGLRSMASVQGALVMYPIHAFGSEAQKERWLPALGAGEAVGCFGLTEPEHGSNPSAMETTAEPDGDEYVLNGSKTWITNSPIADVAVVWARDHGEDGTPVRGFLVETDRDGVTTNEIDEKLSLRASITGEISLRNVRVPAESRLPGVEGMKGPLSCLTQARYGIAWGAVGAARNCFETAREYATDREQFDQPIGGFQMQQDKLAEMATQITTSQLLAHRLAGLKERGDLRPQHVSMAKRNNVRMARDQARVAREMLGGNGITTDYPPMRHMANMETVYTYEGTHDIHTLILGEDLTGMQAYQ

SEQ ID NO: 18710 - protein, 349 aa, Halobacterium sp. NRC-1
MYGLLKSALFGLPPETTHEITTSALRVAQRVGAHRAYAKQFTVTDPRLSVDAFGQTFPNPVGMAAGFDKNAEIPRALAGLGFGHIEVGAVTAERQPGNDRPRLFRLPDDNALVNRMGFNNEGADTVGARLDAEPLPDVPVGVNIGKSKTTPLADAPDDYTYTFSRVGDAVDYVVVNVSSPNTPGLRELQGRDQLAAILEALQDAGASPLLVKLSPDLHQDAVADAVELANDLGLDGIVATNTTTERPESLSHPHAGEQGGLSGAPIRERATEQVRFVAERTDQPVVGVGGVATAEDAYEKIRAGASVVQLYTALVYEGPWVAKRINEGLVSLLERDGFDSVEDAVGADL

SEQ ID NO: 18711 - protein, 489 aa, Halobacterium sp. NRC-1
MSDLDFGDVDWNVQYIDGEYVPPGDRGTLEVDDPSTRELFTEIPAGTTDDVDAAYEAAADAQTEWADTPPQERARIVAAASEILASHRDEVVDLLATESGTTYTKGAAEFEASVGITDEAASFPTRMNGDHKQSVVEGKENIVVREPQGVVGIISPWNFPLNLSIRAVAPAVAAGNSVVLKPASNTPVTGGLLIAKVFEAAGLPEGVFNVVTGKGSEIGDRIAGHPHADVISFTGSTAIGRQVAATAGENLALPAMELGGNNVHIVTEDADLDDAVDSGVFGSFLHSGQICISINRHVVHEDVYDEYVERLTERAAALPTGTAHDADTVVGPIIDESQRDQILDYIERTVDAGATLETGGDHDGLVVEPTVLSDATNDMAAACNEHFGPVAPVIPFSDDDEAVEIANSTEYGLSGSVHAGDTGRARDIADRIDTGMIHINDQPVNQEPHLPFGGYKNSGLGRYNGEYVLNEFTQEKWVSIQRETRDYPF

SEQ ID NO: 18712 - protein, 305 aa, Halobacterium sp. NRC-1
MELGVVGLGRMGRIVVDRCLDAGHDVVAFDIDATAREDAADAGATPADTLDALAAELGAEKRIWLMVPAGDPVDAALDELAPHLDSDDVVVDGGNSHFEDSTRRAEEHDFAYLDCGTSGGPAGAELGFSLMVGGPEWAYDDLVPVFDAVATGPDGHDRMGPAGAGHYVKMVHNGVEYALMQTYGEGFELLHEGRYDLDLEAVARTWNNGAVIRSWLLELCEEAFREEGSDLGTVADHVAGGSTGTWTVQEALEQEVPVPLVSQALSERFGSRSTGGDTGRFARRLANRLRYGFGRHEVARTGDDA

SEQ ID NO: 18713 - protein, 661 aa, Halobacterium sp. NRC-1
MGQTLTEKILDDHLVEGDLQPGEEIGIEIDQTLSQDTTGTMVWLQFEALEMDEVQTELAAQYCDHQTYQFDFKNTDDHRFLRSAAGTYGAYFSRPGNGICHNVHKENFAAPGKTLLGSDSHTPTPGGLGQLAIGAGGIDIAVAMGGGAYYVEMPEVVNVRLEGELPEWATAKDVILELLRRLSVKGGVGKVLEYTGPGVESLSVPERTTITNMGTELGATSSIFPTDDRTEDWLARFDREDEFVDLQADADAEYADEIVVDLSDLEPLIAEPSMPDNVVPVREVAGQEVEQVMVGSCTNGAYEDVLPAAKMLEGREVSKHTEMIVAPGSKQASEMLAREGWTAEMMAAGVNFSEATCGACIGIGHVPASDSVSLRTFNRNFEGRSGIEDDSVYLCSPEVATASAIAGEIVDPRDLSDDLGDLEAPGFEMGTSYSGGYGAGDTDIITPEESIDDDLIKGPNISSVPVKDPLGADVRGETLLKMQDNITTDHIIPATSDILKFRSNIERLSEFTLSRIDDTFAERAKAADSGVLVAGENYGQGSSREHAAMCPMFLGVESVLAQSFARIHKANLFNFGILPLNIDEETYARIEQGDDVEVVDDVAAAVADGQEEFTVRVNDDWEATATLDASERERRTLAAGGKLSLTKQRHSEGSGAAPADD

SEQ ID NO: 18714 - protein, 95 aa, Halobacterium sp. NRC-1
MSDPLRELFDVIEDRKETMPENSYTASLLADDEKGENAALEKVGEEATEFLLAAKDGDTDELAHEGADVVYHMLVVLAQQDMDVEALLAELDDRR

SEQ ID NO: 18715 - protein, 246 aa, Halobacterium sp. NRC-1
MHAPDLAGRTVLVTGSARGLGRGLALSLADCGAAVAIHYHTSADAADEAAAEARALGAPAVTTVRGDVTSPDAVDHIFDTVEADLGPVDVLVNNVGAFAPTHWTEIDADTWHTVLDTNLTAPFLTAKRALPGMRARSWGRIVNVGYASAEKGLVNPTNFPYFAAKQGLLMFTRMLAADTQDDGITANAVSPYVVQNSDEFPADAPRGRWATVEDIAGVVRFFCDADSGYVSGENVNVDGGWLPEHV

SEQ ID NO: 18716 - protein, 421 aa, Halobacterium sp. NRC-1
MSDNRHQNLAVIGHVDHGKSTMVGRLLYETGSVPEHVIEQHKEEAEEKGKGGFEFAYVMDNLAEERERGVTIDIAHQEFTTDEYEFTIVDCPGHRDFVKNMITGASQADNAVLVVAADDGVAPQTREHVFLSRTLGIDELIVAVNKMDVVDYDESKYNEVVSGVKDLFGQVGFNPDDAKFIATSAFEGDNVSDHSDNTPWYDGPTLLEALNGLPVPQPPTDADLRLPIQDVYTISGIGTVPVGRIETGVMNTGDNVSFQPSDVGGEVKTIEMHHEEVPNAEPGDNVGFNVRGIGKDDIRRGDVCGPADDPPSVADTFQAQVVVMQHPSVITAGYTPVFHAHTAQVACTIESIDKKMDPASGETQEENPDFIQSGDAAVVTVRPQKPLSLEPSSEIPELGSFAVRDMGQTIAAGKVLDVDEA

SEQ ID NO: 18717 - protein, 317 aa, Halobacterium sp. NRC-1
MRLAVMGAGAVGQAVVDQAASHGHTVVAVADSTSAVVDGSGVDAAAVCARKRDAASEIGTGAPSDALAADYDVLVEATPTTLGDAEPGFGHVERALSADRHVVLANKGPVAERYAGVCELAAASAGSLRFEATVGGAIPVLATIERIGADRVRAVRGVLNGTANFVLSRMAAAGLEYEHVLAEAQEVGVAEADPTFDVDGTDAALKCAILANVIGDREYDLDGVSVDGITGVAPSALELAETDGQTIRLIGEVGPDHVRVGPRLVPANGTLAVSGTTNIVQLETEHAGRLNLSGQGAGGAATASAVLADVDHIADQQ

SEQ ID NO: 18718 - protein, 608 aa, Halobacterium sp. NRC-1
MSTEREAKVYVNGSLVGTHENPEELAEQIREARRRGEVSEMVNVSVRDRTGEVIVNADAGRARRPLLVVENGEPVVTQEEVEAVKNGDIDFEDLVEAGKVEFIDAEEEEDILVGVEEEELTTDHTHLEIDPQLIFGIGAGMIPYPEHNASPRITMGAGMMKQSLGLPAANYRIRPDTRQHLLHYPQKAMVNTQTTEQIGYDDRPAGQNFVVAVMSYEGFNIEDALVMNKGSVERALSRSHFFRTYEGEERRYPGGQEDRFEIPGDDVRGARGEDAYTHLDDDGLVNPETKVDDSSVLLGKTSPPRFLEEPEDMGGLSPQKRRETSVTMRSGEDGVVDTVTLMEGEDGSKLAKVSVRDERIPELGDKFASRHGQKGVVGHLAPQEDMPFTQEGVVPDLVLNPHALPSRMTVGHVLEMLGGKAGSLDGRSVDGTPFTGEGEDEIRGTLEDRGFKSSGKEVMYSGVSGEKIEAEIFVGTIFYHKLYHMVSNKLHARSKGPVQVLTRQPTEGRAREGGLRVGEMERDTVIGHGAAMVLKERLLDSSDREEIHVCGNCGMTAVENYEQRRVYCPNCEEETDVHSIEMSYAFKLLLDEMKALGIAPRLELEEAV

SEQ ID NO: 18719 - protein, 393 aa, Anabaena PCC7120
MKKDFMFTSESVTEGHPDKLCDQISDAIVDRFLQQDPYARVITECAASTGIVFIAARFEPNTNVDFTNIARQVIDQVGYEQMEFNGKNCSILTSLKELPPDPYHLFNEHKLSDAEIEQITVTNQATVFGFACHQTSTLMPLPIWLAHKLARQISEVRRQNLLSYLTPDGKTQVGVEYKNRLPYRIHSITVIASQNKPGKPDLKQLQDDIRETVIYPVFADEEIKPDEKTRIFINPDGPFIVGGPAVHSGLTGRKNAIDTYGEYSKHSGSALSGKDPIRIDRVGAYVARYAAKNVVAANLADECEVQLSYSIGLARPVSVQVETFGTGKISDEDITVLLEKHFDFRLAGILKQFNLRHLPSLTKGGFYRKLAAYGHVGRQDIDLPWEKIDKVGL

SEQ ID NO: 18720 - protein, 867 aa, Anabaena PCC7120
SYASQHGCGYLQHLCIRVSSESAAANLSIYGANILSETEIRSSFSILVDQFKSLPVALLGVAAGVSVFTGGLIDAVVILGVVGVNAVIGYATETQSERIIHSLKHQEQTSAWVMRDGKAQEIPVENVVVGDVLILKPGSYVAADARLIEADNLSIDESALTGESLPASKNTAFLTGEDVPLGDRLNMIYRGTYITGGQGLAAVVATGQFTEMGHIQTLVGTANATETPLARQLDQVGSQLVVIGMGLCGLVFGMGVLRGYGLVQMLKSSISLAVAAVPEGLPTIATTTLALGIRDMRRNKVLVRSLSAVEALGSVQTICLDKTGTITENKMSVVEIHTNTREIKVTDGEFIAGGENINPYMYDELLKLIHVSVLCNESEVSRDDGEYVVTGSATENALIYMGIAAGVDAIALKDKYPLLQTNLRSENRNIMSTIHETHNGHKFVAVKGSPGEVVQMCQGWMKDGQVVPLTDADRQMLEIENDRMAGKALRVLGVAYNHIDESHNGNHETDLIWLGLVGMADPIRRGAKALIADFHHAGIDTVMITGDQSPTAYAIAKELELNRHTQLEILDSTNLNNLTPEALTALSDKVDVFARISPSNKLQVVQALQGAGKVVAMTGDGINDAPALKAAQVGVAMGKGGTDVAREVADIVLEDDRLETMIIAVSRGRTIYNNIRKSVHFLLATNLSEIMVMTTATAVGIGEPLNAIQLLWLNLVTDIFPGLSLAMEAPEPEVLSQPPRNPTEPIIKKSDFGRITFESATISASTLAAYSYGILKYGISPQASTIAFMGLTTAQLLHTISSRSEKHSIFSSEKLPHNPYLTAAVTGSFALQLLAVAVPPLRTLLKITPINLVDGAVIGGSALLPLI

SEQ ID NO: 18721 - protein, 206 aa, Anabaena PCC7120
NVIPVEEIRYDERGLVPAIVQDYLDGTVLMMAWMNRESLQKTLDTGETWFWSRSRQEFWHKGGTSGHTQKVQSIRYDCDSDALLVGVEQIGDIACHTGERSCFHQVEGKIVAPPGDTLSQVFQVICDRRNHPTESSYTSKLFAGGDNKILKKIGEESAEVVMACKDDDQEAIAGEVADLLYHTLVALAHHQVDIKAVYRKLQERRR

SEQ ID NO: 18722 - protein, 420 aa, Anabaena PCC7120
KSQEIFAAAQNLMPGGVSSPVRAFKSVGGQPIVFDHVKGAYIWDVDGNQYIDYVGTWGPAICGHAHPDVIGALHDALEKGTSFGAPSFLENVLAEMVIAAVPSIEMVRFVNSGTEACMAVLRLMRAFTNREKVIKFEGCYHGHADMFLVKAGSGVATLGLPDSPGVPKSATSSTLTAPYNDLEAVKALFEENRDQIAGVILEPVVGNAGFITPDAGFLEGLRELTHEHGALLVFDEVMTGFRIAYGGAQEKFGVTPDLTTLGKVIGGGLPVGAYGGRRDIMSMIAPAGPVYQAGTLSGNPLAMTAGIKTLELLQKPGAYEYLERITKKLADGLLQVALETGHAACGGHISAMFGLFFTSGPVHNYEDAKNSDTAKFGRFHRGMLERGVYLAPSQFEAGFTSLAHTDEDIDQTIAIAREVL

SEQ ID NO: 18723 - protein, 288 aa, Anabaena PCC7120
KVRKAVIPAAGFGTRLFPATKVVKKELFPIIDQDGRAKPVILAIVEEAISAGITEVGIVVQPDDIGIFADLFKNPPAPELLQKLSPQNQEYSQYLQDLGQKVVLLTQSEQEGYGHAVFCAKDWVGNEPFLLMLGDHVYKSDIKKSCAQQVVEIYAQVHQSVVGLTTMPAAIINKAGCIAGVWQEFNSILELTQLAEKPNLDYAREHLRVEGMAEDEFLCVFGLYVLTPKIFDFLADSINQNLRDRGEFQLTNCLDKLCQAEGMTGYVVKGKCFDTGLPNTYRQSLIDF

SEQ ID NO: 18724 - protein, 555 aa, Anabaena PCC7120
LLQILFTGIFITLLGMITPYATSIIIDNAIPDSDRSLLLQIGLGLLVAALGAGLFQLAQGFALLRMETSGDASTQAGVWDRLLNLPVSFFREYTTGDLLSRISSVSAIRRQLSGRTLINFITSIFALFYLGQLFYYNYKLALIAVASAVVAIAITTISGILLLSKVRPLLEVQGNIFGQTVQLINGISKLHIAGAEERAFAAWSKNYTRQIKLELSTQLVEDFVVIFNTIIPIITSGVLFWFTTKLLEEAQTSGSIAFSLGTFLAFNTAFSNFTRGTTNLSNTVTQILQILPQWQRTQPILTTIPEVNLSKSDPGRLAGKITVDNVTFCYRRDGNLTLDNVSISAEPGEFIALVGSSGSGKSTLLRLLLGFETPQAGSIHYDGQDLSGLDVDAVRRQLGVVLQNGQLNSASIFENIAGDAQITLDEAWEAARMSGFAEDVTAMPMQMHTVVSEGGGNLSGGQRQRLLIARALALKPRILLFDEATSALDNRTQAIVSESLDKLQVTRIAIAHRLSTIRNAHRIYVLQAGRVVQQGTFQELANTEGIFAQLMARQM

SEQ ID NO: 18725 - protein, 686 aa, Anabaena PCC7120
LRVKTPTLLQMEAVECGAAALGIILGYYGRVVPLPQLRRDCGVSRDGSKASNMVKAARTYGLEAKGFKKELKQVQQLRPPYIVFWNFNHFVVVEGFGKHQVYINDPATGPRHVSLQEFDEGYTGIVLVMEPGAEFQKGGRKPSMIASLWSRLQGAESALVYCIVAGFFLTIIGLVIPVFSQIFVDDILVQGRMLWLHPLLLAMAIAAILQGSLTLLRLRYLRRLKIRLAVGMSSRFLWHILRLPVSFYAQRFAGEISNRTTLNDQVADVLAGQLATTIIDTLMVLFYALVMVQYDWVLTLMVVSFAAVNVLTLQWISRQRIDANQRLIQEYGKAAGISIATLQSIETLKASGLESDFFSRWSGYYTKALNSQQELGITNQTFSVLPTLLSALSAMLLLIVGGFRVMDGHLSIGMLIAFQGLMSGFQQPVNNLVNFGTTLQELEGNLIRLDDVLDNPVGEVGGKTSSSSLQALPKLQGYVELKNITFGYSRLEAPLIENFNLSIKPGQRVALVGGSGSGKSTIAKLVSGLYQPWTGEIYFDSQPREEISLQLLTNSVAMVEQEILLFGGTVRDNLTLWDTTVPDKNLMRACQDAAIADVIFSMSGGYDAELIEGAANLSGGQRQRLEIARALVNNPSILVMDEATSALDAETEKIIDQNLRRRGCTCIIVAHRLSTIRDCDQIIVLE

SEQ ID NO: 18726 - protein, 205 aa, Anabaena PCC7120
LSLQFTTVPPAKSQTPAGLVVTLHGWGANAEDVASLLPYFNLPDYQFVFPNAPYPYPYAPLGRSWYDLRQENMYEGLAESRELLKDFVLSLESSTGVPLSRTILSGFSQGGAMTFDVGSKLPLAGLVVMSGYLHPEAISPDNTNIPPTLILHGTRDEVVPLQAAVKARTTVESLGVPVQYQEFEAGHEINLEMLNVARNFIVNAL

SEQ ID NO: 18727 - protein, 668 aa, Anabaena PCC7120
  unsure (1)..(668): unsure at all Xaa locations
LYILMAASTSSKPMGWWCEMLRVILRKXLESTLILAIAKNLEEIIRQQVEREKLLREITQRIRQSLDLQTIFDIACQEICQVIQADRVGIFKFYPESNFNDGEFVAESVVKEFPSVIAIRVHDHCFGENYSSLYALGRSYVVDDIYHSDMTTCHTDILAQFHVRANVIMPLLCGAELWGLLCIHQCATTRHWQQSEIDFTQQLATQLAIAIQQASLVEQLQQELAERHQAELKLTQSNQQLAISNQELARATRLKDEFLANMSHELRTPLNAILGMTEGLQEGVFGMINNKQFKALETIERSSSHLLDLINDILDVAKIEAGQIKLDCTTISVANLCESSLVFIKQQALQKRIQVEIKIPFNLPDLFVDERRIRQVLINLLNNAVKFTPEAGRISLEVTQLSPDISTVQNFLQIAVIDTGIGIMQENINKLFQPFIQIDSALNRQYEGTGLGLALVKKIVELHGGRVGLTSELGIGSCFTIELPCIPSTPASPDLIRDLLTTPTPELDSPTADEAVSLAPVILLAEDNKANIKTFSSYLSAKGYDILLATNGQQAIELATIHQPDLILMDIQMPGIDGLEAIRQIRLDPQLVNIPIVALTALAMTGDRDRCLQAGANDYLTKPVKLKQLATTIQQLLITTKKXICPLFSXLTISQITLMLLKPSXVSK

SEQ ID NO: 18728 - protein, 633 aa, Anabaena PCC7120
MAKVVGIDLGTTNSCVAVMEGGKPTVIANAEGFRTTPSVVAFAKNGDTLVGQIAKRQAVMNPENTFYSVKRFIGRRYDEVTNEATEVSYKVLSSGGNVKVDSPGAGKQFAPEEISAKVLRKLVEDASKYLGETVTQAVITVPAYFNDSQRQATKDAGKIAGIEVMRIINEPTAASLAYGFDKKSNETILVFDLGGGTFDVSVLEVGDGVFEVLATSGDTHLGGDDFDKKIADFLAEQFIKDEGIDLRKDKQALGRLTEAAEKAKIELSSVTQAEINLPFITATQDGPKHLDMTLTRAKFEELCADLIDRCRIPVEQALRDAKLKKENIDEVVLVGGSTRIPAVQQLVKNLLGREPNQTVNPDEVVAVGAAIQAGVLGGEVTGILLLDVTPLSLGVETLGGVMTKIIPRNTTIPTKKSEVFSTAVDGQTNVEIHVLQGEREFANDNKSLGTFRLDGIPPAPRGVPQIEVVFDIDANGILNVTAKDKGTGKEQSISITGASTLDKTDIDRMVREAEQNASSDKERREKIERKNQADSLAYQAEKQLQELGDKVPEADKTKVEGLVKDLREAVAKEDDEQIKKLTPELQQALFAVGSNIYQQAGGGAAPGAAPQDGGTTSSDGGDDVIDADFTETK

SEQ ID NO: 18729 - protein, 319 aa, Anabaena PCC7120
MAQDRKSTVIVTGASSGVGLYAAKALAKRGWHVVMACRNLEKAEQAAQEVGIPKDSYSIIHIDLGSLDSVRQFVNDFRATGKSLDALLCNAAIYMPLIKEPLRSPEGYELTMTTNHLGHFLLCKLMLEDLQKSSAVDKRLVILGTVTHNPDELGGKIPPRPDLGNLEGFAQGFKPPISMIDGKKFEPVKAYKDSKVCNVLTMRELHRRYHESTGITFTSLYPGCVAETPLFRNHYPLFQKIFPLFQKYITGGYVSQELAGERVADVIAAPEYKQSGAYWSWGNRQKKDGKSFVQKVSPQARDDEKAERLWDLSEKLVGL

SEQ ID NO: 18730 - protein, 381 aa, Anabaena PCC7120
MKVLVIGGDGYCGWATALYLSNRGYEVGILDSLVRRHWDNELGIETLTPIAPIQQRLQRWQDLTGKSIDLFVGDITNYEFLQKALHKFEPNAIVHFGEQRSAPFSMIDREHAVVTQVNNVVGTLNLLYAMKEDFPDCHLVKLGTMGEYGTPNIDIEEGYITIEHNGRKDTLPYPKQPGSMYHLSKVHDSHNIHFACRIWGLRATDLNQGVVYGVLTEETGMDELLINRLDYDGVFGTALNRFCIQAATGHPLTVYGTGGQTRGFLDIRDTVRCVELAIANPAPSGEFRVFNQFTEQFSVGDLALMVKKAGNALGLNVEINNLDNPRIEKEEHYFNAKNTKLLDLGLQPHYLSDSLLDSLLNFAVKYQGRVDQKQILPKVSW

SEQ ID NO: 18731 - protein, 196 aa, Anabaena PCC7120
KFYYNPISVNARRVWVALLEKQIPFEPLLLNLNGDQFQEEFTAINPLQRVPVIVDNGLRVIESLAILDYLETKYPTPSLIPSEPGAIATVRMVEMITISELQPATVILTRPLVELDTDAKKLVSAQEAVAKILQFYETLLGEQIYFAGKDFTLAEVVAGTLIPSLPLFGFSLDDYPRLLAWAERLEERESWQQTTP

SEQ ID NO: 18732 - protein, 774 aa, Anabaena PCC7120
LWLVTQGAISPHTITGLNQSSVWGMGKVIRLEHPELNCRCVDLDPTQELFTQVENLVTEITHPGEEAQITLHKSERKVARLTRCTLQILPHEPYRLTIAKRGVIASLKWQSSPRRQPQPGEVEIQVKATGLNFIDVLDALGLLPFERNWFGVECAGEVVAIGEGVTHLNVGDAVVALAADSFSQYVTTNANYVIKKPDSLSFTAAATIPANFLTAAYALREVAKIQPGKRILIHAATGGTGMAALQIAQQAGLEVFATASVGKWETLRALGVQHIFNSRTLNFAEEIHEITQGEGVDIVFNSLSGEFIPASLSVLKPQGQFIEIGKRGVWNAQKVAQVKPDVVYHLVDLMSVAQQQPQTIQTLLHCLMAEFESGELRWSPTDRRSSHPQTIFPATKIVEALQMMQQARHIGKIVITHTPTESLQPDATYLITGGMGGLGLRVARWLVEKGAKHLVLLGRNQPDTTAQQQIQALEATGAKIIITQADVSQKDQLAAVLTDIQQNHPPLRGVIHAAGVLDDGILQQLTPERSHRVMNPKVTGAWNLHQLTQDIPLDYFIMFSSAASLLGSPGQANHVAANTFLDALAQYRRHQGLPALSINWGVWSDIGAAAKRQVSNQMSSRGIGEITPDQGIDILEFILTQSSTQVGVIPINWSELLKQKLSSTFFADFYESTPSTSQEYQPSQLIQHIQCLGIKERISYLRKYLQTEVSQVLGSSSSQLPNVQLGFFDMGMDSLMMVELRSRLETSLKQTIPSTVLFEHPSIQALAEYIATQL

SEQ ID NO: 18733 - protein, 184 aa, Anabaena PCC7120
MLKLYGGAFSRASIVKWYLEELEVPYEFVLLDMQAGEHLQPEYLKINPIGKVPAIVDGDFQLWESGAILLYLNDKYGKTSLSAEERGILSQWVVFANATLGTGIFVEANREKEMPRLLTPLNEIFEHQPFLLGNEFSVADVAVGSILAYIPIMLKLDLGDYPAVVNYIKQMTERPAFQKSIAGR

SEQ ID NO: 18734 - protein, 330 aa, Anabaena PCC7120
VLSSATFKLQPTATGLTENHRLRLFSGSSNVQLSQEVARYLGMDLGPMIRKRFADGELYVQIQESIRGCDVYLIQPCCQPVNDHLMELLIMVDACRRASARQVTAVIPYYGYARADRKTAGRESITAKLVANLITQAGANRVLAMDLHAAQIQGYFDIPFDHVYGSPVLLDYLTSKQLHDIVVVSPDVGGVARARAFAKKLNDAPLAIIDKRRQAHNVAEVLNVIGDVKGKTAVLVDDMIDTGGTIAAGAKLLREEGARQVYACATHAVFSPPAVERLSSGLFEEVIVTNTIPIPESDRFPQLVVLSVANLLGETIWRIHEDTSISSMFR

SEQ ID NO: 18735 - protein, 273 aa, Anabaena PCC7120
VGLVTLDLIYLAESAPQNNQKLVATDYTVAAGGPATNAAVTFSYLGNQATVLGVVGSHPMTQLIRSDLTKYQVAIADIDPTINTPPPVSSIIVTQATGERAVISINAVKTQASEDSIPPDILHNIDIVLIDGHQMTVGYVITQKARANNIPVVIDGGSWKPGFERILPLVDYAICSANFYPPNCSSSEEAFAYLHNLGIPHIAITHGEQPIEYLSCGEHGTVVVPKITAVDTLGAGDIFHGAFCHYILQASFTKALEGAAKIAADACKLFGTR

SEQ ID NO: 18736 - protein, 447 aa, Anabaena PCC7120
QRPNPLKTHPFLQKLQWIADPVEYMKKASLQHPDMFTAEVIGFGDTVVFVSHPQGIQTLFANDRKKLVAVGEANRILYPLVGNNSMFLLEGVKHKQRRQLLMPSFHGERMREYGHLIRNITENLFSQLQQDVTFSALTAMREISMQVILQAVFGFYEGERCQQFKHLLPIFLSELFQSPLASSILFFPSLQKDLGNLTPWGRFVRQREKIDKLLYAEIAERRQEINSDRIDILSLLISARDETGDSMSDKELRDELITLMISGHETTGTAMAWSLYWILQTPEVFQRLIQELDSLGDSPDPMSIFRLPYLTAVCNETLRINPVAMLTLPRVVKEPIELLGNRLETSTTVVGCIYLTHHREDLYPESKLFKPERFLKREFSQYEFMPFGGGVRGCIGQALAMFEMKIVLATVLSRYQLALADRKPERPQRQGFTLTPTNGVKMLITGQ

SEQ ID NO: 18737 - protein, 548 aa, Anabaena PCC7120
VQSDRTILLEVHSPTAAKAREAIAPFAELIKSPEHIHTYQITPLSIWNARAAGMQVEAMVAALRDYAKYPIPEAVAQEISTLGERYGLTVIERDEDSLRLRVSDVALAELLVRDKQVAPLLGKRLSEVSFQVEAGLRGTLKQALLAVGYPAEDIAGYVSGDALSIKLREETRTGKKFLLRDYQRQAAEAFYQSGRVQGGSGVIVLPCGAGKTIVGMSAIAAVQENTLILSTSLTSVRQWRRELLDKTDLPEEAIAEYSGEVKNTGPITLSTYQILTYRPNREDDFPHFDLFSARSWGLIIYDEVHLLPAPVFRITAELQARRRLGLTATLIREDGREGDVFALIGPKRYDVPWRELETEGFIATASCTEIRVSQDAERQMTYALAPRRNQFRVAAENPHKVQVVKELLEKESGHRILIIGEFLAQLETLAKVTGLPLITGKTPEKEREQLYQAFREGKLGGLVLSRVGNFAIDLPDADILIQVSGKYGSRQEEAQRLGRVLRPKSDGRPAQFYTLVSLRTCEEDFARHRQLFLTEQGYSYNIQIVDQF

SEQ ID NO: 18738 - protein, 202 aa, Anabaena PCC7120
GRFIVFEGVEGCGKTSQMQLCAEWLQSLGISVVLTREPGGTELGLDLRRLLLQKAEDKPIAEVTELLLYAADRAQHVAQELKPKLAQGKYILCDRYVDSTIAYQGYGRNLDMNLIHQLNDIATGGLTSDITIWLDVDVEVGLARKRGDNVGLDRIEQETIAFHRRVQQGYADLAASSPKRIIRVDGQLSKETVHKTIQEILS

SEQ ID NO: 18739 - protein, 627 aa, Anabaena PCC7120
RVWKIEDSEALYRIEGWGQPYFSINAAGHVTVSPKGDRGGSLDLFELVNALKQRSLGLPLLIRFSDILEDRIERLNACFAKAIARYNYPGVYRGVFPVKCNQQRHLIEDLVRFGRPHQFGLEAGSKPELMIALALLDTPGSLLICNGYKDREYVETAMLSQRLGQTPIIVLEQVEEVDLVIAASHQLGIKPILGVRAKLSTQGMGRWGTSTGDRAKFGLTIPEIIQAVDKLRDADLLDSLQLMHFHIGSQISAINVIKDAIQEASRIYVELASLGANMKYLDVGGGLGVDYDGSQTNFYASKNYNMQNYANDIVAELKDTCAEKQIPVPTLISESGRAIASHQSVLIFDVLSTSDVPRDNPEPPKEGESPVINYLWETYQSINKENYQEFYHDATQFKEEAISRFNLGILRLRERAKAERLYWACCQKILDIIRQHDYVPDELEDLEKIMASIYYINLSVFQSAPDCWAIDQLFPIMPIHRLDEEPTQRGILADLTCDSDGKIDRFIDLRDVKSVLELHPFQPGEPYYMGMFLNGAYQEIMGNLHNLFGDTNAVHIQLTPKGYQIEHVVKGDTMSEVVSYVQYDSEDMVENIRQRCERALEEKRITLAESQRLLQTYEQSLRRYTYL

SEQ ID NO: 18740 - protein, 149 aa, Anabaena PCC7120
LERTFLAIKPDGVQRGLVGEIIRRFETKGFTLVGLKFLQVSKELAEQHYGVHRERPFFPSLVEFITSGPVVAMVWEGDGVIASARKIIGATNPLTAEPGTIRGDFGINIGRNLIHGSDAPETAQKEVSLWFTDAELVNWQPHLTPWLHE

SEQ ID NO: 18741 - protein, 317 aa, Anabaena PCC7120
MTKTALVTGITGQDGYYLSHLLLNQGYRVVGLVSPHRQPNLAKLGDLANKVEIYNVDLRDPVALLNAVEQLRPQEIYNLAAPSFVPDSWKDPLGTLDLITGTATRLLDAVRQVGLSTRFYQASSSEMFGDVLSSPQDEETSFRPKNPYAAAKLHAHWTMVHHRQRYGLFACSGILYNHESPLRPPQFVTRKVSLAAASIKLGLAQTLEMGNLDAKRDWGFAGDYVKAMWLMLQAEEPEEYVIGTGKLHSVKELVSIAFESVGLNWQNHVVINTDLLRQDEHFQLVANPIKAKKNLGWETEVSFERLLEKMVQTDVER

SEQ ID NO: 18742 - protein, 508 aa, Anabaena PCC7120
MKLAYWMYAGPAHIGTLRVATSFKNVHAIMHAPLGDDYFNVMRSMLSRERDFTPVTTSVVDRHVLARGSQEKVVDNITRKDAEERPDLIVLTPTCTSSILQEDLENFVERAQLEAKGDVLLADVNHYRVNELQAGDRTLHQIVQYYIEKARKKGELPEGKTAKPSVNIIGISTLGFHNNHDCTELKRLMADLGIEVNAVIPEGASVHELKNLPRAWFNLVPYRELGLMTANYLEKEFGTPCIDIVPMGVVETARCIRKIQEVINAQGADVNYEDYINEQTLYVSQAAWFSRSIDCQNLTGKKAVVFGDNTHAAALTKILSREMGIHVVWAGTYCKYDADWFREQVSEYCDEVLITEDHGEIGDAIARVEPSAIFGTQMERHVGKRLDIPCGVIAAPIHVQNFPIGYKPFLGYEGTNQITDLIYNSFTLGMEDHLLEIFGGHDTKEVITKGISAGSDLSWTKDGLAELNKIPGFVRGKVKRNTEKFARDRGFKDISAEVLYAAKEAVGA

SEQ ID NO: 18743 - protein, 428 aa, Anabaena PCC7120
IHEIFMPALSSTMTEGKIVSWVKSPGDKVEKGETVVVVESDKADMDVETFYEGFLAHIIVEAGDSAPVGAAIAYVAETEAEIEAAKSLGSSGAAAATPPAAPQPVATTAAVGVPATSQNGSNHREGRLIASPRARKLAKELKVDLTSLKGSGPYGRIVADDIESAVGKVKQPATTPSAPTPTFTPAAPPAPRTPAPAPAPIAAAPGQVVPFNTLQNAVIRNMVASLDVPVFRVGYTITTDGLDKLYKQIKSKGVTMTALLAKAVAVTLQKHPLLNASYSDQGLVYHPDINVAVAVAMDGGGLITPVLKNADKIDIYSLSRTWKSLVDKARSKQLQPDEYTGGNFTLSNLGMFGVDTFDAILPPGQGSILAIGASRPQLVATGDGLFGVKQQMQVNITSDHRIIYGADAAAFLQDLAKLIETDAQSLTL

SEQ ID NO: 18744 - protein, 632 aa, Anabaena PCC7120
VDYTNVESLPEIWPIAGKKFGETLALYNPHAKPEVKITYQQLADKIQLFASGLQALGVQAGDRISLIADNSPRWFIADQGIMTAGAVDAVRSSQAEKEELLYIVAHSGSTALVVEDLKTFNKLQDRLHDLPIQVVVILTDETPPTEQSLKVLNFLQLIEVGKNHTFVPVKRKRNELATLIYTSGTTGKPKGVMLSYSNLLHQVTTFRVVVQPKVGDTALSILPSWHSYERTVEYYLLSQGCTQIYTNLRSVKADLKQYKPNYMVAVPRLWESIYEGVQKQFREQPANKQRLIKFLLGMSEKYIKAQRIAQGTSLDHLHASSLERLIAKVLEFAFLPFHVLGQKLVYGKVKEATGGRFKQVISGGGALPKHIDTFFEIIGVQILQGYGLTETSPVTNVRRPWRNFIGTSGQPIPGTEVKIVDPETRQPLPVGKRGLVLLKGPQVMQGYYQNPEATAKAIDPQGWFDSGDLGWVTPDNELVLTGRAKDTIVLSNGENIEPQPIEDACLRSPYIDQIMLVGQDQRSIGALIVPNVEALAKWAESQNLVLSVEDDNLTSSSSQKINLESKMIQGLFRQELNREVQNRPGYRPDDRVGPFKLILEPFSIENGLMTQTLKLRRHVVTERYRDIINAMF

SEQ ID NO: 18745 - protein, 149 aa, Anabaena PCC7120
MGVSGSGKTTIGQMLAESLHWEFHDADSFHSPDNIEKMRRGIPLDDNDRIPWLQSLQTAIINWLQDNRNVVLACSALKASYRQFLVLDSDIKLVYLQGTFELIQTRLQKRENHFMNRELLTSQFASLEEPDNVILVDISQSPQVIVQAI

SEQ ID NO: 18746 - protein, 393 aa, Anabaena PCC7120
TVRDILAHVKARGDAAVQEYTSRFDHYRPHSHHLSAAFIAEQAAKCSDEVKAALELAAERISSFHQKQLPQDIGYTDTAGVKLGLNWVALSQVGIYVPGGRASYPSSVLMNALPAKIAGVERIVMTVPMPHGEINPAVLAAAQVAGVTEIYSIGGAQAVGALAYGTETITPVDKIVGPGNAYVAEAKRQVFGTVGIDSIAGPSEILVVADRQNNPEWIAWDLLSQAEHDPSAQSILITDSESFAQQVIAAVEQILTTLPSQKVASSSWQNHGAVIIVRDLAESIPLLNQLAPEHVELCVDNPQLLASQIKCAGSLFLGRYTPEAIGDYLGGPNHVLPTSRSARFASGLSVYDFLKRITYLECNQAALQKIGQSAVTLAETEGLPAHAGSVAVR

SEQ ID NO: 18747 - protein, 555 aa, Anabaena PCC7120
STIQALPQEVVYLITAGEVIDSFAAVVRELVENSLDAGANRIVVYLWPQQWRVRVADNGCGMNLDDLQQAASAHSTSKIRSSADLWKIHSLGFRGEALHSLTTLADVEIISRAPENVGWRVVYGDSGKAVHVEATAIAPGTVVTVSNLFASCAARRQGLPTTAQQMKAVQATIQQIALCHPQTTWQVWQNDRIWFTISPAATAGQLIPQFLPQLRPSDLQEIKLEIPNPENPQLSTNNKPNASALALVVGLPDRCHRHRPDWVRVAINGRMIKLPELEQTILAAFHRTLPRDRYPLCFVHLLISPDQINWNRNPAKTEIYLHDLSYWQEQVTQAINQALRISAANIPESVQTTRVSQLLKAAEEKGNYNFNPRNANPADNTQNYLKAVAQVSNTYIVAEHPGGMWLVEQHIAHERVLYEQLCDNWRLIPVEPPIILYQLSPAQVAQLQRIGLDIDIFGEQLWAVRNLPAMLQQREDCAEAILELSWGGDLQTAQVAVACRSAIRNGTPMSLPEMQKLLDDWQRTRNPRTCPHGRPIYLSLDESSLSRFFRRHWVI

SEQ ID NO: 18748 - protein, 249 aa, Anabaena PCC7120
SGDYRNVIAYCQKCLSLTDNPDLSVRMQILSHLGNAYRHLNDYNKAIEFLQACLQLTQTLQDKRSQVAALNNLGLVYKASGNFNQAIGYQEQSLIIVEELKDSWGIEQVLKNLGNTWYALDNYPKAIAYYEKCVKIALSLNNPRSAAQVLKNLGNACYAIGDYAKAIKYYEKRWQLARDLKDKRSEEQSLGSLGVTCEALGDHSRAITYYEARLLLARSIKDKRIEEQALASLKIACYALGDYAKAMQY

SEQ ID NO: 18749 - protein, 552 aa, Anabaena PCC7120
IHQAKLRPEEHIYGLGERAAPLNLRTCGNEEETRTYRMWNYDAGGIYGTGTDPLYLCIPVYLGLHEEGSYLIFYENSFPANFSFSNLARAEFEGGMLRYYFSAGSLPQLLERYTELTGRPPLPPRWTFGYHQSRWGYEREAALREVVKGFETYNIPVSALHLDIDVLDNFRAFTIDPDRFPHLPELAAELAAKGIRLITIINPGVRASRKNKLFEEGRAQDVFCKLPNGKPAIASVWAGLSAFPDFTNPQARHWWSRQYEYLLDLGITGFWHDMNEPGVFVLWGDPSLPPHATWHSMEGRGGDHREAHNFYGLLQAEAGYQALCEYQPQRRPFIVSRSGWAGLQRYAWTWTGDIITSWEGLRQTIPTVLNLGLSGIAYSGSDIGGFKGHPSAELYLRWFQVSCFMPFCRTHSANNTKPRTPWSFGEPTLGIVRQFLQLRYRLMPYFYTLAWESTQTGHPLVRPLFWADQDNPHLWDIDDAFLLGDALLVAAIAEEGATSRTIILPKGNWYNFWNDELLEGEKQVKLKAPLEQIPILVKAGSILPMEENNQLI

SEQ ID NO: 18750 - protein, 483 aa, Anabaena PCC7120
LLEAKQAADAANQAKSEFLANMSHELRTPLNGILGFAQVLEVSPNLREKDLEGVNIIHQCGSHLLLLINDILDLSKIEARKLELVVANVHLPTFLHGVSEICSIRAAQKGIAFKVSMGDRLPTVMEVDEKRLRQVLINLLGNAVKFTDSGGVTFKVELLDTQDQDNQQSSVAKIRFQIEDTGVGMSPEQLEKIFLAFEQVGDCRRQSEGTGLGLAISQRIAELMGSQIQVQSRLGEGSIFWLDVTLPVPISHDWQTYAPMHQKVIGIQGSAPQILIVDDDDNHRSMLNSLLQEIGCQTLEASDGKQGLQMVNEHHPDLILLDLAMPNMDGFELMVQLQENPQTSSIPIIVSSASVFEENRQRSLQAGATAFLPKPLQIDELFNALRSLLQVEWIYAPSASLSLSPQPGPTTPTELVLPSQDVLQQLYHLSMMGDIPAIEGILRELIQHNSQLTPFATELSKLTTNFQTAKIRQFLKSFVITES

SEQ ID NO: 18751 - protein, 284 aa, Anabaena PCC7120
TAKILDGKTLAEKIQKELTAQIIDAQAKIGRPPGLAVLMVGDNPASAAYVRNKEKSCAKVGIASFGKHFPQETTQTELEDVIAALNQDEQVDGILVQLPLPEHLDAVKLLHQIEPDKDADGLHPVNLGRLVRGEKGLRSCTPAGVMRLLAEYEISLRGKQAVVVGRSILVGKPMALMLLEADATVTIAHSRSQDLKSITQNADILIAAAGLPGLITADMVKPGAVVVDVGINRVSDAHGKSRLVGDINFASIAGVAEYITPVPGGIGPMTVALLLQNTVTSYLQ

SEQ ID NO: 18752 - protein, 309 aa, Anabaena PCC7120
MVAADNLRKMSEEAKFNLVAYLKERQKLCEAALDAAIPIIYPEKIYESMRYSLLAGGKRLRPILCLATSEMMGGTIEIAMPTACAVEMIHTMSLIHDDLPAMDNDDYRRGMLTNHKVYGEDIAILAGDGLLAYAFEFVAIRTPESVPRDRVLQVVARLGRALGAAGLVGGQVVDLDSEGKSDTSLETLNFIHNHKTAALLEACVVCGGILAGASSENVQRLSRYSQNIGLAFQIIDDILDITSTQEQLGKTAGKDLLAKKVTYPSLWGIEQSRVKAQQLIEAACTELEPFGEDAQPLKAIAHFITSRNH

SEQ ID NO: 18753 - protein, 136 aa, Anabaena PCC7120
MRLHIILGPTSVGKTDRSVVLAKQTKAPVIVLDRIQIYQEIATGSGRPLIDELEGTTRIYLEERQLADGNLNTLESLSLALQHIDRLSSQHKLLILEGGSISLCTALWKSRILENYQTTIEYVKVENEELYQSRLW

SEQ ID NO: 18754 - protein, 316 aa, Anabaena PCC7120
AVLIQNLQKRYGTVEAVKDVSFQVEPGEIFGLLGPNGAGKTTTLRALCTLTTPDAGKIEVSGISVLDNPRVARQRLGYVAQEVALDKVLTGKELLQLQAALYHLPNAIAKQRIDTVLDLLGLQEYANKKTGTYSGGLRKRLDLAAGLLHSPDVLVLDEPTVGLDIESRFVVWEFLRKLRVSGTTVVITSHYLEEIDALADRVAIIDRGVVIAVGTPSELKDRVGGDRITLRIREFSPTAEAEQAKSLLQGLPFVKEVIINNAQGNSLNLVVTPQNDALITIQQALNNASLPIFGIAQSRPSLDDVYLAATGRTLLD

SEQ ID NO: 18755 - protein, 271 aa, Anabaena PCC7120
MLGQLLDGRYKVTQVLGAGGFGKTYIAEDIKLYNNLCVVKQLQPMANDPMTLQVARRLFASEAELLHKLGTHDQIPQLLAHFEEHQEFFLVQQFIDGHPLSDELTPGKRLSEPYTIALLKNILQPLAFVHQNNVIHRDIKPPNLIRRKSDGKVVLIDFGAVKQIGTQVVNGEGVTKMTVSIGTAGYMPSEQSRGSPRLSSDVYAVGMIGIQALTGLMPHQLQEDIQTAEIIWRELVQVSPSLADVLDRMVRYDFRQRYQSAVEALATVQNL

SEQ ID NO: 18756 - protein, 566 aa, Anabaena PCC7120
  unsure (1)..(566): unsure at all Xaa locations
ENFQPPAQFPSGPHFGNGGFSNSLPFNGWGPKRLGKLENSSPPFQEGRRQXSSHWSLVTGSPRILPLEEIIPAPPIGTTHQPXLCLPDEEEYLESARVKNLVKTYATFMPVPIKTDGEVLNRQKAPWRESPSNLTKEDYLEFYRYLYPFQEEPLLWVHLNTDYPFIINGILYFPKMRPDVDVTKGQIKLFCNQVFVSDNCEEIIPQFLVPMRGVIDSTDIPLNVSRSALQGDRTVRKIGDYIAKKVGDRLKELYRDDREQYISAWKDLSTFVKFGVLNDEKFKKQVEDIIIFRSTVKWEQPAETPAVEVQSQEGDVWQDITPSPDSPTPGLPYTTLKEYLERNKERHENRVFYSTDEATQATYIELHKNQGLEVLFLDSFIDTHFINFLEQEYQDVKFTRVDSDLDNTLLEQDKAGEIVDPTTNKTKSEIIKELFEKSLNKPKVNIRTEALKSDDPQGTPPAIVLLPEFLRRMREMTAMMQQQNADFPEDHILLVNTAHPLIQNLVNLNQGAIIQGDGESTTNPLVNLICQHVYDLALMSQKGFDAEGMKSFVERSNDVLTKLTQQ

SEQ ID NO: 18757 - protein, 226 aa, Anabaena PCC7120
RPYHQILIVECGEPLVEIPLELFSWESPHPYARLGAAYGEYSPYFLRQSVVNCLIKAQSYLESLRPRWRIQIFDAYRPVAVQQFMVDYSFAMAVEERGLIEAELTPQQRQEIWQAVYEIWAVPSLDEKTPPPHSTGAAVDVTLVDDGGQVVNMGSPIDELSERSHPDYYANSKEPAAPEYHAHRQLLCDVMLKASFQRNPKEWWHFCYGDQMWAWLSNQPTAIYGR

SEQ ID NO: 18758 - protein, 427 aa, Anabaena PCC7120
VKLGILGLGTVGTGTVQLLQDTVGRHPLLQEIEIYRVGVRSLDKSRDVQLQPEVITTDLESIVNDPAVDIVVEVMGGLEPARSLILQAIHNGKHVVTANKAAIARFGAEIFTAANQAGVYVMLEAAVGGGIPVIQPLKQALSVNRLHTVTGIVNGTTNYILTRMQTEGSEFADVLADAQRLGYAEADPTADVEGLDAADKIAILASLAFDGRINLQDVYCEGIRQVSKTDIAYAEKLGFVIKLLAIAKNQAQDATKLSVRVHPTFVPKTHPLASINGVYNAILVEGEPIGQVMFFGPGAGAGATASAVTSDILSLVAALKSNTTAPNPLLTCRHEEYSQVAPISDLLTRFYARFLTKDQAGVIGQLGTCFGNHGVSIESIVQTGFQGELVEIVVVTHDVREGEFRQALAEIQNLPAIDSIPSILRVL

SEQ ID NO: 18759 - protein, 406 aa, Anabaena PCC7120
VTEGHPDKICDQISDTILDTLLAQDPTSRVAAEVVVNTGLVLITGEITTKANVNYANIARQKIAEIGYTNADNGFSANSTSVIVALDEQSPDIAQGVNTAQETREQDSEELFDKIGAGDQGIMFGFACNETPELMPLPICLAHRIARRLAAVRKTGELSYLRPDGKTQVTVVYEDGRPVGIDTVLISTQHTATIGDITDEAAVQAKIKQDLWTAVVEPVFGDLEIKPDQETRFLVNPTGKFVIGGPQGDSGLTGRKIIVDTYGGYSRHGGGAFSGKDPTKVDRSAAYAARYVAKNVVAAGLAEKCEVQLSYAIGVARPVSIFLDTFGTGKVDDEILLELVKDNFELRPAGIIHSFNLRNLPSERGGRFYQDVAAYGHLGRNDLDLPWERTDKADFLKQAVTHSLSA

SEQ ID NO: 18760 - protein, 407 aa, Anabaena PCC7120
KGNQEGLAVSKKTVASLSAADISGKRALVRVDFNVPLDDQGNITDDTRIRAALPTIQDLTQKGAKVILASHFGRPKGVDEKLRLTPVAKRLSELLGQEVIKTDDSIGDEVAAKVATLQNGQVLLLENVRFYKEEEKNDPEFAKKLAANADFYVNDAFGTAHRAHASTEGVTKFLSPSVAGYLVEKELQYLQSAIENPQRPLAAIIGGSKVSSKIGVIETLLEKCDKLIIGGGMIFTFYKARGLNVGKSLVEEDKLELAKSLEAKAKERGVSLLLPTDVVLADNFAPDANSQTVSIENIPDGWMGLDIGPDSVKVFQAALADTKTVIWNGPMGVFEFDKFAAGTEAIAHTLAEIGKTGTTTIIGGGDSVAAVEKVGLADQMSHISTGGGASLELLEGKVLPGIAALDE

SEQ ID NO: 18761 - protein, 548 aa, Anabaena PCC7120
SQFDVLVVGAGAAGLYTALCLPESLRVGLITKETVALSASDWAQGGIAAAIAPNDSPSLHIEDTIQAGAGLCDVAAVEFLAQQAPKCIESLVNLGVAFDRHGQALALTLEAAHSRNRVLHAADTTGREVTTTLTDQVLRRPNIQVIQQALALSLWLEPETGHCQGISLFYQGAITWVRAGAVVLATGGGGQVFAQTTNPAVSTGDGVAIAWRAGAILRDLEFVQFHPTALTKPGADRFLISEAVRGEGAHLVDNEGRRFAFDYHPAGELAPRDVVSRAIFSHLQRTAVDPATAHVWLDMRPIPEDKIRLRFPNIVKVCQRWGIDVFREPIPVAPAAHYWMGGIATNLKNQTNIPGLYAVGETASTGVHGANRLASNSLLECIVFGAQLANLTPADLIQHTETPALPTREFKIDASEWQHQQSQLAILREKLPRLVWQSAGICREQSTLSVAIATVKSWQQDFAALPLSQFLLSLQPNEPVSCNFSDTDQQLRLWAETGNLLDVAYLILKSAAFRIESRGGHFRLDYPHSNPDWQVHSLVQKHQWWQSP

SEQ ID NO: 18762 - protein, 608 aa, Anabaena PCC7120
NNDWRLFSRLVPYARRNTKLLILAMVLLLPLALANAVQPLLIGQAVSLIRKESSAYEFLRNRPLSQGLHIIEGVLLFTIVVRLALTGYQGYLLQKLGQKITAAIRQDLFHHVTSLAVRFFDRTPVGKLITRLTSDVEVLGDVFSTGAIGIVSDVVLMVVITGLMFSIQWQLASLLLVMLLPVTWLIIYFQQEYRKANYKAREELSLLNSQLQENVLGINVVQLFRREKFNAELFRTTNQRYTKQVDQTIFFDSAVSATLEWIGLIAIAGVLWVGGWLLSDNQVDFGTLSTFILYAQRLFDPLRDFAEKFTVIQSGFTAIERVSDILDEPIEISDRSNSRFSVFDAKFGYIDEIVADLESQNISDTPNMGEIRFEHVWFAYKDDDYVIKDLDFIIRPGEKVALVGPTGAGKSSIIRLLCRLYEPTQGRILVDGIDIRELPQAELRRYMAVILQEGFLFAGNVKSNITLGDYYTFEEIQAAAQQTNIAEFIEELPLGYDTKLRERGTNLSSGQKQLLAFARAAIRNPQILVLDEATASLDVGTEALVQEALNELLIGRTAIIIAHRLSTIRNVDRIFVLKRGELVEQGSHEELLNSGGLYSTLHNLQMLG

SEQ ID NO: 18763 - protein, 460 aa, Anabaena PCC7120
GLFYATPAQDGILSRIRIPGGIINSTQCQAIADIADQYGGGYVDVTNRANVQIREIRASIDSTVLKYLQDLGLGSSNAGVDQIRNIMTSPTAGIDPQELIDTRPFVRSWDNYITENSVFSGLSAKFSVCFDGGGLVSVSDRLNDITFTATLVENKVCFRLCLSIGAKGKPPVDIGILLLPEECLPVLTALADVYLLHTDASSKRKPRLREVVNSLGLNNYLQEAEKRLTIPLGGKNLTPLPPSLRGKGEKTRHFSPILVEEGLGGRSNSKYHHIGIHPQHQQNLYYIGLVLPLGRLETWQVRGLADLSTKYGNGTLRLTPWQNLLLTDIPQQSLTDVQSQVLGLGLDFSLANIKSGLVACSGIQGCAAAATDTKSHALALANYLDSHISLEHPVTIHFSGCDKSCAHHGNSDITLLGVNNEMGEGYQVYVGDGDSNEKFGREIHPYITVAELPTTIERIL

SEQ ID NO: 18764 - protein, 265 aa, Anabaena PCC7120
IASCGSDRTIKIWQLATGEDISSLKGHSRKVNAVVFSPDGKTLVSGGDDNTIKIWNLKTGKVIRTITGHSDAVHTLAISPNGKTLVSGSDDNTVKVWNLNTGRLINTLTGHTFWVRSVAISPDGVNIASGSFDKTVKIWNLETGTLTHTLAGNGETVTSIAFNPDGNTLASASRDRTIKIWKVGAGTRVRTLKGSTETITSIAFSPDGNTLASASRDQTIKLWNLETGKEIRTLEGHENTVTTVAFTPDGANLVSGSGDNTMRIW

SEQ ID NO: 18765 - protein, 454 aa, Anabaena PCC7120
DVVIIGGSLAGRYAALTATQMGAKVALVESQLNNSLIVHQAIGEIANLTQNLHNLAGCGIDAVHPDTSEKCQISLKWAAALFSAQGIAANVQEQMSLAHLSAQGVDVIVDSGQFQRSPHLAFVVGQRLLRGRTYLLASGSLPAIPKIEGLQATDYLTPANIWQYLYKQHSPSSELPQNWVIIGGTPQSIEISQTLARLGCSITLVVKSLHLLPQLDPEIAQLLQAQLEIDGVRILTQKMVTQVKRIDDKKWVQAGEKAIEADEILVAIGQKPNIESLNLPEVGVKWQQHRLLVNEKLQTTNHRIYACGDVICGYDLPNVANYEARIALNNALFLPRLQVNYQNTPWAILSHPTLAQVGVTENQAKRQFSQQEVIVLRHYYKSIAAAQLKNEITGICKLVVLGNGKILGATIFSTQARELINLIALAMSRNISVKHLGNLSAVYPSFSELLEQTA

SEQ ID NO: 18766 - protein, 457 aa, Anabaena PCC7120
IKFGTDGWRGIIADDFTFPNVRKVTRAIASYLETAYTKDRPVLIAYDTRFLADQFAQTAAQVLADLGWNVKVTDRDCPTPVIAYNARHLNSAGALMFTASHNPAPYCGIKYIPDYAGPATPEITDTIVANIESASDELPSGKPSGTISTFDPKPDYLQFIYTLLDIERIKSAQLKVKYDALYSTSRGYLDEVLLESGVQLESFHTWRDVLFGGGMPEPKGEQLVELVEAVRRDHADLGLATDGDSDRFGIVDELGNVLTPNTVLLVLARHLIKNKGKTGAIVRTVATTHLLDNFAAKYGLTIYETAVGFKYIGEKMRETAVLIGGEESGGLSIIGHIPEKDGVLADMLIAEAIAYEGKPLSQLVKEAIAEADGPLYNNRLDLHLTEAHKVAVIDSFTKNPPSEVAGIKVKEVGRKDGIKLYLEEGSWVLLRPSGTEPLVRVYLETNSPEKLSKLEQE

SEQ ID NO: 18767 - protein, 200 aa, Anabaena PCC7120
TVIITGASQGIGKATALLFARHNYNVVLAARQLDRLEAIATEIREMGQQAIAISTDVKDATQVNNMMQKAIAHFGQVDVLINNAGIFCLGSVENFSLEDWHQIIDTNLWGYIHTIHAILPHFLQRGAGTIVNVSSIGGLEPIPYHVPYTASKYAITGLTKSLHAELSPKNIHVSGIYPSFISTQLMERAIFRGKDEEMAQ

SEQ ID NO: 18768 - protein, 575 aa, Anabaena PCC7120
MLEHDVIIVGGGLAGCRAAVEIARTDPSLNVAVVAKTHPIRSHSVAAQGGMAASLKNVDSTDTWEAHAFDTVKGSDYLADQDAVAILTQEAPDVVIDLEHMGVLFSRLPDGRIAQRAFGGHSHNRTCYAADKTGHAILHELVNNLRRYGVHIYQEWYVMRLILEENEAKGLVMYSLLDGHIEVVRAKAVMFATGGYGRVYNTTSNDYASTGDGLAMTAIAGLPLEDMEFVQFHPTGLYPVGVLISEAVRGEGAYLINSEGDRFMATYAPSRMELAPRDITSRAIAYEIRAGRGVNLDGSPGGPFVYLDLRHMGKEKIMSRVPFCWEEAHRLVGVDAVTQPMPVRPTIHYCMGGIPVNTDGRVRSSGDGLVEGFFAAGETSCVSVHGANRLGSNSLLECVVYGKRTGAAIAQYVQKRKLPAIDEQRYIKQAQQEIQALLEQPGEYRINQVRQAFQDAMTDYCGVFRTQELMSQGWQKITEIQQKYSQIYLDDKGSCWNTELVEALELRSLMIVGQTILASALNRQESRGAHFREDYPQRDDTKFLQHTMAYYSPAGIDIQYRPVTITMFEPQERKY

SEQ ID NO: 18769 - protein, 711 aa, Anabaena PCC7120
  unsure (1)..(711): unsure at all Xaa locations
MGKVVGIDLGTTNSVVAVMEGGKPVVIANAEGMRTTPSVVGFSKDGERVVGQMARRQTVLNPQNTFFAVKRYIGRRYNELSPESKRVPYTIRKDEVGNIKVACPRLNKEFSAEEISAMVLKKLADDASAYLGSAVTGAVITVPAYFNDSQRQATRDAGRIAGLEVLRILNEPTAASLAYGLDRGDTETILVFDLGGGTFDVSILEVGDGVFEVKATSGDTQLGGNDFDKKIVDWLAEQFLETEGVDLRRDRQALQRLMEAAEKAKIELSAVSITDINLPFITATEDGPKHLETRLTRSQFEGLCVDLLGRVRNPVKRALKDAGLRPDDIEEVVLVGGSTRMPMVKQLVRDLIGIEPSENVNPDEVVAMGAAIQAGILAGEFKDVLLLDVTPLSLGLEAIGGVMKKLIPRNTTIPVRRSDIFSTSENNQNSVEIHVVQGEREMAGDNKSLGRFKLYGIPPAPRGIPQIQVAFDIDANGILQVTALDRTTGREQSITIQGASTLSESEVNRMIQEAQKYADVDRERKERVEKRTRSEALILQGERQLREVALEFGMQFARNRRQRIDNISRELKESLKENDDRGIDQAYADLQDALYELNREVRQYYAEDEDDDLFATIKDIFVGDKDKERDLPRDSYRERDAYNNRDYGRDYGRDYGRDSRPSYDNSRPPRKSPRPSYQDNWDDDDDWLXMRNREESIQNSLWYRVASPREG

SEQ ID NO: 18770 - protein, 331 aa, Anabaena PCC7120
MQNLQNFRDYYEILGVTKDATNEDIKKNYRRLARQYHPDLNPGNKDAEEKFKIIGEAYEMLSDATKRAQYDQFSRYWKQKGFPKQTPKSKAWGDSRNGERNGNENVDPSQFTNFEDFLNQVIGVGSRRDSKNGASTNTTTDPFRSPKSRVEYTVPKNPSRPARRDIEARLTLPFEKAYSGGNERIRLEDGRSLEVTMPPGMVTGQTIRLRNQGISGGDLYLKITVEPHPLFKLEGTNIFCQVPVTPSEAVLGGQVEAPTLDGPVKMTIPPGVRSGQRFRLANKGYPSDNGKRGDQLVEIQILTPKTISQEEKELYEKLRQIETFKPRADLI

SEQ ID NO: 18771 - protein, 441 aa, Anabaena PCC7120
TNTNISPNQELLPLTAKANSQGNLEIGGCDVTTLVEQFGSPLYILDEETLRTACQQYRDGFQKYYPGESQVLYASKAWNCLAVCAIAASEGLGIDVVSGGELYTALAAGVSPAKIYLHGNNKSREELVLAIESGVTIVADNWYELRILASLADSEEPIRLMLRLTPGIECHTHEYIRTGHLDSKFGFDPNDLAEVFEFVSQQPNLNCVGLHAHIGSQIFERQPHRDLAAVMVQWLRDANKYGLNVTELNVGGGLGIKYVESDDPPSIDEWVKAICEVVQAACAAENLPLPKLLSEPGRSLIATSCITAYTVGSSKTIPEIRTYVSIDGGMSDNPRPITYQSVYRAVIANKLSAPHTETVTIAGKHCESGDILIKNAQLPKTEPGDILVVMATGAYNYSMASNYNRLPRPAAVVVANGEANLILQRETYQDLIRQDCLPERL

SEQ ID NO: 18772 - protein, 817 aa, Anabaena PCC7120
MFERFTEKAIKVIMLAQEEARRLGHNFVGTEQILLGLIGEGTGVAAKVLKSMGVNLKDARIEVEKIIGRGSGFVAVEIPFTPRAKRVLELSLEEARQLGHNYIGTEHLLLGLIREGEGVAARVLENLGVDLSKVRTQVIRMLGETAEVSATGQSGRTKTPTLDEFGSNLTQMATDNKLDPVVGRAKEIERVIQILGRRTKNNPVLIGEPGVGKTAIAEGLASRIANKDVPDILEDKRVVTLDIGLLVAGTKYRGEFEERLKKIMDEIRQAGNVILVIDEVHTLIGAGAAEGAIDAANILKPALARGELQCIGATTLDEYRKHIERDAALERRFQPVMVGEPSVDETIEILYGLRDRYEQHHKLKISDEALVAAAKLSDRYISDRYLPDKAIDLVDEAGSRVRLMNSQLPPAAKELDKELRQILKEKDDAVRSQDFDRAGELRDREMEIKAEIRAIAQSKTNASGTEGQEPVVTEEDIAHIVASWTGVPVNKLTESESEKLLHMEDTLHQRLIGQEDAVKAVSRAIRRARVGLKNPNRPIASFVFSGPTGVGKTELAKSLASYFFGSEEAMIRLDMSEYMERHTVSKLIGSPPGYVGYNEGGQLTEAVRRRPYTVVLFDEIEKAHPDVFNMLLQILEDGRLTDAKGRTVDFKNTLLILTSNIGSKVIEKGGGGIGFEFSEDQTETQYNRIRSLVNEELKQYFRPEFLNRLDEIIVFRQLSKLEVTEIADIMLKEVFGRLTEKGITLEVSDRFKGRLIEEGYSPSYGARPLRRAIMRLLEDSLAEEILSGRIKDGDVALIDIDENGNVQVTSQQRRELL

SEQ ID NO: 18773 - protein, 494 aa, Anabaena PCC7120
  unsure (1)..(494): unsure at all Xaa locations
SKXKHKIMPTFPSDPLFQYQWHLYNYDWFTGTRGLDLNVVDVWDDYTGRGVTVGVFEGGGVEYTHPDLAPNYNTAIDYDGVTNGGNPYPLAGESGHATSVAGVIGAAAGNGIGGVGVAYGSTLASFRFSYNNSDSMIRALQRLRNVDVANNSWGSTSIFGADFLNPGYAPVVQAIRDAVQFGRNGLGTAIVWSAGNSREEGLNTNYSNFSNSRHVISVAALEYDGTASFYSTPGASILVSAFGSGVPGSIVTTDRRGSEGSSLGDYNYEFNGTSAAAPEVSGVVALMLEANRNLGYRDIQEILAYSARQNDFYNVGGNYIWQINGANNFNGGGLHVSHDYGFGLVDALAAVRLAETWQKQSRFNNEQSLSYSSGNLGLTVPDNDEAGISHTFTVAAGLEIDWVEVELNLTHPYRGDIVVYLTSPSGVQSVLVHQPGNKEDEGDNIVFKLSSTQHWGETSAGNWTLTIQDLGPSDIGIFNSWKLNLYGDADTIND

SEQ ID NO: 18774 - protein, 402 aa, Anabaena PCC7120
  unsure (1)..(402): unsure at all Xaa locations
TPXEFFNFEFXILNFEFXIAMPDPYAWLQNSLLTIHRADWYRSVQAIQGRAGASVVLGGQEVINFASNDYLGLAGDERLIAAAVAATQEFGTGSTGSRLLSGHRELHGQLEKAIASWKQTEDALVFSSGYLANIGAIAALVGKRDLILSDQYNHSSLKNGAILSGATVREYSHCQVGELKTQLLEQRQNYRRCLILTDSVFSMDGDLCPLPDLLDLAEEFSCMLLVDEAHATGVMGETGAGCVEHFGCTGRQLIQIGTLSKALGSLGGYVTGSHNLIDYLRNRAPSWIYTTGLSPADTAAALAAINIAQQEPQHRMQLWHNVNYLRELLQKIPNLKLLPSASPILCFQLSSPSEALQVGKQLKQAGIFAPAIRPPTVPTSRIRISLMATHKASHIEKLVAVL

SEQ ID NO: 18775 - protein, 586 aa, Anabaena PCC7120
MQLRDSVRRTKIVATIGPATSSPEMLKAIIEAGATTLRLNFSHGSHADHQRSIRLIRQTAFELNQPVAILQDLQGPKIRLGKFENGSIVLAKGDRFTLTNRPVVGSQEISCVTYDYLADEVPVGAKILLDDGRVEMVVEDINRDKGDLNCRVTVAGKLSNNKGVNFPGVYLSIKAMTDKDREDLMFGLDQGVDWVALSFVRNPQDIIEIKELISSTGKQVPVVAKIEKHEAIEQMEAVLALCDGVMVARGDLGVELPAEDVPVLQKRLIATANRLGIPIITATQMLDSMVSNPRPTRAEVSDVANAILDGTDAVMLSNETAVGSYPVEAVATMARIAERIEQEEAMASKLRQMRDNRRSIPNAISQAVGQIAEQLGAAAIMTLTQTGATARNVSKFRPQTPILAVTPHVNVARQLQMVWGVKPLLVLELPSTGQTFQAAINVAQEHSLLFEGDLVVMTAGTLQGVSGSTDLIKVEVVTAVLGQGIGLGQGLVSGCARVAHTGMDVGNFNAGDILVAPRTGADFVEAIRKAGGIITEDESLTSHAAVIGLRLGVPVIVGVKKATQVIRDGAILTLDLQRGLVYSGAV

SEQ ID NO: 18776 - protein, 205 aa, Anabaena PCC7120
NTVLITGGASGIGLALAHKFLQAQNTVIITGRNAEKLAGVKALWPEILTEVADLQDLNILQKLVNRYPNVNILINNAGIQYNYEFTNPEITPELIEAELRTNLIAPLQLIKLMLPHLLNKPEAAIINVSSGLGLVPKESAPVYCGSKAGIHIATKALRWQLETTSIKVFEIIAPLVDTPMTQGRGKGKISPDALVNEFWHDFTRD

SEQ ID NO: 18777 - protein, 509 aa, Anabaena PCC7120
MVSLLENPLRVGLQQQGMPEPQIIVIFGASGDLTWRKLVPALYKLRRERRIPPETTIVGVARREWSHEYFREQMQKGMEEAHSSVELGELWQDFSQGLFYCPGDIDNPESYQKLKNLLSELDEKRGTRGNRMFYLSVAPNFFPEAIKQLGGAGMLDDPYKHRLVIEKPFGRDLASAQSLNAVVQKYCKEHQVYRIDHYLGKETVQNLLVFRFANAIFEPLWNRQFVDHVQITVAETVGVEDRAGYYEKAGALRDMLQNHLMQLYCLTAMEAPNSMDADSIRTEKVKVLQATRLADVHNLSRSAIRGQYSAGWMKGQQVPGYRTEPGVDPNSSTPTYVGMKFLVDNWRWQGVPFYLRTGKRMPKKVSEISIHFRDVPSRMFQSAAQQRNANILAMRIQPNEGISLRFDVKMPGAEFRTRSVDMDFSYGSFGIEATSDAYDRLFLDCMMGDQTLFTRADEVEAAWQVVTPALSVWDSPADPATIPQYEAGTWEPAEAEFLINQDGRRWRRL

SEQ ID NO: 18778 - protein, 349 aa, Anabaena PCC7120
MAKASESLDLSVNESTDKALDRDCTTLSRHVLQQLQSFSADAQDLSALMNRIALAGKLVARRLSRAGLMEGVLGFTGEVNVQGESVKKMDVYANDVFISVFKQSGLVCRLASEEMDEPYYIPENCPIGRYTLLYDPIDGSSNTDTNLSLGSIFSIRQQEGDDSDGQAKDLLTNGRKQIAAGYILYGPSTMLVYTMGTGVHSFTLDPSLGEFILSEENIRIPDHGAVYSVNEGNFWQWEESMREYIRYVHRTEGYTARYSGAMVSDIHRILVQGGVFLYPGTIQNPEGKLRLLYESAPLAFLIQQAGGRATTGLVDILDVVPKKLHQRTPLIIGSKEDVAKVESFIQNGH

SEQ ID NO: 18779 - protein, 240 aa, Anabaena PCC7120
LTTHNLTIGYKTSRKNVRCVASDISVSLQSGEMVCLLGPNGAGKSTLLRSLAGMQPPIAGEVRLLGENVYHLQPQNLAKRMSLVLTEKVDVGMLSAYTLVSLGRHPYTDWWGRLTPEDEAIVHWAIKSVGAVHLAQRQVSELSDGERQKIMIARALAQSPMVMLLDEPTAFLDLPRRVEIMQLLRQLARETNQAILLSTHDLDLALRLADKVWLLSTGGILQVGAPEDLVLSGAFADTFR

SEQ ID NO: 18780 - protein, 481 aa, Anabaena PCC7120
MVTTAEKTNIGYITQIIGPVVDVKFPNGKLPQIYNALTIKGTNEAGQQLNLTVEVQQLLGDNQIRAVAMSSTDGLVRGLEVVDTGAPISVPVGKATLGRIFNVLGEPVDNRGPVNNQETLPIHRPAPKLTELETKPSVFETGIKVVDLLTPYRRGGKIGLFGGAGVGKTVIMMELINNIATQHGGVSVFAGVGERTREGNDLYNEMIESGVINNENLNESKIALVYGQMNEPPGARMRVGLSGLTMAEYFRDVNKQDVLLFIDNIFRFVQAGSEVSALLGRMPSAVGYQPTLGTDVGQLQERITSTTEGSITSIQAVYVPADDLTDPAPATTFAHLDGTTVLSRGLASKGIYPAVDPLGSTSTMLQPNIVGDEHYNTARAVQSTLQRYKELQDIIAILGLDELSEEDRLIVARARKVERFLSQPFFVAEVFTGSPGKYVKLEDTIKGFQKILSGELDDLPEQAFYLVGDINEAIAKAEKIK

SEQ ID NO: 18781 - protein, 457 aa, Anabaena PCC7120
TKTIEVRNPRTGKFDYVIIPPPPRLLAQQCNRARRAQSRWQELGVEGRITALQQWKQAILSRREQLTEALVNDTGRLSITVLEIDSFIASIDRWCGLAPELLQESAKNTSIPFIALQQSLVPYPLVGVISPWNFPLLLSMIDTIPALLAGCAVVVKPSEIAPRFVAPLLMALNTVPELRDILTFVEGGGETGANLINYVDLVCFTGSVATGREVAETAARRFIPAYLELGGKDPAIVLESANLDLATSAILWGAVVNTGQSCLSIERIYVAESRFEEFYHQLIAKAHRLQLAYPLVEDGAIGPIIAERQAGIVNDHILDAVEKGAVIHCGGKVEELGGGWWCRPTVMTNVNHSMKVMTEETFGPIMPVMPFPDVEEAVYLANDTIYGLSAAVFAGSEDEALKVARQLNAGAISINDAALTAVMHEGEKNAFNFSGLGGSRMGASGLKRFLRKQAFLI

SEQ ID NO: 18782 - protein, 75 aa, Anabaena PCC7120
ETFEKVKKIVIEQLSVENPDTVTPEASFANDLQADSLDTVELVMALEEEFDIEIPDEAAEKITTVQEAVDYINNQ

SEQ ID NO: 18783 - protein, 415 aa, Anabaena PCC7120
MTDYNRKRVVVTGVGAITPIGNTASEYWEGLLSGRNGIDYITHFDASSHDCRIAGEVKNFDPHEYLERKEAKRMDRFSQFAVAAAKQALVDSQLVINELNAEQVGVIIGSGVGGLKVMEDQQTIYLNRGPDRCSPFMIPMMIANMAAGLTAIHTGAKGPNNCTVTACAAGSNAIGDAFRLVQGGYAQAMICGGAEAAITPLGVAGFAAARALSTRNDDPAHACRPFDRDRDGFVMGEGAGILILEELQHAISRGARIYAEIVGYGMTCDAYHMTSPVPGGEGASRAIQLALKDANITPEQVSYINAHGTSTSANDTTETAAIKRALGDHAYKIAVSSTKSMTGHLLGGSGGIEAVATVLATAHDQIPPTINIENLDPDCDLDYVPDSSRAHKVQVALSNSFGFGGHNVTLAFKKY

SEQ ID NO: 18784 - protein, 669 aa, Anabaena PCC7120
MAVATQSLEELSINAIRFLAVDAIEKAKSGHPGLPMGAAPMAFVLWNRFMRYNPKNPKWFNRDRFVLSAGHGSMLQYALLYLTGYDSVSIEDIKQFRQWESKTPGHPENFMTAGVEVTTGPLGQGIANGVGLAIAEAHLAAKFNKPDAKIVDHYTYVILGDGCNMEGVSGEAASFAGHLGLGKLIALYDDNHISIDGSTDVAFTEDVSKRFESYGWHVIHVKDGNTDLEAIHKAIEEAKAVTDKPTMIKVTTIIGYGSPNKSNTAGVHGAALGGDEVALTRQNLGWSHDPFVVPEDVLNYTRKAVERGAGYESDWNKTYADYKAKYPQEAAEFERYLSGKLADGWDKVLPSYTPEDKGLPTRKHSETCLNKLAAVLPELIGGSADLTHSNLTEIKGKGDFQKGQYQNPNIHFGVREHGMGAICNGIALHGSGLIPYGATFLIFSDYMRAPIRLSALSQAGSIWVMTHDSIGQGEDGPTHQPIETLASLRAIPNLTVIRPADGNETSGAYKVAIERAKNNAPTLLAFTRQNVPNLAGTSIDDVAKGGYIVVDTDGTPDLILIGTGSELSLCVTAAEKLKAEGKKVRVVSLAAWDLFDAQDAAYKESVLPKAVTKRLAVEAASSFGWHKYIGSEGDAVTIDRFGASAPGGVCLEKFGFSVDNVLAKAKQLL

SEQ ID NO: 18785 - protein, 192 aa, Anabaena PCC7120
NPTAKYTIIYAHGNAEDLGEIRQFLEQLRDLGFNVLAYDYRGYGTSAGRPTENNAYQDIDAAYNYLTKDLKILPKNIIVFGRSVGGGSAVDLAARQPVGGLIIESTFTSAFQVVVPIKILPFDKFNNLEKIKKVNCPVLIMHGQADEIIPFTHAQKLYAASPSPKLKLWVDNASHNDFYGVAGQRYKNILRE

SEQ ID NO: 18786 - protein, 151 aa, Anabaena PCC7120
  unsure (1)..(151): unsure at all Xaa locations
NFSLFFNTGRGTVPIMQLNLPTAIXESVRTIEGHPTVSAIALGADGQTLVSGGQDKTIKVWELQTGKLKKTLRSDSGAINALAISPDGKTVVSGSGDRLVRIWDITSNQPQKILRGHSGNVTHVDISSDGKTIISLDRGDSPEIKVWDLKT

SEQ ID NO: 18787 - protein, 655 aa, Anabaena PCC7120
MSISTSVLSDLLQSLPYLRPQLYFKASLTALSHAMEDQVLAATLDQPLVIASFQRERFYRQEAHRYQRLAQRSSQIYVLSAPETDFANSSEYYEKVAFEPDDALSQEWHLVVVADNYATCLVCRESLGSIAKNRQIPEFSPGLDMDAGRRFEGIWTSERGVSIKAAQLLLDRILVYRPDLAKKVTKACQRFGIGETKIYSNASSFVTEYACDIDTDPFVQRLVTYLQASQYKLHKAYRSIAAQARKERLVNSISTAIRRSLDPHQVLQIAAQELGQHLGASRCLIYRAQASDAQAVIEHEFLTPGTVSISGQTRELKNNSLFKEVVDHGEGVCVTDTLNDFRITNSPTLSLIAKKLAIRSWLIEPVVFQGRLLGIVELHYCSLPPHQWQPGELDLVEAIATQIGAALIQAEAYANLEELNQQLEALDRTRSNLIAITGHELRTPLSTIQVCLESLATEPDMPVELQQVMLNTALSDSERMRKLVQDFLTLSNLESGRVEWHPESLTLQECIDLALSRLRIRPGVEKPPAIKTQIDGNLPLVRADGDWLVEVLAKLVDNACKFTPTQGEIKISATHNGSQMVEVTVADTGRGIEPNRLEIVFDRFYQEEGALRRTAGGTGLGLAICRQIVNGWGGAIWAASTGKDQGSQFHFTIPV

SEQ ID NO: 18788 - protein, 395 aa, Anabaena PCC7120
LAVVVGILFGAGNPNPNFIDLINHLTIPCNLILKALRALATPLILLAILHAFLTVHIPGRSGRKLAILLLTNTLMAIVIGLLVANLLQPGRWWSVASFGAAPTNKTLDPWGLLQDIVPPSILQPLVDNNVIQLVFVALAFGVVLRAIKTEQVAQKKNDYQPVEQLIGLLFEAVMAVLKWVIALVPIAVFGIVAKTIALQGFKPFISLAAFIVAVLIGLFLQGIYYTLRVKFGSWVSPQRFLRGGSDALLTAFSTASSTAAMPVTFQALMQKIGVRESSASLGALVGSNFNNDGTALYEAMSALFVGQLLGLHLNLPQQLMVVFTSIIASVGAAGIPEAGLVTMTLVFTAVGLPTQYIALLITVDWFLDRCRTAINVMGDMTISCLLDGKTQQVEQ

SEQ ID NO: 18789 - protein, 284 aa, Anabaena PCC7120
LNLIQWYPGHIAKAEKNLKEQLSRVDVVFEVRDARIPLATHHPQIDEWVGNKARILVLNRLDMIPPQVRSLWIDYFQNRGEVPYCTNAQHGQGVVGVAKAAQAAGVELNQRRRDRGMLPRAVRAVVIGFPNVGKSALINRLLGKRVVESAARPGVTRQLRWVRISDQLELLDAPGVIPVKLGNQEAAVKLAICDDIGQASYDNQLVAAALIDLVNSLQEQAGELLPKSPLYTRYELDPTPHTGEGYLHALAEYRHKGDVERTARQLLTDYRKGLLGTLPLELPP

SEQ ID NO: 18790 - protein, 352 aa, Anabaena PCC7120
MIVVMKVGSPEVEINRINDELTSWGLTPEKIIGKHKVVIGLVGETADLDPLQIQEVSPWIEQVLRVELPYKRASRQYRHGEASEVVVNTPDGSVVFGENQALVVVAGPCSVENEEMIIETAQRVKAAGAKFLRGGAYKPRTSPYAFQGHGESALELLAKARDVSGLGIITEVMDASELDIIAEVADVIQVGARNMQNFSLLKKVGAQPKPVLLKRGMAATIEDWLMAAEYVLAAGNPNVILCERGIRTFDRQYTRNTLDLSVVPVLRKLTHLPIMIDPSHGTGWAEYVPSMAMAAIAAGTDSLMIEVHPNPKKALSDGPQSLTPEHFDRLMQELAVIGKAVGRWPQPAVVTA

SEQ ID NO: 18791 - protein, 116 aa, Anabaena PCC7120
TAKLWNLQGREIATLTHDGWINHISFSPDGKTIGIRSGDKTVKLWNLRGQEIATLKHNSSTIVSDPIFSPDGKTIATVSLDRTVRLWTEVRDGSWQQFAEYQSRRVVFSPDNKLIA

SEQ ID NO: 18792 - protein, 335 aa, Anabaena PCC7120
MKIDHVHFYVEDAKVWRDWFLNYLGFTGVSSNIGSLHTCTEVVQSGDVCFLLSSPLLSTSPVAEFLRQHPPGVSDVAFAVEDVEVAIAHAQAHGATILQPIGERQIGNISRQCGKIAAWGGLTHTLIEKLNSDNQITSSPNFITAIDHIVLNVAVGELEAAVAWYEKILDLQPRQAFKIQTDRSALHSQVMVSRDGSVQLPINEPASSNSQIQEFLNFNRGAGIQHIALQTQNIVDAIAQFRNRGLPLLSVPQTYYTQLKQRLEIPLSSAELEAIAQQEILVDWRKDNQNGVLLQIFTQPIFAEPTFFLEFIERRSQAQGFGEGNFRALFEAIES

SEQ ID NO: 18793 - protein, 625 aa, Anabaena PCC7120
IAEAIAASQKYLLSLQNPAGYWWAELESNVTITAEVVLLHKIWGTDKTRPLHKVEAYLRSQQKQHGGWELFYGDGGELSTSVEAYMALKLLGVPATDPAMIQARDFILQRGGISKTRIFTKFHLALIGCYNWRGLPSLPAWVMLLPNQFPVNIYEMSSWARSSTVPLLIVFDQKPVYQVNPTITLDELYAEGVENVRYELPRSGDWTDLFLTLDEGFKLAESFNFIPFREEGIKAAEKWIIERQEATGDWGGIIPAMLNSMLALRSLGYDTNDPIVERGLQALDNFAIETVDCYRVQPCVSPVWDTAWVIRALIDSGIAPDHPAIVKAGEWLLQKQILDYGDWNVKNRQGKPGAWAFEFENRFYPDVDDTAVVVMALHAAKLPNEQLKQKACDRALQWVASMQCKPGGWAAFDLDNDQDWLNSVPYGDLKAMIDPNTADVTARVIEMLGACNLSIDSHNLERALTYLLNEQEAEGCWFGRWGVNYIYGTSGVLSALALINPQKYQRHIQQGATWLVGCQNPDGGWGETCFSYNDPSLKGQGDSTPSQTAWALIGLIAAGEATGNFAHDAIERGINHLVSTQQPDGSWFEAYFTGTGFPCHFYLKYHYYQQYFPLIALGRYQAIKS

SEQ ID NO: 18794 - protein, 376 aa, Anabaena PCC7120
KTVVPDTKIVDANNKFGFKLFSEIAKQDGNAKNISVSPTSVAIALAMTYNGASGSTQKAMAKTLELQGISLPELNSGYASLNKLLQNPGENVQLTIANSLWVNQDVSLRPDFVQTTRDFYQAKVTNLDFQNVTAVNTINSWVQENTKGKIDKIVDNIEPNQALFLINAIYFNGKWSNAFDKSQTTPQTFYTASGQQKQHPMMSQTGEYRYYETPQFQSVSLPYGQDGKVSLYIFLPTKNSNLKAFSQNLNAENWEKWMPQFRNREGSIRLPRFQTDYDITLNDALKSLGMAEAFSNKANFSGIGDNLTISQVRHKTVIEVNEEGTEASAATSVGMVATSLREPQQPFKMIVDRPFFYAIRDNQSKNILFMGAVVEP

SEQ ID NO: 18795 - protein, 539 aa, Anabaena PCC7120
SLKDVGGLGEVVKELKELIAIPLKRPDLLAKLGLEPTRGVLLVGPPGTGKTLTARGLAEELGVNYIALVGPEVISKYYGEAEQRLRGIFEKAAKNAPCIIFIDEIDSLAPDRSAVEGEVEKRLVAQLLSLMDGFSHSQGVIVLAATNRPDHLDPALRRPGRFDREVQFRVPDVKGRRDILQILTRAMPLEETVDLDAIAERSVGFVGADLKALCQKAAYTALRRQMPSVESAVPENMTVSQADFLQALKEIKPAVLRSVEVEVPHIAWDDIGGLDTIKQTLRESVEGALLYPELYLQTKALAPKGILLWGPPGTGKTLLAKAVASQARANFIGVNGPELLSRWVGASEQAVRELFAKARQAEPCVVFIDEIDTLAPARGSFSGDSGVSDRVVGQLLTELDGIEVGSTILVIGATNRPDALDPALLRAGRLDLQMKVDLPDLASRLAILLVHSQGRPLDGVDFNYWAEMTQDWNGADLTLLCNQAAVEAIRRFRSQGLTDPSEIKITTDDFNYAYKVLQNSAQIKFLALYRGWGRGQKRL

SEQ ID NO: 18796 - protein, 909 aa, Anabaena PCC7120
SNKPAESQYKTTLSRVNSQATLVANNPHQFRVTENVHKTVLDNGLTVFIKEVPTVPIVSVQVWYKFGSRHEESGVNGIAHQLEHMMFKGHKKAGQFNLDVYLSALGSDSNAFTSYDQTAYYGPVERDKLKVLLVLKADRMQNALIDADKLASEKRVVISELQGYENSPEYRLNRAVMQAVFPNHPYGLPVGGTKADVEKFPVEKVQEYYQDFYSPENAVLVIVGDCQAKETLATVKEIFGGIPQRQQPTANSQQSIINSQQPTANSPIVLREPGAAGLLQVIYPLPPASHPDMPALEVVDYILTEGRNSRLYKALIESGLASEVEASIGGLQQAGWYELLVTADPDQDIGKIDSVLNKAIANLARTDVKAEELARAKRQLEAAIILSNRTITDQAMQLGNDETTVGNYRFTDYYLSAIRQVTSADVVRVVNKYLPKSHRKVGIFQPTISTSTKEVGNKKSTQRTQENLAGDSSVTSSEVMKYLPSLDITTDNIPQKSQTRLPQQFTLANGLQVFLLPDKSTPTVTLSGYVKAGTEFDPDGQAGLASLVADSLMSGTKTKNASTLAQVLDDRGVTLDFAAYRNGMRIQADSLAEDFPVLIRTLADGLKNSTFPKKELDLNLQQAVTSLKMELDDPGEVARRIFLQSVYPKKHPLHTFPTVESLRKIRRQDVIAFSQKYYRPDTTVLVLMGDFEPQQVRSLIQAEFGDWQASGEPPSINYPQVGLPKTTTRENPVLPGKTQAITYLGYAGIKRQDPRFYAALVLNQILGGDTLSSRLGAQVRDRQGLTYGIYSDFQAEKDFGTFWIEMQTSPEDANKAIASTQQVLEQIHQQGVTASEVETAKRTLIGNYNVSLADPEELTNKILMNQVYGLEPGELHFYNQKIQQVTLTEVNQAASELLHPDQVVVVTAG

SEQ ID NO: 18797 - protein, 394 aa, Anabaena PCC7120
LMTNFTSRMQAVQSPIIPVVGELIQNSPGTISLGQGVVSYSPPPEAIELLPRFLADPANNLYKAVEGIPPLLNALTEKLSTFNNIEITTDNCIVVTAGSNMAFMNAILAITSPGDEIILNTPYYFNHEMAITMAGCRAVLVETDENYQLCPEAIAQAITPKTRAVVTISPNNPTGVVYCEDLLRNVNQICANYGIYHISDEAYEYFTYDGVKHVSPASFAGSSEYTISLYSLSKAYGFASWRIGYMVIPKHLLVAIKKVQDTILICPPVVSQYAALGALQAKPEYLQDHIGALAQPAVGIAQVRQIVFDYLKQLQGLCNITPADGAFYVFLKVHTQIDAFALVKQLIQEYKVAVIPGTTFGMENGCYLRVAYGALQKDTVKEGIERLVQGLKTI

SEQ ID NO: 18798 - protein, 428 aa, Anabaena PCC7120
MNIAVVGLSHKTAPVEIREKLSIPEPQTESAIAQLTSYPHIDEVAILSTCNRLEIYIVAGETDHGIREVTQFLSEHSKLPVHSLRQHLFVLLHEDAVMHIMRVAAGLDSLVLGEGQILAQVKNTHKLGQQYNGIKTILNRLFKQALTAGKRVRTETSIGTGAVSISSAAVELAQIKAENLAACRVTILGAGKMSRLLVQHLVSKGATQISIVNRSRERAQELAKQFSEHPIRTHLLPEMMTVIAESHLVFTSTSATEPILDRAKLEMVLAPNQPLMLFDISVPRNVHTDVNELVNVQAFNVDDLKAVVAQNYESRRKMAQEAERLLEEEIEAFDIWWRSLETVSTISSLRSKIETIREQELEKALSRLGSEFGDKHQEVIEALTRGIVNKILHDPMVQLRAQQDVEARRRCMQTLQMLFNLDVGEQFS

SEQ ID NO: 18799 - protein, 717 aa, Anabaena PCC7120
EIIRQGKMFLHQEWELQDGRTLEQNYIPIVVDHKLYGHLWKYRDITQYKKSEVALRLSEERLKLAVDAVEEGLWDWNLVTGEVYRSARWFTMLGYTPMEIGNDIKFRDKLIHPDDIPLMQQRLISHLKGDTPFYEVEIRLLAKSGEWRWILDRGKLVSRDSQGRAIRMVGTHLDITQRKQAEQDLQQQYQHTLLLKQITEEIRQSLQWEKILKTTVTEVQRILQVDRALIFQINSDGSGKVVQEAVMPGWSVTLDQDIYDPCLKDGYLNMYRDGRITAIADVYQGGLKPCYVEFLQQFQVKANLVVPIRVRRNLWGLLIVHQCDRPRQWTELELDLLKHLADQMGIALTQSQLLAQETRQAQLLALQNEELNVAKQVAEKANMAKSNFLATMSHEIRTPMNAIIGMSGLLLDTTLKPEQFDYVETIRNSSHTLLTIINDILDFSKIESGKLELEEQPFDLRLCVEEALDLLAPQAASKGIELMYQLEPDTPTLVVGDITRIRQILWNLVSNAVKFTKIGEICITIGAKQKIYKQTDPTRYEFQFAVQDTGIGIERDRLHRLFKPFSQVDASMTRRYGGTGLGLAISKRLSEIMGGKMWVESQSHQGSIFYFTATLQVNSSAINSAAKVDPELVGKRLLLAVGNANLRKCLTRQLQSLGLDVQAVDSNATALHCLWQHTSLALAVLDVDSPQINGLHLSTKIRAIPQHQNLPLVMLSA

SEQ ID NO: 18800 - protein, 211 aa, Anabaena PCC7120
QNQVSDNNSSKQPDNSWIAELGRTVVLSIVLALGIRTFVAEARWIPSGSMEPTLHGTPNQWEADKIIVDKLKYRFSQPQRGDIVVFSPTEELQKEQYQDAFIKRVVGLPGETVELRNGRVYINKKPLNEEKYLGSKQATVIDVCTSGQQPAFLTKPQTIPSDSYLVLGDNRNSSYDSRCWGVVPRQNIIGRAVLRFWPLNNVGEIDKSPLY

SEQ ID NO: 18801 - protein, 1079 aa, Anabaena PCC7120
  unsure (1)..(1079): unsure at all Xaa locations
MKTATELQARLEYYYQQIKTVIMIRQNPITGLLPASTAITAHGDYTDAWVRDNVYSILAVWGLALAYRKVDEDQGRTYELEHSVIKLMRGLLFAMMRQAHKVEQFKQTQSPLDGLHAKYNTATGDIVVGDDEWGHLQLDATSIFLLMLAQMTASGLQIIYTIDEVNFVQNLVYYIGRAYRTPDYGIWERGNKINHGNAELNASSVGMAKAALEAMNELDLFGVRGSQASVIHVLPDEIARTRSTLESLLPRESASKEIDAALLSIISYPAFAVEDAQLRERTLNEIINKLQGKYGCKRFLRDGHQTVLEDTQRLHYEPWELKQFEHIECEWPLFFTYLALDGLFCDDSKQAQFYQEQLEKLLIERDGVSANIGHSLRLLPELYYVPAENVEAEKLAPQTQPRLPNENVPLVWAQSLYYLGQMLSEGLLAVGDVDPLGRHLTIGKKREALVQIVLLAEDEDLQAQLAVHGIETQTPKQVAPIQVRQASELSTIYTQIGRNDKLGLTGRPVRRLRSLTTSRVFRLRGETIVFLPSFLDSQQFYLTLDYHFLVDQIRSELAYIQKYWSDLGRPILTLMLTHTMLETGSQALLELMQELKDGVCNGVAVKLGRLNQLMLTGAIQRIDFLQDVEFYQSAVQDAGKRCYYLAYHPGKNWRLGHSQEFQVEYETNLDFLLSSLRASENLYEQIELLQTLTRLQGLEFDTGFGTNQRVTVADLLDEVYTKAGELGFWAVVRRAAGLRQMVDIGLTDAVTSILIRGKQIAVGRAYSEASLISVPMPHNEIADKINHFCREDIRDRVLTQEVLIYLGILIRSQTESFQGLLTLRVGYLILLITSELAQELKVTQDEAYERLMELPPFEVKTRLQQVLTAYPGMSQLLRQQESLHVKQKVTDIDWVILPAISEEMEVPIGGWRRFRQAEGALNRVPKNFFQQVWLIMQHCKGLVIGDKLERRNRLDSDVILSEMTAGEKNFALRIEHLLNKIEAPEYRQVNIEALMELAAIASRNPNLQIEEYIVLDVLIGHAVRLAWLEQHPERGDRYDEDKASAWRSFYNTSPKECATYILEAFKFLTEFVKXRXGCR

SEQ ID NO: 18802 - protein, 302 aa, Anabaena PCC7120
SIIVFGSINIDLVATAPKLPGAGETLLGEDFFKVPGGKGANQAVALARLGVPTQMVGRVGAQSFGAELMQNLQDAGVQTDNIFVDETASSGVAMITVAHNGENQIVVIPGANGRVNQVDVERLSRILPTATALLLQLEIPVPAVIAAAQAARSNNITVILDPAPAPSDLPTELYSFVDIITPNEVEAGQLVGFPVDGEDAARKAAGVLLQKGVKSAIVKLGAKGVVCATNKETFFVPAFSVDTLDTVAAGDAFNGGLATALYSGLSLHQAVIWGAAAGALAATKLGAQTSLPDKLTFEAFLK

SEQ ID NO: 18803 - protein, 565 aa, Anabaena PCC7120
KAYIIVPILSGDQVWGLLATYQNSGPRQWKTGEINIVIQIGNQLEVALQQAQLLTQTQRQSQALEAAAIAADAANRAKSEFLANMSHELRTPLNAILGFTQIMSHDKTLSKDNQQNLTIINRAGEHLLDLINDVLEMSKIEAGRTTLNINSFDLIHLLDNLQEMMQGRATAKGLHLKFEYAPNIAQHIQADESKLRQVLLNILGNAIKFTETGSIILRVKMGTGDWGLGTEEDTKTHLSIPNTQSPITNPQSLIFEIQDTGIGICDDEVCVLFEAFGQTEAGRKSQQGTGLGLAISRKYVQLMGGDISVSSAVGVGSTFSFQIQVGLVSAHEIPYQPTTRSVIGLAPQQRECRILVVDDVADSRLLLVKLLSSVGFVVQEAANGQEALAIWQQWHPQLILMDMRMPIMDGYEATHFIRSAEIENHTTIPNPHTIIIALTAHAFEEQRQAMLQVGCDDLINKPFSEKEILEKLNKYLGIKYLYQEDSSQTLKARTKIFTHDNLLPLLSTLPRDWLINLYNAAAQCSDDLILKLVGEISAENTALKEYFVDLAHNFQFEKIMEIVST

SEQ ID NO: 18804 - protein, 216 aa, Anabaena PCC7120
MLTAILFDLDGTIVNTDPIHYQAWRQMLWKCNIEIDETFYKSRISGRLNPEIVKDILPELSSAAGREFADEKEALFRELASHLQPLNGFAELIAWTEVHQLKRALVTNAPRLNAEFMLEVLGITDSFHQIVLADDCVAGKPDPAPYQVALSKLGIPAEKAIALEDSPSGIRAAVGAGIRTIGIASTHDPDILLEVGSFMAIPDFTDLHLWTLLNSL

SEQ ID NO: 18805 - protein, 493 aa, Anabaena PCC7120
TTQKPQTTPQQNHLKNFIQNYNQRTQTSKKIAQQNRQILADKTSIGFNFAPETKELCYPIAIEKSNGSRLWDVDGNEYIDILMGLGINLFGHNPPFIQTAISEQLQQGMHIGVQNTLAGEVAQLISELTGAERVTFSNTGTEAVMTAVRIARAATKRPKIAIFTNSYHGHFDSVLVRATMTEYAKKAARRIIAAKSGSFIGRLAQPIQALFTANLNPKAVPAAPGIPNSAAADVLILEYGNEHSLKLIRKHRRELAAVLVEPVQSRCPELQPREFLQQLRQITQELGIVLIFDEMVTGFRIHPGGAQAHFGVKADIATYSKIVGGGLPLSVIAGKASYMNYIDGGQWQFGDDSTPQVPTTFFAGTFCKHPLALAAARATLQHLKISGIELHNELNQRTTQLVNDLNTHMTQQGIAIKFTSFGSFFAVAASQSAVPPMAINLLSYHLITKGIHLRQGDKGGFLSTAHTEEDINLIKKAFIDSINELRNEGFINN

SEQ ID NO: 18806 - protein, 628 aa, Anabaena PCC7120
MPKRLLVVESPGKVKKLSQILGSEWIVRASCGHIRELSDEGEDALGFSMDGSSVQCHYVPRDQRSKETIQQLKSAAKQVSEVVLGTDPDREGETIAWHLKEVLGLREPKRVVYTEITASAVQSAIAHPRKLDLNLVGAGLCRDCLDKLVGYKGSPLVWALNNGAKSVGRVQSSTLHLICQREREIQSFVPQDYWSVWVDYVEGFRAFYKGAVNTRSNSPEAEVEIHDDAAGNSTTAPESTRVLAEAEANRLVEEARRHPHQIVQYEGKVANRQPPPPFITSTLQQAAGSKLKFAPEKTMQLAQKLYEAGLITYMRTDSVMLSPEFCESARQWLEQNDPQNVPTQVARHRSSKTAQQGHEAIRPTDVFRPSAQLRIELSTDEFNLYVMIWKRAIASQCRPAQLRKTVVITQSGQILWQARGQVVEFLGYTRYWPNLSKDTLLPTLQQGQMVTLENAGHEKKQTQPPPRYSEPKLVQLMERKGIGRPSTYSPTIATLKKRGYVELTKDNLHPTNLGLEVDTFLQKALPDLLEAEFTAKMENALDAIAEGKQPWQIYLTTWNQNYFAPALAKAKTVTVDSGKTTKTFPARQYDTSRTRCPDCNNFLSKIPSSKLKKKYFLKCTSGCENTVL

SEQ ID NO: 18807 - protein, 556 aa, Anabaena PCC7120
LVDYLKPQKSRMVKFAIALLVSIGLQILNPQILRYFIDTAVSGGDSQKLLLAALLFIGVALITQAMSIIATFYGENVAWTATNNLRADLVEHCLRLDLSFHKYRTPGELVERIDGDVQNLSEFFSKFTIHILGNLLMVLGVIVVLFIEDWRAGLAILLFALTALSTLIKLRRISVFHWGGYRQFSAEFFGFLGEQLTGMEDIRANGAKNYVMQRFYTIIRNWLPIFHKARFADTILWVTTNGIFTLGSVIALIVGAYLWSQQTITIGTVYLLYYYTNILSEPIEQIRNQFEDLQQADASIYRITDLLQIQSQLRTSGEKLLPPGALSIAVENISFAYNDRKNDTEDWVLQDVSFNLPAGQVLGLLGRTGSGKSTLARLLLRLYDPQSGSIRLGGVPIDQTPLQELPGKVGLVTQDVQLFQTTVRNNLTFFNPDITSDRIHETIEMLGLSEWLHSLPNGLDTTLGPDSSGLSAGQAQLLAFTRVFLKNPGLVILDEASSRLDPMTERLIEKAIDKLLMGRTAIIIAHRLATVERANQILILDKGKISEYGERKELAN

SEQ ID NO: 18808 - protein, 508 aa, Anabaena PCC7120
RFTMRSLLRRNLLERLLNNPHAQIKAAHNDTEKTVSQGEVISYFRDDTEHIEDNVAWVSEIFGEGIFAVLSLVILLSVNVPMTLFVFLPLVGMVVIIQKTETRIKQYRKSSRQATQQVTGILGEIFSSVQAIKVAGAEQDVLSYFRTLNDNRRETMVKDTLLKAILNSLFQNMVNFGTGLILVMASFLMQSGSNQLTVGDFALFVYNLSFVTGFFASVGGFMALYKQTEVAFERMTTLISGASTETLVAPNQLYLQDLGKSRKNLPRLEQPKNNASHQLQSLKLTNLTYIYPGTTQGIVDINLQIQRGSLTVITGRIGAGKTTLLRVLLGLLPKQAGEIYWNNHLVADPANFFVPPRSAYTPQIPQLFSYSLRENILLGLSKDDADIETALKMAVFEQDLAAMNEKLETLVGTKGVRLSGGQMQRVAAARMFVRQPELLIFDDLSSALDVETELALWSRIFANTTEENPWTPTCLVVSHRRSVLRRADQIIVMKAGRVVAQGKFEDIL

SEQ ID NO: 18809 - protein, 776 aa, Anabaena PCC7120
APGAPGVSSVWSYAGKQGIGTSYEQYVNNKYSDRAPTNAISKVWFSIAQGIVTETAYGEIDRAQINDLQFLVTGKGFFDEEKVATESKVDYLDKDSDGRPLSPAYRVINTDKEGKYTIEKHIFTDPDHQTLFTKVIFTANEDNITPYILINPHMNNTGKEDVAFVKSDSLNAREGEIVYLSLKSSLPFVKTSAGYVARSDGYQDLKDNGVMDWTYDYTDQSKPGSVAMIGQLPALSKGQTSTFNIAVGFGSTYEAATEQADASLKEGYESLLAKYNGKGNAVGWEDYLASLSNLPAMIANTGDKGKQLYASAFTLKSMEDKENPGALIASLSVPWGDTVNADTFATGYRAVWPRDFYQAAMALLALGDKETPLTAFKYLPQVQVQSDTLGNSGATGWFLQKTHVDGTLEWLGVQLDQTAMPIMLGWKLWKAGVLSDGEITQQYRTMLKPAAEFLANGGNVNIHTSNQANNRKINPPSTHQERWEEQSGYSPSTTAAIITGLVAAADIAENAADDPGAAAFYFSKADEYQKNVDKFMFTTTGDVKNCNGSSEYLLRVTPNADPNDGSRIHDNNSLLEADERQILDGGFLELVRYGVRKGDDAHIAASVCALDNINLSEALRVRYDIAFDGKKYPGFRRYGNDGYGEQINDGSNFRDIDDGQKKDRRGRIWPFFTGERGHYELELAKAKHGGTISDQEVAKLRDTYVRAMEYFANESLMLPEQVWDGVGANTAHKYITGEGTNSATPLAWAHAEYIKLVKSLTDKNVWDSYPIVQARY

SEQ ID NO: 18810 - protein, 427 aa, Anabaena PCC7120
LRIITQQADVKAELQRICDRTHDEQVLHKEATVREVLQAVKRQGDKAVLHYTDEFDNQILKAEELRVTGSELDAAYQQVSQELLEAIQLASRQIEAFHRQRVPKSWVHFGDDDIVLGKRYTPIDRAGLYVPGGRAAYVSTVLMNAIPARVAGVPRIVIATPPGAQKAINPAVLVAAQEVGVQEIYRVGGAQAIAALAYGTETIPKVDVITGPGNIYVTLAKKLVYGNVGIDSLAGPSEVLIIADEGANPVHVATDMLAQAEHDPMAAAILFTTDPALAKNVQVAVERQLVDHPRRIDTEKAIAHYGLIVLVESLDAAAELSNEFAPEHLELEVKDPWAVLPNIRHAGAIFLGYSTPEAVGDYLAGPNHTLPTSGAARYASALSVETFLKHSSIIQYSQTALNKVAGAIDALATAEGLPSHADSVKRR

SEQ ID NO: 18811 - protein, 458 aa, Anabaena PCC7120
DFRIERDSMGDRQIASDVYYGIQTLRAVENFPISGLKPLPTYVDAGLLIKKATAIVNGELGCIPQDISQAIVQATDEILAGKLRDQFVVDVYQAGAGTSHHMNINEVLANRALEILGAEKGNYQRVSPNDHVNYGQSTNDVIPTAIRIGGLLALTKTLQPALEKAIAALEHKAVEFQDIVKSGRTHLQDAVPVRLGDNFAAWAHILSEHQNRIYTASGDLMVLGLGGSAAGTGLNTHPQYRARVVEVLAELLNLPLQPAPHLMAAMQSMSPFVNVSGAIRNLAQDLAKISHDLRLMDSGPKTGLKEIQLPPVQPGSSIMPGKYNPVMAEMTSMVCFQVMGYDQAIALAAQAGQLELNVMMPLIAYDLIHSIEILGSTIAALTERCIQGITANKERCLAYAEGSLALVTALNTHIGYLNAADVAKESLNTGKSLRQIVLEKGLMSEAELATVLNLEEMS

SEQ ID NO: 18812 - protein, 901 aa, Anabaena PCC7120
IQSHQWHNLSASKVAQYLDANLDTGLTSNQIAKRQESFGANELKGKKGTSPIVRFLLQFNQPLLYILLIAGAIKALIGQWVNAWVIWGVTLINAIIGFVQESKAESAIAALASSVQTNATILRNGQKVQVPSQELVPGDLVLLTSGDKVPADLRLIQSRNLQVNESALTGESVAIEKNTEPVDANAVLAERSNMAYAGSFVTFGTGKGIVVAIGEATETGRISQLMEQGTSLKTPLTRKFDKFSRTLLYIILGIAALTFAVGLGYGNSWASMFEAAVAFAVSAIPEGLPAVVTVTLAIGVSRMAKRHAIVRKLPAVETLGGATVICSDKTGTLTENQMTVQVIYTDGQYYTVTGTGYIPEGEILRDEQPVDWRSSPVLAECLQAGLLCNDSHLEQKEGEWQVIGDPTEGALIVVANKVGLTSNNLESEMPRLDVIPFESEFQYMATLHEGGSGENSARVRTIYVKGSVEAIVQRCQQMLTGGNLVSVDAQTLHQEVETMAHQGLRVLAFARKTVSVSQDSLDHADIDNDLVFLGLQGMIDPPRAEAIAAVAACQNAGIQVKMITGDHAATAQAIAQRMGFNQNGEVLAFTGAQLAQMSQTQLATAIEDGAVFARVAPEQKLRLVEALQSKGEVVAMTGDGVNDAPALRQADIGIAMGGAGTEVAKEAADMILTDDNFASIEAAVEEGRTVYRNLLKAIAFILPVNGGESMTILISVLLARELPILSLQVLWLNMVNSIAMTVPLAFEPSSQRVMQLPPRSPREPLLSKSLVKRIFAISIFNWILIFGVFEWIKQSTGNIDLARTMAIQALVSGRFFYLLSISQLGIAAINFLRGVRQKLSDISAIAIGIVTTIILQIIFSQWSLMNQLFATAPLNLTQWLTCLLVGLPMIPVALIVNKFDP

SEQ ID NO: 18813 - protein, 276 aa, Anabaena PCC7120
  unsure (1)..(276): unsure at all Xaa locations
MSLVVSTSAKHFPAWAFFSLVSNGILMLAVILLIWQQQKLSILSSNAPLSVPVSQPQAVAPELGPRHQLNYQQWVDILKQEANVAAEKRPQRLSIMAGDSLSLWFPVELLPEDRNWLNQGISGETSRGLLQRLNLFDKTQPETIFVMIGINDLIRGVNDEVILDNQRQILRYLRKTHPKTKIFVQSILPHGAEEATWEGREKLLAIPNSRIQKLNQQLQSIATKQSVKYLDLYPLFTNQKGNIRSEFTTDGLHLSPAGYVVWRTALQVYQQGVDRX

SEQ ID NO: 18814 - protein, 1210 aa, Anabaena PCC7120
  unsure (1)..(1210): unsure at all Xaa locations
RKAAFLANSRCADLDIRVFSDRDITSKRLEVEAALQGADVFFGSLLFDYDQVVWLRDRVSQIPIRLVFESALELMSLTKLGAFAIGDKPKECPNLLNLFSTNLATDEKKTNLLVILAFXKSAPKLLKFVPVQKVQDLRNWLIIYGYWNAGGTENVAALFWTLAEKYLDLKIGDIPPPIETPNIGLLHPDYPGFFESPREYLAWYQKREEAGVQGAGCRGEKNPVVGILLYRKHVITKQPYIPQLIRRFEDAGLIPLPIFINGVEGHVAVRDWMTTDYEFQQRQIGNIATPSLSPEAVKVDAIVSTIGFPLVGGPAGSMEAGRQVEVAKRILTAKNVPYIVAAPLLIQDIHSWTRQGVGGLQSVVLYALPELDGAIDTVPLGGLVGEDIYLVPERVQRLIGRVKSWIALRQTPAAERKIAIILYGFPPGYGATGTAALLNVPRSLIKLLHALKDQGYNVGDIPEDGEELIRLVKETDEEMERWEKNKPFPSSANTVNSRKLEKWLGYLRTSRIEKQWKSLTGSGIKTYGDELHVGGVQLGNVWIGVQPPLGIQGDPMRLMFERDLTPHPQYAAFYKWLQNDLQADAVVHFGMHGTVEWLPGSPLGNTGYSWSDILLGDLPNLYIYAANNPSESILAKRRGYGVLISHNVPPYGRAGLYKELITLRDLIAEYREDPNKNYVLKEAICKKIVDTGLDTDCPFEDAKRLGIPFTPENIRMFSAHAFDDYLVKLYEYLQVLETRLFSSGLHTLGEAPNQEELASYLEAYFGEEQAKQPEMEKQITDLLMQTTDELTNLLRGLNGEYIPPAPGGDLLRDGAGVLPTGRNIHALDPYRMPSPAAYERGREIAQKIIAQHLQEHHTYPETVAVLLWGLDAIKTKGESLGILLELVGAEPVKEGTGRIVRYELKPLAEVGHPRIDVLGNLSGIFRDSFVNIIELLDDLFQRAADADEPEDQNFVRKHALALKAQGVENASARLFSNPAGDFGSLVNDRVVDGNWESGEELGNTWQSRNVFSYGRQDKGQARPEVLQQLLKTSDRIVQEIDSVEYGLTDIQEYYANTGGLKKAAEKQSGKKVTASFVESFSKDTTPRNLEDLLRMEYRTKLLNPKWADAMASQGSGGAYEISQRMTALIGWGGTADFKDDWVYDQAADTYALDPEMAEKLRQANPEAFRNILSRMLEAHGRGLWQADTDKLDKLRQLYELTDEQLEGVTV

SEQ ID NO: 18815 - protein, 1082 aa, Anabaena PCC7120
  unsure (1)..(1082): unsure at all Xaa locations
DIEQIRTFIGTSLIQVISGIVTLISAAVILLIMNWQLAIITLTVVPMSGWLMARFITQNDRLFRQVQEQLSDLNAVLQENLIGIRVVKAFVRESAERSRYTGLNDALVTANMKTIRAIRNTFPFIFLLSNLVTLAVFGYGGAQVIGNTFSIGELVAFNAYLILILQPILLIGFAAPAIAQAAASAQRVYEVVDAAVEIRDRADAIPFETCGGRITFENVSFRYPGAATEALKDVSFETKPNELIAILGMTGSGKSTVMNLIPRFYDVTKGAIRIDGQDVRDFTLNSLRKHIGIVFQETTLFSGTIRENIAYAKPKASLEQVMEVAKTAQIHDFIMSLPDGYETIVGERGVGLSGGQKQRIAIARTLLTDYSILILDDSTSAVDAKTAAEIQAELDSMMRQKACVTFVVAQRISTVKNADRIFLIDKGRLAAQGTHEELMQTSPLYGAILESQVKKRQEAEERGSRGAGETXEVMIVYSXLITHYPLPITHYPHENSSPSYCLRATSNXATFNLTTLLTIPASLSQRSSHCFEFSINWRCHPGDRAVFTGLVSXXPDSQREFTGLLLLLVLLGLNYSFGIWAIRGQVIRVGWIMQRLLAQLRQDIFTKIQSLPLSFFDRSEAGDLMSRLLNDVNTVNQAFGQTVAQMLGNTFSLVGIVIAMLSINLQLGLLSNLVVPLMIFTTSLFARWARTKFRVTRQTIGELSAKLEEDIGSVXEAQAFNRVHLNIAEFDILNAANRDANVEAVAITAAFLPSIDFLNTLATAGVLAYGGYLAVTGAATVGVVTSFLLYVQQFFRPIQILSQFYTQAQSAFAGLERIFLLLDEPSQLNDAPNATQMPAIQGKVTFENVKFGYNPEQLVLKGVNLQANPGQMVALVGATGSGKTTIINLILRFYDVSDGAVKIDGVDVRSVTQASLRRQIGIVLQDNILFSGTVAENIAFGAPYATQAEIEAAAQMANVHEFITSLPQGYTTKLGERGAPLSQGQRQLISIARAVLINPRILILDEATSSIDTRTEALVQDAIARLLQGRTSFVIAHRLSTVTQANQVLVIQQGQIIERGTHAELVSQQGIYANLYALQLGA

SEQ ID NO: 18816 - protein, 319 aa, Anabaena PCC7120
RPRRLRRTATLRRMVRETTLTVDDLIYPMFVMEGEGQKVEITSMPGCYRYSLDLLLKEIAEVSQLGIPAIALFPVISENKKDDIGAESYNPEGLVQQTVKAIKQAVPDIVVITDVALDPFTTHGHDGLVDENGTILNDPTVEMLVKMALSQAAAGTDFVAPSDMMDGRIGAIRQALDAEGYINVGILAYSAKYASAYYGPFRDALDSAPKFGDKKTYQMDAANAREAIKEVELDIVEGADIVMVKPALAYLDIIHQVQQATQLPVAAYNVSGEYAMIKAAAQMGWINEKQVILESLTSMKRAGADLILTYFAKEVALML

SEQ ID NO: 18817 - protein, 113 aa, Anabaena PCC7120
VLGVSFSPTEKLLASAGWDNTVSLWRRDGTLLQTLLKGLSDSVNAVNFSPNGEILAAANWDSTVKLWSREGKLIKTLNGHEAPVLSVSFSPDGQTLASASDDNTIILWNLHLD

SEQ ID NO: 18818 - protein, 258 aa, Anabaena PCC7120
RYEIQQLLGKKAGRRTLLAKDVVTGELVIVKLLVFSSDFEWDDLKLFEREAETLKSLSHPHIPRYLDYFEVNPPTIKGFALVQSYISAQTLEQYLQSGRSFSESDIKQIATAILEILIYLHGLYPPVIHRDIKPSNILLGERSGNNVGQVYLIDFGSVQTALGAEGGTRTVVGTYGYMPPEQFGGRTVTASDLYSLGATLIYLVTGTHPADLPQKDFRIQFESVANLSPGLAAWLKTMTEPSVERRFSSPQQALKALE

SEQ ID NO: 18819 - protein, 483 aa, Anabaena PCC7120
LDQNQTPLIESIKACTARHHAAFYTPGHKQGRGIAQPLADLLGKAVFSADLTELADLDNLSAPQGVIQEAQQLAAAAFGASQTWFLVNGSTCGVEAAILATCRPGDKIILPRNVHSSAIAGLILSGAIPIFIYPEYDPVLDIAHSITPEAVKAALQQHPDAKAVLTVYPTYYGVCGDLEAIAQVTHHYNIPLLVDEAHGAHFAFHPELPTSALAAGADLTVQSIHKVLGAMTQASMLHIQGDRINAVRVSQALQLLQSTSPSYVLLASLDAARQQMALSGKQLMSRTLQLANEARERISQIPGLSVLQPPTKTPSPGFTTLDKTRLTVTVSGLGLTGFAAEEILDEQLGVTAEFATLQHLTFIISLGNTATDIEQLVQGFTTLAETTLPTKALVNPKVNSNLEYFSEISPRDAFFADSETLSIEQACDGICAEIVCPYPPGIPVLMPGEVITKPAIEYLQHIQSLGGFITGCADTSLNTLKVL

SEQ ID NO: 18820 - protein, 306 aa, Anabaena PCC7120
MAALLGRDLLSLADLTPTELQELLQLATQLKSQQLKLRCNKVLGLLFSKASTRTPVSFTVAMYQLGGQVIDLNPNVTQVSRGEPVQDTARLLERYLDVLAIRTFEQQELATFAEYAKIPVINALTDLEHPCQILADLLTVQECFDSISGLTLTYVGDGNNVANSLMLGCALAGMNVRIATPSGYEPNPQVVAQAQAIADGKTEILLTNDPDLATKGASVLYTDVWASMGQEAEADDRFPIFQPYQISEQLLSLAEPNAIVLHCLPAHRGEEITEEVIEGSQSRVWQQAENRLHVQKALLASILGAE

SEQ ID NO: 18821 - protein, 691 aa, Anabaena PCC7120
  unsure (1)..(691): unsure at all Xaa locations
MKLTSIKLCNFRSFYGRTPEIVIAGGDVLNTTIIHGNNGSGKTSLLNAFTWVLYEKFSAAFASIEQLVNKRAIAEAKLGQAVECWVEINWEHEGKRYNVKRQCKGYKNKTDFAIGKTELLMQVAGDDGRWYYPSQQPEEIIGQILPVSLHQYFFFDGERIEEIVRSDKKAEIAEATKIFLGVEVINRSIRHLGEAKKSLENELKAIGDSEIKQLLREQEKLEQEIERIHTRQTEIKQELEYQQTFKKETGNRLQELSAAKELQQRRQELENQKNSNQESLRQTREALKKIISARGYTVLLSDTTAQFRTIINQLKQQGELTAGISREFIHELLKSQRCICGADLHEGNHAHTNVSLWLNQAGSSAVEETAIRMSAQVDEIDKQAIAFWEEVDKEQARINQLRQNISQVENELETIQERLRKDANEEISSLQKRLDEIESKIDELNREQGANQQEISHVQADIDALVKQIAKQKLNEEKQLLAQRRINATQDAIERLTEVRNRQENQFRLQLEKRLQEIFNSVSFTPYVPKISDKYELTLVESTSGMEASVAASTGENQILSLSFIASIIDKVRDWSEKRKILTVPDSSTFPIVMDSPFGSLDETYRRRIAQTLPELANQLIVLVTKTQWRGEVETEMTDRIGREYVLTYYSSKPDCEQDYIELSGGRFPLVKQSPNEFEYTEVIVVEREWX

SEQ ID NO: 18822 - protein, 342 aa, Anabaena PCC7120
MVQERTIPKFNTANAKITKEEGLLLYEDMTLGRFFEDKCAEMYYRGKMFGFVHLYNGQEAVSTGVIQAMRPGEDFVSSTYRDHVHALSAGVPAREVMAELFGKATGCSKGRGGSMHMFSAEHGLLGGYAFVAEGIPVAAGAAFQSKYRREVLGDPNADQVTACFFGDGAANNGQFFETLNMAALWKLPIIFVVENNKWAIGMAHDRATSDPEIYKKASVFNMVGVEVDGMDVLAVRAVAQEAVARARAGEGPTLIEALTYRFRGHSLADPDEMRSKAEKEFWFSRDPIKKLAAYLIEQNLADEAELKAIERKIQDVIDDAVKFAESSPEPDPSELYRFVFAE

SEQ ID NO: 18823 - protein, 860 aa, Anabaena PCC7120
  unsure (1)..(860): unsure at all Xaa locations
MNFHQKAHKTGKSRIYRALVATAFLASGIFPFTTPALAEGTKAGQSITNEATATYEDPNNPNVPLNTTSNTVTVTVAEVAGITVDYTGLVDDDGGTIEINDLLIFNYTITNVGNDPTQFRIPNLATTTGPATVSGTLPNNGTLNNLQYSTDNGVTWVNITGSEAIVPNIAVGGQVLVRVPVTVQPGAQSGDIITVRLGNTPANAQNVLRSPDGGDVYTVDNLNGSVTDEVDGAPVNGTREASDTSIDVQVGGGVKTYSLATVLKTRTAYSNAGTTNSITDDTLSYGLSLRVEGNDPTGQGITPAALEGRGINLNGTSNVPHILVSDAIPTGTDLVSVTAPNGWTAVYTISPIGTDANAAAWTTTPPGDLSTVTRVGFINNTAIVTSVAPNQTVNGFTINLRVESSFAGTSLNVANIAQLFGQTPGNNFPVYDESGDQNPSNFNGQFGNMTPNLPALTDLNNDGVPDSLPDTSVDDGFVDNPAAPETGVDGNNDNTGVGDGGEANIFTLEVPVASAILNGPVNAPNAIGPSGGTNDDFTNKSSLVPFGTQPNSTLNPQPVAFTNTIRNSGSAASDYSLVPIPPASNTPAGNNADLPVGTLVTITYASESRSYVWTGSEFLFDLDRNPATTGDQSTINLTSEYITIPSVAPGTNINYGVEIDLPDGTQLSTDIDKGFPVPVTAFVDDGTAGLNGEAVQNTTINRVYTGFLKLRKLSRILDQNGQPVAGADGILSDTDKSPVPGNIIEYQIQYSNISEPQSGNGNIILNASNVVINENGVTAPNNWALDNDSNGQIDTSNIIGSATDPNGTIQFFNGNPATTSGSDQTGTTVNTDVTRYVNSVTGQVAPGQQRTFTFRRKVNX

SEQ ID NO: 18824 - protein, 480 aa, Anabaena PCC7120
TPNWVKNAVFYQIFPDRFARSKQPHKRLLRDARWEDWDAMPTLQGYKGGDLWGIMEQLDYIQDLGIDAIYFTPIFQSASNHRYHTHDYYQVDPMLGGNAAFKELLDASHERNIKVVLDGVFNHSSRGFFFFHDVLENGPHSPWVNWFKIEGWPLAPYTGELPANYVGWADNRALPVFNHDNPEVREYIMEIAEYWIKFGIDGWRLDVPFEIKTPGFWQEFRDRVKAINPEAYIVGEVWGDSSEWLDGTQFDGVMNYLFAGPTIAFAAGDRVVLEQVQSRDYQPYPPLFAAEYATKIQEVLQLYPWDIQLTQLNLLASHDTARLLTIAGGDQASIQLATLLLLTFPGAPSIYYGDEVGLPGGIDPDSRRGFPLEANWDREIYQTHRQLIALRRTYPALRTGDYQVIWAQGALYIFARTLGKEELIIAVNVGTATAQANVDVASLQTQPNKILYGQAEFHWHNTEETKQLFLSLPPRSGCIL

SEQ ID NO: 18825 - protein, 429 aa, Anabaena PCC7120
VKKVLAIILGGGAGTRLYPLTKLRAKPAVPVAGKYRLIDIPVSNCINSEIFKIYVLTQFNSASLNRHIARTYNFSGFSEGFVEVLAAQQTPENPNWFQGTADAVRQYLWMLQEWDVDEFLILSGDHLYRMDYRLFIQRHRETNADITLSVIPIDDRRASDFGLMKIDNSGRVIDFSEKPKGEALTKMRVDTTVLGLTPEQAASQPYIASMGIYVFKKDVLIKLLKEALERTDFGKEIIPDAAKDHNVQAYLFDDYWEDIGTIEAFYNANLALTQQPMPPFSFYDEEAPIYTRARYLPPTKLLDCHVTESIIGEGCILKNCRIQHSVLGVRSRIETGCMIEESLLMGADFYQASVERQCSIDKGDIPVGIGPDTIIRRAIIDKNARIGHDVKIINKDNVQEADRESQGFYIRSGIVVVLKNAVITDGTII

SEQ ID NO: 18826 - protein, 330 aa, Anabaena PCC7120
MAATDFKDYYAILGVSKTATPEEIKQAFRKLARKYHPDVNPGNKQAEASFKEVNEAYEVLSDADKRKKYDQFGQYWRQVGEGFPGGGAGVDMGGVDFSQYGNFDEFINELLGRFGGAAPRGGRQSYSYRTPGGRPGGGFGGFNDFGFQDVGAAGGGQDAEATISLTFAEAFAGVQKRFNLGNETIDVRIPAGTKPGTRLRVRGKGQFNPMTQQRGDLYLKVEFQPHSFFQIEGDNLACEIPITPDEAALGASIDVPTPDGSVNVKLPAGVRSGQSLRLRGKGWPIAKGGRGDQFVKVAIVPPKDMSQQEREYYEKIRAIRSYNPRSHLQQ

SEQ ID NO: 18827 - protein, 192 aa, Anabaena PCC7120
LRVGQQAPDFTATAVVDQEFKTIKLSDYRGKYVVLFFYPLDFTFVCPTEITAFSDRYEEFKKLNTEILGVSVDSEFSHLAWIQTDRKSGGVGDLNYPLVSDIKKEVSDAYNVLDPAAGIALRGLFIIDKDGIIQHATINNLAFGRSVDETLRTLQAIQYVQSHPDEVCPAGWQPGEKTMTPDPVKSKVYFAA

SEQ ID NO: 18828 - protein, 332 aa, Anabaena PCC7120
MEVIFKIIRQQQNSAPIVQNYFIETDPGNTILDCLNRIKWEQDGTLAFRKNCRNTICGSCAMRINGRSALACKENVGSELARLQKISSSANQATNIPEITIAPLGNMPVIKDLVVDMNSFWNNLEAVAPYVSTAARQVPEREFLQTPDERSRLDQTGNCIMCGACYSECNAREVNPDFVGPHALAKAYRMVADSRDTDTAQRLESYNEGTKGVWGCTRCLYCDSVCPMEVAPLEQITKIKQEILTQKQASDSRSIRHRKVLVELVKEGGWIDERQFGLQVVGNYLKDLRGLLSLAPLGLRMIAKGKFPLSFEPSAGTAQVRSLIESIQKANE

SEQ ID NO: 18829 - protein, 447 aa, Anabaena PCC7120
MKFDKILIANRGEIALRILRACEEMGIATIAVHSTVDRNALHVQLADEAVCIGEPASAKSYLNIPNIIAAALTRNASAIHPGYGFLSENAKFAEICADHHIAFIGPTPEAIRLMGDKSTAKETMQKAGVPTVPGSEGLVETEQEGLELAKDIGYPVMIKATAGGGGRGMRLVRSPDEFVKLFLAAQGEAGAAFGNAGVYIEKFIERPRHIEFQILADNYGNVIHLGERDCSIQRRNQKLLEEAPSPALDSDLREKMGQAAVKAAQFINYTGAGTIEFLLDRSGQFYFMEMNTGFQVEHPVTEMVTGVDLLVEQIRIAQGERLRLTQDQVVLRGHAIECRINAEDPDHDFRPAPGRISGYLPPGGPGVRIDSHVYTDYQIPPYYDSLIGKLIVWGPDRATAINRMKRALRECAITGLPTTIGFHQRIMENPQFLQGNVSTSFVQEMNK

SEQ ID NO: 18830 - protein, 942 aa, Anabaena PCC7120
PESSTTWHSLEVDKALGLLNSNADSGLTTEEVEQRLQKYGPNELEEHGGRSAWEILFDQFKNIMLLMLIAVAFISGSLDFISWQAGELKPGEIPFKDTIAILAIVILNGILGYVQESRAEQALAALKKLASPSVRVIRSGKLVDVAAKDIVPGDVMLLEAGVQISADGRLIEQANLQVRESALTGEAEAVNKQASLQLPEDTSLGDRINVVYQGTEVVQGRGKVLVTNTGMTTELGKIATMLQSVENEPTPLQQRMTQLGNVLVSGSLVLVAIVVVGGVIQAGNFSPLRDLLEVSLSMAVAVVPEGLPAVITVTLALGTQRMVRRNALIRKLPAVETLGSVTTICSDKTGTLTQNKMVVQSIYTNHKTFRVTGEGYAPVGEFQLDGQNVPAEDYPEIPALLVACAVCNDSVLQKEAGEWMILGDPTEGALVTLAGKAGIEKDQWNYKLPRVREFPFSSERKRMSVISQVEKVATGEPTMATVDPTLAGLVNSEPYIMFTKGSPELILARCTAIHLGANSDHLNDEQRQQILAANDQLASKGLRVLGFAYKPLAEVPPEGSDETSEQGMVWLGLVGMLDAPRPEVRAAVQECREAGIRPIMITGDHQLTARAIATDLGIAQEGDRVLTGQELQRMDDQELEQQVDLVSIYARVSPEHKLRIVQALQRRGRFVAMTGDGVNDAPALKQADIGIAMGITGTDVSKEASDMVLLDDNFATIVTATKEGRVVYTNIRRFIKYILGSNIGEVLTIAAAPLMGLGGVPLTPLQILWMNLVTDGLPALALAVEPPEPDVMKRPPFSPRESIFARGLGSYMIRIGIVFAIISIILMKWAYDHSHAVTGPGLDPERWKTMVFTSLCIAQMGHAIAIRSNNQLTIETNPVSNPYVLGAVVVTTILQLMLVYVPPLRDFFGTHWLPLDELAICVGFSALMFVWVEMEKLFFRFM

SEQ ID NO: 18831 - protein, 598 aa, Anabaena PCC7120
MAKFKDIVNYFRDDWKLSAFTIAASSVYEVVDLLVPYAIGQILNVLSNQPLDKPLEGAIATLSQLTNYPVSKLLSLGVLLGLIFLVTVVRAPTQPWLTSWFHWDIALRSRRDKTQSAIEKILTLPLEFYDVNNPGRIAGRLGRGLSNHTWTYPEIAGQLIPKLFRVLGIFGFIVLIEWRIAIFYLISFVLILGFSLRQLKRIIWHESLLDKYMENTESRTSELITNIKTVKAFATESKELKRQKQRLDRELKVVDYRIHRGYVNLLTWQKTVIQFCVFTILGLTLAATVSGKVSLGHFVMTLTLSSMAYSELEPISTLAEVFARRYSSMLRFHEFLQEPTGYDAASLLEEDNTSSPYKFTGKVEFSGVSFGYDASRKVLQDINLFIEPYQTVALVGRSGSGKSTLVKLLLRYFEPQDGQILIDGQDIRTLNVGKYRRRLAIVHQEVDVFNGTVLDNLTYGRPEATFEEVKEACRIARVDEVMQHLPQGYYTVVGERGVRLSGGQRQRLGIARALLVEPDVLIFDEATSSLDYESERAIQLAMRSIQGTCTTIVIAHRLSTVREADKIVVLDQGKIVEVGNHDELLRQEGIYRRLHSLQ

SEQ ID NO: 18832 - protein, 392 aa, Anabaena PCC7120
PNPPSPHPNSSLMPLSDAMPALLVLADGTAYRGWSFGATGTTIGEVVFNTGMTGYQEVLTDPSYRGQIVVFTYPELGNTGVNPEDEESARPQVRGAIARNICHKPSNWRSTQSLPDYLKQHHIPGIFGIDTRALTRKIRMYGAMNGGISTEILDEAELLEQVQAAPNMAGLNLVREVTTSTVYEWSDPTTAVWEFNPDGTVKNGESLTVVALDFGVKRNILRRLASYGCRVIVVPADTSPEEILKYNPDGIFLSNGPGDPSAVTEGITTAKALLESEKPIFGICMGHQILGHALGAETFKLKFGHRGLNQPAGLTQRVEITSQNHSFAIDPDSLPEAVVEISHLNLNDRTVAGLRHKSLPIFSVQYHPEASPGPHDADYLFAQFVHQMRTTK

SEQ ID NO: 18833 - protein, 383 aa, Anabaena PCC7120
LETAKIAADVANQAKSEFLASMSHELRTPLNGILGYAQILERSENIAPAALEGINIIHQCGSHLLILINDILDLSKIEAGKLELHNTDFDFSYFLTGVVEMCRIRALQKGISFHYLPDPDLPQAINADEKRLRQIIINLLGNAIKFTETGGVNFTIQVLEAGADFNKIRFQVEDTGVGMTPEQLTKIFLPFEQVGDKNKQAEGTGLGLAISCRIAELMGSQIQVDSILGTGSKFWLDLNLNIISHWLQTSSVLQKKKIIGIQDKQPKVLIVDDKWENRAIICNFLRPIGFECLEAANGQEGLNIAATNEPDLIITDLAMPVIDGFEMIQTIRSLPQISKVPIFVSSASVFESDKNKSLQIGGTEFLPKPLELDKLLKYLQDYL

SEQ ID NO: 18834 - protein, 345 aa, Anabaena PCC7120
NKLTNANIENYHVLLTPNAVKEKLPLTETAAEIVLQFRCEIEKILDFQDRRKFIVVGPCSIHDPNAALEYAHKLKKLAERVQDKLLLIMRVYFEKPRTTVGWKGLINDPEMDDSFHVENGLLLARDLLIKLTELGLPTATEALDPIVPQYIGELITWAAIGARTTESQTHREMASGLSMPVGFKNGTDGNIQVALNALHSARMTHNFLGINPEGQVSVFETKGNAYGHVILRGGNQPNFDVASVKQVEEKLKQAQLPPRIVIDCSHGNTNKNYRLQSDVLENVVQQIVDGNTSIVGMMLESNLYEGNQPINCKREELKYGVSVPDPCIGWEQTEKIILAAYEKLN

SEQ ID NO: 18835 - protein, 399 aa, Anabaena PCC7120
RIALISVHGDPAIEIGKEEAGGQNVYVREVGKALAQLGWQVDMFSRKVSPEQELIVHHSPLCRTIRLTAGPEEFVPRDNGFKYLPEFVQQLLRFQKENNVNYPLVHTNYWLSSWVGMQLKAIQGSKQVHTYHSLGAVKYKSIDTIPLVATKRLSVEKQVLETAERIVATSPQEQQHMRSLVSTKGYIDIVPCGTDIHRFGSIARQAARAELGIDQEAKVVLYVGRFDQRKGIETLVRAMNESQLRDTNKLKLIIGGGSTPGNSDGRERDRIEAIVQELGMTEMTSFPGRLSQDVLPAYYAAADVCVVPSHYEPFGLVAIEAMASGTPVVASDVGGLQFTVVSEKTGLLVPPKDIAAFNIAIDRILMNPQWRDELGLAARKHVTHKFGWEGVASQLDGIY

SEQ ID NO: 18836 - protein, 325 aa, Anabaena PCC7120
MFPTHRPRRLRTHPQLRRMVRETVLTTNDLIYPLFAVPGEGIANEVKSMPGVYQLSVDKIVEEAKEVHDLGIPAIILFGIPADKDTDATGAWHDCGIVQKAATAVKAAVPDLIVIADTCLCEYTSHGHCGYLQVGDLTGRVLNDPTLELLKKTAVSQAKAGADIIAPSGMMDGFVQAIRAGLDEAGFQDTPILSYAAKYASAYYGPFRDAADSTPQFGDRRTYQMDPGNSREAIREIELDIAEGADMLMVKPALAYMDIIWQVKEASNLPVAAYNVSGEYSMVKAAALNGWIDEQRVVMETLTGFKRAGADLILTYHAKDAARWL

SEQ ID NO: 18837 - protein, 240 aa, Anabaena PCC7120
VRKIVIAGNWKMFKTQAESQEFLKEFLPALEETPQEREVLLCVPFTDLAILSQSLHGSLVQLGAQNVHWAENGAYTGEISGPMLTEIGVRYVIVGHSERRQFFGETDETVNLRLQAAQKYGLTPILCVGETKQQRDSGETESLIVSQLDKDLINVDQTNLVIAYEPIWAIGTGDTCETTEANRVIGLIRSQLKNSDVPIQYGGSVKPNNIDEIMAQPEIDGVLVGGASLEAASFARIVNY

SEQ ID NO: 18838 - protein, 209 aa, Anabaena PCC7120
MQISDYPQLNLSSVPRIASVHRITGETNVQVTVNLDGTGICKAATGIPFLDHMLHQISSHGLIDLDVQAKGDWEIDDHHTNEDVGITLGQALAKALGDRKGIVRFGNFLAPLDEALVQVALDFSGRPHLSYGLQIPTERVGTYDTQLVREFFVALVNHSQMTLHIRQLDGINSHHIIEATFKAFARAARMAIEVDPRRAGTIPSSKGVL

SEQ ID NO: 18839 - protein, 264 aa, Anabaena PCC7120
MTTKISMLNLTGKNALVTGIANNRSIAWGIAQQLHAAGANLGITYLPDERGKFEKKVSELVEPLNPSLFLPCNVQNDEQIQSTFDTIRDKWGRLDILIHCLAFANRDDLTGDFSQTSRAGFATALDISTFSLVQLSGAAKPLMTEGGSIITLSYLGGVRAVPNYNVMGVAKAGLEASVRYLASELGSQNIRVNAISAGPIRTLASSAVGGILDMIHHVEQVAPLRRTVTQLEVGNTAAFLASDLASGITGQVLYVDAGYEIMGM

SEQ ID NO: 18840 - protein, 575 aa, Anabaena PCC7120
INLVWTTSHTMTIILATLTLVAGLLPAAIAYLGKLIVDGVVLASQGNTQGNIYAPLLYVGLEAIAVALLAGSQRGLIICQSLLRVLLGQRVNVLILKKALTLDLTHFENSEFYDKLTNARREASVRPLSLVNRTFGLVQNALSLITFGFLLVKFSIWAVIVLIVAAMPAFIAETRFAGEAFRLFSWRAPETRQQHYIENLLAREDFATEVKLYQLGDMLLGRYRNVFRQLYNEDRDLTIRRGMWGYLLGLVSTVAFYIAYAWIVIEAVVGRISLGDMTMYLTVFRQGQSTFANALTSIGGMYEDNLYLSNLYDFLEEKVTQPWGKITKGIDTQDGIRFENVTFTYPGSSQPALKNISLHLKPGEKLAIVGENGSGKTTLIKLLTRLYTPDSGRILLDGVDLQSWNVDALRQRIGVIFQNFVRYQFTVGENIGVGDVDSLNDTTRWQIAAQKGNAHSFIERLPQQFQTQLGKWFKSGQELSGGQWQKIALARAFMRTQADILVLDEPTSAIDAQAEYEIFNHFRALTQNQMVFLISHRFSTVRMADKILVIENGEVREQGTHEELLAREGLYAKLF

SEQ ID NO: 18841 - protein, 346 aa, Anabaena PCC7120
PQLDRLDTNESPYDLPPELKQKLAWTFQQVIESNRYPDGGHETLKSAIAEYVNESANISSLRFTAANISVGNGSDELIRSLLIATCLSGEGSILVANPTFSMYGILAQTLGIPVVSVSRNPDNFAIDLTAAQSAIEQTLNPPIRVVFVVHPNSPTANPLTANELRWLKSLSERILVVVDEAYFEFSQNTLVSELAQRPNWIILRTFSKAFRLAAMRVGYCVAHPEAIAILEKVRLPYNLPSFSIASALVALQNRAILLESIPQTLDERTKLINAFSQHPALAVAESAANFIFLRLKADSDNSSDTTLLNLHQQLKNSGTLVRQISGGLRITIGTPEENIRTLNHIQ

SEQ ID NO: 18842 - protein, 479 aa, Anabaena PCC7120
MRVAIAGAGLAGLSCAKYLTDAGHTPIVLERRDVLGGLVAAWKDSDGDWYETGLHAFFGAYPNMLQLLKELGIEDRLQWKEHTLIFNQPDKPGTLSRFDVPDIPSPFNIIASILRNNDMLTWEQKIRFAIGLLPAIVRGQKYVEEMDKYSFSDWLKRQGVGERVASDVFIAASKALTFINPDEVSSTILLTALNRFLQERYGSKIAFLDGSPTERLCQPIVDYITERGGEVRLNAPLKEILLNPDGTVKGFLLRGLNGEPDEVITADFYVSAMAVDPLKVMLPQPWQQMEFFQKLEGLEGVPVINLHLWFDRKLTDIDHLLFSRSPLLSVYADMSNTCREYANPDRSMLELVLAPAKDWISKSDEEIVSATMVELEKLFPDHFKGDNPAKLLKSHVVKTPRSVYKATPGRQQYRPAQKTPIANFFLSGSYTMQRYLGSMEGAVLSGKLTAQAICESLPEDNTSNLQTLTRPPATNAATA

SEQ ID NO: 18843 - protein, 378 aa, Anabaena PCC7120
ELRQSEERFRSLSTCSPIGIFETDTAGCCKYTNPRYQAICGLDATESLDKRWLESVHSEDQERAIASWSTYIYQGGDYSDEFRFQTVDGSLRWVQVRSSPMLSGNGELLGYVGTLEDITARKQSEEIRAQVIREQTARQEAEATNRMKDEFLAVLSHELRTPLTSMLGWSKILRAKKLDEKATARALEAIERNANSQVQLIEDILDVSRIIRGQLRLNLSPVNLITVVEAALEAVRPLADTKNMTINTVLDYTLSPVSGDFARLQQIVWNLLTNAIKFTPKEGQVEIRLEGINGELSDDLTHAQIQVIDTGVGIASEFLPKVFERFRQADSTTTRSHNGLGLGLAIVRHLVELHNGTILAESPGVGKGATFTVRFPLI

SEQ ID NO: 18844 - protein, 169 aa, Anabaena PCC7120
MPLKLISKKSTAALAISTTVALFGISLSRLKLPFETFTHNVTSVPIIQPDRTIKDHSAWIYAIAITPDGKTLVNGNYDGTIKTWNLHTGKLLHTFKSHTDAVSSLAMSVDGRILVSGSWDNRIKLWNLETNTLISTLDGHKDDVQTVAISPNGKLVASGSADNTIKLWN

SEQ ID NO: 18845 - protein, 1118 aa, Anabaena PCC7120
PYRGLFAFREEDAHLFFGREEFTADLVKAVKRKRFVAVVGASGSGKSSLVFAGLTPQLRQDPNVQWQIISFRPGKNPFEALATALVSLRQCCPSFSLENILELPEDSTTTRLLELDLAIALQQNHQLLHTILEKVVQQKFGTRLLLIADQFEELYTLCPEPQRQPFLDLLLNAYSFTPAFTIVLTLRADFYSYALSYRPFSDALQGAVQNLGPMNMKELRRVIEEPAKKNAIGLEAGLTNQLIDEIDQQPGHLPLLEFALTQLWSKQQNRLLTHQAYQEIGGVEEALANHAEAVYAQLTEADRQRAQQIFIQLVRLGDDTEATRRLTTREEVRLENWDLVTRLASSRLVVTNRNESTAEETVEIVHEALIRSWGRLEQWLIVDGDFLRWREQLRLAIRLWENSGHDQGVLLRGKALIDAQEWQLQRAQELNTNEIRFINKSGELRELEVKQQQRIRKIGISSLVTGLILALGLAGVAWLQGQKARMSETKAISSSAESFLNANLEFDGLIASIRAGRRIKGTDGIDANTRTQITETLQQSINFVREKNRLAEHDGMLESVSFSPDSKFIATASRDKTVKIWSLDGKKQLVVLREEKGEGFNSVAFSPDGTLMATGSWDNTAKIWSREGKRLHTLDGHKEAVLEVAFSPDSQLLATASWDNTVKLWSREGKLLHTLEGHKDKVNSITFSPDGQLIATVGWDNTMKLWNLDGKELRTFRGHQDMIWSVSFSPDGKQIATASGDRTVKLWSLDGKELQTLRGHQNGVNSVTFSPDGKLIATASGDRTVKLWNSKGQELETLYGHTDAVNSVAFSPDGTSIATAGNDKTAKIWKLNSPNSIIVRGHEDEVFDLVFSPNGKYIATASWDKTAKLWSIVGDKLQELRTFNGHQGRVNKLSFSPDGKYIATTSWDKTAKLWNLDGTLQKTLTGHKDTVWSVNFSPDGQLIATASEDKTVKLWNRDGELLKTLPRQSSVVNSAVFSPDGKLIATAGWDKTVKIWSIDGRLQKTLTGHTSGINSVTFSPDGKLIASASWDNTVKIWNLDGKELRTLRGHKNVVHNVTFSPDGKLIATASGDNTVKIWNINGQELRTLRGYKDAVWSLRFSLDGKTLATGSRYDIVVW

SEQ ID NO: 18846 - protein, 461 aa, Anabaena PCC7120
MRVCVIGTGYVGLVTGACLAHIGHDVICIDNNEEKVKIMKAGQSPIFEPGLSEIMQSAIQSGKIQFSTDLAAGVAHGEILFIAVGTPPLPTGESDTRYVEAVARGIGANLNGGYKVIVNKSTVPIGSGDWVRMIVLDGIAERQKTLVTAGGSVEDKLPELPQFDVVSNPEFLREGSAVYDTFNPDRIVLGGNSSRAIAAMQELYAPIVERKFAENQSLPPVPILATDLSSAEMIKYAANAFLATKISFINEVANICDRVGADVTQVAKGIGLDSRIGNKFLQAGIGWGGSCFPKDVAALIHTADDYGYEAQLLKSAVSVNERQRLIALEKLQQVLKILKGKTVGLLGLTFKPDTDDLRDAPALNLIEQLNRLGAKVKAYDPIVSQTGMRHGLSGVLVETDAERLADGCDALVLVTEWQQFSGLDYAKMAKLMNNPVVIDGRNFLDPETLVRAGFQYVGVGR

SEQ ID NO: 18847 - protein, 336 aa, Anabaena PCC7120
TPTVKAKLSPSLPATDAKARVSNFMKQLQDEITQALTKLDGGSEFHEDSWERPEGGGGRSRVLRDGAIFEQAGVNFSEVWGSHLPPSILAQRPEAEGHGFYATGTSLVLHPRNPYVPTVHLNYRYFEAGPVWWFGGGADLTPYYPFAEDAAHFHQTLKLACDEHHPEYYPVFKRWCDEYFYLKHRDETRGVGGLFFDYQDGQGVLYRGPNPKGEAANYSNQVGEPASRDWEDLFSFIQGSGKAFLPAYVPIVERRHGMEYGDRQRNFQLYRRGRYVEFNLVYDRGTIFGLQTNGRTESILMSLPPLVRWEYGYQPEPNSPEAELYDTFLKPQDWSN

SEQ ID NO: 18848 - protein, 562 aa, Anabaena PCC7120
LPYIRPQWQNITKGLVGIVGYVLATLTLINFAGKLANPFGQGNVVAIAQLAAILGLVFLVRGFFQSVQDIYMSKAALRIAFYLRKQVYGHLQKLDLSYFETAKAGDLSYRLTEDIDRIGEVVNKLFHDFIPCVLQLIAIPIYMIYLNWQLTLATVIVAPFMGILIGWFGERLRKYSLRSQNRVSDLSAILTEVFSGIRLIRAFAAENYEVTRFSREAERSFQAKYSAERLKAVQIPIVGFLEALSALSLLLVGAWQIQQNNLTVGEFFSYLAAAGLLIDPIGHVTNNYNEFKQGEASVDRIFELMAIQPTVLEKPNAVTLPPVKGKVEYSGVTFAYKPGETVLKDINLLAMPGEAIAFVGASGAGKTTFVNLLPRFYDPSAGQILIDGVDIRDVRLQSLRRQIGIVPQETIMFSGTVAQNIAFGQDIFDLEAVAAAAKIANAHQFISQLPEGYNTWVGERGVNLSGGQRQRIAIARAVLLNPQILILDEATSALDSESEALVQEALERLMQNRTVFIIAHRLSTVRRCDRILVLERGQIVESGTHEELLALENRYARFYTQQ

SEQ ID NO: 18849 - protein, 413 aa, Anabaena PCC7120
LIGVLVYVQSAEQTQLKQSKALADAAKESADSANNAKSEFLANMSHELRTPLNGILGYAQILGRSKVLPDKERQGVNIIHQCGSHLLTLINDILDLSKIEARKLELASQAFHLPSFMQGVVEICHIRVQQKGIEFHYEPDADLPAGISADEKRLRQVLINLLGNAIKFTDRGSVALRVQRTGLEESDPRTKLRFSIVDTGVGIASADINKLFQTFEQVGEQKRKVEGTGLGLAISQQLVQLMGGQIQVKSQLGVGSEFFFEIILPLASDWSQQQTASVGNIIGYEGVKRHILVVDDRWENRAVLLNLLEPLGFIITEAENGQAGLDQLQQHLPDLVITDLVMPVMDGFEMLRKIREQEQLRSLKILVSSASVAQIDQQMSIDAGGDDFLAKPVQVNDLFTLLEKHLELTWKTE

SEQ ID NO: 18850 - protein, 206 aa, Anabaena PCC7120
SQALQASSDNCELYYKRGLSYYQLGDYEAAIADYSQAININLHDAKSYHKRGLALSQLAAYEAAIDDYNQAIRINPHAASIYKNRAEARSHLGDNQGAIEDYTQAIKINPQYADTYKNRGISRYLLATQPGFTQAIKINPNDANAYKNRGNARADIGDYLGAIEDYNQAIQINPKAADAYYNRGNARYDLGDEEGAIADYTQAIQI

SEQ ID NO: 18851 - protein, 730 aa, Anabaena PCC7120
VTESTKTLCPYCGVGCGLEVTPPAQLNKATNRDSQGNPTWRVRGDKAHPSSQGMVCVKGATIAESLDKNRLHYPMVRESLDQEFRRVSWDEAFDLITKRIQSVRFTQGAEAICMYGSGQFQTEDYYIAQKLMKGCLGSNNFDANSRLCMSSAVSGYIQSFGADGPPCCYEDLELTDCAFLIGTNTAECHPIVFNRLEKYHRKNHKVKMIVVDPRRTPTAEAADLHLAIKPGTDIDLLNGIAHLLMRWNMIDVGFIDDCTRNFSAYAEVIRHYSPEVVARQCGITIEDLETASRYWGESQRVLSLWSMGVNQSSEGTAKVRTIINLHLMTGQVGKPGAGPFSLTGQPNAMGGREAGGLAHLLPGYRLVKNPQHRAELEAFWGFQPGQISPHPGLTAWDMITGLEDGNVGLLWIAATNPAVSMPDLERTKKALLRSPFTIYQDAYHPTETTAYAHVLLPAAQWGEKTGIMTNSERRVTLCQAFRQPPREAKPDWEIFAEVGRRLGFEDKFAFTNSAQVYAEFTQLTKGRPCDMSGISHQQLQAQGPTQWPHSSINIETQKPTQHPTVNSQQSTVTSQQSKRLYTDLRFHTPDGRARFGAYYSKGLAEPPDPSYPFVLTTGRLYGHWHTQTRTGRIEKIRAMHPEPFIEIHPRDAAKLGITDNVVVEVRSRRGSAKFPAKVTKAISPGTVFVPMHWGKLWADDAEANALTHSESCPDSLQPELKACAVQLIPI

SEQ ID NO: 18852 - protein, 536 aa, Anabaena PCC7120
MTDTVTTPKASLNKFEKFKAEKDGLAIKSEIEKIASLGWEAMDATDRDHRLKWVGVFFRPVTPGKFMMRMRMPNGILTSDQMRVLAEVVQRYGDDGNADITTRQNIQLRGIRIEDLPHIFNKFHAVGLTSVQSGMDNIRNITGDPIAGLDADELYDTRELVQQIQDMLTNKGEGNREFSNLPRKFNIAIAGGRDNSVHAEINDLAFVPAFKEGIGDWVLGNGEESSTYQKVFGFNVLVGGFFSAKRCEAAIPLNAWVTPEEVLPLCRAILEVYRDNGLRANRLKSRLMWLIDEWGIDKFRAEVEQRLGKSLLPAAPKDEIDWEKRDHIGVYKQKQEGLNYVGLHIPVGRLYAEDMFELARIADVYGSGEIRMTVEQNIIIPNITDSRLRTLLTDPLLERFSLDPGALTRSLVSCTGAQFCNFALIETKNRALEMIKGLEAELTFTRPVRIHWTGCPNSCGQPQVADIGLMGTKARKNGKAVEGVDIYMGGKVGKDAHLGSCVQKGIPCEDLHLVLRDLLITNFGAKPRQEALVTSQ

SEQ ID NO: 18853 - protein, 640 aa, Anabaena PCC7120
  unsure (1)..(640): unsure at all Xaa locations
MHLSEITHPNQLHGLSIRQLQQIARQIRDKHLQTVAEFGGHLGPGLGVVELTLGLYQTLDLDRDKVIWDVGHQAYPHKLITGRYSDFHTLRQKDGIAGYLKRGENKFDHFGAGHASTSISAALGMALARDMNGEKFKAVAVIGDGALTGGMALEAINHAGHLPKTNLLVVLNDNEMSISPNVGAIPRYLNKMRLSPPVQFIKDNFEEQFKHIPFVGESLSPELGRIKEGMKRLAVPKVGAVFEELGFTYMGPVDGHNLEELIATFQQAHQIAGPVLVHVATIKGKGYELAEKDQVGYHAQTPFNLTTGKAIPSNKPKPPAYAKVFSHTLVKLAEQNPKIIGITAAMATGTGLDKLQAKLPNQYIDVGIAEQHAVTLAAGLATEGMRPVAAIYSTFLQRAYDQIIHDVCIQNLPVFFCLDRAGIVGSDGPTHQGMYDIAYLRCIPNIVMMAPKDEAEMQRMVVTGIEHTTGPIAMRFPRGNGYGVPLMEEGWEPLEIGKGEILRNGDDVLIIGYGTMVYPSMQAAEILSEHGIEATVINARFVKPLDTELIVPLAQKIGRVVTLEEGCVMGGFGSAVAEALLDADVVVPVKRIGIPDVLVEHATPDESKAELGLTSRQIAERVLQAYFQKQPSPVSXVSVS

SEQ ID NO: 18854 - protein, 853 aa, Anabaena PCC7120
SFDQDSNAHKSFELPGARPHYNPDRPGQVEHIFLDLNLDIPQQSYEGSCSIRLLPIRNGIDRLTLDAVNLQIRSVQVDEVGQDFDYDGEQLVIQLSQPTEIGKRILIAIAYAVEKPQRGIYFIQPDSHYPNKTVQVWTQGEDEDSRFWFPCFDYPGQLSTSEIRVRVPKSLMAISNGELIDTQEDGKHKIYHWSQQQIHPTYLMTLAVADFAEIRDEWRGKPVTYYVEKGREADAKRSMGKTPRMIEFLSEKYGYAYAFPKYAQVCVSDFIFGGMENTSTTLLTDRCLLDERAALDNRNTESLVVHELAHQWFGDLLVIKHWSHAWIKEGMASYSEVMWTEQEYSAEEAAYYRLLEARSYLSEDSGRYRRPMVTHVYREAIELYDRHTYEKGSCVYHMIRAELGEDLFWQAIQTFVRDNAHKTVETIDLLRAIEKATGRNLAFLFDQYVYRGGHPDFKVAYSWDGEAKLAKVTVTQTQVPADKDKDVFDLRIPIGFGYNQTEAAAKLQTFTVRVHEREQSFYFPLTEKPDFISFDVGNHWLKTVSLEYPIPELKAQLASDPDPISRIYAAAALAKKGGLEATKALAASLKNEPFWGVRVEVAKQLAEIKLDQAFDGLVEGLADKNAYVRRAVVQALAKIKTLASYKAVKGVVKDGDASYYVESAACLALGAIAAINFDDKSKEEKAIKLLQSVLEERAGWNEVVRSGAIGGLAELKTSEAALDLILEYTKLGVPQPLRLAAIRALGKISPGQSPVNLERIIARLGELSKENFFLTLMAVVAALGQMETPKAMGVLRSLADQTADGRVRRFAEEELANVQKNIGTDNALRKLREEFDQLKQQNQELKSRLENLE

SEQ ID NO: 18855 - protein, 522 aa, Anabaena PCC7120
YRIAAMAGAIILTIALKNLATYTSTLSSSSLTRRLTADMREAGIDLLLNIDIDYYAKTKVGDLINRLGGEIGRAASYVGNIIRLVIVSVTISVFVCLLLSISWQLTIMATILLSLVTLVNQFAISRSRQFGKILSEMSKAYSIAVLETLNGIRLVKTTANERKEFNRIKRLIRERESADFKAQMNSNAITPLSEFLGVTSLLIIVLLSKTFFADQISTLSAVLLTYLLILLRLLPLVSQLNSLRSSFASMNASVDSVTELLRLDDKPFLINGKIAYNGLKTGITFKSVSFTYPGHDKQVLKDVTLKLPRGTTLALVGGSGAGKSTLADLLPRFYDPTGGCIILDDTDLREFDITSIRKCMGIVSQDTFLFNNSVRNNIAYGKQEATEEEVVAAAKRANAYEFISKLPQQFDTMIGDRGVMLSGGQRQRLAIARALLQNPDILILDEATSALDTVSERLVQGALEELSRDRTTLVIAHRLSTVRKADQIAVLEQGKVVEVGTHEELLQKGGYYSRLYGMQFSN

SEQ ID NO: 18856 - protein, 257 aa, Anabaena PCC7120
MQVIRLAALSDNYIFLLHDSHKNIAAVVDPAEAEPVLKQLAQLKAELVAIFNTHHHNDHVGGNQKLIQKFPQVKVYGGAKDQGRIPGQQVFLQPGDRVQFADRVAEVIFVPGHTRAHIAYYFPPQTDDTPGELFCGDTLFAGGCGRLFEGTPAQMVESLTKLRSLPENTRVWCAHEYTLKNLQFALSVDSKNTELQKRLDEVKTKRSQGIATVPSLLGVEKLTNPFLRWEQPSLQLAVNSNDPVQTFARIRGLKDKF

SEQ ID NO: 18857 - protein, 383 aa, Anabaena PCC7120
QFAKRLEKIPPYLFAEINRKREALIAKGVDIINIGVGDPDKPTPAHILQAMREAIDDASNHNYPPYEGTQEFREAAVEWMERRFGVMDLNPNTEVVSSIGSKEAIHNTFLAFVEAGDYTLIPDPGYPVYRTSTIFAGGEAFSMPLKAENKFLPDLDLIPEEVARKAKMLWINYPNNPTGALATLEFFEELVALCQQYSILLCHDHAYSEMAYDGYKPPSVLQIPGAKDIAIEFHSLSKSYNMTGWRIGFAVGNAYAIKGLSQVKTNVDSGVFKAIQKAAIAAYATDEVELQAVMSVYQSRRDIIVKGLQSLGWPIEPPKATLYVWVPVPPGYTSTEFTTLLLDKCGIVVPPGVGYGASGEGYFRVALTISDERLHEAIQRMQD

SEQ ID NO: 18858 - protein, 309 aa, Anabaena PCC7120
SPILHCLPRVAIIGAGRVGSTLAQRIAEKNLADVVLLDIVEGIPQGLALDLLEARGIELHNRQIIGTNNYADTSGSQIVVITAGFPRKPGMSRDDLLRTNAKIVIEAAKQAIAYSPYAIFIVVTNPLDVMTYLAWEATGLPRNRIMGMAGVLDSARFETFIALELGVLPADVKAMVLGSHGDLMVPLSRYATVNGIPITQLLDAVTIERLVERTRNGGAEIVELMQTGGAFFAPASATSLMVESILLNQSRLLPVSIYLQGEYDLKDVVIGVPCRLGLNGIESVIELNLSDSEREALHISAKSVQKNIE

SEQ ID NO: 18859 - protein, 190 aa, Anabaena PCC7120
  unsure (1)..(190): unsure at all Xaa locations
GAGXKLLLLTFXFNRLQXTLISGQNFFLENQRIFRKFPVIQLRQIVTLVLQEPKFLGMTVQQSPXAYPLILRGLTKETIQQRVSIGAEQLQIPGDWLGRTEVQLSAGQRQLVAIARALVIQPKILLLDEPTSHLDIGIASHLIQVLTQLTQTHHTTIVMVNSQLDFTQMFCNRLLYLQQGRLLVNQTASN

SEQ ID NO: 18860 - protein, 335 aa, Anabaena PCC7120
YDTIIVGAGPAGGAAAYHLAKKGRSVLVLEKESLPRYKPCGGGVSPIVAEWFDFDFSPAISLKVDSFRFTWNLGDPVEAKIETKEPVWMVRRDVFDHFLVQQAQKQGAELRDNTEVTGIEFKSDRWQVDTVNGPVTSRYLIAADGAKGPMAKWLGFKERKRRLAGALEAEVPANVEDKSTIHFEFGLVKNGYIWNFPKEDGYSIGVGTFIGGQPQDFKKILVEYSQLFNIDVKTSKQYGHPIALWDGNQKLHTQNAILAGEAACVVDPMTAEGIRPSIYSGVMAAGAVDKALSGDINALEQYTEIIHESWGAEMAWAQKLAGAFYRFPSVGYQVG

SEQ ID NO: 18861 - protein, 285 aa, Anabaena PCC7120
IWSSLGFGFAELGTVTFVGQPGNPPPRLFRLPLDQAALNRMGFNNHGAAVMAARLADEKGQFSIPIGINLGKSKVTPLEAAAEDYLNSFRLLKELGDYFVVNVSSPNTPGLRSLQDASMLSSILDVLQKENNSHKPIFVKIAPDLEWEAIADIIGLAKTYQLAGIIATNTTIRRDGLKTQVIEQTGKAPQEEAGGISGAPVRDRSTEIIRFIWQQTQGEIPIIGVGGIFTPEDAWAKITAGASLIQVYTGWIYQGPMMVSQILTGLLSKLEEHELNSISEAIGLE

SEQ ID NO: 18862 - protein, 343 aa, Anabaena PCC7120
PHLLRAARGEIVDRPPVWMMRQAGRYMKAYRDLREKYPSFRDRSEIPEVAIEVSLQPWKAFQPDGVILFSDIVTPLPGLGIEMDIAEGKGPIIHAPIRTQAQIEQLRPLEPEAALPFIKTILQALRQEVGNQSTVLGFVGAPWTLAAYAVEGKGSKTYSIIKNMAFSDPTILHQLLSKLADAIAIYARYQIDSGAQVVQMFDSWAGQLSPQDYDTFALPYQQRVFQQIKQTHPDTPLILLVSGSAGVLERMGQSGADIVTVDWTVDMADARARLGKQMKVQGNLDPGVLYASKQFIRDRIIDTVRKAGNWGHILNLGHGVLPDTPEENVAFFFETAKQLNVLV

SEQ ID NO: 18863 - protein, 292 aa, Anabaena PCC7120
MNLTPDSKVIIQGFHEFISENHIAQMKAYGTNLVAGVQPGYGGQELYHLPVFDLVEEVVGQFGSIDTTIICVHPYQVLDAALEAIASHIRQIIIISAGVPPLDMVELLRKAEAGETLVVGPNSPGIIVPGKILLGTQPSEFYTPGVVGIVSRSSTLTYEVARELTQAGWGQSISVSIGSDAIVGSSFLQWLQILDEDETTEAIVLVGQPGGGSEEAAARYIAEAIDKPVIAYIAGRQAPPGKTWRQTGTLATVVGRPPNFGTAQSKITAFEAAEVPVAERPSLIPQLLKKAI

SEQ ID NO: 18864 - protein, 589 aa, Anabaena PCC7120
VSNKLSPLRRLLNYGQKYRGQIYQASTYSVINTVLDLAPPWLVGIAVDILVQQQDSTIAKFGIKEVVWQFALLSLITVIVWIFESLSQYAYDRIWRNVAQNIQHSLRLDAYNHLQKLESAYFEDSSTGGLMSILSDDINQLEDFLNGGANEVIQVTTSLIILIVGAFFILPFNITLAAMLPMPFILWGSLVYQKRLEPRYADVREKVSFLNSRLANNISGITTIKSFTAEKYESARLAEESEAYRKSNAKAIKLSAAFIPLIRMLVLAGFTALLFLGGMAAYSQKISIGNYSVLLVLVQRLLWPLVFLGETFDHYQRGMASTRRVMDLLDTPIQIITGDVPLVVENVRGEVDFKNVTFAYQNSEVIIKDLSLHIPAGNTIAVVGSTGSGKSTLVKLLLRFYDVSHGSITIDGIDIQKLNLSDLRRSIGLVSQDVFLFHGTVAENIAYGTFDASDEAIINAAKVAEAHDFIMRLPQGYETIVGERGQKLSGGQRQRIAIARAVLKNPPILILDEATSAVDNETEAAIQRSLEKITVNRTTIAIAHRLSTIRHSHCIYVMEHGQIVEQGTHEDLIALDGIYTNLWRVQSGV

SEQ ID NO: 18865 - protein, 651 aa, Anabaena PCC7120
  unsure (1)..(651): unsure at all Xaa locations
LARAIGALLQKHNAKGERVLLLYPQGLDVMAAFLGSLYGGVIAIPAPPPDAGRLKRALPRLRAIVKDANAKFVFTNQHLLGVLQAAKLDFPEFEEMTWFASEDIDLELADQWQDPEITPNTLAYLQYTSGSTSTPKGVMISHHNIMHHCAYLQKACGYDTESVSITWMPYFHDYGLVEGLTVPIYNGHPCYVMSPMSFIKQPVRWLQAISRYRGTHSQAPNFAYEQCIRRVTDAQLATLDLSSWVAAGNAAEPINPRVLEEFFEKFAPSGFKWETFAPAYGLAENTLLVSTSPRNTPPVLCLVEKTKIEQNKIVEATTWDDGVRAIPGCGRLVCETQVAIVNPDTLTRCGTDEVGEVWVADPSVAGGYWQRPQESESTFRAKIAGNNQVSFLRTGDLGFIKGGELFITGRIKDLIIIRGTNHYPQDLEWTVQEIHPALRPDYGAAFSIDVDGVEQLVVVQEVKRKPEEEFNSDEVLTNIRQAIAEIHELQAYAVVLVKPGNVLKTSSGKIQRRACKASFLAGELEVLADWSENPKYTASYRRLQGEVNSLLEKVQVTHXGENYAATQAILDAEALEKDLGDPSNPNNVMSFKQVIDLDERKSFPMRLLIGSITGNSSTITSLQNAAVNLPPLTSLSPLCASFPAVTKPQRS

SEQ ID NO: 18866 - protein, 302 aa, Anabaena PCC7120
NQMKNEKWNAENIPPQKGRLAIVTGSSSGIGYETARVLANKQASVIIAVRNLDKGNKALAKILQQNKDADVKLMELDLANLASVKNFAENFRKNYLRLDLLINNAGVMIPPYSKTTDGFELQFGTNHLGHFALTGQLLEFLISTEGSRIVNVSSGAHNMGKIDFDDLNWEQRSYAKWKAYGDSKLANLYFTYELDRKLKDNGIDTLVTASHPGWTATELQRTAGGIVKYLNGIVAQDITMGALPTLRAAIEAGLKGAEYFGPNGFMEMRGYPIKVESNELSKDQALAKKLWVVSEKLTDVKF

SEQ ID NO: 18867 - protein, 1328 aa, Anabaena PCC7120
MFTHVKSTIRHIAPDNLRGRNLIKVVYVVLESQYQSALSQAVRTINANNPNLAIEISGYLIEELRDPENYEEFKREIEGANIFIASLIFIEDLAQKVVAAVEPHRDRLDVAVVFPSMPEVMRLNKMGSFSLAQLGQSKSAIAQFMRKRKEKSGAGFQDGMLKLLRTLPQVLKYLPVEKAQDARNFMLSFQYWLGGSPENLENFLLMLTDKYVLKAVEKQNSASVEYEAPVVYPDLGIWHPLAPSMFEDVREYLNWYTARKDISSDLKDPLAPCVGLVLQRTHLVTGDDAHYVAMVQELEALGARVLPVFAGGLDFSKPVDAYFYEPTTKTPLVDAVISLTGFALVGGPARQDHPKAIDALKRLNRPYMVALPLVFQTTEEWLDSDLGLHPIQVALQIAIPELDGAIEPIILSGRDGTTGKAIALQDRIAAVAQRALKWANLRRKPKLNKKVAITVFSFPPDKGNVGTAAYLDVFGSIYEVMQALRNNGYDVQDLPENAQELMEQVIHDAQAQYASPELNIAYKMSVPEYEELTPYSQRLEENWGPPPGNLNSDGQNLLIYGKQFGNVFIGVQPTFGYEGDPMRLLFSRSASPHHGFAAYYTYLERVWGADAVLHFGTHGSLEFMPGKQMGMSGECYPDNLIGTIPNLYYYAANNPSEATIAKRRSYAETISYLTPPAENAGLYKGLKELSELIASYQTLKDSGRGIPIVNTIMDKCRIVNLDKDINLPETDAKDMTPEERDNIVGSVYRKLMEIESRLLPCGLHVIGKPPTAEEAIATLVNIASLDRQEEEILSLPRIIANSLGRDIDEIYQNNDRGILEDVQLLQDITLATRAAVRALVEEQTNAEGRVSLVSKLNFFNMGKKEPWVESLHQSGYPKVDTSALKPLFEYLEFCLQQVCADNELGALLKGLEGEYILPGPGGDPIRNPDVLPTGKNIHALDPQSIPTAAAVQSAKIVVDRLLARNKADNNGNWPETIACVLWGTDNIKTYGESLAQIMWMVGVRPVPDALGRVNKLELIPLEELGRPRIDVVINCSGVFRDLFINQMNLLDQGVKMAAEADEPLEMNFVRKHALQQAEEMGINLRQAATRVFSNASGSYSSNINLAVENSTWDSEAELQEMYLKRKSFSFNSDNPGMMDESRQLFESTLKTADATFQNLDSSEISLTDVSHYFDSDPTKLVASLRGDGKKPSSYIADTTTANAQVRTLSETVRLDARTKLLNPKWYEGMLSHGYEGVRELSKRLVNTTGWSATAGAVDNWIYEDTNETFIKDEEMQKRLLNLNPHSFRKIVSTLLEVNGRGYWETSEENLDRLRELYQEVEDRIEGIE

SEQ ID NO: 18868 - protein, 362 aa, Anabaena PCC7120
MGNTFGHLFRITTFGESHGGGVGVVIDGCPPLLEISPEEIQLELDRRRPGQSKITTPRKEADTCEILSGVYEGKTLGTPISILVRNKDTRPQDYDEMAQKYRPSHADATYDAKYGIRNWQGGGRSSARETIGRVAAGAIAKKILRQVANVEVIGYVKRIKDLEGVVDPNTVTLDQVESNIVRCPDGELADRMIELIEQTGRQGDSIGGVVECVARNVPKGLGEPVFDKLEADIAKAVMSLPASKGFEIGSGFAGTLLTGFEHNDEYYIDENGEIRTVTNRSGGIQGGIANGENIILRVAFKPTATIRKEQKTVTREGEETLLAAKGRHDPCVLPRAVPMVEAMVALVLCDHLLRHHGQCKVL

SEQ ID NO: 18869 - protein, 195 aa, Anabaena PCC7120
LHLYDFLPSGNGYKVRLLLTQMGIPFERTEVNILKGESRTPEFLSKNSNGRIPVLEVAPGKYLAESNAILLYLSEYTEFLPYDRYLKAQVMQWLFFEQYSHEPYIATSRFWVSILGKVEEYRTALEEKREPGYAALKVMENHLKCHNFFVDERYTIADIALFAYTHVADEGGFDLTPFPAIQAWIDRVKAQPGYI

SEQ ID NO: 18870 - protein, 386 aa, Anabaena PCC7120
GLAYRCYTTSEELEALREGQKAKGEAPRYDNRHRHLTPEQEAEFKAQGRSFVIRFKIDDEREIVWNDLVRGKMSWRGSDLGGDMVIARASENDTGQPLYNFVVVIDDIDMQISHVIRGEDHIANTAKQILLYEAFGAKIPEFAHTPLILNMEGRKLSKRDGVTSISDFKQMGFTSEGLVNYMTLLGWSPPDSTQEIFTLEAAAKEFTFERVNKAGAKFDWAKLDWLNSQYIHNTPVDQLTDLLIPYWEAAGYSLAGGRDRPWLEQLVGLLSASLTRLTDAVDMSKLFFTETVELSEEGSKQLQQEGSKAVLEAIIAALETQAQLTETAAQDIIKQVVKGQNVKKGLVMRSLRVALTGDVHGPDLIQSWLLLNQIGLDKPRLNQAIA

SEQ ID NO: 18871 - protein, 768 aa, Anabaena PCC7120
DFLSHLNPSQRQAVEHYCGPLLVVAGAGSGKTRALTYRIANLILKHRVAPENILAVTFTNKAAREMKERIQRLFAEQLALTEHGKRLDLLPEHEQTKLRSRVYKTTIKELWCGTFHSLFSRILRFDIEKYQDEKGRQWNRNFSIFDESDVQGLIKEIVTKQLNLDDKKFEPRSVRYAISNAKNQGLSPQEFEKDQPNYRGRVIADVYNRYQDKLAENNALDFDDLILIPTRLFQQNEQVLGYWHRKFCHILVDEYQDTNRTQYDLIRLLTTNGEEKKSAWEWQNRSVFVVGDADQSIYSFRMADFTILLDFQNQFGDGLPDEDTRTMVKLEENYRSCENILQVANELIENNTQRIDKVLKPTRGAGEEIYCHKADNELEEADFVIRQIRTLEHQNPELDWGSFAILYRTNAQSRPFEELLVRNQIPYTVVGGMKFYDRKEIKDVIAYLRAISNPSDTVSLLRVINTPRRGIGKATIDNLINASQQLGTTLWEILSDETSVNTLAGRSAKGVNNFAKMINRWQEQIATAPVTEIVMGILEDSGYVQDLQSQGTDESEDRIQNVQELYNAVLQFQEENEDVSLTAFLQSTALSSDLDNLKEGQTAVSLMTLHASKGLEFPVVFLVGLEQGLFPGYRSLSDPAALEEERRLCYVGITRAQERLYLSFARERRLYGSREPAMRSQFLDELPAELITTQYQVRQTYTRPPSTTNGKETANQDWQVGDRVLHKSFGIGEITHVFGAGSKLSVAIKFTSLGQKIVDPRVAQLQKV

SEQ ID NO: 18872 - protein, 242 aa, Anabaena PCC7120
  unsure (1)..(242): unsure at all Xaa locations
LXMEVIRLDKVSLWRRTQEEFSYDLKKTLLSLIEGKYRKPAKKLVLDNVDLVVEKGDKIGIIGANGSGKSTLLKIISGILQPTTGTVRVKGQVAPLIELGAGFDAEISVMDNILLYGVLLGFSRAEMKERANSILEFAELQDYALVPVKGLSSGMVARLGFSIATDVQPNILILDEVLSVGDENFKNKCKQRIDNFWNGDATVLVVSHDLQFVKQYCNQLVWLSHGKIEFIGDSGEAIQHYL

SEQ ID NO: 18873 - protein, 328 aa, Anabaena PCC7120
SEALANPSPDIIASSDRTAKTRQLLGMKGAAPGETSIWKIRLQLMKPITWIPLIWGVVCGAASSGNYTWSLENVLKAATCMLLSGPLLTGYTQTLNDFYDREIDAINEPYRPIPSGAISVPQVVTQIVLLFIAGIAVAFTLDLWAGHEFPNVTVLALFGSFIAFIYSAPPLKLKQNGWLGNYALGASYIALPWWAGHALFGELNWKIAVLTLIYSLAGLGIAIVNDFKSVEGDRQLGLQSLPVMFGINTAAWICVVMIDVFQGLIAAYLVTIHENLYAAILVLLIIPQITFQDMYFLRDPLKNDVKYQASAQPFLVLGMLVAGLALGH

SEQ ID NO: 18874 - protein, 372 aa, Anabaena PCC7120
GIDLGTTNSVGAFKLAEVEVVTANDNTPPDRKLTRSLVAYDQDKLLVGNQAYNQLRADPENVIASIKRLIGRGFSDQAVKKQRLEVGYKITEPSYGTDNSIAVWLGGQEYSPEDISAEILKKVVSNAQAYRQGIGKIDEVIDQAVITIPAYFNDQQRYATRTAALKAGLTPLELLPEPTAAAISYGFSPDSEDVKTILVYDFGGGTFDASLITAAGTSFIEQGKAGDLWLGGDDIDSQIMNFVKTQVAQEEKIGDIDGLIAKMPYYQRLRFNADLKMAVERAKVELSSAQVARISPATQLLDELGIAIPIEVEITRQQFEAMISDLVDRSVQICRLALQDAEYHLEMVDIVLLVGGSSQIPLVQRKVKEAFG

SEQ ID NO: 18875 - protein, 706 aa, Anabaena PCC7120
  unsure (1)..(706): unsure at all Xaa locations
THLLRQIADQVGIAVAQAQLLEVETRQRQELEVARSQAELASHAKSAFLANMSHEIRTPMNAVLGMTGLMLETLLNQEQRDFMETIRISGDALLTLINEILDLSKLEAGEMALENLNFNLSTCVEEVLDLLAPQAHSKGLEIAALIYRHVPIQLQGDASRLRQILMNLIGNAIKFTSFGEVVMRVELRSETPTTAIIHFAVTDSGLGITLEDQHKLFTPFTQVDASTTRKYGGTGLGLAICKQLVTLMGGEIGVESQLGKGSKFWFEIPFAKQLQPVSFVEDCGLLNNRRLLVVDDHATNRKIIYHQVSRWGMQVDQADRAVAALSMIVEACQQNKPYDVILIDMQMPEMDGMALGKQIKANSAIPPTPLIMLTSTNQRDEVQQAIKIGFAAYLVKPVKSSRLLDTIMSVLKTPSQLEAEKLEVKSQELEKNNLDHSRNHNFTATQAQNSVSTKTRILLAEDNLVNQKVALKQLQSLGYTADVAANGKEVLQLLKQIPYDLILMDCQMPILDGLEATKEIHRWAESSFASCRRPVIIAMTANAMKEDKQMCLDAGMDDYLSKPVMKEQLATALEYWVPVNTKFTTGSRVXSKXSSSXWEHLHQLSENDTEFELHLLQIFVEDVRARLELAKEAIANTDFQQMAQQVHQLKGASTNIGATAMYLAAEKLEQLAQNQERRGSMELITEIEEGVNQIQAFLTRSQIVXP

SEQ ID NO: 18876 - protein, 253 aa, Anabaena PCC7120
HKQTALITGAASGIGYELVCIFAENDYNLVLVDRAKEKLEEIAIEFQDKFGISVKPIVRDLSKTTSPEEIFQEVEQANIKVDVLVNNAGFGTYGLFNDTNLTDELEMLQVNVVCTTHLTKLFLKNMVQQGEGKILNVSSAAAFQPGPLMAVYFATKAYVLSFSEALANELDGTGVTVTVLCPGTTQSAFHQRTGMADSKLVKGKRMMDASTVADIGYRGLMQGKTIVIPGLINKIMAKSIRFIPRKLVTKIVR

SEQ ID NO: 18877 - protein, 387 aa, Anabaena PCC7120
MGRVGVLLLNLGGPDKLEDVAPFLFNLFSDPEIIRLPFRWLQKPLAWFIASRRTKTSQENYKQIGGGSPLRRITEAQGEALKEQLHYLGQEANIYVGMRYWHPYTEEAIALLTQDNLDNLVILPLYPQFSISTSGSSFRLLERLWQEDPKLQRLEYTVIPSWYKEPGYLQAMAELIRQEIEQFPHPDQVHVFFSAHGVPKSYVEEAGDPYQQEIEECTALIMQTLNRPNPHTLAYQSRVGPVEWLQPYTEDALKELGAQGVKDLVVVPISFVSEHIETLQEIDIEYREIAEEAGIHNFRRVPAPNTHPVFIRALADLVIDALNKPSFKLSQAAQIKKMVKMYPPESWEWGMTSSAEVWNGRIAMLGFIALIIELVTGQGLLHMIGLL

SEQ ID NO: 18878 - protein, 539 aa, Anabaena PCC7120
MQEYDVVMIGAGHNGLVCAAYLLKAGYSVLLLEKRSVPGGAATTEECLPKEAPGFKFNLCAIDHEFIHLGPVVEELELGKYGLEYLECDPVVFCPHPDGKYFLAHKSLEKTCAEIARYSERDAKKYAEFTEYWQRAIGAMIPMFNAPPKSIIDIVGNYDITKFKDLFSVIGSPNKTLDFIRNMLTSAEDILNEWFDSEFLKAPLARLASELGAPPSQKTIAIGAIMMAMRHNPGMARPRGGTGALIKALVNLVISKGGVILTDQQVEKVLIDDGKAVGVRVSGGTEYRAKYGVISNIDAKRLFLQMTDKSDVDAADPDLWERLERRIVNNNETILKIDLALDEPLRFPFHAHKDEYLVGSILIADSVAHVEQAHSKCTLGEIPDSDPSMYVVMPSYLDPTLAPSGKHTVWIEFFAPYQIAGAEGTGFKGTGWTDELKNQVADKVVDKLATYAPNVKTATIARRVESPAELGERLGAYKGNYYHIDMTLDQMVFFRPLPEIANYKTPIDNLFLTGAGTHPGGSISGMPGRNCARVFLQTK

SEQ ID NO: 18879 - protein, 982 aa, Anabaena PCC7120
MVDLLRQLRDLCSPEGQATKDQAVSAVKLIEQLNINEAIRAARAFALYFQLINIIEQEYEQRQQLTRYSDLEAETAPLNGSENITSSSNHNEDDVIFNRGLGTDFLGKNWTNRGQGKQKGTFAALFPLLSKLNVPPQQIQRLISQLDVRLVFTAHPTEIVRHTIRDKQRQVVDLLQQLDEVENRAKDGGGYPWEAGEIREKLLEEIRLWWRTDELHQFKPTVLDEVDYALHYFQEVLFDGIPQLYKRFKYALNQTFSWLEPPSKDFCSFGSWVGSDRDGNPSVTPEITWQTACYQRKMVLERYIKSVTQLIELLSISMHWSDVLPDLLESLELDQSQLSEVYDALALRYRQEPYRLKLAYVLKRLENTRDRNLALYKGETPTNEDSPMYRSGSEFLAELRLIQHNLTETGLSCRELDNLICQVEIFDFNLTKLDIRQESTRHSDALNEILDYLQLLPQPYNDLSEEQRVAWLTTELQTRRPLISSELPFSDKTNDVIKTFRVVRSLQQEFGINICQTYIISMCRQVSDVLEVLLLAKEARLFDPAIAVGTIQVVPLFETVEDLQRSRSVMRQLFELPLYRALLAGGYKNTEVKVPNTELTPQSPAPSPQSVLTPDLQEVMLGYSDSNKDSGFLSSNWEIHKAQKSLQQIAEEYGVNLRIFHGRGGSVGRGGGPAHEAILAQPGHSINGRIKITEQGEVLASKYSLLDLALYNLETITTAVIQASLLRTGFDDIEPWNEIMEELAARSRQHYRGLIYEQPDFIDFFHQVTPIEEISQLQISSRPARRPSGKKDLSSLRAIPWVFSWTQTRFLLPSWYGVGTALQEFFNEEPEEHLKLMRYFYVKWPFFKMVISKVEMTLAKVDMQMAGHYVQELSDPEDKPRFEKVFEQIANEYYLTRDLVLKITDHGRLLDGDPVLQRSVQLRNGTIVPLGFIQVSLLKRLRQSKNNTATSGVIHSRYSKGELLRGALLTINGIAAGMRNTG

SEQ ID NO: 18880 - protein, 330 aa, Anabaena PCC7120
MTSNLEAQLLALRQEGEQAIAAADTLERLEELRVSYLGKKGQLGALLRSMGQMSAEERPKIGAIANTVKEALQASLDKQRESLESAQIQAQLDAETLDVTMPGIYKPQGRIHPLNGIIDRALDVFVGLGYTVAQGLEMETDYYNFEALNTPPDHPARDMQDTFYLPDGNLLRTHTSSVQIRYMEKEEPPIHIVAPGRVYRRDNVDATHSAVFHQIELLAIDEGLTFTDLKGTIKVFLQAMFGDLPIRFRASYFPFTEPSAEVDLQWNGRWLEVMGCGMVDPNVMKSVGYNPEIYTGFAAGFGVERFAMVLHQIDDIRRLYASDLRFLRQF

SEQ ID NO: 18881 - protein, 285 aa, Anabaena PCC7120
MKFYKYHALGNDYLVINPQDLKFPLTPEKIKIICHRNFGIGSDGILLGPLASTKAQFALRIFNPDGSEAEKSGNGLRIFSRYLWDMGLVDEKPFSIETAGGIVESAIKDAGKTVQVEMGKVSFWSRDIPVIGDDREVIQEKIFLDEGIFTFCAATIGNPHCVILLDDINSEVARNFGPIFEGYPLFPNRTNVQFMKVLDRSTIQIEIWERGAGYTLASGSSSSAAAATAHKLGLCDSKIIVKMPGGDILIQIKDDFHISMTDSVTKLAQGELSTEIFAIETVINI

SEQ ID NO: 18882 - protein, 383 aa, Anabaena PCC7120
ASSTPQGFSTFITNLGIRDTTEDFVFLRSDVPCVADGVFTQSLFAGPSVTISRQNLQDGQAQGIIIISKNANVANGAVGIADAQEIIQLVAQETGIAAENLAIASTGVIGRRYPIEKIRAGLVGMGQKLTAADFDLAARGIMTTDTVSKIAARQVGNAKLVGIAKGVGMIEPNMATMLAFFFTDAAISANTLRQIFRSTIDKTFNCLSIDTDTSTSDSAVILANGLAGEVPEAEFASALQEIAHDLVLKIARDGEGATKVIEVTVDSAANYAQAKRVAKAIVNSPLVKTAVYGADPNWGRVAMAIGKCEDERDINPDQVVIRFDEVQVYPNTFQAENLEKLKEIMSKEKVNIHVSLNIGTDVATVWGCDLTEGYVEINGKYST

SEQ ID NO: 18883 - protein, 203 aa, Anabaena PCC7120
DTVFVGSDASVSTGNGNDQIFIGVESPASNTTANGGNGDDEITVIEAGGSNNLFGAAGNDTLQVIEGSRQFAFGGSGNDTLTSNGSYNRLNGGSGDDKLFSSVNDSLFGGDGDDVLFAGQAGSNRLTGGAGADQFWIANGSLPTSKNTVTDFAVGVDKIGLGGIGVTQFSALSLVQQGADTLVKLGATELVALQGITSTSLSV

SEQ ID NO: 18884 - protein, 359 aa, Anabaena PCC7120
MNQNKRALITGITGQDGSYLSEFLIEQGYEVHGIIRRTSTFNTDRIDHIYEDPHQEGARLFLHYGDLTDGTTLRRILEEVQPTEIYNLGAQSHVRVSFDSPEYTVDAVGMGTLRLLEAIRDYQRRTGIQVRFYQAGSSEMYGLVQAVPQSETTPFYPRSPYACAKVYAHWQTVNYRESYGLFACNGILFNHESPRRGETFVTRKITRAVAQIVAGNQKSIYMGNLDAKRDWGYAKDYVRAMWLMLQQEQPDDYVVATGETHSVREFLELAFSYVNLNWQDYVEFDERYLRPAEVDLLIGDPTKAQQKLGWKPSVTFNELVALMVEADLQALGQTSPNGNTSILPQDIATIRQQLGVLHF

SEQ ID NO: 18885 - protein, 295 aa, Anabaena PCC7120
MVNDIEYIRQAEATRVQVLSEALPYIQQFAGRTVVVKYGGAAMKDSHLKDQVIRDIVFLSCVGLRPILVHGGGPEINSWLDKLGIEAQFKNGLRVTDAPTMDVVEMVLVGRVNKEIVSLINQAGGLAVGLCGKDGNLITARPQGQEGIGFVGEVSNVNIKILETLASNGYIPVVSSVAADDSGQAYNINADTVAGEIAAALGAEKLILLTDTRGILKDYQDPGTLIPKVDIREARELINSGVVSGGMIPKVTCCVRSLAQGVRAAHIIDGRIPHALLLEIFTDVGIGTMILGSQY

SEQ ID NO: 18886 - protein, 609 aa, Anabaena PCC7120
NKRWRNAGLYALLFIVVIALGTAFFEKQPQSRESWRYSQFIQEVEKGRVERVSLSADRSTALVTPKYDPSKKLVTLVNDPELINTLTARGVDITVLPQTDEGFWFKALSSLFFPVLLLVGLFFLLRRAQSGPGSQAMNFGKSKARVQMEPQTQVTFGDVAGIDQAKLELNEVVDFLKNADRFTAVGAKIPKGVLLVGPPGTGKTLLARAVAGEAGVPFFSISGSEFVEMFVGVGASRVRDLFEQAKSNAPCIVFIDEIDAVGRQRGAGLGGGNDEREQTLNQLLTEMDGFEGNTGIIIIAATNRPDVLDAALLRPGRFDRQVVVDRPDYAGRSEILKVHARGKTLAKDVDLDKIARRTPGFTGADLSNLLNEAAILAARRNLTEISMDEINDAIDRVLAGPEKKDRVMSEKRKVLVAYHEAGHALVGALMPDYDPVQKISIIPRGRAGGLTWFTPSEDRMDTGLYSRAYLENQMAVALGGRIAEEIIFGEEEVTTGASNDLQQVARVARQMITRFGMSDKLGPVALGRQQGNMFLGRDIMSERDFSEETAAAIDEEVHKLVETAYTRAKEVLVNNRHILDQIAQMLVDKETVDADELQEILANNDVKTA

SEQ ID NO: 18887 - protein, 728 aa, Anabaena PCC7120
SPALQQPLTPPEQTPQSPTPVTLSYPFVSSWNTGAACLTMAAQHLENAVNLEWVQRQLRGQSPKQVVEAGEKLGFVLRRLQMTWAELRQLTFPALLLLQAESTPDPSWVIAYGVKGDRLIIANPLNPDNLCESLPQSVVEQCWDGQLWQVELISKQEKFNLSWFTPAVWKYRKLLAEVLLASFTLQLLGLGTPLITQVVIDKVMVQESLPTLDVMAIALLLIAVFESILGILRLFIFTHTARRLDLSLSAQLFRHLMRLPLAYFESRRVGDTVARVQELEQIRQFLTGTALTVILDSIFAVVYLALMFYYNIPLTFVALAVLPLFATLTIVATPILRNWLNETFNRSADSQSFLVETVTGIHSVKAHAAESVARDRWEGLFARFVRTGFKASTTSNISSNIGDFLTNFSSLLILWFGAKLVIDQKLTIGQLVAFQMLSGRVTGPLLRLVQLWQNLQQVLLSVDRIGDILNVAPEAEMGTGLVLPPLKGQVSFEQIFFRYKTNTEPVLRGISFNVEPGQFVGIVGRSGSGKSTLSKLLQRLYQIESGRILIDGFDIKSADLSSLRQQIGVVLQEDFLFNGSILENITLGNPDITAEQVVEAARLAVAHDFISQLPYGYETNVGERGTALSGGQRQRIALARLFLSDSPILVLDEATSALDSETEQQVLQNLQKISANRTVFLIAHRFAPLKRADLILVLEKGVIAERGTHPELLQQKGLYWSLYQRQQA

SEQ ID NO: 18888 - protein, 309 aa, Anabaena PCC7120
MIEVEHLSKTYGSTPAITDVTFSVEPGEILGFLGPNGAGKTTTMRILAGYLPASSGTAKIAGFDVHDNSLAVRQRIGYLPETPPLYTDMTVEGFLHFVARIKGVSAGDRSLKVNAAIKRCNLEDRRKVIIRKLSKGYRQRVGIAQAIVHDPPAIILDEPTVGLDPRQIIDVRNLIKSLAGTHTVILSTHILPEASMTCNRVAIINRGKVVATNTPEHLMTQLTGGSGYEIEVEGEITLAKQVLQKVPGVSLVESIPGHHLPRENRAYLRVLSKPGSEAGKDIATSLISSGFGLYEMRRVSATLEDVFLQ

SEQ ID NO: 18889 - protein, 289 aa, Anabaena PCC7120
TLKLRGMSCASCAKSIEDTISSVPGVNECSVNFGAEQATVNYDPRKTDLQAIQNAVDAAGYSASPLQEQNLMAGEDDEEKRYRLQESRDLMRKLTVGGIIGIVLVIGSLPMMTGLDLPLIPIWLHNPWLQLVLTTPVQFWCGYSFYINTWKAFQRHAATMDTLITLGTSAAYFYSLFATLFPSFFIAQGLMPDVYYETAAIVITLILLGRLFENRAKGQTSEAIRKLIGLQVKTARLIRNGREVDVPIEEVEIGDVVLVRPGEKIPVDGEVVDGTSTVDEAMVTGESIP

SEQ ID NO: 18890 - protein, 721 aa, Anabaena PCC7120
EAAECGAASLAIILAYYDSIVPLAELRIECGVSRDGSKASNIILAARRYGMVADGFKAEHLEQLQDLTPPYIVFWNFNHFLVVEGLSKHWVFLNDPATGPRRVSWEEFDESFTGVVLVMEPGADFNKGGRKPSVILGLIDRLRGSIGSILYCIFAGFFLVLPGLAIPVFSQVFVDHVLVESRTEWLRPLILGMILTTVFQGLLTLLRLRYLRKLRIKLAVGMSTRFLWHILRLPVRFYAQRYAGEVSNRASLNNKVAEVLSGQLATTVIDVVMILFYALVMFAYDWVLTLIGICFTAINGLALQWVARHRVDANIRLIQDWGKATAVSIAAIQSIETLKASALESDFFSRWSGYYAKAVSAQQDLEVTNQILGILPILLASLTSMLILVVGGWRVMDGNLSIGMLVAFQSLMLSFQQPVNTLVDFGTTLQELEGDLNRLDDVLSNSLDPEVEMVSREAGEQREQGRGGDEEKSKIENPKSKIQNLQGYVELRNITFGYSHIDPPLIEDFSLSLQPGQRVALVGASGSGKSTLAKLICGLYQHWEGEILFDGIKRSEIPRHVLASCLSLVEQDIFLFGGTVRDNLTLWDATVPDEQLVQACQDAAIHEAVMAIPGGYDGELLEGGANLSGGQRQRLEIARALVKNPAILVMDEATSALDAQTEQIIMENLRRRNCSCILVAHRLSTIRDCDEIIVLEQGKVVQRGTHDELWQEGGVYERLIR

SEQ ID NO: 18891 - protein, 203 aa, Anabaena PCC7120
DTVFVGSNASVSTGNGNDQVFIGVDSPASNTTANGGHGDDEITVIEAGGSNNLFGAAGNDTLQVIEGSRQFAFGGSGNDTLTSNGSYNRLNGGSGDDKLFSSVNDSLFGGDGDDVLFAGQAGSNRLTGGAGADQFWIANGSLPTSKNTVTDFAVGVDKIGLGGVGVTQFSALSLVQQGADTLVKLGATDLVILQGITSTSLTV

SEQ ID NO: 18892 - protein, 430 aa, Anabaena PCC7120
  unsure (1)..(430): unsure at all Xaa locations
VMQAEYRQRREQLMAKIGSGTGIFRSAPMAVMHNDVEYTYRQDSDFFYLTGFNEPQAVAVLTPHHPEHRFILFVQPKDREKEVWTGYLCGVDAAKEIYGADEAYPISELDEKLPQYLEKAERIYYHLGRDRNFNDKILGHYQQLLRTYPKRGTGPIGIEDTGPILHSMRLIKSESELVQMRQAAAIATESHNKALESSAPGLYEYEIQAEIEHIFRLRGAMGPAYPSIVASGANACVLHYIENNRQMQDGDLLLIDAGCAYGYYNSDITRTFPVNGKFTPEQKILYEIVLEAQKQAIAQVQPGNSFKSVHDTAVRVLTEGLVEIGILKGEGXQIIEEEKYKPYYMHRTSHWLGLDVHDXRRYQHGDDKPQILQPGQVLTVETQTIYGPDSKLAEDQPETDPVWVGIGLALRDDVWXTATGHEFKLGEXPK

SEQ ID NO: 18893 - protein, 579 aa, Anabaena PCC7120
  unsure (1)..(579): unsure at all Xaa locations
WXXRPDSTAMGYQQWSMPXDIXGHTSRVRSVVFSPNSLMLASGSSDQTVRLWDISSGECLYIFQGHTGWVYSVAFNLDGSMLATGSGDQTVRLWDISSSQCFYIFQGHTSCVRSVVFSSDGAMLASGSDDQTVRLWDISSGNCLYTLQGHTSCVRSVVFSPDGAMLASGGDDQIVRLWDISSGNCLYTLQGYTSWVRFLVFSPNGVTLANGSSDQIVRLWDISSKKCLYTLQGHTNWVNAVAFSPDGATLASGSGDQTVRLWDISSSKCLYILQGHTSWVNSVVFNPDGSTLASGSSDQTVRLWEINSSKCLCTFQGHTSWVNSVVFNPDGSMLASGSSDKTVRLWDISSSKCLHTFQGHTNWVNSVAFNPDGSMLASGSGDQTVRLWEISSSKCLHTFQGHTSWVSSVTFSPDGTMLASGSDDQTVRLWSISSGECLYTFLGHTNWVGSVIFSPDGAILASGSGDQTVRLWSISSGKCLYTLQGHNNWVGSIVFSPDGTLLASGSDDQTVRLWNISSGECLYTLHGHINSVRSVAFSSDGLILASGSDDETIKLWDVKTGECIKTLKSEKIYEGMNIT

SEQ ID NO: 18894 - protein, 475 aa, Anabaena PCC7120
QAFEQAQLKKSKEAADLANHAKSEFLANMSHELRTPLNGILGCAQILQRSSTLPEQEQHHINIIEQCGSHLLTLINDILDLAKIEAKKLELHGEDVHFPSFIQGIAEICQIRAAQKDILFVYEPASNLPIWLHIDAKRLRQVLLNLLGNAIKFTDHGQVKLKVETIEESSTQKPVKHRIRYCIEDTGIGITDAELSKIFLPFEQVGEKKRQTEGTGLGLAITRQLVQMMGSDIHVTSQVGHGSTFWFELEMVATNEWVQSMMTTSARKIIGFEGNPRRILIVDDRWENRTVLNDLLQPLGFEIMEAVNGQDGLEQAIAISTDLIITDLLMPEMDGFTLIQNLRQIPQFKNLKIIVSSASVFESDQHRSLAVGGDDFLSKPIQANELLRQLERHLNLVWIYQPSESETQAISDVVTQNNDPSTQLITPPPEVLRELLTLAKKGNFNAIIKCADQLEAEDTNLATFAHQLRQLARQF

SEQ ID NO: 18895 - protein, 321 aa, Anabaena PCC7120
PKDSRQRSQQFMQNLQDEICTALEQLDGKASFHQDHWERAEGGEGRTRVIREGRVFEQGGVNFSAVWGNSLPASILAQRPEAAGHEFFATGTSMVLHPRNPYVPTVHLNYRYFEAGPIWWFGGGADLTPYYAFKEDAVHFHQTLKNACDVHNPEYYPTFKRWCDEYFYLRHREEQRGIGGIFFDYQDASGKLYVESQTDSSVAIYSQKVGNVARNWEDIFAFVQSCGQAFLPAYLPIVERRQGIEYGDRQRNFQLYRRGRYVEFNLVYDRGTVFGLQTKGRTESILMSLPPLARWEYCYEPEAGSPEAELTEVFLQPRDWV

SEQ ID NO: 18896 - protein, 280 aa, Anabaena PCC7120
  unsure (1)..(280): unsure at all Xaa locations
SQYDGIVIDGHFIPCVSVRNPAELPWGKLGADYVVXSTGLFTDSEGASKHLQAGARRVIISAPTKDPDRVRTLLVGVNHDLFDPSKDLIVSNASCTTNCLAPIAKVINDNFGLTEGLMTTVHAMTATQPTVDGPSKKDWRGGRGAAQNIIPSSTGAAKAVALVLPELKGKLTGMAFRVPTPDVSVVDLTFKTAKATSYKEICAAMKQASEGSLAGILGYTDEEVVSTDFQGDTHSSIFDAGAGIELNSNFFKVVAWYDNEWGYSNRVVDLMLSMVQKEQL

SEQ ID NO: 18897 - protein, 485 aa, Anabaena PCC7120
  unsure (1)..(485): unsure at all Xaa locations
RRTKIICTVGPATSAPERLEALVEAGMNVARLNFSHGAYDFHAQTAQYLRQISADRQKPVAIMQDLCGPKIRLGTLPPEGLMVEAGQEVTFVLQEKGSSLDELPLPLPTLFAMVRPGEPILINDGRVKLIVTDRDADRIRAIAKIGGLLSTRKGVNLPATRLPVSSITEKDLQDLRFGIDLSVDWVAVSFVRSPYDLEPAQRMIEAAGKTIRVIAKIERPEAVEQIDSIIDVADAIMIARGDLGVEMPIHEVPLIQKDIIRRCNQAGKPVITATQMLESMISAPDPTRAEATDVANSILDGTDAVMLSGETAVGQYPVAAVQVMHDIAVTTEKSLQEGSKHCLSHEAGGLSVTESVAEAVCRIAYETGAKAILCNTTSGSTAKLVSKYRPTTPIFALTPDETAYHQLALSWGVEPLLTPPVHNAEEMFMNLINTAVRTGLVHDGDKVVITSGVPIGKSGTTSLIKVHSIGQPITAXYSXNKSEAF

SEQ ID NO: 18898 - protein, 332 aa, Anabaena PCC7120
MTKNLLEQLREMTVVVADTGDIQAIEKFTPRDATTNPSLITAAAKMPEYQEIVDQTLLQAKKDAGAGASKGQIVSLAFDRLAVSFGLKILQIIPGRVSTEVDARLSYDTEATITKARELIAQYKAAGIGPERVLIKIASTWEGIKAAEILEKEGIHCNLTLLFGLHQAIACAEAGITLISPFVGRILDWYKKETGRDSYPSAEDPGVLSVTTIYNYYKKFGYKTEVMGASFRNIGEITELAGSDLLTISPGLLGELQATIGELPRKLDPAKAATLDIDKISIDKATFDKMHAADRMAYDKLDEGIKGFTKALEELETLLAERLARLEVVASH

SEQ ID NO: 18899 - protein, 278 aa, Anabaena PCC7120
MTNQAPIPVIVNGAAGKMGREVVKAVAQAPDLNLLGAIDSSPEHQGKDAGELAGLSEPLEVPITNQLEPMLGYVAGERQGPPGVIVDFTHPDSVYDNVRSAIAYGIRPVVGTTGLSPAQIQNLADFAEKASTGCLIIPNFSIGMVLLQQAAVTASQYFDHVEIIELHHNQKADAPSGTAIQTAELLAELGKTFNSAIVEETEKIPGARGSLAEEGIRIHSVRLPGLIAHQEVIFGAPGQIYTLRHDTSDRACYMPGVLLAIRKVLQLKSLVYGLEKIL

SEQ ID NO: 18900 - protein, 344 aa, Anabaena PCC7120
ISGLVAAYELTAVGHDVTLLEASKRIGGRVLTLRGAFQGEDLLELGAARIPSNHHLTFGYIKHFGLKLSQFAPADGKYLTIKDGKRLLIPAKVLFQNQPQIRPQEIQKLTDGFDLLPKAFAQALTKEIKLDEPVARIVQTSNGVEVSCLSGQRYLGDYVLCTVPLTVLNQITFSPELSEEKKQAAAGGYNYRAATRGFVKFPNRFWERENLNGWGFFDDEELWHTTWDRPEKTGILHAYLKGEKGLEIDGFEGKTQQQKLLQHWEKILPGVSNYSVRSYFHSWTKDIWSKGGWAYPTDEQEKKLFPELGKSEGKIYFAGEHTSKTRGWLQGALESGLKAAQEIH

SEQ ID NO: 18901 - protein, 333 aa, Anabaena PCC7120
KQTWSQRFESALHPAIALFNASISFDIELIEYDLTGSQAHAQMLAHTGIISPAEGEQLVAGLEQIREEYRQGKFQPGIDAEDVHFAVERRLTEIVGDVGKKLHTARSRNDQVGTDTRLYLRDQILQIKTQLREFQRVLLDIAEKNVETLIPGYTHLQRAQPVSLAHHLLAYFQMAQRDWERLGDVYRRVNISPLGCGALAGTTFPIDRHYTAELLQFERIYENSLDGVSDRDFAIEFLCAASLIMVHLSRLSEEIILWASEEFRFVILKDSCATGSSIMPQKKNPDVPELVRGKTGRVFGHLQAMLVIMKGLPLAYNKVLQEAKEGLFDNVKT

SEQ ID NO: 18902 - protein, 532 aa, Anabaena PCC7120
MILAADAWPIPPIYRISLLILLSTWMRATFNYFGGVYTESAQLNLADRLHKQIFEQLQALRLSYFAQTRSGELINTITTEIERIKQGFSGLAFVLTRIMTVCVYFVVMFSISWQLSIISVLIFLLLAVGLSTLNKRVRETSFGISHANAQFTAVAVEFINGIRTIQAFGTQEFERQRFYKASTNQLNAAIKVVLAWTLVKPIAEGIATTVLISLIVISFATFTLPVASLLTFFFVLVRVIPNIQDINGTVAFLSTLQGSSENIKNILQTNNKPYLKNGKLHFQGLKRSIDLVSVDFGYTADNLVLNNITLTIERGKTTALVGASGAGKTTLADLIPRFYDPTEGQILVDGLDVQYFEINSLRRKMAVVSQDTFIFNTSIRDNIAYGTSGASEAEIREVARLANALQFIEEMPEGFDTKLGDRGVRLSGGQRQRIAIARALLRDPEILILDEATSALDSVSERLIQESIEKLSVGRTVIAIAHRLSTIAKADKVVVMEQGRIVEQGNYQELLEQRGKLWKYHQMQHESGQTNS

SEQ ID NO: 18903 - protein, 415 aa, Anabaena PCC7120
GDQMSNLTGVRAIMKDIIETLKSGGGQDLINLSAGNPLILPEVEQLWRDCTAELLASQEYGEVVCRYGSSQGYAPLIEAVVKDFNRRYGLNLTDRNILITPGSQTLYFYAANVFGGYTSSGDLKQIVLPLSPDYTGYGGICLVPEALVAYKPSLDIDAAAHSFKYRPDFSQVSISESTGCVIFSRPCNPTGNVLTDDEVRKIAALAAPYNVPVLIDSAYAPPFPALNFTDMSLIFGENILHCTSLSKAGLPGERIGIAIGNERLIQVLESFQTNASLHSSRYGQAIAARAINSGALAQIAEQVIRPFYKNKFAIVENALEAAMPKELPWFLHRGEGAIFSWLWLQDLPITDWELYQELKKVGVIVVPGSTFFPGLKEEWAHKHQCVRISLTGSDTEIALGMQRLAKAVEQIYQRT

SEQ ID NO: 18904 - protein, 369 aa, Anabaena PCC7120
VEVKAAIAYGAGKPLTIETVQLEGPKAGEVLVEVKASGVCHTDAYTLSGNDPEGLFPAILGHEGAGVVVDVGAGVTSVKPGDHVIPLYTPECRQCAYCLSFKTNLCQAIRGTQGRGVMPDGTSRFSINGQMIHHYMGTSTFANYTVLPEIAVAKIREDAPFDKVCYIGCGVTTGIGAVIYTAKVEAGANVVVFGLGGIGLNVIQGARMVGANMIVGVDINPSKRALAEKFGMTHFVNPQEVEGDLVAYLVDLTKGGADYSFECIGNVNVMRQALECCHKGWGVSVIIGVAGAGQEISTRPFQLVTGRVWKGSAFGGARGRTDVPKIVDWYMDGKINIDDLITHVMPIEKINDAMDLMHRGESIRSVVTF

SEQ ID NO: 18905 - protein, 478 aa, Anabaena PCC7120
  unsure (1)..(478): unsure at all Xaa locations
TIKLWDVSQGKCLRTLKSHTGWVRSVAFSADGQTLASGSGDRTIKIWNYHTGECLKTYIGHTNSVYSIAYSPDSKILVSGSGDRTIKLWDCQTHICIKTLHGHTNEVCSVAFSPDGQTLACVSLDQSVRLWNCRTGQCLKAWYGNTDWALPVAFSPDRQILASGSNDKTVKLWDWQTGKYISSLEGHTDFIYGIAFSPDSQTLASASTDSSVRLWNISTGQCFQILLEHTDWVYAVVFHPQGKIIATGSADCTVKLWNISTGQCLKTLSEHSDKILGMAWSPDGQLLASASADQSVRLWDCCTGRCVGILRGHSNRVYSAIFSPNGEIIATCSTDQTVKIWDWQQGKCLKTLTGHTNWVFDIAFSPDGKILASASHDQTVRIWDVNTGKCHHICIGHTHLVSSVAFSPDGEVVASGSQDQTVRIWNVKTGECLQILRAKRLYEGMNITGVTGLTKATIFTLQALGALRXLNSAARLKC

SEQ ID NO: 18906 - protein, 147 aa, Anabaena PCC7120
GNILSAAFSPEGQLLATCDTDCHVRVWEVKSGKLLLICRGHSNWVRFVVFSPDGEILASCGADENVKLWSVRDGVCIKTLTGHEHEVFSVAFHPDGETLASASGDKTIKLWDIQDGTCLQTLTGHTDWVRCVAFSPDGNTLASSAAD

SEQ ID NO: 18907 - protein, 606 aa, Anabaena PCC7120
NRLVGHGDVVTRVKFSPDGEKLASASWDKTVKIWQRDGKLLHTLRGHTDAVWSVNFSPDGKMLVSASRDKTVKVWRVEDGQEIATLTHQNWVACIGFSPDSKTVASMEWNGTMRLWNLQGQELKSFPTHKAPVVAVHFSPKGNMIATASRDGTAKVWSLDGKELLSLGGHKNWVMYVNFSEDGKNLVTASRDKTAKIWDLQGKELATLRGHSDTVASAVFSRDGQTIATASSDKTVRLWNRKGEELQVFWGHTDAVWGVNLSKDGKLLVSSGEDGTVRLWNMENGEAGKFQSLSFNLGEAAAGTISFSPDGKILGTTGRYTMAKLWNHQGQELVTLNGHSDTLRSLQFSPDGQIIATASRDKTVKLWNLNGKERATLHGHQADVRSATFSPDSKTIASASWDTTVKLWNLNGREIMTLRGHQAGVRNVSFSPDDQIIATASEDGTAKLWNRQGQELVTLKGHQAGIQAVSFSPDSQVIATASKDKTVKLWNRQGKELLTLLGHRGEVNAVSFSPNRETIATASEDMTVKLWNLKGGQMQTLSGLDAGVKSVSFSPDGKVLASSDSLGKVTLWNLDFDSSPEKLLAQACNCVRDYLLNSADIKEHER

SEQ ID NO: 18908 - protein, 142 aa, Anabaena PCC7120
ILVLHGPNLNLLGKREPGVYGSTTLAEINSLLAEAALKLQAKVFPLQSNHEGVLVDAIHEALGKHQGILINAGAYTHTSVALRDAIAAVNLPTVEVHLSNIYRREDFRHHSYIAPVVIGQISGFGVQSYLLGLQGLVAHLKG

SEQ ID NO: 18909 - protein, 379 aa, Anabaena PCC7120
ADRIQQLPPYVFARLDELKAKAREQGIDLIDLGMGNPDGATPQPVVDAAIQALQDPKNHGYPPFEGTASFRRAITNWYNRRYGVVLDPDSEALPLLGSKEGLSHLAIAYVNPGDVVLVPSPAYPAHFRGPVIAGGTVHSLILKPENDWLIDLTAIPEEVARKAKILYFNYPSNPTGATAPREFFEEIVAFARKYEILLVHDLCYAELAFDGYQPTSLLEIPGAKDIGVEFHTLSKTYNMAGWRVGFVVGNRHVIQGLRTLKTNLDYGIFAALQTAAETALQLPDIYLHEVQQRYRTRRDFLIQGLGELGWDVPKTKATMYLWVKCPVGMGSTDFALNLLQQTGVVVTPGNAFGVAGEGYVRISLIADCDRLGEALDRIK

SEQ ID NO: 18910 - protein, 355 aa, Anabaena PCC7120
LITLAVAPAKVIRGCNILQVAATEIAKLGSRPLIVAGNSTVAISQEKLQPILEAQNLHVAQASYGADCAEVSLKALRKAAKEHKADTIIGIGGGKALDTAKLVAHQLDIPIVTIPTSAATCAAWTALSNVYSEDGAFLYDVALSRCPDLLILDYDLIQTAPQHTLVAGIGDAIAKWYEASVSSGHLEQTLIISAVQQARVLRDILFQKSAIALQQPGSEAWREVVDATVLLAGVIGGLGGAQCRTVAAHAVHNGLTHIAGHSSIHGEKVAYGILVQLRLEEMVQGNQLAAASRQQLLKFYAEIGLPQKLGDLGLGNITLGELQTAAEIALTPQSDIHRLPFKVVLEQLMAAMVST

SEQ ID NO: 18911 - protein, 663 aa, Anabaena PCC7120
  unsure (1)..(663): unsure at all Xaa locations
KLRKISERLTLAISSGRFGIWEFDCVQEKVIWDERMYELYGVHPEDFPGNFDAWLSFVHPDDQDYLLVTIQQVLHQNQEYDAEFQIIQPSGEIRVIKAYGVLNCDEQGKPILMVGINIDITERKQAEQELIHNRDLREVIFNESADALFLVDPVTLLTLDCNRRTVELFEATNKGELLGIEGRTLQRRPFTSNEIDTIVTQMQTKGFWSQEIEYVTLKGKLFWGNIAAKPITIAGRTLNLVRVTDINERKQAEEKLLRTNEQLAKANAELARATRLKDEFLANMSHELRTPLNAILGMSEGFIEGVFGAINQKQAKAIATIKRSGKHLLELINDILDLSKIESGKLELQISDVSVRSICDGSLTFIQQMALKKNICLSTHIGSNLDTIQVDDRRLRQVLINLLSNAVKFTPEGGNVKLTVWLEEVGANKPXGQKNSYLQSSIPSPHICFRVTDTGIGIASEDISKLFQPFTQLDSSLNRNYTGTGLGLALVKRITTLHGGTILVNSEVGQGSCFTVRIPYLSGDNSLKKLQDPERVDLPATLIPKTLTIPVILLAEDNQANIDTISSYLESRGYEMVLAENGQQALDFAREKCPDLIIMDIQMPGMNGLEAIRQIRNEQKFIDIPIIALTALAMPSDRTTCLAAGANEYLTKPIKLKQLVLTI

SEQ ID NO: 18912 - protein, 455 aa, Anabaena PCC7120
AMAIATINPATGETLKTFEPLNDVEIAAKLDLADQAFEKYRHTSFAERSQALQAAANILEQEKADFAKLMTLEMGKPYKAAIAEVEKCAAVCRYYAENAADFLADVSVKTDASHSFVRYQPLGIILAVMPWNFPFWQVFRFAAPALMAGNVGLLKHASNVPQCALAIEDIIHRAGFPKGVFQTLLIGAAKVADLIADERVKAATLTGSEPAGASLAAAAGKQIKKTVLELGGSDPFIVLESADVEAAAATATSARMLNNGQSCIAAKRFIVAEAIADQFEKLLLEKFTALKIGDPLHPDTDLGPLATPDILQDLDQQVQTAVKSGGKVLTGGYPLADRPGNFYPATIIIDIPVDQPIAQEEFFGPVALLFRVPDIDTAIQLANATPFGLGASAWTNNDQERDRLISEIEAGAVFINGLVKSDPRLPFGGIKRSGYGRELSIQGIHEFVNVKTVWV

SEQ ID NO: 18913 - protein, 812 aa, Anabaena PCC7120
PKVQAAREQEPAMFEHFTSEAIKVIMLAQEEARRLGHNFVGTEQILLGLMGEGTGVAAKVLTEMGVTLKDARREVEKIIGRGSGFVPPEIPFTPKVKSLFEQSFREAHNLGNNYINTEHLLLGLTEAGEGVAAKVLQNLGVDLKSVRSAVIRRLGEDPTVVVGGGGSRRNQTPMMEEFGRNLTKLAKEGKLDPVVGRQKEIERTVQILGRRTKNNPVLIGEPGVGKTAIAEGLAQRIINQDVPDILQDKQVVSLDMGSLVAGTRFRGDFEERIKKIVEEVRSAGNIILVIDEIHTLVGAGGTEGGLDAANILKPALARGELQCIGATTLDEYRQYIERDAALERRFQPIMVGEPSVAETIDILYGLRGAYEQHHKVHISDEAVVAAAQLADRYISDRFLPDKAIDLIDEAGSRVRLRNSQISPNKELKRQLTDITKSKNEAVRLQDFDKAAKLRDEEIALETELQAATTGQTIKPVVDEEDIAQIVASWTGVPVNKLTESESELLLHLEDTLHKRLIGQEQAVTSVSRAIRRARVGLKSPNRPIASFIFSGPTGVGKTELAKALAAYFFGAEDAMIRFDMSEYMESHTVSKLIGSPPGYVGYDEGGQLTEAVRRRPYTVLLFDEIEKAHPDVFNMLLQLLDDGHLTDAKGRKVDFKNTLIILTSNIGSKVIEKGGGGLGFEFDNQAEASYNRIRNLVNEELKNYFRPEFLNRLDEVIVFTQLSRDEVKQIADIMLRDVASRLTEKGITLEVTERFKELVVTEGYNPSYGARPLRRAIMRLLEDSLAEVLLSGEITEGDTAIADVNDDGQVQI

SEQ ID NO: 18914 - protein, 413 aa, Anabaena PCC7120
MADWQEITGGITAPKGYRAAGITAGLKPSGLPDLALIVSDVEAIASGVFTTSQVKAACVDYCRQRLQAKQSARAILCNAGQANAATGSQGIKDAEESAELLAKELNISPELILLASTGVIGQRIKMDALRNGIPKLIASLTDTGSDAAAGAIITTDLVTKSIALETTIGDRPVRIGGIAKGSGMIHPNMATMLAFVTCDAAVSSHLWQQMLTRAADRSFNSITVDGDTSTNDSLIALANGQSRTPAITEVGAESEKLEAMLTAVCQHLAKAIARDGEGATCLIEVQVTGAHDEQAARQIAKTIAGSSLVKSAIFGRDPNWGRIAAAAGRAGVPFEQENLQIQLGDFLLLDNGQPLPFDRAAASAYLKQAATGAYLQQDTVLISVKVGNGHGTGKAWGCDLSYDYVKINAEYTT

SEQ ID NO: 18915 - protein, 261 aa, Anabaena PCC7120
IMNGLKGKNTLITGASSGIGQAIAIRLAQEGCNIAINYRKSPSGAEETEEMALQKACKNVEICGVKSLLVQGDVSQEEDVVEMVNTVIEEFGSLDILINNAGIQTECPSHEITAEDFDRVIGVNLRGSYLCARETIKHLLTQNRSGVIINISSVHEIIPRPMYVSYSISKGGMENMTKTLALEYAHRGIRVNSVAPGATITPINEAWTDDPEKKAVVESHIPMRRAGTSEEMAAAVAFLASDEAAYITGQTLFVDGGLSLY

SEQ ID NO: 18916 - protein, 206 aa, Anabaena PCC7120
MIDLYYWTTPNGHKITIFLEEVGLPYNIIPINIGAGDQFQPEFLKISPNNRIPAIVDNEPADGGAAISVFESGAILLYLAEKTGKFIPQNIRGRTEVLQWLFWQMAGLGPMAGQNHHFSTYAPEKIEYAINRYVNETGRLYAVLDKRLADREFVAGEYSIADIAAYPWIVPYERQSQNLDSFPHLKRWFETIQIRPAVIRAYEKAE

SEQ ID NO: 18917 - protein, 3133 aa, Anabaena PCC7120
  unsure (1)..(3133): unsure at all Xaa locations
LFFQQVAKQPNQTAIVTTEQTLTYQQVSDRVCHLAEHLQQLSVIPNQLVAIVMDKGWEQIVAALAILTAGAAYVPIDPQLPAQRRLHLLQETQAQIILTQSWLDTTLEWADHLTRICVDLSPNLSPTRREALTSPSDSSDVEPILNSPPSLVGKGAGGLGQPTDLAYVIYTSGSTGTPKGVMIDHQGAVNTILDINQRFGVTENDRVLAVSSLSFDLSVYDIFGILAAGGTIIIPKSGNDPTHWMQLINQHQVTIWNTVPALMQLLLDTSPTQNQTLRLILLSGDWIPLTLPPRIRSQFNHPQIISLGGATEASIWSIFYPIETIDPNWKSIPYGYSLTNQQVYVLNHSLEPCPTWAIGEIYISGLGVAKGYWQNPELTAEKFIQLDMGENFPPTPLHPYTPTPLYKTGDLGRYLSDGTIEFLGREDFQVKINGYRIELGEIEAALQQHPAITQAVVTTAGNALSQQQLVAYLVLQPEVIASQNTLNSSSQLDFKLQQKGVRKFDAGVHSVALPGVKSSQVNLRRQSYRQFLAETIPLNALGEFFECLQMQHLENSPLPKYRYASAGSLYPVQTYIYIKPHRVENLAAGFYYYHPQKHQLIQLSDETNIDSSIYGINQEIFTQAAFAIFLIGDLQAISPVYGDKSRDFCLLEAGYMGQLLMETAPNQNLGLCPIGDLEFDAIREHFILHEQQIFLHGFVGGIIDPHWTTRWLSPETAQTKVTKAELITQKLRQFLQQRLPEYMIPRLYIPLETLPLTPNGKIDRRALPQPEYQFSQSEQPIIPPSTELEIALAQLWQSILNVEVSSIHNNFFELGGNSLSATQIITQMRQNLQLDLPIREFFLNPTLTAQAELLKQQWEAKQEITIEPIERINPQELLANLDELSDEEVEILLQKMQLEEDDLSHAKTQRREEXEERRXFSNQTISLFSSLRLCASAXGKNIILLDXIMNISTSQKRELLAKLLQQKATKQHFPLSFAQKRLWFLDKLQPGLSVYNVPAALRLTGNLDVTRLEQSLQSILLRHEILRTSFAVINDEPVQNIAVNVKINLPIIDLRELSPENQESQVIQQAKLLTEQPFQLTEPPLLRVALLQLSDTEFVLILVMHHIITDYWSFRVLVRELISLYQGQTLAKLPIQFADFATWQQKWLQSEARQNQLLYWQEQLKNYPRELSLPTDYPRNAIQTFKGARLFFTLSPELSEQLRQLSQQYNATLFMTLLTAFNILLYRYSGQDDILVGSTVTSRDRPEIANLIGLFVNNLIFRTNLSGKPSFIELLNQVKETVLGALSHQDLPFEDLVEQLQPERNLSQNPLFQVMFVLHNTPNKTTNLPGLKIEPLETEHSTSRFDISLDMYETPNGLRGTWEYSTELFEQATIERLIAHFQILLSNIVDNPKQSINEVPLLTVKEQNLLTEWNDTFTDIPELTVYELFSQQVEKTPDKIAVLFGNKSLTYQQLEQEANHLAAYLQNIGVQAETRVGICCDRSLEMVISLLAVHKAGGAYVPLDPGYPQERLQFIINDSQISILLTQTSLLNNLPLIEEIALNKPLKTPLCASAPLREIKIIPLISNTDKTNDLSHPNQLAYLIYTSGSTGTPKGVQILHRSLSNFLTAMSKAPGLTAEDNLLAVTTLAFDIAALEIFLPLIVGACLVLVEREVTLDGERLAQAIAQHQITFMQATPATWRLLLASGWEGKQDLKILCGGEALDNTLAQQLLSCTQEVWNLYGPTETTIWSAAQKLSIDEPVTIGHPIANTQFYVLDEHLQPVPIGVPGELYIGGAGVAKGYWQRPDLTAERFLNQQSTVNSQQSTVNTLYKTGDRVRYLPDGKLEYLGRLDYQVKIRGFRIELGEIEAVLAQHPQISQAVVSVQEDEPGEQRLVAYIVPNSQDVGSNDLQQFLANKLPKYMIPGVFVTLTALPLTPNGKVDRKALPTPNTQSQVNETPRTPTEEVLASIWAMVLGVESVGIEDNFFDLGGHSLLATRLISQVRQVFGVELPLRNLFESPKIADLARVIEHSHHEINPILPIARTGNLPLSFAQQRFWILAQLEPDSPFYNIPLAVQIRGDIHLDSLQRSFTEVVRRQEILRSHFLNVDGQPVLRIADVCDVNIPVIDLQGLPEFEQQQQVQELARTQAQQPFDLAGLLWRVRLVKLGEGNQVLLLTLHHIIADAWSVGLLVREISRAFAERPAGKAQRRREEERIQYVDFAFWQREWLRGRVLEEHLEYWRGQLESAPVMLELPTDYPRPAVQSFRGAVYGFGLSAELTQGLQGLSRRYHSTLFMTLLAVWNVLLYRYSGDDDIVVGSPIANRNRVETEGLIGCFANTLALRTDLSANPSFADLLSRVRATALGAYAHQDLPFEQLVDVLQPVRSLSHSPLFQVMLVLQNLPLPELDMGGIEWQVIEADSGTAKFDLTWFVSETAQGLSCKLEYNTDLFAATTIERLAGHLETLLQAVVLNPEQHINELPLLTTVEQQQLAQWNATQRQYPQQCLHELFEAQVRQTPEKIAVIWGEKQLTYQELNTKANQLACHLQSLGVQPETPVGICVDRSLDMIIGLLAILKADGAYVPLDPTYPEARLAFIIEDSQMQVLLTQQKQLTKLPQLQIPIISLDTPIPSPQSPVPSPQSPTNLAYIIYTSGTTGIPKGVAITHQSPVTLMYWAREIYTRAELTGVLASTSICFDLSIFEIFVPLSWGGCVILADNALQLPELPAAAQVTLINTVPSAARELLRLNGIAATVQTVNLAGEPLPKSLVDELYQQSTIERVYNLYGPSEDTTYSTHALIPRNSQQAPTIGQPIANTQVYILDQNLQPVPVGIPGEIYLSGAGLARGYWKRPKLTDERFIKQSTVNSQQSTVNTLYKTGDRARYLPDGNIEYLGRFDHQVKLRGFRIELGEIEALLHQHPELTQAVAIVRNDTPEHSRLVAYVVPKSHIEAAELRQFLAAKLPAYMLPTAFVILETLPLTANGKVDRFALPIPDLSPVTTTTAPRTPIEQQLINIWTQVLGVESISIHDNFFRLGGDSILAIQAVAKANQQGLALRPRQMFQYQTVAELAAIVDTDTTLSSEQTPITGEVPLTPIQQWFFEQNLVDAHHWNQAILLEVHQSLNPDYLRQALDQLLAHHDGLRSHFQQTPDGWRQF

SEQ ID NO: 18918 - protein, 393 aa, Anabaena PCC7120
YVVPGGRFNEMYGWDSYFILLGLLQDEEWELAQSQVDQLLYQVQHYGTILNANRTYMLTRSQPPVLSMMVLALFQHTQDQAWLKSTLPLLEQFYYYWVVPPHLNSATGLSRYYALGEGAAPEVLFSELDETGRSHYERVKEYYKTFEIDDYDVSLFYDSERDELTDLFYKGDRSMRESGFDITNRFGPFSVDIVHYAPVCLNSLLYQMEQDLAQIHKILDNPELAEQWSDRATLRRERINQYLWDEEKGIYLDYHFYSGKRRHYEFATTFYPLWTGLSSPEQAQRIVENLSLFTAPGGIFTSTHVTGNQWDAPFGWAPLTLIAVQGLYRYGYRKEGDDIAHKFLTMAIQEFTKYGFFVEKYDVERCSAQVSDEICFGYSSNEIGFGWTNGVIL

SEQ ID NO: 18919 - protein, 338 aa, Anabaena PCC7120
DPKIGGVMIMGDRGTGKSTTIRALADLLPEIPVVANDPFNSDPSDPDLMSDEVRQKSGTGAEIPIEFKKVQMVDLPLGATEDRVCGTIDIEKALSEGVKAFEPGLLAKANRGILYVDEVNLLDDHLVDVLLDSAASGWNTVEREGISIRHPARFVLVGSGNPEEGELRPQLLDRFGMHAEIHTVKEPALRVQIVEQRSEFDQNPPTFLEKYNPEQTALQKKIVEAQKLLPEVKLDYDLRVKISEVCSELDVDGLRGDIVTNRAAKALTAYEGRTEVTVDDIRRVITLCLRHRLRKDPLESIDSGYKVEKVFARIFGVELLEDDSSQKNGAGQIKTGVR

SEQ ID NO: 18920 - protein, 406 aa, Anabaena PCC7120
LTLRVAVVGSGPAGSSAAETLAKAGIETYLFERKLDNAKPCGGAIPLCMVSEFDLPPEIIDRQVRKMKMISPSNREVDINLIKEDEYIGMCRREVLDGFLRNRAAKLGANLINATVHKVDIPGNNSDPYTIHYVDHNEGGAQGVTKTLKVDLIIGADGANSRIAKEMDAGDYNYAIAFQERIRLPEDKMAYYNDLAEMYVGNDVSTDFYAWVFPKYDHVAVGTGTMQVHKASIKQLQAGIRTRASEKLAGGKIIKVEAHPIPEHPRPRRVVGRIALVGDAAGYVTKSSGEGIYFAAKSGRMCAETIVEVSQNGSRIPTENELKIYLKRWDKKYGLTYKVLDILQTVFYRSDATREAFVEMCGDLDVQKLTFDSYLYKTVVPANPITQLKITAKTIGSLIRGNALAP

SEQ ID NO: 18921 - protein, 157 aa, Anabaena PCC7120
KLLLVGQGSVGKTSLIERLIHNKYDRNQPQTDGLKVETWNVQVNSKDIRLNVWDFGGQEIYHATHQFFLTKRSLYLLVCNCRTSEEENRIEYWLKLIESFGGQSPVIIVGNKKDEQPLDINRKALREKYPNIQAIIETSCQDNIGIDELRTAILQQV

SEQ ID NO: 18922 - protein, 323 aa, Anabaena PCC7120
MAETLFFNALREAIDEEMARDSSVFVLGEDVGHYGGSYKVTKDLYKKYGELRILDTPIAENSFTGMAVGAAMTGLRPIIEGMNMGFLLLAFNQISNNAGMLRYTSGGNFKIPLVIRGPGGVGRQLGAEHSQRLETYFQAVPGLKIVTCSTPYNAKGLLKSAIRDDNPVLFFEHVLLYNLKEDLPEKEYYLPLDKAEIVRSGKDVTILTYSRMRHHVTQAVKTLEKQGYDPEVIDLISLKPLDLETIGASIRKTHKVIIVEEAMRTGGIAAELIASINDRFFDELDAPVLRLSSQDIPTPYNGTLERLTIVQPEQIVEAVQKMI

SEQ ID NO: 18923 - protein, 323 aa, Anabaena PCC7120
MTPATSLFTPVEADLRILADNLKQLVGNRHPILFAAAEHLFGAGGKRIRPAIVLLISRATMLDQGITPRHRRLAEITEMIHTASLVHDDVVDESEVRRGVPTVHSLFGNRIAILAGDFLFAQSSWYLANLDNLQVVKLLSEVIMDLATGEIQQGLNRFDASISIETYIEKSYYKTASLVANSSKAAGLLSEVSPETAEHLYAYGRHLGIAFQIVDDILDFTSTTDTLGKPVGSDLKSGNLTAPVLFALAEKPYLEVLIEREFAQEGDLEQALELIQDSQGIQQSRELAAHHTKLAIEHLATLPPSESHQALIKIAEYAISRLY

SEQ ID NO: 18924 - protein, 212 aa, Anabaena PCC7120
MALRLGDTVPNFTQASTHGDIDFYAWAGDSWVVLFSHPADYTPVCTTELGTVAKLKPEFDKRNVKAIALSVDDVESHNGWVGDIEETQSTTLNYPILADADRKVSDLYDMIHPNANAAVTVRSVFVIDPNKKLRLTFTYPPSTGRNFDELLRVIDSLQLTDNYSVATPADWKDGDKVVIVPSLKDPEVLKEKFPKGYEVVKPYLRLTPQPNK

SEQ ID NO: 18925 - protein, 130 aa, Anabaena PCC7120
QCIVNRRAQFSASHRYWLPELSEAENIEKFGACSRFPGHGHNYVIFISLAGELDEYGMVLNLSDVKQVIKREVTSQLDFSYLNDVWAEFGQTLPTTENIARVIWQRLAPHLPLVRVQLFEHPELWADYQG

SEQ ID NO: 18926 - protein, 129 aa, Anabaena PCC7120
AYLTISTHFSAAHRLAHPNLSQEDNTEIYGKCARPHGHGHNYHLEVTVKGEIDPRTGMIVDLGALNQAIEDYVVEPFDHTFLNKDIPYFAEVVPTAENIALYISNLLRSPIQELGAKLYKVKLIESPNN

SEQ ID NO: 18927 - protein, 285 aa, Anabaena PCC7120
SVAISPDGEVIVSGCTDQTVNIWNLQTGKLIRTLTGNLGEVSSVAISPDGNFLAVGSGVHPRSNVKVWHLKTGKLLHTLLGHQKPVNVVVISPDGQILASGSNKIKIWNLQKGDGVPPTVGDRICTLWHSSAVHAIAISPDSTILASGSSDNKIRLWNPRTGDPLRTLNSHDNEVKAIAISRDGQFLFSGSADTTIKIWHLITGQILHTLTGHSGDIKSLTTSPNGQFLFSGSADTTIKIWRISTGELLHTLTGHSASVNSVAISPGGNLLASGSADQTIKIWQI

SEQ ID NO: 18928 - protein, 359 aa, Anabaena PCC7120
MALVPLRLLLDHAAENGYGIPAFNVNNLEQIQAILKAAAETDSPVILQASRGARNYAGENFLRHLILAAVETYPEIPIVMHQDHGNAPSTCYSAIKNNFTSVMMDGSLEADAKTPASFEYNVNVTREVVNVAHALGVSVEGELGCLGSLETGAGEAEDGHGFEGTLDHSQLLTDPDEAVNFVEATQVDALAVAIGTSHGAYKFTRKPTGEILAISRIEEIHRRLPNTHLVMHGSSSVPEDLIALINEYGGAIPETYGVPVEEIQKGIKSGVRKVNIDTDNRLAITAAVREALAKNPKEFDPRHFLKPSITYMQKVCAERYVQFGTAGNASKIKQVSLETFAAKYAKGELNAISKAAAKV

SEQ ID NO: 18929 - protein, 379 aa, Anabaena PCC7120
MENFVFYNPVKILFGKGQIANIAAEIPTDAKILITYGGGSIKANGVYDQVKSALAGRKIFEFGGIEPNPHLETLLKAVELIRQEGIDFLLAVGGGSVVDGTKFIAAAVPFVGDPWDILAKQAPVTAAVPFGAVLTLPATGSEMNTNSVVTKWETKEKLFFASPLVFPRFSVLDPETTFSLPPRQIGNGIVDAYTHVMEQYLTYPVNAHLQDRWAESILKTLIEEGPKTLANPTDYDARANLVWAATLALNGLIGAGVPQDWATHMIGHELTALHGLDHAQTLAIVLPSTLSIRRDRKWQKLLQYAERVWNIVDGSEEYRVNEAIAKTRNFFESVGVRTRLSDYGVGLETIPLVVENLQKHGLAILGEQKDVDSQVVEQI

SEQ ID NO: 18930 - protein, 179 aa, Anabaena PCC7120
LNFYYNHRSPMARRVWRTLLEKEIIFEPIIMSLDGDQLQPEFLEINPFHHIPVILDNGFRVVESLAIMDYLEAKYPTPALLPKEAESLAKVRMVQMVTTNELLPKMISLIFEDKNSSKFLQAYEHINKVLAFLSESLGNESYYGGEQLTLADIVAGTDLSLLPKLGISFSNYPNLQDWF

SEQ ID NO: 18931 - protein, 172 aa, Anabaena PCC7120
MDLKSLIRDIPDFPKPGILFRDITTLLRDRQGLRYTIDFLAEKCSEANLNIDYVIGMESRGFIFGTPLAYKLGAGFIPVRKKGKLPAAVHSIEYELEYGTDCLEVHRDALHPDSRVLIVDDLIATGGTASATAKLVQQIGCELVGFGFIIELRDLQGRKHLPDVPIISLVEY

SEQ ID NO: 18932 - protein, 125 aa, Anabaena PCC7120
FEYPQDLRYLDTHEYVRLDGEIATIGITEFAVDQLGDVVFLELPDIGDLLTKGDTFGSIESVKAVENLNAPITGTVVERNEILVESPEAVADDPYGEGWFLKVRVNDPDEVNDALTADEYRAEVE

SEQ ID NO: 18933 - protein, 605 aa, Anabaena PCC7120
  unsure (1)..(605): unsure at all Xaa locations
VTPQRVTGGFALLDSLLRHGVEYIFGYPGGAILPIYDDLYKVEATGSLKHILVRHEQGAAHAADGYARATGKVGVCFGTSGPGATNLVTGIATAYMDSIPMVIVTGQVPRKMIGTDAFQETDIYGITLPIVKHSYVVRDPQDMARIVAEAFHIASTGRPGPVLIDVPKDVAFEQFDYVPVEPGSIKLRGYRPTVKGNPRQINAAIELIRESRRPLLYVGGGAIASGAHAEIQELAELFNIPVTTTLMGIGAFDEHHPLSLGMLGMHGTAYANFAVTECDLLICVGARXDDRVTGXLDEFASRAKVIHIDIDXAEVGKNRIPEVPIVGDVRKVLLDLLRRCKQTSAKTTPNQNQEWLNLINRWREDYPLVVPQHPDSIPPQEVIVEVGSQAPHAFYTTDVGQHQMWAAQFLKNGPRRWISSAGLGTMGFGLPAAIGAKVAFPDEQVICISGDASFQMCLQELGTAAQYKINVKTVILNNGWQGMVRQWQQAFHGERYSCSNMEVGMPDVELLAQAYGIKGIVVTHREQLKDAIAQMLAYDGPVILDVRVTKDENCYPMVAPGKSNAQMIGLPKQPPKTSVEPVYCSHCGTSNLPNHNFCSECGTKL

SEQ ID NO: 18934 - protein, 347 aa, Anabaena PCC7120
  unsure (1)..(347): unsure at all Xaa locations
MGYGEVESYEDFANYNEQALNLLTAKFAPVPTWIYPPLAKLLALFDRHEWGHQHHDFISPHNAIFEKQRAGIEQNLQAKWGDRIQVFKAFNFCAPFLPNQVLAEIKSQGFDKILIYPLLVVDSIFTSGIAIEQVNNALTETNDGENHWLKALRYIPSFYNEPEYIHLMAHLVEEKINADLATAYLPSQIGIVLMNHGCPHKAKGFTSGIVESQALYDLVREELIYKYPLISVGWLNHDTPLIEWTQPNAEQAAKNLIQLGAKVIIFMPIGFATENHETLLDVHHIIHDLEKKYSGVDYVQMACVNDHPEFLAMAAEWANAQIAELQHEQAVAINPQLAVHHHHHHHX

SEQ ID NO: 18935 - protein, 381 aa, Anabaena PCC7120
AIAAHGGQLVNRVATPAQREEFVSKAEFLPRVQLDERAVSDLEMIAIGGFSPLTGFMNQEDYDRVVSEMRLANGLAWSIPITLSVSEEVASSLQEGSLIRLDNPAGDYIGVLQLTQKYRYDKTREAINVYRTDDAKHPGVQVLYNQGAVNLAGDIWLLERSSHPLFPDYQIDPVASRQMFRDKGWKTIVGFQTRNPIHRAHEYIQKCALETVDGLFLHPLVGATKEDDIAADVRMRCYEILLEHYYPEDRVILAINPAAMRYAGPREAIFHALVRKNYGCTHFIVGRDHAGVGDYYGTYDAQYIFDEFEPGELGIVPMKFEHAFYCTRTKQMATTKTSPSRPEERVHLSGTKVREMLRRGELPPPEFSRPEVAAELARAMR

SEQ ID NO: 18936 - protein, 613 aa, Anabaena PCC7120
KPPRLRQFGGSFLILLTLLLLLNFIVPSFSGPRLPQVPYSEFIAQVQAGKVDKAIVGGDRIQYSIKTQTPDGKVVDQVFATTPVAIDLDLPKILRNNNVEFAAPPPDQNAWIGTLLSWVAPPLIFFGIWAFLINRQGAGPAALTVGKSKARIYSEGSTGVKFLDVAGVDEAKAELEEIVDFLKNATKYTNLGAKIPKGVLLVGPPGTGKTLLAKAIAGEAGVPFFSISGSEFIELFVGVGAARVRDLFEQAKKQAPCIVFIDELDALGKSRGGAGGFVGGNDEREQTLNQLLTEMDGFDANTGVIIIAATNRPEVLDPALRRPGRFDRQVVVDRPDKIGREAILKVHARNVKLADDVDLGNIAIKTPGFAGADLANLVNEAALLAARQNRQAVVMADFNEAIERLVAGLEKRSRVLNETEKKTVAYHEVGHAIIGALMPGAGRVEKISVVPRGVGALGYTIQMPEEDRFLMIEDEIRGRIATLLGGRSAEETVFGKVSTGASDDIQKATDLAERYVTLYGMSDKLGPVAFEKIQQQFLEGYSNPRRSISPKVAEEIDREVKQIVDNAHHIALSILQNNRDLLEETAQELLQTEILEGTALRERLSQAQAPEEL

SEQ ID NO: 18937 - protein, 458 aa, Anabaena PCC7120
MQISSSGYILALDLGTTGNRAFIFNNAGKIVAQAYKELTQHYPQPGWLEHDAEEIWQDTCWVMKTAIVNAQISPSEIAAIGLTVQRETCLLWDKTTGRPLHKAIVWQDRRTAPLCHQLQEKGYAQEIYSRTGLVVDAYFSATKLRWLLDYITGVDLKNVLAGTIDTWILWKLTGGKVHATDHSNASRTMLMNLKTGEWDEQLLEILQIPAHILPQIQPSLGKFGVTDTSLLDAAIPITAILGDQQAALFGHGCDRPGLMKCTYGTGSFLVAHTGSNIVRSQHQLISTIAWTQADKQENINIGYALEGSMFTSGACIQWLRDGIKLIKTAAETETMANQVADNGGVYFVPAFSGLGAPYWDMNARGAFFGITASVQPQHLVRAVLEAIAYQVLEVVQAINASCSSPMQRLIVDGGACENNFLMQFQADVLGIPVERPTMRDTTVQGAAFAAGLAVGFWD

SEQ ID NO: 18938 - protein, 286 aa, Anabaena PCC7120
INTAFFMSATLYQQIQQFYDASSGLWEEIWGEHMHHGYYGADGTEQKNRRQAQIDLIEELLTWAGVQTAENILDVGCGIGGSSLYLAGKLNAKATGITLSPVQAARATERAKEAGLSGRSQFLVANAQAMPFDDNSFDLVWSLESGEHMPDKTKFLQECYRVLKPGGKLIMVTWCHRPTDKTPLTADEKKHLEDIYRVYCLPYVISLPEYEAIARQLPLNNIRTADWSQSVAQFWNIVIDSAFTPQAIFGLLRAGWTTIQGALSLGLMRRGYERGLIRFGLLCGDK

SEQ ID NO: 18939 - protein, 304 aa, Anabaena PCC7120
DWQGAENAFRQALQREPNLAMARAYLGNIYLMQNRLDVAVQEYGEAIRLNPNLGETYYNLGLALQQQGKKEGAITAYRQALVIDPRRVEAYYNLGLVLYEQGLLQEAIAAYQDAVNLEPSKINAHHNLAIALQQTGKMEEAIVAYREVLKLDPKNAAAYSSLGSLMAMQGRPEEAIAAYTQAVRQDPKNALAYYNLGITLYNQGELQKASNAFKRAQEEYSQQGNLEQTEKTEQLMQQVAQKIEEQKLQQRQASTPKPTDNSTNNLLEKLTQLTAPKEQPANSGAVPVSDEQKQFPPIFPNTNS

SEQ ID NO: 18940 - protein, 287 aa, Anabaena PCC7120
MTTLTGKTVLLTGASRGLGVYIARALAKEQATVVCVSRSQSGLAQTCNAVKAAGGKAIAIPFDVRNTSQLSALVQQAQDIVGPIDVLINNAGIEINGTFANYSLAEIQSIFNTNLLAAMELTRLLLPSMMERGSGRIVNIASLAGKKGVAFNSVYSASKAGLIMWTDAMRQELVGTGVNISVVCPGYVSQTGMTVDTRVSAPKLAGISTPKSVANAVVKAIKNKTTEVIVNQNPITESLTKLMLAVGQISPTSVDRIYRWFGVVDFNQKRAENRVKDGYVAVESHRS

SEQ ID NO: 18941 - protein, 315 aa, Anabaena PCC7120
MPNLKSIRDRIQSVKNTKKITEAMRLVAAARVRRAQEQVIATRPFADRLAQVLYGLQTRLRFEDVDLPLLKKREVKSVGLLVISGDRGLCGGYNTNVIRRAENRAKELKAEGLDYTFVIVGRKAEQYFRRREQPIDASYTGLEQIPTADEANKIADELLSLFLSEKVDRIELVYTRFVSLVSSRPVIQTLLPLDTQGLEAADDEIFRLTTRGGQFQVERQTVTSQARPLPRDMIFEQDPVQILDSLLPLYLSNQLLRALQESAASELAARMTAMSNASENAGELIKSLSLSYNKARQAAITQELLEVVGGAEALT

SEQ ID NO: 18942 - protein, 506 aa, Anabaena PCC7120
MSISIRPDEISSIIQQQIEQYDQEVKVANVGTVLQVGDGIARIYGLEKAMAGELLEFEDGTVGIAQNLEEDNVGAVLMGEGREIQEGSTVTATGRIAQIGVGEALIGRVVDALGRAIDGKGDIKASESRLIESPAPGIIARRSVHEPMQTGITAIDSMIPIGRGQRELIIGDRQTGKTAIAIDTIINQKGEDVVCVYVAIGQKASTVANVVQTLQEKGAMDYTVVVAAGASEPATLQFLAPYTGATIAEYFMYKGKATLVIYDDLSKQAQAYRQMSLLLRRPPGREAYPGDVFYIHSRLLERAAKLSDELGKGSMTALPIIETQAGDVSAYIPTNVISITDGQIFLSSDLFNAGIRPAVNPGISVSRVGSAAQTKAMKKVAGKIKLELAQFDDLQAFAQFASDLDKATQDQLARGQRLRELLKQSQNQPLSVAEQVAILYAGINGYLDDIPVDKVTTFTKGLRDYLKSGVNPYFQDVQSKKALGDDEEKALKAALEDYKKTFKATA

SEQ ID NO: 18943 - protein, 183 aa, Anabaena PCC7120
MTSKVANTEVAQPYAQALLSIAKSKSLTEEFGTDARTLLNLLTENQQLRNFIDNPFIAAENKKALIKQILSEASPYLRNFLLLLVDKRRIFFLPEILQQYLALLRQLNQTVLAEVTSAVALTEDQQQAVTEKVLALTKARQVELATKVDSDLIGGVIIKVGSQVIDSSIRGQLRRLSLRLSNS

SEQ ID NO: 18944 - protein, 494 aa, Anabaena PCC7120
FDVIVIGSGIGGLVTATQLATKGAKVLVLESYIIPGGSAGYFERQGYRFDVGASMIFGLGNRGTTNLLTRALQAVNSSVDAIADPVQIHYHLPNNLNLKVDRVYDKFLQNLAAYFPHEKEGIRGFYDECWQVFKCLNRMELLSLEEPRYLLRSFLQHPLACLGLLKYLPQNAGDIARRYIKDPELLKFIDIECYCWSVVPAAMTPMINAGMVFSDRHYGGVNYPKGGVGQIAQKLVEGLEKAGGEIRYQAKVAKIITEKDCAVGVQLTNGEIYRGKRIVSNATRWDTFDKLLPVDQIPSNEKKWQQNYKKSPSFLSLHIGVKESVLPQGTECHHIILEDWQNMTQPEGTLFVSIPTLLDPELAPEGYHIIHAFTPNWMNDWHGLSVSDYEAKKEETAWRIIDRLEKIFPGLDAGLDYLEVGTPRTHRRFLGREDGTYGPIPRRKLRGLLSMPFNRTAIKGLYCVGDSTFPGQGLNAVAFSGFACAHRIAVDLGL

SEQ ID NO: 18945 - protein, 285 aa, Anabaena PCC7120
ITGKTKLLGVIGHPVEHSLSPVMHNAAIAQLGLDYVYLPFPIAPDNLEAAIALLATIGVVGFSVTIPHKQAIIPLLSEISPVAQAIGAVNTVTRQNNQWVGTNTDIEGFIAPLQTTYKRDWSQQIAVILGNGGAARAVVAGCYQLGFAEIHVVGRNVQRLEEFRHSWENSPIAENLQVHTWDYLAKLIPQANLLVNTTPIGMYPQVDESPLSAEELVNLQTGTIAYDLIYIPKPTQFLQKAQQQGAIIIDGLEMLVQQGVAALKIWLQQDDIPVDVMRQALIKHL

SEQ ID NO: 18946 - protein, 169 aa, Anabaena PCC7120
PHFTPDGQIKVDMGLPRLLAGEIPTTLGAADGKVINQPLEVEGQTWEVTCVSMGNPHCITFVEDVAAIPLEIIGPKFEHHPAFPQRTNTEFIQVVSRDYLKMRVWERGAGITLACGTGACASLVAAVLTGRSDRLATVELPGGPLEIEWSEVDQRIYMTGPADRVFTGK

SEQ ID NO: 18947 - protein, 376 aa, Anabaena PCC7120
DAEIANRIKDEFLAVLSHELRTPLNPILGWSKLLRSRQFDAATTDRALETIERNATLQTQLIEDLLDVSRILQGKLSLNICPVSLPIVIGAAIDTVRLAAEAKEIKIQNVFDPNLGQVMGDANRLQQVVWNLLSNAVKFTSPGGTVEIHLKAVNDQAQIQVIDTGKGITPEFLPYVFDYFRQADGTTTRNFGGLGLGLAIVRQVVELHGGTVQAKSPGDGLGATFTVNLPLSPKNEAMNHEDKNPVSANFQPATLSGVRVLIVDDEPDIRDLVTFILEDYDVKVIAVSSAQEALEALSQSLPDIIVSDIGMPDVDGYMLMRQLRQRSPQEGGNLPAIALTAYAGEINQKQALAAGFQLHISKPVDPDALIEAIGNL

SEQ ID NO: 18948 - protein, 633 aa, Anabaena PCC7120
MCGIVGYIGTQAATEILLAGLEKLEYRGYDSAGIATVWEGDVNCVRAKGKLHNLRSKLEQLATPSQIGIGHTRWATHGKPEEYNAHPHLDTAMRIAVVQNGIIENYRELRDELKQKGHEFRSETDTEVIPHLIAEFLKNLPSPPLPTSSSPFLEAIRQAVKHLQGAFAIAVISADYPDELIVVRQQAPLVIGFGQGEFFCASDTPAIVSHTRAVLPLENGEIARLTPLGVEIYNFAGDRLKKQPRLLNLNPTMVEKQGFKHFMLKEIYEQPGVVRASLEAYFNPDTNTDESFTSPVNLGLSEEIYADLEQIHIVACGTSWHAALVGKYLLEQLAGISTQVHYASEYRYAPSPLTANTLIIGVTQSGETADTLAALAMEKERRQGKEAKYQARLLGITNRPESSLGHLVPHIINTLAGIEIGVAATKTFVAQLMAFYALALDLAYHRQTVAPDKLADIIQGLRQIPKEIEATLERQEKLTEHLAHEFAETKDFIFLGRGINFPIALEGALKLKEISYIHAEGYPAGEMKHGPIALLDAKVPVVAIAYPGSVYEKVISNSQEAKARDSRLIGVTPVNDGEAAEIFNDLLPVSSVDELLSPILTVVPLQLLAYHIAARRGLDVDQPRNLAKSVTVE

SEQ ID NO: 18949 - protein, 484 aa, Anabaena PCC7120
MNLSFPELGISQERVEHLEKLGFTAPTNIQAQAIPQLLSGRDVVGQSQTGTGKTAAFSLPILERLDPQQKAVQAIVLTPTRELAIQVHDAMAQFVGNSGLRTLAIYGGQSIDRQMLQLKRGVHIVVGTPGRVIDLLERGNLKLDQVKWFVLDEADEMLSMGFIDDVEKILSQAPQDRQTALFSATMPPSIRMLVNKFLRSPVTVTVEQPKATPNKINQVAYLIPRHWTKARALQPILEMEDPETALIFVRTRRTAAELTSQLQAAGHSVDEYHGDLSQQARERLLTRFRSRQVRWVVATDIAARGLDVDQLSHVINYDLPDSVETYVHRIGRTGRAGKEGTAITLVQPFERRKQQIFERHVRQNWQLLSIPTRAQIEARHILKLQEQVREALAGERLASFLPIVSELIEKYDAQAIAAAALQIAYDQTRPAWLSTDAEIPEEVASTPKPKLGGKRREFSGDRGRSNWNKSDNNNSDDERRGTPK

SEQ ID NO: 18950 - protein, 312 aa, Anabaena PCC7120
VETITLGKNGPTVTPLCIGTWAWGDKLFWNYGNGYGSEQLQEAFTAALEAGVTFFDTAEVYGLGLSEELLGQFVKQAKQPVQIATKFGPLPWRFSGQSVSDALTDSLKRLQLERVDLYQVHWPFTFLLSQETLMNTLADEVKRGRIAAVGVSNYSASQMRQAHQILAARGVPLAVNQVRYSLVSRQIETEGIVATARELDVTILAYSPLAQGLLTGKYSADSDEVPTGARSIDPRFKKEGLQKIAPVISLLRSLGEKYDRTPAQVALNWLIAQGNVIPIAGVKTAQQVRQNAGALGWRLNDEEVQELEKVSR

SEQ ID NO: 18951 - protein, 274 aa, Anabaena PCC7120
MGICGKLGVAALVALIVGCSPVQSQVPPLTELSPSISVHLLLGNPSGATPTKLTPDNYLMVKNQYALSYNNSKGTANWVAWQLNSSWLGNAERQDNFRPDKTLPAGWVRVTPSMYSGSGYDRGHIAPSADRTKTTEDNAATFLMTNMMPQTPDNNRNTWGNLEDYCRELVSQGKELYIVAGPNGSLGKPLKGKVTVPKSTWKIVVVLDSPGSGLEGITANTRVIAVNIPNDPELNNDWRAYKVSVDELESLTGYDFLSNVSPNIQTSIESKVDN

SEQ ID NO: 18952 - protein, 204 aa, Anabaena PCC7120
LPMIIVHHLNNSRSQRVLWLLEELGIEYDIKFYERDSKTMLAPASLRQVHPLGKSPVITDAEVTVAESGAIIEYIVERYGNGQLIPKSGTPERLRYTYWLHYAEGSAMPPLVMNLIFNRFGAGDSGANDAFIAPQIELHFDYIEAELGKSTWFVGSEFTAADIQMSFPLELVVLQAELISSRPKIQEFIERIHARPAYKRALER

SEQ ID NO: 18953 - protein, 358 aa, Anabaena PCC7120
MSKSRRIGILTSGGDCSGLNAVIRAVVHCASGKGWEVFGIRQATLGLMARPPQVSKLEIDQVDPLLTSGGTMLGTTNKGDPFAFPMPDGSFCDRSSEIIAGYHQLDLDALIGIGGDGSLAILRRLAQQGAINLVGIPKTIDNDIGITEHAIGFDTAVNIATEALDRLHFTAASHSRVMILEVMGRDAGHIALAAGIAGGADVILIPEILYSMDDICYHIKHRQEEGKNYCLIIVSEAVRTQDGEILTLTNRLGQSRYGGIGEYLADQISDRIGAETRVTVLGHIQRGGIASPLDRLVASAFGVAAVNLIEAAKYDYMVAWQNRQVITVPIEEAIAQYKAVNPEDALVKTARGLGIYLG

SEQ ID NO: 18954 - protein, 202 aa, Anabaena PCC7120
AVSAREAQIPLKATNFQEYYNQGVQKLEQGNFNGAIADFNSVVQMNPRFYEGFCLRGLAKSQLRDFSAAISDFNLALRLNPKHTDAYNGRGISYVELGDFQKAIADFNQTVKIDPNSQDGYYNLGLAHFRQGNHQQAIADFNKALQINPNLADAYGNRGLAQYALGDSKSAVTDLQQAAKLFLKQGDTQAYQQTQALIQQIQ

SEQ ID NO: 18955 - protein, 742 aa, Anabaena PCC7120
IVSLQTLQLQISGMDCGSCAKTIEAGVQKIIGVQEASVSFASERLHISYDPQLVNEKTIYDRIQDLGYTVEEGVETSSNHHTDACGHDHEHHHDHDYSHNHEHSQPINKSKQKQKSDLTSWRFWIENRRGQSVILAGIGLVLGLLTQYLVLPIWIARAFYGIGIVIAGYPIARAGLFELRLRRADMNLLMTISVIGAVILGDWFEGGLVVFLFSLGTTLQVFTFGRTRNAIRSLMDLTPPTATVKRGNQEFTVPVESIQLGEILTIRPGGRVALDGVVVSGNSAIDQSPITGESIPEDKDVGDTVFAGTLNQTGFLEVKVTHTSSDTTVAKIINLVEQAQESRAPSQQWVDKFAQVYTPIVILAAIAIALIPPLAFAQPFNVWLYRALVMLVIACPCALVISTPVSIVSAIGAATRRGVLFKGGNALETAGHLTTLAFDKTGTITQGLPIVQQVYDLGVVSGDMVLLLAASLEQKSEHPLAKAIVVKAQELGLELETPLNFTALPGKGIQANFGEQLYLVGNRRLFSDQGICLSDEAESLLTEIEQFGQIPVLVGTNGGLLGAIALSDGIRLEATEALRQLQRVGLKRLVMLTGDRASVAKQIAQQVGITEYQAELLPEDKLQAIQQLRRHGVVGMVGDGINDAPALATADISFAVGGIDIALETADVVLVGSDLRQLAYAVDLSRRTVSVIQQNVVFSLVTKALFLLLGTFGFVGLAIAVLADTGTSLLVTANGMRLFKTK

SEQ ID NO: 18956 - protein, 746 aa, Anabaena PCC7120
ENTTLKLRGMSCASCASSIEDAINSVPGVNECIVNFGAEQATIEYDPRRTDLEAIQEAVDAAGYSAYPLQKQNLMAGDDDAEKRHRLRESRDLMRKVAVGGIISTVLVIGSLPMMTGLHLPFIPVWLHNPWVQLILTTPVQFWCGYSFYINGWKALKRHAATMDTLIALGTSAAYFYSLFPTLFPSFFINQGLTPDVYYETAAVVITLILLGRLFENRAKGQTSEAIRKLIGLQAKTARLIRNGREVDVPIEEVQIGDVILVRPGEKIPVDGEVVDGTSTIDEGMVTGESVPVKKQPGDEVIGATINKTGSFKFRATRVGSDTVLAQIVQLVQQAQGSKAPIQRLADQVTGWFVPAVIAIALLTFIIWFNFTGNVTLALITTVGVLIIACPCALGLATPTSVMVGTGKGAENGILIKGAESLELAHKIQTIVLDKTGTITQGKPTVTDFVTVNGTANGNEIRLVQLAASVERNSEHPLAEAVVRYAQSQEVTLADVKEFEAVAGSGVQGIVSDSLVQIGTQRWMSELGIDTQALQQDKERLEYLGKTAIWIAVDRQIQGLMGISDAIKPTSIQAISALQKLGLEVVMLTGDNRRTAETIAREVGIKRVLAEVRPDQKAATVQKLQSEGKIVAMVGDGINDAPALAQADVGMAIGTGTDVAIAASDITLISGDLRSIVTAIQLSRATIRNIRQNLFFAFIYNVAGIPIAAGILFPIFGWLLNPIIAGAAMAFSSVSVVTNALRLRKF

SEQ ID NO: 18957 - protein, 287 aa, Anabaena PCC7120
KVMSVMFSPDGQRLASGSADKTVRVWNLANEETLILKGHGKSSWSGGVNSIAFSPNGKTLASASDDKTIKLWDVNTGAEIIAFTGHEEAVYSVSFSPDGKTLVSGSKDKSVKLWSLATGRELYSLKGHLDDVLSVAFSPDGQVVASGGAGNDKTIKIWHLAKQKVQTITGHSEWFGGINSLAFSPDGNILASGSWDKNIKLWQWQNSEEICTLTGHSDHVCCVSFSPNGNILASASKDKSIKLWQVDTRSIISSFIVHEESVYSLAFSPDGQTLASSSGDKIIRILP

SEQ ID NO: 18958 - protein, 282 aa, Anabaena PCC7120
KTAWVFPGQGSQALGMGTDLLDIPTAKEKFAQAEAILGWSVSEICQNEEKLSQTLYTQPSLYVVESILADLTKERGHQPDLVAGHSLGEYIALYVAGVFEWSAGLKLVKRRAELMDSAAGGMMAAMMNFDREQLETVISQTPDVVLANDNSPAQVVISGTPEAVQTVMSQVKAKRAVPLKVSGAFHSHLMNTAAVEFQEILETVEFQQASVPVLSNVEPAPAVDAAILKQRLSQQMTGSVRWREISLTLPANGIEKVVEIGPGNVLTGLIKRTTADLILKNI

SEQ ID NO: 18959 - protein, 287 aa, Anabaena PCC7120
IRQRRLALPTESLSSLAAAASRQAIASAGITASDIDLILLATSTPDDLFGTATKIQAELGANKAVAFDLTAACSGFVFGLVTAAQFIRTGVYQNVLLIGADILSRWVDWQDRRTCVLFGDGAGAVVLQANSSDRLLGFALKSDGTQNHYLNLAYQGTAKEILPNVKITQGTYQPVTMNGKEVYRFAAQKVPEIIDKALFEAQLTVDQIDWLLLHQANQRILDTVAQRLNIPAHKVISNLANYGNTSAASIPLALDEAVREGKIKPNDIIATSGFGAGLTWGAAIFQW

SEQ ID NO: 18960 - protein, 1094 aa, Anabaena PCC7120
IPKVGILFYRAHYLAGNIQVIDALCAALWQRNLQPVPVFISSLRDPDVQAELIDFFQPKDSQQISLLLNTTSFSLARLETEAPQTELWEKLDVPVLQVILSGGFVEQWEAQLNGLSPRDIAMNVALPEVDGRIISRAVSFKAIQTRNPDLETDVVVYEPISDRIDFVAQLAANWVHLRSQPPQQRRIALILANYPNRDGRLANGVGLDTPESCVEILKALQQSGYVVSNLPANGDELIQLLTAGVTNDPEGREIRPVQQSLSSEEYQEYFAGLPATVQQGINERWGRDWGLGEQASNFPSSSCPIPGIQFGNVFVGIQPSRGYDIDPNLNYHAPDLEPTHAYLAFYYWVRESFGADAVVHVGKHGNLEWLPGKSLALSSNCYPEAVFGPMPHLYPFIVNDPGEGSQAKRRAQAVIIDHLTPPMTRAELYGALQKLENLVDEYYEAESLDPSRLGVIRDRIRDLVIQENLYKDLGIEKEEDIVNFESLILNSLDGYLCELKEAQIRDGLHIFGQCPQGRQLRDLIVAIARIPNRYSTGITRALANVWGLDFDPLTDNFSTPLSTQDQKLLAAKTPNPCRTVGDAVTALEEHAALLVEQLINPPTAPEVRPEGNPPCDFSSCPLPSSSSPPAPLNTVLNWIKSKLLPSLQQTHAEITNLLHGLDGGYIPSAASGAPTRGRPEVLPTGRNFYAVDIRAIPTETAWDIGRKAAENLVECYTQEHGEYPKTLGLSVWGTATMRTGGDDIAEALALLGVQPVWDGAARRVVDLDILPLSILGRPRVDVTLRISGFFRDAFPNLMDLFEQAVNAVAALDEPPEQNPLAAQIRQDTDFWIQQGLTPETAFERSRYRLFGSKPGAYGAGLQGLIESQNWQNDQDLANAYINWSCYAYSSGKSQEAGTEINPPSPIPSPEAFTQRLGQMQIVLQNQDNREHDLLDSDDYYQFQGGLTAAIRSLQGKNPETYFGDNSIPSQPRVRQLREEIARVYRSRVVNPKWIEGMMRHGYKGAFEMAATVDFLFAYDATTRCVEDYMYQGVMQAYLLDPVVCTYIENKNPHALRDIAERLLEANQRGLWENVNIETLENLRNLVHQAEATIE

SEQ ID NO: 18961 - protein, 378 aa, Anabaena PCC7120
PTNKPQVTHFSSGPCAKHPGWSVSNLENACLGRSHRSEDGKAKLSEVIERSKQILGLPADYRLGIVPASDTGAVEMALWSLLGQRPLDILAWESFGQEWVKDVVDELKLPDVRLLKAPYGGLPNLDEVDFSHDVVFLWNGTTSGVRVPNGDWIKDDRQGLTICDATSAVFAMDIPWEKIDVLTYSWQKVLGGEAQHGVIVLSPRAVERLETYEPAWPIPKIFRLSQKGKLIEGIFKGDTINTPSMLCVEDALDALIWAEIVGGLPGLISRSEANLAAIAQWVKQSNWADFLAEKPETRSCTSICLKIIDAAFASLSAEDQGKFTKKLAKLLEKQQVAYDIAPYRAAPPGLRIWGGATVETADIEALLPWLDWAYVTVK

SEQ ID NO: 18962 - protein, 327 aa, Anabaena PCC7120
STWNRHHVLSLADFTAAEYDIVLKTAASFQEVLSRRTKKVPALQGQVVANLFFEPSTRTRSSFELAAKRLSADTLNFAASTSSMTKGETILDTAKTYLAMGTDIMVIRHKEAGVPNAIAQEMDRLGVRVSVLNAGDGQHEHPSQGLLDLFTICSLIDPANPRLELLQGKKIAIVGDILHSRVARSNIWSLIASGAQVHLAAPPTLLPKFFAEYIFGEETAPPGQLFIHWQLEPALQEADFVMTLRLQKERMTANLLPSLREYHQLFGITRAKLQLCQPNVKVLHPGPVNRGVEISSDLMDDPEFSLIQSQVTSGVAVRMALLYLIGS

SEQ ID NO: 18963 - protein, 209 aa, Anabaena PCC7120
FGKKLALPTPEKALPGRAQIMPVPANHYVNKNPLKPPFPDGFEKALFGLGCFWGAERKFWQQQGVYSTAVGYAAGFTPNPTYDEVCTGLTGHNEVVLVVFDPKVISYTQLLKVFWESHNPTQGMRQGNDVGTQYRSGIYVYSEAQKQLAEASRDAYQQALSSAGYEKITTEILDAPEFYYAEAYHQQYLAKNPNGYCGLGGTNVACPVG

SEQ ID NO: 18964 - protein, 551 aa, Anabaena PCC7120
QQKTLKNSALQQTPIAIIGMSALFAKAENLQQYWDNILARINGISEVPETAWSLKDYYDPDPSTPDKTYARAGGFLPEIDFDPLEFGLPPDTLEALDSANLLALVLAKQALKDAGYSEGKEFNRETTGVILGASGLWKSITPLTARLQYPVWEKVLKNSGLSAEQTEKIIEKMQAAFVPWTENSFPGMLPNVVAGRITNRLDLGGTNCVVDAACASSLSALKMAISELIEGRCDMMLTGGFDTDNSILNYMCFSKTPAFSKKDYLNPFDATSDGMMVGEGLGMLVIKRLADAERDGDRIYAVIKGIGTASDGRYKSIYAPRVEGQVRALRRAYEDAGFSPATLGLMEAHGTGTPAGDFCEFTALNQVLTENQAGKQQIALGSVKSQIGHTKAAAGAASLIKATLALHHKILPPTINVTQPNPKFKIEESPFYINTETRPWIQNGDIPRRAGVSSFGFGGTDYHVVLEEYTPTLPQEAIASIPQPNLFYLWADTPQQLSQKCQATLEQLQSDNGGEQYNQLQNHSKTALIPETSARVGFVATSLEEAQKLLK

SEQ ID NO: 18965 - protein, 1117 aa, Anabaena PCC7120
GREQDINNLIGRISRADQKLIVIHGPSGVGKSSTVTAGLVPALQNRAIGDQIAMPVVLQVYTDWVRELGKALTEAVTHISGDVSIAPEILSTPTPPMDIGYARPMAIADILGQLRQNANNHLITVLIFDQFEEFFFGYSDRQQKKEFDQFLSQCLNISFVKIILSIREDYLHRLLEFKHLSYLEAINNNILDKQIRYQLNNFSPEYAKVIIQKLTARSQVNLEPALIDAVVEDLSTELGEVRPIELQVVGAQIQDERINTLKQYQQYRPNKLIERYIKELIKECGPENERAALLVLYLLTDESNKRPFKTRAELATELAELEDPEKLDLVLDILVNSGLVVLFPDIPERYQLIHDYLVDLIRYLQQQESSLQAQLDQLRRKVQQSQSEIARLKSELSQKKQSKLTDTHPQQGLDLVTELRELRKREELTQLEIEQLRGELKEKELTAQLAESQKQQRLSEAKLNRSLKIALTASCLAILGLSVSIITAVDSEIKTLSVSSEALFASQKGLDAVKEGVKAARKLQRAIWVDPYTREQVQTALYQAVVGVREYNRLEGHTAGVNSAVFSPDGSLIASASADNTINLWRSDGSLINTLSKHTNVVNSVNFSPDALLIASASQDKTVKLWNRVGQLVTTLQGHGDVVNNASFSPDGSLIASGSSDKTVKLWSREGKLLNTLSGHNDAVLGIAWTPDGQTLASVGADKNIKLWNRDGKLLKTWQGHDDAILGVAWSPKGETIATASFDQTIKLWNRQGNLLKTLSGHTAGVTAVTFSPNGETIGSASIDATLKLWSPQGLLLGTLKGHNSWVNSVSFSPDGRIFASGSRDKTVTLWRWDEVLLRNPKGDGNDWVTSISFSSDGETLAAASRDQTVKILSRHGKLLNTFKGHTGSIWGVAWSPNRQMIASASKDQTVKLWHQDGKILHTLQGHQDAVLAVAWSSDSQVIASAGKDKIVKIWSQGGQLLHTLQGHTDAVNWVSFSPDGKLLASVSDDTTVKLWSRDGQLLHTLKEHSRRVNGVAWSPDGQILASASIDGTVKLWNRDGSLSRNLPGDGDSFISVSFSPDGKMLAANSDDQIRLWNQKGTLLMVLKGDKDELTSVTFSPDSQILAVGGGNGKVIF

SEQ ID NO: 18966 - protein, 249 aa, Anabaena PCC7120
IVLITGASSGIGNACARIFAGAGAKLILAARRLARLQQLADELNQDFGVEIHLLQLDVRDRPSVESAIASLPPAWSAIDILINNAGLSRGLDKLHEGDLQDWEEMIDTNVKGLLYLTRYVVPGMVNRGRGHVINLGSIAGHQTYPGGNVYCGTKAAVKAISEGLKQDLLGTPVRVTSVDPGMVETEFSEVRFHGDTERAKKVYQGVNPLTPEDVADVIFFCATRSPHVNINEVILMPVDQASATLVHRQ

SEQ ID NO: 18967 - protein, 981 aa, Anabaena PCC7120
  unsure (1)..(981): unsure at all Xaa locations
VRKVHPRFRNYXTTNRQTILASGDASAGIYIVLGGKVRLLDDAHNLITTVSTGASFGELTLFPDADFIPYVARASVNLKLGYLPQTILQDLMGENSSVGDRLKKHAETWDLLVLCCQNSLLPQNSSVEEIIKALALFERHSLDIGSLPSQIFPDTKLWILRRGELENNNGRTFQPGTISQYSKQINWQVTQSAIVYILKQENWQVAQEYWPELGTGDWGLGTGENASQSPLPSLRSPVVREPEPQPQPKQRRAYFPSPRLQVGHWWGRLIKRYPIFEQQSAADCGAACLVMISRYWGKRLSVNRLRDLTNVNRSGASLKGLTAAAETIGFTTRPVKASFDKLAQQPLPAIAHWEGKHYIVVYEINKKQVIVGDPAIGQRNLSIAEFKAGWTGYALLLQPTTELKENEEANTSFWQLFELVKPHTRVLVEVFSASVLIQVFGLITPLFTQLLLDRVIVQGSTLTLNAVGLGLMIFGLFRVVLNGLRQYLLDHTANRISISLLVGFIKHTFRLPLSFFESRYVGDIVSRVQENQKIQRFLTGEALSIILDLLTVFIYVALMFWYSSAMALMSLAIVPPFMLLAIIATPFLRRISREVFSATANENSYLIQSLSGIRSIRSMAIEQTVRWHWEELLNNVIRKTFSGQIISNKLQIFSSALETLVTTSLLWFGAWLVIQNQLTIGQLVAFNMLLGNIIRPFQRLVVLWNQLQEVVISTERINDVLEAEPEEDLQHQHRQFISNLLGHIRFDNVTFRYHPESDRNILENLSFEIKPEQTVAVVGRSGSGKTTLFKLILGLYPPTDGKVLIDGKDVTNIALRSLRSQIGVVDQDTFLFGGTIRENISIAHPEASLEEIIAVARLAGADDFIKQMPAGYETQIGEGGGMLSGGQRQRLAIARALLGNPRLLLLDEATSHLDSESERIIQNNLKTILKGRTSVIIAHRLSTVRHADLILVLDRGLLVESGNHDQLIARRGHYFYLNQQQ

SEQ ID NO: 18968 - protein, 360 aa, Anabaena PCC7120
MTSVINVNLPTQSYEIAIAPASLDQIGQSLAGLKLGKKVLLVSNPTIFKHFGKVAVDSLEAAGFQVASYSLPAGERYKTLNSIQKLYDIALENRLERSSTMVALGGGVIGDMTGFAAATWLRGINVVQVPTTLLAMVDSAIGGKTGVNHPHGKNLIGAFHQPRFVLIDPQVLKTLPVREFRAGMAEVIKYGVIWDAELFNQLEQSKRLDQLRYIKPELVDAILTRSCQAKADVVGKDEKEGGLRAILNYGHTVGHAVESLTNYRLLKHGEAVGIGMVAAGQIAVNLELWQQADADRQNALIEKAGLPTKLPVGLDIEGIIEALQLDKKVKDGKVRFVLPTQIGVVTVTDEVTSDHIRQVL

SEQ ID NO: 18969 - protein, 343 aa, Anabaena PCC7120
RSNVEAMASYVPGEQPPQGTQVIKLNSNENPYPPSPEALAAIKDIDGECLRRYPEPFGEEFRKAVSQLLGVPCNWVIVGNGSDEILSIVIRACAEPTRKVVYPVPTYVLYRTLTEMQAADILEIPYREYNILPVADLIAAHGSVTFIASPNSPSGHVVPSDDLRKLASELSGVLVIDEAYVDFAEESALNLVQDHENVILIRTLSKGYSLAGLRLGFGVGNPQLLNGLFKVKDSYNVDAIACKVATAAITDQAYKNACVAKVKASRTRLAKDLKQLGFCVWDSQANFLLTQPPQGNAEYLYQQLREKKILIRYFKQPGLEDKLRITVGTDEQNQILLQALRDL

SEQ ID NO: 18970 - protein, 230 aa, Anabaena PCC7120
MLNIHNLNKSYGDRHVLQDLTLNIINGEVYGLLGANGSGKTTTINIICNLLKADSGDIKLNNQVISESTKKLIGVAPQENILYKTLTCEENLQFFAEIYGLSKENIQKQIKDILAAVNLSDRAKSPVETLSGGMQRRLNIAVALVHQPKLVILDEPTTGLDIEARYEIWELIRQLKAQGITVLLTTHLLDEAERLCEKIGILKNGQILVEGSLAELRNLIPAQEILSLKT

SEQ ID NO: 18971 - protein, 463 aa, Anabaena PCC7120
TLFDKVWDLHTVGTLPSGLTQLFIGLHLVHEVTSPQAFAMLRERGLKVLFPERTVATVDHIVPTENQARPFVDRLAEEMIQALEQNCQENNITFYNIGSGNQGIVHVIAPELGLTQPGMTIACGDSHTSSHGAFGAIAFGIGTSQVRDVLASQTLSLSKLKVRKIEVNGALNPGVYAKDVILHIIRTLGVKGGVGYAYEYAGTTFEQMNMEERMTVCNMAIEGGARCGYVNPDQVTYDYLQGRDFAPQGADWEKAVTWWESIKSDADAEYDDVIVFNAADIPPTVTWGITPGQGIGVNQLIPQPEELLEEDRFVAEEAYRYMDLYPGQPIKGTKIDVCFIGSCTNGRLTDLQEAAKIAKGRRVAAGVKAFVVPGSERVKKAAEAEGLDKIFEAAGFEWREPGCSMCLAMNPDKLEGRQISASSSNRNFKGRQGSASGRTLLMSPAMVATAAIQGEVADVRELL

SEQ ID NO: 18972 - protein, 186 aa, Anabaena PCC7120
KTIVLTGASAGIGRMLAISLSQQDANLVLAARNQEALEQTMTACTNYPGKVIAVHTDVTQAEACQQLIERAIATFGQIDILINNAGIGMLTRFDEVTDISIFEQVMQANYLGAVYCTHYALPYLKASQGQLVAISSICGKTGVPTRTGYVASKHAMQGFFDTLRIELHSTGVDVLVVSPGFVATDI

SEQ ID NO: 18973 - protein, 244 aa, Anabaena PCC7120
LIVGASQGIGLGFVKKLLQDDRIAKIYATYRQKDSAFELITLENAYSQRLTCLSLDITDELQIAEILQQINIETNRLHLVINCVGILHEGDFQPEKSLRQLNSENLLRYFQINSIGAVLLAKHLLPFFRHNEPSVFASISAKLGSIGDNQLGGWYGYRASKAALNMFMRTVAVEYGRSCPKTTVVTLHPGTTDTRLSRPFQKNVAAEKLFSIERTVDQLLAVIAHLREGDSGKFFSWDGSQLPW

SEQ ID NO: 18974 - protein, 512 aa, Anabaena PCC7120
MPQNPERTVDHVDLFKQPEYTELFENKRKNFEGAHPPEEVERVSEWTKSWDYREKNFAREALTVNPAKGCQPVGAMFAALGFEGTLPFVQGSQGCVAYFRTHLSRHYKEPCSAVSSSMTEDAAVFGGLNNMIEGMQVSYQLYKPKMIAVCTTCMAEVIGDDLGAFITNSKNAGSIPQDFPVPFAHTPSFVGSHITGYDNMMKGILSNLTEGKKKATSNGKINFIPGFDTYVGNNRELKRMMGVMGVDYTILSDSSDYFDSPNMGEYEMYPGGTKLEDAADSINAKATVALQAYTTPKTREYIKTQWKQETQVLRPFGVKGTDEFLTAVSELTGKAIPEELEIERGRLVDAITDSYAWIHGKKFAIYGDPDLIISITSFLLEMGAEPVHILCNNGDDTFKKEMEAILAASPFGKEAKVWIQKDLWHFRSLLFTEPVDFFIGNSYGKYLWRDTSIPMVRIGYPLFDRHHLHRYSTLGYQGGLNILNWVVNTLLDEMDRSTNITGKTDISFDLIR

SEQ ID NO: 18975 - protein, 459 aa, Anabaena PCC7120
MLTQLPNPISVPSWWQLINWIADPIGFQKKYSKKYGNIFSMQLAGIGSFVILGEPQALQEIFTQDSRFDVGRGNTLAEPLIGRTSLMLMDGDRHRRERKLLMPPFHGERLQAYAQQICLITNQIASEWQIGQPFVARSAMQKLSLEVIIQIVFGLADGERYQQIKPLFTDWLNMTDSPLRSSMLFLKSLQKDWGTWTPWGQMKHKQRSIYDLLQAEIEEKRTKENEQRGDVLSLMMAARDENGQAMTDEELKDELLTILFAGHETTATTIAWAFYQILKNVNVQEKLQQELDRLGANPNPMEIAQLPYLTAVSQETLRMYPVLPTLFPRITKSSINIAGYQLEPDTTLMASIYLIHYREDLYPNPQQFRPERFIERQYSPSEYIPFGGGSRRCLGYALALLEIKLVIATVLSNYQLALAEDKPVNVQRRGFTLAPDGGVRVIMTGKKSLKFEQSSKIFN

SEQ ID NO: 18976 - protein, 480 aa, Anabaena PCC7120
MTPPENKNLVDENKELIQEVLKAYPEKSRKKREKHLNVHEENKSDCGVKSNIKSVPGVMTARGCAYAGSKGVVWGPIKDMIHISHGPVGCGYWSWSGRRNYYVGVTGINSFGTMHFTSDFQERDIVFGGDKKLTKLIEELDVLFPLNRGVSIQSECPIGLIGDDIEAVAKKTSKQIGKPVVPLRCEGFRGVSQSLGHHIANDAIRDWIFPEYDKLKKENRLDFEPSPYDVALIGDYNIGGDAWASRMLLEEMGLRVVAQWSGDGTLNELIQGPAAKLVLIHCYRSMNYICRSLEEQYGMPWMEFNFFGPTKIAASLREIAAKFDSKIQENAEKVIAKYTPVMNAVLDKYRPRLEGNTVMLYVGGLRPRHVVPAFEDLGIKVVGTGYEFAHNDDYKRTTHYIDNATIIYDDVTAYEFEEFVKAKKPDLIASGIKEKYVFQKMGLPFRQMHSWDYSELGDGVQMSDEVRFFCEGRKKSLFLA

SEQ ID NO: 18977 - protein, 196 aa, Anabaena PCC7120
TDENKVIAITGASSGIGEATARLLARQGLRVMLGARRTDRLEAIAAEIRSKGGEAEYRTLDVTNLEDMQAFVEFAQDKFGRLDVVVNNAGLMPLSRLEVLKIDEWNRMIDVNIRGVLHGIAAALPLFKQQRSGQFVNLSSIGGHNVYPTAAVYCATKFAVWAISEGLRQESTDIRVTVISPGVTETELASTITDAK

SEQ ID NO: 18978 - protein, 215 aa, Anabaena PCC7120
QGVILDVDGTLVISNDAHAQAWVEAFAEFGYEVKFEQVRPLIGMGGDQIIPQFAPGLSDEQGKGKEIADQRKQLIINKFAKNLAPTNGTRQLILKMQSLGLHLIIASSASSQELSVLLKAAQVEDLLSQDEATTSSDAEASKPAPDIVEVALNRLNIEPSEVVMLGDTPYDITSANQAGIKVIALRCGGFDDSQLKDAIAIYDDPADLLTQYQHS

SEQ ID NO: 18979 - protein, 276 aa, Anabaena PCC7120
PSSVGTILASAGAKSIKLWNPNTGKLLRTLSGQAFTVSFSPDGQILASGSQDGSLNLWDVQTGKLIRTLQHSEPVLGVVFSPDGQTLVSNLDLGSIIRLWNWRTGEIIRIKDDPDAYQKGFENFKTQPATFSLDGQTLFATSGSGSMLQSWNLKTSKRTGSFDAKSSINAVAISPDGNTLATGIRDNAIKLWNINDGKLIHTLTGHQGQVRTVAFSPDGTLLASGSSDGTVKLWNATTGKEINTFTAHKEQVWSVAFNPDGKTLASTGQDGSVKIW

SEQ ID NO: 18980 - protein, 254 aa, Anabaena PCC7120
MQLKPINQQVVSVVGAASGIGREAAIRFAQRGAKVVVSARSQSGLESLVREITDFGGEAIAVVANVEKFEQVKAIADKTVEVYGRLDTWVHVSAIGLFANFDDITPEEFKHVIDVNLMGQVYGAMAALPHLKREGRGALIHISSMEARRSLPYQSAYSSSKHGVDGFIDAMRLELIHDKWPISVTSIKPAVINTPFWNNGLTKLGVKPSGTPPYYDPRLVANAILYAAEHPTRDLLVGDVAKILDLLHRISPAL

SEQ ID NO: 18981 - protein, 378 aa, Anabaena PCC7120
VVITGIGLVSALGKSLEESWQGLIAGKSGIKWHQPFPELPPLPLGLIGEKPTSLHSLTQVVVDAAIKDAGLVPPLTDCALVIGSSRGYQGSWEKLARQIYTGDDSADEAEKLENWLDVLPHMNTIAAARQIGATGAVIAPMAACATGIWAIAQAAILIQTGQYQRVIAGATEAAITPLTLSGFQQMGALAKTGAYPFDLQREGLVLGEGAAVFVLESRQLAKKRKAKIYGQILGFGLINDAYHSTQLEPEGKGAIASIQQCLARSQLTLTDIDYIHAHGTATQLNDRVESQVIKHLFPSKVAVSSTKGSTGHTLGASGALGVAFSLLALEQKIIPPCVGFQEPEFDLNIVKTAQHSQIQQVLCLSFGFGGQNAAIALG

SEQ ID NO: 18982 - protein, 266 aa, Anabaena PCC7120
PHKSNVNTHPFRILQGHSNRVFSVVFSSTGQLLASGSADRTIKLWSPHTGQCLHTLHGHGSWVWAIAFSLDDKLLASGSYDHTVKIWDVSSGQCLQTLQGHPGSVLAVAFSCDGKTLFSSGYEKLVKQWDVETGYCLQTWEADSNRVWAVAVSRDNQYLATGGDDSVVRLWDIGKGVCVRTFSGHTSQVICILFTKDGRRMISSSSDRTIKIWNVSTGECLATLQAHDHWVWSLYLTPDEKTLLSSSWDETIKCWNISTGECWQTL

SEQ ID NO: 18983 - protein, 499 aa, Anabaena PCC7120
MSKKVAIVGAGPGGLATAIRLAGLGYQVEIFEAAERVGGRMRGFEVDSYAFDTGPTILQLPHLYKELFEEAGLNFADYVQLKRLEPYTRLKFWDGTQLDITSDLQSFKTQLATLRSDLPLAFDRWYSEHIRKYELGYKPYLAGPARSIFGYLRPDELMKFLSFRPWENLYQHFWRFFQDERLVYALSYPSKYLGMHPTVASSVFSLIPFLEFSQGVWHPVGGFRALAQGLANAAQDLGVKIHLHSPVHQIWIEQGQVRGLELADASRHQFDTVVINADFAYAVRHLLPTSARGRYTDNKLGQMQFSCSTFMLYLGINRRYEDLPHHQIYLSDNIRRLERPWVDDSALDETDPPFYVCNPTIIDPSNAPAGHSTLFVLVPIPNTSYAVDWDIKQKSYTDFILKRLHLLGYHNIEQHIVTQSCYTAQSWLDDYRVHLGAVFNLSHNLTQLGPFRPPIRSENIAGLYWIGGAVHPGSGLLTILEASRSAAGFIHQDFASTGS

SEQ ID NO: 18984 - protein, 316 aa, Anabaena PCC7120
PLRLTELPVPKPNSEQVLIRVHACAVCRTDLHIVDGELTHPKLPLILGHQIVGTIEALGEKVDQFHLGQRVGVPWLGHTCAHCPYCLSGRENLCDYAEFTGYNLDGGYADYTVADHRFCFPLDPSYPDLQAAPLLCGGLIGYRAYNMTGNAEKLGFYGFGSSAHILIQLARYQGRKVFAFTRPGDTVGQEFARQLGANWAGDSDVLPPEPLDAAIIFAPVGKLVPTALRAVAKGGVVVCAGIHMSDIPSFPYSILWEERVLRSVANLTRQDGEEFLTIAPQIPIRTEVNSFPLTQANEALDALRSGKIEGSAVLVM

SEQ ID NO: 18985 - protein, 688 aa, Anabaena PCC7120
NPLLKGSGLPPFTEIQPEQVQPAFQQLLAELEQELTTLEANVQPTWDGLVEPLEKLSDRLTWSWGIVNHLVGVKNSPKLRVAHEAVQPQVVQFINKLGQSQPIYNAFKELRASDSWKTLDSAQQRIVEAAIRDAELSGVGLQGEARERFNAIQMELAELATKFSNHVLDATTAFSLTLTTKAEVDGLPQSLLSLAAQAARAAGAENATPENGPWRITLDIPSYSPFMQHSTRRDLREKLYKTYITRASSDELDNNPIIERTLELRQELANLLGFQNYAELSLASKMAPNVEAVEALLEELRSASYDAAVKDLEALKAFAASKGAPEAADLRHWDISFWAERQREEKFAFTAEELRPYFPLPQVLDGLFALVHRLFGITVTPADGQAPVWHKDIRYFQIADETGSPIAYFYLDPYSRPAEKRGGAWMDTCINRAIITENGVTTVRLPVAYLVCNQTPPVDGKPSLMTFYEVETLFHEFGHGLHHMLTKVNYTGAAGINNVEWDAVELPSQFMENWCYERTTLFSLAKHYQTGETLPEHYYQKLLAARNYMSGSGILRQLHFSSVDLELHSRYRPGGQETAADVRHRVAQKTTVLPPLPEDAFLCAFGHIFAGGYAAGYYSYKWAEVLSADAFAAFEDAGLEDEAAIKATGRRYRDTVLALGGSKHPMEVFAAFRGREPSTTSLLKHNGL

SEQ ID NO: 18986 - protein, 398 aa, Anabaena PCC7120
  unsure (1)..(398): unsure at all Xaa locations
VXSMKILVLSWEFPPRIVGGIARHVAELYPELVKLGHEIHLITVEVGQASMYEVVEGIHVHRVPVSYSHDFFHWVVNLNQSMGHHGGKLIAEEGPFDLIHAHDWLVGDAAIALKHNFKIPLIATIHATEYGRYNGIHNETQRYIHTKENLLAYNAWRIIVCTNYMRQEVERTLESPWDKIDVIYNGIRPEKKQHHEDFHAQDFRRQFAEDHEKIVYYVGRMTYEKGVSNLLNAAPKVLSEMGGYVKFVIVGGGNTDNLKRQAWDLGIWHKCYFTGFLSDEYLDKFQTVADCAVFPSLYEPFGIVALESFASRVPVVVSDTGGFPEVVQHTRTGIVTWVNNHDSLAWGILEVLKNPGYSQWLIDNAYKDLEHRFSWPKLAQQTEAVYQRVVKERSQVEW

SEQ ID NO: 18987 - protein, 373 aa, Anabaena PCC7120
SEDSEYFAKCVEQLGIPITLHPHLAQIQVSGKGGDIPAKQADLFVGLAGTAARFITALVALGNGEYRLDGVPRMRERPMGDLVTVLQNSGITINFEGNSGFMPYTIYGQQFAGGHFRLKANQTSQQLSALLMIAPYAQQDTTIEVEGTLVSQSYVKMTCRLMADFGVDVTQTDDNQFHIKAGQRYQARHYTIEPDASNASYFFAAAAVTGGRVRVNHLTKQSCQGDILWLNVLEQMGCQVIEGADYTEVIGPEQLQGIDIDMNDMSDLVQTLGAIAPYASSPVIIRNVEHIRYKETERIRAVVTELRRLGVKVEEFADGMKIEPTPITPAAIETYHDHRMAMAFAVTGLKTPGIVIQDPGCTAKTFPDYFTRF

SEQ ID NO: 18988 - protein, 375 aa, Anabaena PCC7120
MARDYYEILGVARDADKEEIKQAYRRLARKYHPDVNKEPGAEERFKEINRAYEVLSEPETRARYDRFGPEGVSGAGVGFQDMSDMGGFADIFESIFSGFAGGGMGGPTQQRRRGGPARGDDLRLDLKLDFREAVFGGEKEIRISHLETCETCSGSGAKPGTRPRTCSTCSGSGQVRRVTRTPFGSFTQVSTCPTCNGTGMVIEDKCDTCDGKGTNQVTKKLKITIPAGVDNGTRLRIKDEGDAGQRGGPPGDLYVYLFVNEDEEFQRDGINVISEIKVSYLQAILGCRLEVNTVDGPVELIIPAGTQPNTVMKLENRGVPRLGNPVSRGDHLLTVLIDIPTKVIPEERELLEKLAKIKGDRTGKGGLEGFLGNLF

SEQ ID NO: 18989 - protein, 606 aa, Anabaena PCC7120
  unsure (1)..(606): unsure at all Xaa locations
MGKVIGIDLGTTNSCVAVLEGGQPIVIANSEGGRTTPSIVGFGKSGDRLVGQLAKRQAVTNAENTIFSIKRFIGRRWEDTETERDRVPYGCVKGRDDTVDVQIRGRNYTPQEISAMILQKLKQDAENFLGEAVTQAVITVPAYFTDAQRQATKDAGTIAGLEVLRIINEPTAAALAFGLEKQDQEQLILVFDLGGGTFDVSILQLGDGVFEVKATSGNNQLGGDDFDGCVVCWMIERFQQQEKIDLAQDKMALQRLREAAEKAKIELSSMASTSINLPFITADETGPKHLEMELSRSKFEELVGQLIEATIQPMIQALKDADLKPQDIDKIILVGGSTRIPAVQNALIKFFNGKAPDRSVNPDEAVALGAAIQAGVLGGEVDNLLLLDVTPLSLGIETLGEVFTKIIERNTTIPTSKSQIFSTAVDGQTSVEIHILQGERTMARDNKSXGKFLLAGIPPASRGVPQIEVSFEKDVNGILKVAAQDKGTGQEQSIRITNTGGLSTNEVERMRQEAEVFAEEDRRRKELVELKNQADNLLIIYESTLKDNGDLIGEQIKVLANEKVAQIQSVMTNPAISLKEFQQCLDDFQQTLFSIGANVYQRANTQ

SEQ ID NO: 18990 - protein, 310 aa, Anabaena PCC7120
GASLTALGNAYRYLGEYQRAIELFQQSLEIFRDIGDRNGVSNSLIGLGNTYNSVGEYQRAIELFQQSLEISRDIGDRNGVGGSLMGLGNAYNSVGEYQRAIELFQQSLEISRDIGDRNGVGNSLIGLGNAYHSLGEYQRAIEFRQQSLEIFRDMGDRNGVSISLNNLGNTYYFLGEYQRAIEFHQQSLEISRDIGDCNGVGRSLNNLGNAYYSLGKYQQAIEFHQQSLEIKRDIGDRNGVGTSLNNLGTAYSSLGKYQRAIELFQQSLEIKRDIGDRNGVGTSLMNLSNAYYRCGKIREAFAVWHQAESI

SEQ ID NO: 18991 - protein, 424 aa, Anabaena PCC7120
QHLPYTPRLVTSLPGPRAKAIVERDRAVTSPSYTRDYPLVVNRGEGCMVEDVDGNVFLDMTAGIAVTSTGHAHPEVVRAIQEQSARLIHMSGTDFYYEPMVELAENLASQAPFVHDTKVFFTNSGAESNEGAIKLARYYTKRSLIIAFLGAFHGRTYGAMSLTGSKTVQRANFGPLVPGVTHIPYGTHASLDYLENNLLTTIIPAHEVAAIVVEPIQGEGGYIVPEDGFLQRIRNICDRYGILMVVDEVQSGMGRTGRLFAIEHWNVTPDIITTAKGIASGMPLGAILARAELMTWPPGSHATTFGGNPVACAAGIVTLKLLESGLMDNATQMGELLQTGLTQLHEQFPRMSLPRGKGLMVAVDLLDEDGNFDSTLRDRIIQEAFYHGLLLLGCGKAAIRFCPPLVINREQIQTSLDILAGILR

SEQ ID NO: 18992 - protein, 442 aa, Anabaena PCC7120
RDRRQKLAHLIDFPAILWSGGSNARNFPANRFPFRASSHFLYFAGLPLPNAAIYLKAGKLTLFIDDPAPGSALWHGETPKREEIAETIGADAAQPLSELTPFLEGAATIAVQDATTWTQQSQLLNRWVLPQGQPEGIDLELAKAIVTLRLTHDTGALAELRKAATVSVAAHKAGMAATTNAKIEAEIRAAMESVFLAHNMTTAYNSIVTVHGEVLHNEQYHHPLQPGDLLLADVGGETELGWAADITRTWPVSGKFSPTQRDIYDVVLAAHDTCIANIRPGVEYAEIHLLGARVIAEGLVNLGILRGNPEDLVEKDAHALFFPHGIGHLLGLDVHDMEDLGDLAGYEEGKKRSDRFGLGYLRLNRPLRTGMLVTIEPGFYQVPAILNDEKTRSRYQYTVNWERLSQFTDVRGIRIEDDVLVTDTGSEVLTAALPNDADTIEH

SEQ ID NO: 18993 - protein, 519 aa, Anabaena PCC7120
RSISRRLLAILMATVVLWWGWTPEIALAQTPIALQPSKTPTAKVPTSIQPYLDRVIKDLTEFRLDNGMKFIVLERHQAPVVSFLTYADVGGVDEPDGKTGVAHFLEHLAFKGTTRIGTENYQAEKPLLERLEQLDTQIRAAKANGKQDDVVRLQATFKEVESQAGKLVKQNELGQIVEQSGGVGLNANTSTEATRYFYSFPSNKLELWMSLESDRFLDPVIRREFYKEKDVILEERRMRVENSPIGMMVERFIDAAYKVHPYRRPVIGYDQDIRNLTPEDVQTFFNTYYVPSNLTIAVVGDVEVAQVKRLAQTYFGRYKAAPKPQSKIATEPKQTQTREVTLELASQPWYLEGYHRPAMTHPDNAAYDIIASLLSSGRTSRLYKSLVEKERVALNAQGFSGFPGDKYPNLMLFYALTAPNHTVDEVALALSKEIDKLKTEPVSAVELERVKTQARAGLLRSLDSNMGMAQQLLEYEVKTGSWRNLFKQLDDIVAVTPADIQRVAKATFTPENRTIGKLL

SEQ ID NO: 18994 - protein, 551 aa, Anabaena PCC7120
MAKIISFDEESRRALERGVNALADAVKITLGPKGRNVLLEKKYGTPQIVNDGITVAKEIELEDPLENTGARLIQEVASKTKDVAGDGTTTATVLVQALIREGLKNVAAGTNPVSLKRGIDKTTEALVAEIAKVAKPVEGSAIAQVATVSSGNDEEVGAMIAQAVEKVTKDGVITVEESKSLTTELEVVEGMQIDRGYISPYFITNNERQTVELENVRILITDKKISSIQELVPVLEKVARLGQPLLIIAEDVEGDALATLVVNKARGVLSVAAIKAPGFGERRKALLQDIAILTDGQLISEEIGLSLDTASLEALGTAQKITIEKDNTTIVAGNTTKPEIQKRIAQIRRQLEETDSEYDSEKLQERIAKLAGGIAVIKVGAATETELKDRKLRIEDALNATKAAVAEGIVPGGGKTLIYLASKVDEIKKNFDEEEKIGADIVKRALEAPLRQIADNAGAEGSVIVSRVKDSDFNIGYNAATGEFEDLIAAGIIDPAKVVRSALQNAASIAGLVLTTEAIVVEKPEKKSAAPADAGMGGMGGMGGMGGMGGM

SEQ ID NO: 18995 - protein, 243 aa, Anabaena PCC7120
LRGQVAVVTGASRGIGRAIALELANYGATVVVNYASSSTAADEVVAEITGAGGEAVALKADVSQVEQVDNLINGAIDKFKRIDILVNNAGITRDTLLLRMKPEDWQAVIDLNLTGVFLCTRAVSKLMLKQRSGRIINITSVAGQMGNPGQANYSAAKAGVIGFTKTVAKELASRGITVNAVAPGFIATDMTSNLKSEGILQYIPLGRYGQPEEIAGMVRFLAADPAAAYITGQVFNVDGGMVM

SEQ ID NO: 18996 - protein, 473 aa, Anabaena PCC7120
YINGQWLNAATETTLNSHNPADKSEIVATFPRSQADDVDRAVAAARQAYGSWRKVPAPARAEYIFRVGELLLQHKEELAQLISREMGKPLTEARGDVQEGVDCAFYSAGEGRRLFGQTTPSEMPNKFAMTMRMPIGVCALITPWNFPVAIPCWKAMPALVCGNTVILKPAEDTPACATKLIEIFAAAGLPPGVINLVHGVGEEVGKALVEHPNIDLVSFTGSSATGAYVGETCGRTHKRVCLEMGGKNAQVVMEDADLELALDGALWGAFGTTGQRCTATSRLILHRDIKEKFTTMLRERTSQLRLGAGTEPETDIGPIINNRQLQRVHEYMNIAREEGAKILIGGEIATEGQLQQGYFFQPTILDNVTPQMRVAREEIFGPVVALIEVSTFEEAIAILNDTKYGLSSSVYTRDINRAFVAMRDIEAGITYINGPTIGAEVHLPFGGVKQTGNGHREAGTTALDVFTEWKSVY

SEQ ID NO: 18997 - protein, 351 aa, Anabaena PCC7120
  unsure (1)..(351): unsure at all Xaa locations
GNTFFELQRYKDALSAYEQAVDIRPDYAPAWQGKGKTLFRLKQYQDALTAYDKAIQIQPDYVEAWSGRGFSLQNLQRYSEAXASFDKALQLNEKYPEVWNARGEAFSNLKQYDQAIKSYDKAIEFNSDAYESFYNKGLALQSMKEYNEAINAYNKAIEIKSDYERAWYNLGNSLVNLNRYEDAFKAYDKAVQYKTDYAIAWLSRGNVLIILRRYPEALESFNQVIKFNPNNYQAWYGRGWSQHQNQRYAEAIESYKKAATIKPSNYEIWYSLGNSQYILQQYQEAIASYNKAVRYRPKHIESWYSRGNALFSLKQYKEAIASYEQAIKHKPDYSQAINARDEAQRQLQAAT

SEQ ID NO: 18998 - protein, 263 aa, Anabaena PCC7120
LVGRYQIISHLGGGGFGETFVACDTHLPGLPKCVVKKLQPQANDPATLEIARRLFDTEAQVLYKLGSCDRIPQLLAYFEEDAEFYLVQEFIPGHDLSKELTPGKVFTQDEVTILLQEILTILEFVHQQNVIHRDINPRNLLRRQDGKLILIDFGAVKQITTQIVTPTGENKSTVIIGTPGYIPGEQAQGNPKFSSDIYAVGIVAIQALTGLLPHQLEHDADTHEIIWQNHAQVSSEFARFIDKMVCYDFRQRYAAATTALQAL

SEQ ID NO: 18999 - protein, 575 aa, Anabaena PCC7120
KAERESLSYGELIQKVNQEQVKRVELDETEQIAKVYLKGQKPDAPPIQVRLLEQNNELINRLKEKNVDFGEISSANSRAAVGLLINLMWILPLVALMLLFLRRSTNASSQAMNFGKSRARFQMEAKTGVKFDDVAGIEEAKEELQEVVTFLKQPERFTAVGARIPKGVLLVGPPGTGKTLLAKAIAGEAAVPFFSISGSEFVEMFVGVGASRVRDLFKKAKDNAPCLIFIDEIDAVGRQRGTGIGGGNDEREQTLNQLLTEMDGFEGNTGIIIIAATNRPDVLDSALLRPGRFDRQVIVDAPDLKGRLEILQVHSRNKKVDPSVSLEAIARRTPGFTCADLANLLNEAAILTARRRKEAITILEMMDACDRILAGMEGTPLCDSKSKRLIAYHEVGQWFVGTLLKDHDPVQKVTLIPRGQAQGLTWFTPNEEQGLISRSQLKARITSTLAGRAAEEIVFGKPEVTTGAGDDLQKVTSMARQMVTKFGMSELGPLSLENQSGEVFLGRDWMNKSDYSEEIAAKIDSQVREIINTCYQTSKELLQTNRVVMERLVDLLTEQETIEGDLFRKIVSESQ

SEQ ID NO: 19000 - protein, 545 aa, Anabaena PCC7120
KKIAADEHFYGFGERTGLLDQIATIRTNWACDALDYDVLTDNMYQAIPFFMALRPGLGYGIFFNTTFWSQFDLGVQEPGVWRMETQEGELDYYIIYGPEPAKILATYTQLTGRMSLPPKWSLGYHQCRWSYESQDIVRQLAKEFRQRQIPCDVIHLDIDYMDGYRVFTWNPKRFSEPKALIDDLKQDGFQAVTIVDPGVKYEPEADYPVFDEGLQKDYFVRKTNGQLFHGYVWPDKAVFPDFVRPEVRDWWGSWHKNLISMGVAGIWNDMNEPALDDRPFGDPGNKISFPLDAPQGSADEMSNHAATHNLYGLMMAQASSQAMQKLRPVERSFILTRSGYAGIQRWSAVWTGDNQSLWEHLEMSLAMLCNLGLSGVAFVGADIGGFAGNATSELFARWMQVGMLYPLMRGHSALSTARHEPWVFGDRTEKICREYIQLRYQLLPYIYTLFWEAATTGAPILRPLLYHFPSDRQTFSMADQVMLGASLLAAPVYRPGVEYRAVYLPEGCWYDWWTGEAFTGPTNILAHAPLERMPLYVRAGAIIPM

SEQ ID NO: 19001 - protein, 439 aa, Anabaena PCC7120
LPNGPRIPRLLRLFKFITQPIQYVEDFAKVYGDNFTIWGSGESYFVYFSHPQALEQIFTNVSCFESSGGGSPLLELLLGKNSLILLEGDRHQRQRQLLTPPFHGERMRAYGQTIREITQQVTQAWQMGKPFNIRASMQEITMRVILRVVFGVDEGELFQELRQLLTTLLDFMGSPLMSSTFFFSFTQKDYGAWSPWGRMVRLIKKIDQLIYALIAQRRAEFGENRQDILSLLISARYDDGQPMSDVELRDELMTMLVAGHETTASALTWAFYWIDSVPEVREKLFQELDTLNDDSEPSIIAKLPYLTAVCQETLRFYPIVLNAFFRRTKNPMEIMGYKLPKATLVVPSIYLAHHREEVYPQSKQFRPERFLEKQFSPYEYLPFGGGNRRGIGLAFAQYEMKIVLATILSQFQVSRLSKRPVQPVRRGLTLAAPGGMKMV

SEQ ID NO: 19002 - protein, 266 aa, Anabaena PCC7120
LVSASEDQTIKVWNLETAKVTTTLQGHTDTVRAIALTPDDQTLISGSADKTIKIWNLQRLRIKRTLSSHAGGIWSLAISSDGQTLVTAHENGSIQIWNFPTGQLLRTIKGHQGRIFSVAMSPDGETFATGGIDKKIKIWNLYTGECLHTITEHQDTVRALVFSRDGKMLASSSWDKSIKIWQMPTGKLLHTLLGHTSRVVTLNLGIDEQTLVSGSLDNKLKIWDMQTGKLLDTISGHTDWILAIAANPAKQILVSSAKDKTIRVWQ

SEQ ID NO: 19003 - protein, 313 aa, Anabaena PCC7120
LTFVPPPIQKINSEIANNAGVEIYVLRLDLMHPWVNGNKWYKLKYNLLEAKEKSYTKLLTFGGAYSNHIFATAAAGNLLGFQTIGIIRGEETLPLNPTLSFATQQGMQLVYVDRETYRQRNSTTLHTDLRKRFGEVFIIPEGGSNLNGVRGCLEIISAATQVFDIVCVACGTATTLAGIALALEPQQRVIGFPVLKNGGFLAQDIAQLMKNYVAAGLPISSSSPASWELVCDYHFGGYAKVKDDLILFSHQFTQSYGVPLDYVYTAKMFYGVMDLLKQRYFTKGDGLRPTVGHRILMIHTGGLQGNIGMSERL

SEQ ID NO: 19004 - protein, 751 aa, Anabaena PCC7120
VNINDITIPFQVDLSNCSKEPIHIPGLIQPHGVLLVLQEVDLTILQVSNNTFNILGRHPEQLLNQHLSCLLEAEQLSLLKDCLAQEDLQIINPLEFIIKSHNESISFDVIAHRSNNLLILELEANLSDKTHSFFRFYHLVKLAMLKLQGTATTTEISQILAQEVRKITGFDRVMVYRFDEQWNGKVIAEVKPEYLTSYLGLNYPASDIPQQARKLYSQNWLRLIPDAKYQPVPIVPINNPLNDQPLDLSRSVLRSVSPLHIEYMQNMGVTASMSISIMKNQKLWGLIACHHQSPKYIPYEIRSACEFLGQMTSVEMSAKEDSEDTEDKIQVKSVHSKLVQYMSAENDFINALIDHQPNILDLVKAQGAAVCFNGNSCTVGQVPPMPDIQVLVEWMSQNIHEEIFATDSLATVYPDAEKLRDVASGLIALSISRSQKNYILWFRPEVVRTVDWGGNPHKPVEVIANGEIRLSPRKSFDLWKETVLLKSQPWKSHEVNAALELRSAIIGIVLQKADELAQLNIELERSNQELDAFAYIASHDLKEPLRGIHNYSNFLMEDYGEIIDAPGKEKLLTLIRLTQRMEDLIDSLLHFSRLGRVDLSMQDTDLNEIVHRILDMLSGRIEETGVEIRILQLLPVVYCDRIQIGEVFSNLIANSIKYNDKANKWIEIGYIDNPPLPPTFYVRDNGIGIREKHFETIFRIFKRLHSPSKYGGGTGAGLTIAKKIVERHGGKIWVESTYGEGSTFYFTLQDV

SEQ ID NO: 19005 - protein, 255 aa, Anabaena PCC7120
IMLSKRILPCLDVKAGRVVKGVNFVDLKDAGDPVELAKVYNDAGADELVFLDITATHEDRDTIIDVVYRTAEQVFIPLTVGGGIQSLENVKALLRAGADKVSINSAAVRDPELIDRASDHFGNQCIVVAIDARRRVDPSNPGWDVYVRGGRENTGLDALSWAKEVEKRGAGELLVTSMDADGTQAGYDIELTRAIAESVEIPVVASGGAGNCEHIYTALTEGKAEAALLASLLHYGQLSVAEIKNYLHESQVPVR

SEQ ID NO: 19006 - protein, 1133 aa, Anabaena PCC7120
VALQDDQGQSMATISVNRDITERKHAELLLRRSEERFQAFMNHSPTPAWITDIDGTIVYVSETYRRTFQLPTQELIGKNIVDIYPPELTQTFRETIQIVARTRQVMETVESAPCSDGTGRDFLVYKFPISSKPDECLIGCIAIDITERKQAEAALRKSEERWQLVIEGNQDAIWDWNIITNETFRSARWAELIKEQNYQPIADHADCVSRIHPDDYERVMAVKQDCLSRKIPNYVVEYRLRCNDDSYRWVLVHATGQWDEQGNPVRMVGSIKDITERIEAQEALQRQLHRTLLLEKITQKIRQSLDSKEIFETAATQIGQALAVDRCLIHSYISHHDPHIPLVAEYNNVLDYCSMQKWEFTTTGNQHILKMMSQDKAIASANVYTDPLLQTAVPSCCEIGVKSMLAVRTSYQGEPSGAICLHQCGYFRQWTNEEIELLEAVAAQLGIALAQAQLLEQETRQREELTIKNFALEQAKRAAEAANRAKSEFLAMMSHEIRTPMNAVIGMTGLLLDTELTSQQRDFVETVLTSGDALLSIINDILDFSKIESGKLELEEQPFEVRTCVEQVIDLLAAKAAQKDIELAYLIHPQVPMQIAGDLTRLRQILTNLLNNAIKFTPEGEVVVSVRSQPSPNQKNKNCCEIIFTIKDTGIGIAPETMDLLFQPFVQADASMTRKYGGTGLGLVISKRLGEMMGGYLWVESRGCVGGNPPPGWQTKNSISSASVATGSTFYFSMTVPVVAHADLETPITSPVQLSGKRLLIVDDNPTNRQILRLQAEPWQMETYTAPSGAEALALIDQGMAFDIAILDVQMPEMDGLTLARQIRQRPSYQHLPLVILTSWGQPDTDLSDIEFAACLNKPIKQSQLYDVLASTLGNQPIRASVVPDRSTEINSCLAQQIPLRILLAEDIVVNQKVALLILKKMGYRADVVANGLEVLEALQRQFYDVVLMDVNMPEMDGLKASQIICQTWSPSSRPYIIAMTANAMRGDREACLAAGMDHYISKPLQLEELAKALGKCHPSGSAIEKALEKTSSQNQTFTDISDLKFATIDTKILQALRDMLGGDKVAFAELINCYLTESPKLIQNIDVAINTKDTQGIWKTAHKFKSSSGSVGAVFLAQLCKLLETKGRNNNL

SEQ ID NO: 19007 - protein, 208 aa, Anabaena PCC7120
MRVKICGITQPQQSVAIASLGATALGFICVPSSPRYVTAGQIRDAVTPLPENIDKIGVFANSSIAEIYQTVIDSGLTGVQLHGDETPEFCDQVRQSLPQVEVLKALRVRSLEHLEQAVIYTKYINTLLLDAYHPQQLGGTGQTLDWQMLQKFRPSCPWLLAGGLTPENILEALSQLNPDGIDLSSGVELKPGDKDLDKVALLFEKLES

SEQ ID NO: 19008 - protein, 208 aa, Anabaena PCC7120
EAINTRPDRNTHNGREPELHQPSEEDMESMMGAVRSILVGVGEDPEREGLLKTPKRVAEAMRFLTSGYNQSLEELLNGAVFDEGHNEMVLVRDINFFSLCEHHMLPFMGRAHVAYIPNQKVVGLSKLARIVEMYSRRLQVQERLTRQIAEAVQTILEPQGVAVVMEASHMCMVMRGVQKPGSWTVTSAMLGVFQEEQKTREEFFNLIR

SEQ ID NO: 19009 - protein, 229 aa, Anabaena PCC7120
MSLEQKRRALITGASSGIGKATALAFAKAGIDVALVSRSLDKLTPVVEATKQTGVVAKAYTVDLADVSQVEAKIQAIAIDFGDIDILVNNAGVAYTATLSETPLADWQQVINLNLTGVFECIKGILPTMRDRHTGTIINVSSIAAKQSFPHWGVYSVSKAGLMALSQTLAQEERVHGIRVTAICPGAVNTGLWDTETVKADFDRSKMLTPEIVAQSILYTALLPPQAVI

SEQ ID NO: 19010 - protein, 378 aa, Anabaena PCC7120
  unsure (1)..(378): unsure at all Xaa locations
SVKHGFRPLLVXGLGTGAWGLGRKIHPSHKIVPKTQSPIPIPHTQYLIPNTXSLTMATTERKPLLLDFEKPLAELANRIDQIRQLAEENGVDVSGEIRKLETRAMQLREEIFSTLSPSQRLQVARHPRRPSTLDYIQAISDEWMELHGDRCGGDDPALIGGVARLGGKPVVILGHQKGRDTKDNIARNFGMATPGGYRKAMRLMEHANKFSMPILTFIDTPGALPTVVAERQGAGEAIAYNLREMFSLDVPIICTVIGEGGSGGALGIGVGDRLLMFEHSVYTVATPEACAAILWKDASKSPQAAVALKIVSHDLKNLGIIDQILPEPTGGAHSDPLTAATTLKQALLDNLDELDRLTSQERRQLRYDKFRKIGVFTE

SEQ ID NO: 19011 - protein, 469 aa, Anabaena PCC7120
MTLQSFGVIGLAVMGENIALNVERNGFPIAVYNRSREKTDAFMAQRAGGRNVKAAFTLEEFVAALERPRKILVMVQAGKPVDAVIQQLKPLLDEGDIIIDGGNSWFEDTQRRTQELEPAGLRFLGMGVSGGEEGALNGPSLMPGGTQSSYEYLSPIFNKIAAQVDDGPCVTYVGPGGSGHYVKMVHNGIEYGDMQLIAEAYDLLKNAGGLNAKQLHEVFTEWNTTDELNSFLIEITANIFPYIDPETKLPLVDLIVDAAGQKGTGRWTVQTALELGVSIPTITAAVNARIISSIRDERIAASKQLTGPSGKYDGDTKEFINKVRDALYCSKICSYAQGMALLSTASATFNWNLNLSEMARIWKGGCIIRAGFLNKIKKAFNENPALPNLLLAPEFKQTILDRQAAWREVIITAAKLGIPVPAFSASLDYFDSYRRDRLPQNLTQAQRDYFGAHTYLRTDKAGAFHTEWV

SEQ ID NO: 19012 - protein, 298 aa, Anabaena PCC7120
IAISAQNLNRVFGDFHAVVDLNLDIRYGDVYGLLGANGAGKTTAIKMLCGLLPISSGEISLAGETGDLRSAELRQRIGYMSQKFTLYDDLTILENLQFYSGVYGIPPRQQREKISWVLSISGLEGQEHLLTRQLPGGWKQRVAFGASVIHEPEILFLDEPTSGVDVLARQQFWQLINDFARHGTAILVTTHYMNEAEQCSRMCFMVAGRKVAEGSASEIKAAQPGQLFELKIGELQGSYDRLRQFLEPWRVSIFGDRLHVVLDHPTAELPQVRSYLQSANLSLTDIQPMPFSLEDAFI

SEQ ID NO: 19013 - protein, 230 aa, Anabaena PCC7120
LNLNEVTIEVRGLYKHYGKTIAIRGLDLQIRRGELFGLIGPDGAGKTTTFNILGGVMQATAGDAKILGLPARDARNYTGYLTQQFSLYPDLSVDENIYYSAGLRLVPEDQLEARRTKYLKLMQLDSFRDRLAGRLSGGMKQKLALCCALIAEPQVLLLDEPTTGVDTIARREFWDILAGLTVQNITVLVATPDLDEAERCDRVALIYNGQIQQMGSPTELKGNLGLNRLI

SEQ ID NO: 19014 - protein, 308 aa, Anabaena PCC7120
ATDFKDYYAVLGVSKTATPEEIKRAYRKLARKYHPDLNPGDKDAEAKFKDLNEANEVLSDPEKRQKYDRFGQHWNHPGYTDAPPPSSTNVDTTDFDQYGDFDSFINDLLGRTRRKTSTGGFDDFSGGFRSQAPAPDTEAAIALTFSEAFHGVQKRLQLDEETINVRIPPGAKPGSRIRIKGKGRPSPFSQQRGDLYLTIEVLPHPFFRFEGDNLVCEIPIRPDEAVLGAQISVPTPDGSVTMKIPKGVRSGQSLRLRGKGWTLPKGGRGDLFAKLQMVTPQDLSAIEQEYYEKIQANTSFNPRTQLEE

SEQ ID NO: 19015 - protein, 219 aa, Anabaena PCC7120
LSKNTNKVYSVAFSPDGRILASASQDQTIKLWDIATGNCQQTLIGHDDWVWSVTFSPVTDDRPLLLASSSADQHIKLWDVATGKCLKTLKGHTREVHSVSFSPDGQTLASSGEDSTVRLWDVKTGQCWQIFEGHSKKVYSVRFSPDGQTLASCGEDRSIKLWDIQRGECVNTLWGHSSQVWAIAFSPDGRTLISCSDDQTARLWDVITGNSLNILRGYT

SEQ ID NO: 19016 - protein, 284 aa, Anabaena PCC7120
RDVYSVAFSPDSQILASGRDDYTIGLWNLKTGECHPLRGHQGRIRSVAFHPDGKILASGSADNTIKLWDISDTNHSKYIRTLTGHTNWVWTVVFSPDKHTLASSSEDRTIRLWDKDTGDCLQKLKGHSHWVWTVAFSPDGRILASGSADSEIKIWDVASGKCLQTLTDPQGMIWSVAFSLDGTLLASASEDQTVKLWNLKTGECVHTLKGHEKQVYSVAFSPNGQIAASGSEDTTVKLWDISTGSCVDTLKHGHTAAIRSVAFSPDGRLLASGSEDEKIQLWDM

SEQ ID NO: 19017 - protein, 485 aa, Anabaena PCC7120
MYIVQIASECAPVIKAGGLGDVVYGLSRELEIRGNCVELILPKYDCMRYDHVWGLHEAYLNLWVPWFGAAIHCTVYCGWVHGRVCFFIEPHSEDNFFNRGCYYGCDDDDMRFAFFSKAALEFLHQSNKRPDIIHCHDWQTGLIPVMLYEIYKYHGMDTQRVCYTIHNFKHQGIGGVKTLWATGLNREAYYFQDDKLRDDHNPFALNYMKGGIVYSNAVTTVSPNHALEAQYTDVGCGLGHTLYLHKEKFSGVLNGIDYDFWNPEIDRHIPDNYSQDDFEQKLYNKKALRERLLLQAADKPIIAYIGRLDNQKGVHLVHHAIYHALNKGAQFVLLGSATEAGINAHFRHEKQFLNSNPDVHLELGFNEELSHLIYAGADMIVVPSNYEPCGLTQMIGLKYGTVPIVRGVGGLVNTVFDRDYDQNLPPEKRNGYVFYQSDNQALESAMNRAIDLWYQSPEQFQQLAIQGMKYDYSWNNPGTEYLNIY

SEQ ID NO: 19018 - protein, 405 aa, Anabaena PCC7120
SSPFSTDSFDASVMSTYGRFPLALERGAGCRVWDTQGKEYLDFVAGIATCTLGHAHPAMVEAVTRQIQKLHHVSNLYYIPEQGELAQWIIQHSCADRVFFCNSGAEANEAAIKLARKYAHTVLDIEKPIILTANASFHGRTLATITATGQAKYQKYFDPLVPGFHYVNYNDISAVEAAISELDEGDYRVAAILIEPLQGEGGVRPGDVEYFQKLRQICDDTGILLMFDEVQVGMGRSGKLWGYEYLGVEPDIFTSAKGLGGGIPIGAMMSKKFCDVFQPGEHASTFGGNPFACGVALAVCQTLERENILQNVQDRGEQLRSGLRAIAAKYPHHLTEVRGWGLINGLELAADIPLTAADVVKAAINEGLLLVPAGPKVVRFVPPLIVTEAEINTALKLLEKALATV

SEQ ID NO: 19019 - protein, 270 aa, Anabaena PCC7120
KSLRLSWTNVAFFTTIHALALLAPWFFSWSALGLLLFLHWLFGSIGICLGYHRLLSHKSFQVPKWLEYAIATIGALAMQGGPIFWIGGHRQHHAHTEDVYLDPYSSQRGFWWSHMLWILYPRSEFFDYEIYQKYAPDLARQPFYRWLDRYFLLLQIPFGLMLYAIGGWSFVIYGVVLRAVLLWHSTWFVNSATHMWGYRTFNADDNARNLWWVSIVTYGEGWHNNHHTYPNVAKAGFQWWEVDVTWWSIKLLQTLGLAKKVVLPPSQRMN

SEQ ID NO: 19020 - protein, 429 aa, Anabaena PCC7120 [sequence omitted]

SEQ ID NO: 19021 - protein, 352 aa, Anabaena PCC7120
MGNFGRVPVGIVGASGYGGVQLVRLLMDHPEIELVYLGGESSVGKSFASLYPHLAHAVKLSIEEVDPEVIARRCEVVFLSMPNGLACQIVPTLLEKGCKVLDLSADYRFRNLTTYTTWYGVERSDRTTADTAIYGLPELYRDRISEAQLVGCPGSYPTASLLALSPLLKQGLIVPETAIVDAKSGTSGGGREAKTYLLLAEADNSLAPYSVVRHRHTPEIEQICSDLAGHEVTVQFTPHLVPIVRGILATVYATLRDPGLVGDDLTTIYTAFYRNSPWVKVCESGIYPQTKWAAGSNLCYIGVEVDPRTGRVIVMSVIDNLIKGQAGQAIQCLNIMMGWDETLGLPKMGFYP

SEQ ID NO: 19022 - protein, 229 aa, Anabaena PCC7120
LKAILFDFNGVIINDERIHLQLIDEILIQENLQPQKVQERQASLGRSDRACFQELLANRGRVVSDDSLTQLLNSKAQAYVLEVEKLEKLPIYPGVEDLIYQARSRHLHLGIVSGAVRQEIELVLNHAKLAEYFTVIVAGDDITTSKPKPDGYLLAVERLNQEYPQLNLLPQECLAIEDTPAGIAAAKRAQMQVVGVANTYPFHMLQRCCNWTVDYLSDLELERVQKIFS

SEQ ID NO: 19023 - protein, 352 aa, Anabaena PCC7120
KRIGILTSGGDCPGLNCVIRAVVSHATLTYDWEVLGIPYATQGLRERQAIALNMHGWDLRGIDPLLNMGGTILGTINKGDTLAHVDEMLASYQALALDALIVIGGDGSLGILHELASRGNWNLVAIPKTIDNDVALTERAVGFDTAVNTIVDALNRLTFTAASHDRVMIVEVMGRSAGHLALHAGIAGGADVILIPEISYTISGLCQHIAELRDRWQRKFAIVVVAEGAKLCLEDVQENIASSCAPSKCGRGQYIADQIAQCSKNLIDTRVSVLGHIQRGGIPSALDRLTATVFGKTAVDLIAQGKFGQMVAWQNGEAIPVPIQDVVAQSPLHVNPQGSLVQSARCLGIYVG

SEQ ID NO: 19024 - protein, 276 aa, Anabaena PCC7120
AFENVDIVLASAGGSTSKAWASVAVEKGAVVIDNSSAFRMNPDVPLIVPEVNPQAAADHKGIIANPNCTTILMTLAVWPLHQVRPVQRIVAATYQSASGAGAKAMAEVKTQSSAILRGEEPVAEVLPYPLAFNLFPHNSPLTDSGYCEEELKMVNETRKIFGTQEIRITATCVRVPVLRAHSEAINLEFAEPFSPDEAREILSQAPGVKLLEDWGKNYFPMPIEASGRDEVLVGRIRQDISHPCGLELWLCGDQIRKGAALNAVQIAELLVEKNLL

SEQ ID NO: 19025 - protein, 291 aa, Anabaena PCC7120
  unsure (1)..(291): unsure at all Xaa locations
FGTVLTAMITPFKADGSVNYAVAAELAANLVDNGTDTLVVCGTTGESPTLSWDEEYNLFVEVLQTVAGKAKVIAGCGSNSTKEAIAATQKAAKIGVHGTLQVVPYYNKPPQAGLYQHFQAIAQACPELPLLLYNVPGRTGQNLSPETVVRLAEIDNIVGVKEASGNLDQAGEIRRLTPKEFQIYAGDDSLTLPLLAIGAKGVVSVASHLVGNQLQQMIQAFXSGQVTVASDIHLRLLPLFKTLFITTNPIPIKQALKLQGWEVGSTRPPLSDADAEVSQKLEAVMKHLDLI

SEQ ID NO: 19026 - protein, 421 aa, Anabaena PCC7120
IQQQRNFFQAGQTKDINFRLEQLKKLRKLVTDNETAITKALKADLNKSEYEAYFAEVGVIKEIDYAIKNLKNWSKPKKADVPLDFFSYSARIYPEPLGVVLIICPWNYPFALTISPLVGAIAAGNCAIIKPSELAPHTSNLAAQLISKCFPSEYVAVVEGGAETSQELLAEKFDHIFFTGGTAIGKIVMEAAAKHLTPVTLELGGKSPCIVDSNIHLEYTAKRIAWGKFINAGQTCIAPDYLLVNQKIKKDLIAAIQKNLQEFYGDNPIDSPDYGRIISHRHFERLAKFLKNGQVIVGGETNYEDKYIAPTLLDNVSLADPVMQEEIFGPILPMIEYTDIKDAIALINSQPKPLALYIFSQNKALQQQVLQETSSGGVCINDTIMHVGVSSLPFGGVGDSGIGSYHGKASFDTFSHYKSVL

SEQ ID NO: 19027 - protein, 552 aa, Anabaena PCC7120
YRWNRENYSSKRRFVDIWSFVLTLMFKLWRYNKSWSYPGGVTEAKQAARRKAQAVWIRNTLLDLGPTFIKVGQLFSTRADIFPGEYVEELAKLQDKVPAFGYEQVEKIVEQELGKKIPELFHSFEPIPLAAASLGQVHKAVLHSGESVVVKVQRPGLKKLFEIDLQILKGIARYFQSHPKWGRGRDWMGIYEECCRILWEEIDYLNEGRNADTFRRNFRGYDWVKVPKVYWRYASPRVLTLEYLPGIKISQYEAIEAAGLDRKVLARQGAQAYLLQLLNNGFFHADPHPGNIAVSADGALIFYDFGMMGQIKSNIREGLMQTLFGIAQKDGDRVVQSLIDLGAIAPVDDMGPVRRSVQYMLDNFMDKPFENQSVAAISDDLYEIAYNQPFRFPATFTFVMRAFSTLEGVGKGLDPEFNFMEVAQPYAMQLMTDMNGSDSNSFLNELSRQAVQVSTTAFGLPRRLEDTLEKLERGDMRLRVRSIESERLLRRQGNIQIGIGYALIISGFTLSATILLVNHYVWLALLAGLIAAAVSVILIRLLLRLDRYDRMY

SEQ ID NO: 19028 - protein, 247 aa, Anabaena PCC7120
  unsure (1)..(247): unsure at all Xaa locations
VMKLNFTGHTDPGLIRSNNQDDYYIDPEGRFFIVADGMGGHAGGEEASRIATREIKAYLTANWDVSKPSSELLEQALWQANEAILQDQQNHPERADMGTTAVVVIFRNDEQWCAHVGDSRLYRLRETQLEQVTEDHTWVARAIKIGDITAEEARVHPFRHVLSRCLGREDLHQVDVQPLDTKIGDRLLLCSDGLTEELPDQKIAHNLQINSLLDQSALSLVEDAKEQGGHDNITVVIVALEXRSQNS

SEQ ID NO: 19029 - protein, 318 aa, Anabaena PCC7120
VSSARRTIRIGSRKSQLALVQTYWVREQLQNSFPDINFEVHTMSTQGDKILDVALAKIGDKGLFTKELEVGMINEEIDFAVHSLKDLPTNLPEGLALAAITERENPADALVVHENFKDKQIDTLPAGAVIGTSSLRRLAQLRNQFPHLTFKDVRGNLNTRLAKLDAGEYDGLILAAAGLQRLGMGDRVHQILPKEISLHAVGQGALGIECRADDAELITVLKAIEHPETRDRCLAERSFLRSLEGGCQVPIGVNTEINGNELILTGVVASVDGQNLVKDTVSGNASDAEAIGIRLAELLREQGAQEILNTIFAEIQRG

SEQ ID NO: 19030 - protein, 465 aa, Anabaena PCC7120
MRILFVAAEAAPIAKVGGMGDVVGALPKVLRKMGHDVRIFLPYYGFLPDKMEIPKDPIWKGYAMFQDFTVHEAVLPGTDVPLYLFGHPAFTPRRIYSGDDEDWRFTLFSNGAAEFCWNYWKPDIIHCHDWHTGMIPVWMNQSPDITTVFTIHNLAYQGPWRWYLDKITWCPWYMQGHNTMAAAVQFADRVNTVSPTYAEQIKTPAYGEKIEGLLSFISGKLSGIVNGIDTEVYDPANDKYIAQTFTADTLDKRKANKIALQEEVGLEVNSNAFLIGMVTRLVEQKGLDLVIQMLDRFMAYTDAQFVLLGTGDRYYETQMWQLASRYPGRMATYLLYNDALSRRIYAGTDAFLMPSRFEPCGISQMMALRYGSIPIVRRTGGLVDTVSHHDPINEAGTGYCFDRYEPLDLFTCMIRAWEGFRYKPQWQELQKRGMSQDFSWYKSAKEYDKLYRSMYGLPDPEETQP

SEQ ID NO: 19031 - protein, 996 aa, Anabaena PCC7120
VVLQVQTSTYEAKTQEIARQLLGATQENRSFFASLRDQMRWDDKLLAWAMSNPGLRVQLFRFIDTLPALHSKAEIAAHLQEYLGDESVELPAALKGMLNFANPDSVPGQVAATTVSTAVETLAHKYISGENIKQVIKTVERLRKEKMAFTIDLLGEAVITETEAQSYLERYLELIAQLTEASKNWGTIAAIDEADGEQLAKVQVSVKLTAFYSQFDPLDAKGSEEKVSDRIRILLRRAKELGAAIHFDMEQYAYKDLTLNILQKILLEDEFRQRTDIGITIQAYLRDSEQDARNAIAWLKQRGYPLTIRLVKGAYWDQETIKAAQKHWPQPVFNDKAATDANFEAITQLLLENHQYVYSAIGSHNVRSQALAMAIAETLNVPRRRFEMQVLYGMGDKLAKALVDRGYRVRVYCPYGDLLPGMAYLIRRLLENTANSSFLRQNLENRPVEELLAAPKVDLAQAKVHSPEAFPQGKHFVGAADTDYAEEEDRTKAARAFAVVRGELGKTYLPLINGEYVQTAEVIDSVNPSNFSEVIGKVGLISVEQAEQAMQAAKAAFPGWRRTSVKERAGILRRAGDLMEQRRAELSAWIVLEVGKPVKEADGEVSEAIDFCRYYADEMERLHQGINYDVDGETNRYIYQPRGIVVVISPWNFPLAIACGMTVAALVTGNCTLLKPAETSSVITAKLTEILVEAGIPKGVFQYVPGKGSQVGAYLVSHPDTHLIAFTGSQEVGCRIYAEAATLKPQQRHMKRVIAEMGGKNAIIVDESADLDQAVVGVVQSAFGYSGQKCSACSRVVVVEAIYDAFIHRVVEATKSLNIGEAELPSTQVGPVIDANARDRIREYIEKGKAESQVALELSAPNHGYFVGPVIFGEVPPHGTIAQQEIFGPVLAVIKAKDFAQALAIANDTDYALTGGLYSRTPSHIQQAQEEFEVGNLYINRNITGAIVARQPFGGFKLSGVGSKAGGPDYLLQFLEPRTITENIQRQGFAPIEGAE

SEQ ID NO: 19032 - protein, 239 aa, Anabaena PCC7120
MTIIHGTNSNDYLYGGDESDTIKGFAGYDYLYGGLGDDYLYGGLDNDKLYGGLGNDKLYGGEGNDNLNGEQGNNSLYGEAGDDTLDAGNSTGNNLLDGGEGNDEIYVYSSSGNNTLKGGVGNDILDVRFSYGKNILDGGSGNDQLYARYSQGNNTLRGGSGDDYLGVDLSAGNNVLNGDDGNDILDVSYQWKGKNIVSGGNGNDIFYAYGVQGANTLNGGSGDDSFYISSPSADTVVHP

SEQ ID NO: 19033 - protein, 389 aa, Anabaena PCC7120
MKAVCWHGTNDVRVETVPDPKILNPRDAIIKITSTAICGSDLHIYNGYIPTMQSGDILGHEFMGEVVELGSAVKNVKVGDRVVVPFTISCGSCFFCQRDLWSLCDNSNPNAWLVELQMGHSPAGLFGYSHLFGGYAGGQAEYARVPFADVGLLKIPDNLPDEQVLFLTDIFPTGYMAAENCNIKPGDIVAVWGCGPVGQFAIKSAYMLGAERVIAFDRIPERLQMAKEQCNAEVLNYEEVNIGEALKEMTGGRGPDACIDAVGMEAHGTDLMAFYDQVKQAVRLETDRPTALRQVIVSAAKGGHVSLAGVYGGFLDKIPMGSAMNKGLTFKMGQTHVHKYLKPLLERIQNGEIDPSFVITHTIPLEQAPHGYEIFKHKKDNCIKVVLKP

SEQ ID NO: 19034 - protein, 445 aa, Anabaena PCC7120
FFNLAVEINPNYAQAYYHRANARYCLADFTAAIADYDQALQINPTFAEYYYCRGNAYLAQGDYDQAIANYISTIEFDPLLASNINEDIANAYYYRGLNNNDQGNYQEAIIDLQQALQWHPYFAAAYSIRGNIYYKLGEYRQAIADHERAVQLDPNLAEAYQNRGNAHYALGAYQKAIADYNRTLEINPHQVGAYYNRGLISFYLHEYQQAFADFNQVLNFNPNDAQAYYQRGLIYEAWQDYQSALADYNQSLQLNSELAVVYGVRANIYRHLGDYPSALADGNRLLELQPNFAAGYCDRATSRRCLGDYRGAIADYNQALQINPNIAEAYYGRAIAHEALRDFIGAIADYTQSIRISPDFAPAYCNRGNARRQLGDTKGAVTDYNQALTINPQLSEAYYNRGSLHYDQQNYRSAIADYTQALELQPESARYYSDRAHARYALQDY

SEQ ID NO: 19035 - protein, 698 aa, Anabaena PCC7120
DGTLACFVMLSQYFNIPLRRDVLRRVLTKQQEHKGSISLQFCAAAAELMGLTTQMVKVPAVALSRLQLPIMIAWQDSFAIIYKNSNQELLVAVPEMGLLRYKLQDFAENWGQEGEVLLLQTTKNTPKSRFNLSWFVPAIKRHRKVLIEVLIASIVIQIFGLVNPLVTQVIIDKVLVGNSPDTLEVFGIFLLVIAVIEAILTTVRTHLFVDTTNRIDLSLGSEVINHLLRLPLSYFERHPVGELATRIHELENIRSFLTGTALTVVMDAVFSVVYIVVMAFYSPILTLVALVTVPLFGLLNLIVSPLMRRQLQEKAERNAETQSYLVEVMGGMQTVKAQNLEMRSRWQWQERYARYISAGFKTVSTQTTASSFSSFLNKFSSMLVLWVGAYLVLNQQLTLGQLIAFRILAGYVTSPLLRLMQLWQNFQETALSLQRLAEILDSPQETETETQNILMPSIQGNVRYENLSFSFLEHGPLQLSNINLDFPAGSFIGIVGQSGSGKSTLLKLLPRLYEPKSGKILIDGYDIAKVELYSLRRQIGMVLQDTLLFDGTVRENIALGSSEASDEEIIAAAKVAFAHDFIMDLPIGYNTRVGERGSGLSGGQRQRIAIARTVLQNPQLLILDEATSALDYNAEAQVGRNLATAFQGKTVFFITHRLSTIRHANIILMMEQGAVVEQGTHEELMARKGYYYCLYQQQ

SEQ ID NO: 19036 - protein, 332 aa, Anabaena PCC7120
LQDIITQMRQVSDWDAVLRITVAKVREKIACDRALIYQFTSPESGTVLAESRTLGWTPTMGEILPGITFGLDTNRDYIEPITINNVAQIQLTPYQKQLLDKFQIKASLSLPIVAGGKVWGLLVVTGCVSARNWKETEITLLTQVSTELTYRLQNFEFQTQLKLQNQAKQAVSKVMEKILRVSNIDKIFQTTTQEIRQLLKCDRVAVYRFNPDWSGEFVAESVGSGWVKLVGPDIKTVWEDTHLQETQGGRYRHQESFVVNDIYEAGHFSCHLEILEQFEIKAYIIVPVFAAEKLWGLLAAYQNSGTREWVEWESSFLTQVGLQFGIAISHAE

SEQ ID NO: 19037 - protein, 731 aa, Anabaena PCC7120
AGGGLPVIQYWVEQTLSPQGLQLWQTLNHKSACLSCAWGTGGQKGGFVNEAGEYLQRCAKSVEAIAAELQPGIKQEFFQEHSISELQNLTSQECDRLGRLSYPLILRSGSSHYQRISWEEVYQIATQAFNFPPARVASYSSGRSSNEAAYLLQLFMRSLGSNNLADCSDLCHAPSTVGLKKVFGSGTSMVSLESLKHSDCLVLIGSNAPANHPRLMNELIKLRERGGKVIIINPQVEIGLVKFASPAFPIKSLLTGGSDISSLYLQPIPGSDVALFVGLQKSLIEQNLIQTEYLNAYTQNWQKVVDYANHISWNDITNTCGISQEEITATAYIIGKSARVVFAWAMGVTQQANGVDNIFSIANTALITGNAGKIGAGTMPIRGHSNVQGFGSMGVTVNLREEIKQALSQVLGKTLNETPGYHTRDLIEAAETGKIDTLFCLGGNLYAANPDLEQAKQALSQIDTIFYVATKPNLGHFHGLAKQQTLILPVFNRFENPHKTTTESGNNFVRLNDEGKSHLQPRNADLISEIELITEIAHRLHSETPINWRKLQDTTYIRELIAKTIPGYEKIATIDQTKQEFVIERRILEEPKFTTSDGKAQMFVTPLPQLSVPTKAEFGVSENQPGIVLILGTGRSYGQHNTVVYRSEDKYRGMPHRLCILMNYFDVKKAGLQEHQRVTVKGDKGKLDNIEIICGAILEGVAFMFYPEANVLFKAKIDPQSGTPAYKRVPV

SEQ ID NO: 19038 - protein, 801 aa, Anabaena PCC7120
MHELFHPIFANGEEKAALQQLIIALDASGKRYFLRNEILHTFSQYCQQAQKPTYFYYSSSVGKLIQYTHEIVLAEDGTWFVVRPRIASQEVWRLTSDLAKFDSMSIDAFLDVSDRLVNAYEPNILEIDLNSFYEASPSISDPRNIGQGLAFLNRYLCSQIATDPQYWVELVYLALRGLQYDGINLMIGDAIPSGIHLAKQIHAAIKFLSALPPEEPYEKFYIELQKLGFEPGWGNTAQRILETITLLDKLIDSPQPAVLEAFVARVPAVFRVVLVSIHGWVAQEDVMGRDETLGQVIYVLEQARSLENKLQQEIKLAGLEVLGIQPHVIILTRLIPNCEGTYCNLRLEKLHNTENAWILRVPFGEFNPEITNNWISKFEIWPYLETFALDAEKQLLAQFQGKPNLIIGNYSDGNLVAFLLARRLKVTHCNIAHSLEKPKNLFSNLYWQDSEEKYHFSVQFTADLITMNAADFIITSSYQEIFGTPESIGQYESYKFFTMPHLYHVVDGIDLFNPKFNMVPPGVNEQVFFPYSQTADRDPNVSKHVHDLLFHRQDSQIFGYLDQPQKPPIFAVAPITSIKNLTGLAECFGRSQELQAHSNLILLTSKLNIDESTNPEEAREIEKLHNIINQYQLHGHIRWLGLRLPNQEVGEAYRLVADYRGIYIHFARFEAFGRSILEAMISGLPTFATKFGGSLEIMEDQNNGFRINPTDLEGTAEKILAFFQECDTHPEHWQEVSQWMSQRIHQKYNWQLHTSQLLALTKIYSFWNFIRPESSEARVRYMESLFHLIYKPRAEQILAKH

SEQ ID NO: 19039 - protein, 400 aa, Anabaena PCC7120
MGRAKKVVLAYSGGVDTSVCIPYLKQEWGVEEVITLAADLGQGDELEPIREKALKSGASESLVADVKESFIKDYAFPAIQANALYENRYPLGTALARPLIAKILVEAAAKYGADAIAHGCTGKGNDQVRFDVSCTALNPNLKILAPAREWGMSREATIAYGEKFGIPSPVKKSSPYSIDKNLLGRSIEAGALEDPKFEPPEEIYEMTKAIADTPNEPEYIEIGFTQGLPTTLNGIPKDPVALIQELNQVVGSHGVGRIDMIENRLVGIKSREIYESPAMLVLIPAHRDLESLTLTADVSHYKRGIEETYSQIVYNGLWYSPLKAALDAFIQKTQERVSGTVRVKLFKGNATIVGRWSDSSLYTPDLATYGAEDQFDHKAAEGFIYVWGLPTRIWAQQDRG

SEQ ID NO: 19040 - protein, 359 aa, Anabaena PCC7120
MTQNYRITLLPGDGIGPEIMAVAVDVLKVVGQQFDIQFDFQEALIGGAAIDATGEPLPSATLDTCRHSDAVLLAAIGGYKWDSLPPHQRPEGGLLGLRAGLELFANLRPAQILPQLIDASTLKREVVEGVDIMVVRELTGGIYFGKPRGIFTTETGEKRGVNTMVYTESEIDRIGRIAFETARKRRGKLCSVDKANVLDVSQLWRDRITNLSQEYPDVELSHLYVDNAAMQLVRAPKQFDTIVTGNLFGDILSDAAAMLTGSIGMLPSASLGASGPGVFEPVHGSAPDIAGQDKANPLAQVLSAAMMLRYALDQPQAADKIEQAVLQVLEQGDRTGDIISVGMNLLGCRGMGDSLIKAL

SEQ ID NO: 19041 - protein, 402 aa, Anabaena PCC7120
ITRNIRRTLDLDLIWQQTVDSLGKALRLERCIICPYQPSSSKVRVIAEYHQPDRPSMLGLEIDVTSEPAFAQALTTLEPIIMEVPGYELCPQQKILVVATCYQDQANGLIAINLRHECYPLTNAELELAKEVADQLGTAIAHATLYKELEAARQKAEEASRLKSEFLANVSHEIRTPLNGMIGFLKLILEGMADDVEEKNQFLSEAHQLSLHLLNIINDILDIAKIEAGKMELVCAPIKLEELFSDVDNFMRPQAEVKNLSFRMQLPPTSDEIVVQGNYQRLLQVMLNIVGNAIKFTHEGGITVTADVVLKKGKLQEQNFPGMVRVRIADTGIGVSLDQQDKLFQLFSQVDGSRTRQYGGTGLGLAISQKLVETMGGEVHFYSLGEGLGSTVTFTVPLYQQP

SEQ ID NO: 19042 - protein, 322 aa, Anabaena PCC7120
GGIELVVGLLTDELVRRGHEVTLFASGDSISLANLVSVHPRALRLDSSVKEYGIYEMLQLGTLYERADEFDIIHSHMGCASLPYTKLVTTPTVHTLHGIFTPDNEKMFRYAKTEPFVSISDAQRDLRLGLNYVGTVYNGIDVSSYKFYPQPDEPPYLAFLGRISPEKGTHLAIEIAKKAGWHLKIAGKVDVVDVEYFEKEIKPLIDGKQIEYLGEADHTQKNVLMGGAVATLFPITWREPFGLVMVESMASGTPVIAMNLGSTTEVIAHGKTGFLCSNVEECVSAIAKVADLDRYTCREYVQNRFSLQAMTGGYEEVYRQIL

SEQ ID NO: 19043 - protein, 205 aa, Anabaena PCC7120
MKAWHSAGKVHGVAADVSTSEGRQMMLDYVSKTFGELDILVNNVGTNIRKKATDYTEEEFAAIFQINLTSIFELSRLFYPLLKTSKNSSIVNIGSVAGLISVRTGAPYGMTKAALVQLTRSLAVEWADDGIRVNAIAPWFIQTPLTEPLLNNPETLSAVLSRTPMKRVGQPEEVASLTAFLCMPTASYITGQCIAVDGGFLAFGF

SEQ ID NO: 19044 - protein, 301 aa, Anabaena PCC7120
DIPVPEAPPGEALVRVLRAGICNTDLELLRGYYPYTGILGHEFVGLVEQGPEHLLNQRVVGEINAVCGYCRFCRRGQPTHCENRTVLGIVNRHGAFAEYLCLPVENLHVVPENVPTDAATFTEPLAAALEIQQQIILSRDDRVLVVGDGKLGQLVAQTLALTGCELLVVGRHQEKLANLKVRGVQTGLVDAVQDRAFDIVVECTGNPEGFAIARRALRPRGTLVLKSTYAGNLSLDASSLVVDEITLIGSRCGVFPPALELLATGKVDVEPLIHSQYPLTQGLLAFEEAQRRGVLKVLLEM

SEQ ID NO: 19045 - protein, 233 aa, Anabaena PCC7120
KTQTNEFNLDELNQQFETATPKEILAWSIEHIPTGLVQTSAFNVDDLVITHILYSELKQPVPVIFLDTLFHFQQTLELVAKAKEIYNLDLQTYKTPDVDTREAFTAKYGEALWDKDITQFHHVTKIEPLQRGLDELNTVAWITGRRRDQAVTRANMPVFELDGKGRLKVNPLAAWTRQDSWDYVAEHKVIYNPLHDQGYPSIGDEPITTKVGEGEDERAGRWRGSNKTECGIH

SEQ ID NO: 19046 - protein, 1136 aa, Anabaena PCC7120
DLGVCPYMGLNAFAEADAAYFYGRETVTQQLIHHLRDNSFLAVIGASGSGKSSVVQAGLIPQLRQGKHIPNSEQWGIKTIRPGVNPLEALARKLGEWGETHLLIEGMLHQGVEGFVYWLRSLPQGVTVLVIDQFEELFTLAPTPDRELFLELLLGAVQYAGDRFKLIITLRADFIAPCLEVPALAEALQVASVLVPPKLSLDDYRRVILHPAQQVGLQVEAELVEVLLRELNQSVGDLPLLEFVLEQLWQQRTAGKLTLQSYQEQLGGIKGALERSCQGVYESLPPQLQECAKWIFLSLTQLGEGTEDTRRRIYKSDLIVKKYPAGLVEQTLNVLTNAKLVVINLEAEIEAQGKSFSPTPPNLSTPFVTVEVAHEILIRHWSTLRWWLEENRDRLRKQRQINHACQLWQQSGKQADFLLQGARLAEAEDIYIYWTDELGADVQEFIGACLAERKHQQLQAKNRLKQAQRAVVALSVLGIASVSFGGLAYWQGREAQFREIAALNSSSQANLLSHQQLAALIASLKAAQQVNHVIAVPNNLKLATVTTLQQALFEMQERNRLEGHKDGVISISISRDGQTIASGSLDKTIKLWSRDGRLFRTLNGHEDAVYSVSFSPDGQTIASGGSDKTIKLWQTSDGTLLKTITGHEQTVNNVYFSPDGKNLASASSDHSIKLWDTTSGQLLMTLTGHSAGVITVRFSPDGQTIAAGSEDKTVKLWHRQDGKLLKTLNGHQDWVNSLSFSPDGKTLASASADKTIKLWRIADGKLVKTLKGHNDSVWDVNFSSDGKAIASASRDNTIKLWNRHGIELETFTGHSGGVYAVNFLPDSNIIASASLDNTIRLWQRPLISPLEVLAGNSGVYAVSFLHDGSIIATAGADGNIQLWHSQDGSLLKTLPGNKAIYGISFTPQGDLIASANADKTVKIWRVRDGKALKTLIGHDNEVNKVNFSPDGKTLASASRDNTVKLWNVSDGKFKKTLKGHTDEVFWVSFSPDGKIIASASADKTIRLWDSFSGNLIKSLPAHNDLVYSVNFNPDGSMLASTSADKTVKLWRSHDGHLLHTFSGHSNVVYSSSFSPDGRYIASASEDKTVKIWQIDGHLLTTLPQHQAGVMSAIFSPDGKTLISGSLDTTTKIWRFD

SEQ ID NO: 19047 - protein, 271 aa, Anabaena PCC7120
MTDTQLVVSSSWLLQNLHNIDVVIVDCRFSLADPQLGKQQYQTSHIEGAYYLDLNLDLSSPVGEHGGRHPLPNPDELAQKLASMGIEFQKTLVVAYDDSRFAFASRLWWLLRYLGHEQVAVLNGGFSQWEQAGYPITDVIPQLKTANFVPQIQTQLLVDIEDVKNRKDLPTVVLVDSRESDRYRGEREPIDKIAGHIAGAVNYPWMEVTDSSGYSIPLTKHQQRWQNLATAEEILVYCGSGVTACVNLLSLEVAGIHTGKLYAGSWSDWIS

SEQ ID NO: 19048 - protein, 479 aa, Anabaena PCC7120
IILDVGGMKCAGCVKAVERQLTQYSGVKNACVNLATEVAVVESEVGLVDPDMLAQRLTSAGFPTQPRKANSKASESTIEDSAARQRQQMQTAFRQLMIAAVLLVFSGIGHLGNIGNSILPILNNIWFHFGLATVALLIPGRPILVDGWLGWRRNAPNMNTLVGLGTLTAYTASVVALLFPQMGWECFFDEPVMMLGFILLGRTLEQQARGKAAAAFRQLLALQPQVARLIANPDLEKMGLGTNTVEIPAEQVRVGEWLQVLPGDKIPVDGEVRFGQTTLDESMLTGEAVPVMKQPGDIVTAGTINQSGAIAIQATRTGNDTTLAHIVALVEAAQTRKAPIQKLADTVAGYFTYGILTASLLTFIFWYCFGTHIWPDITVSGGDMEMMMNHAAHITNNSPLLISLKLAIAVMVVACPCALGLATPTAILVGTGIGAERGLLIKGGDVLEKAHQLDTVVFDKTGTLTTGNPVVTDCLVFAE

SEQ ID NO: 19049 - protein, 303 aa, Anabaena PCC7120
VLCLGEVLFDCLADQLGLKLEQVKSWTAYPGGAPANVACALVKLGTPAGFIGAVGEDEPGNVLVKLLQEVGVDTTGVQRHSTAPTRQVYVVRDLAGDRTFAGFGQYDTSEFADTHLQAKQLPESVFQEADFLILGTLELAYPDSEKAIHRALELAEQYDLKIVLDVNWRPVFWHDENIARQKIQEIFKRVDFLKLAKEEAEWLFDTSDPGAITYRLGSIEGVLVTDGENGCGYCLGENEGKIPAFAVSVVDTTGAGDSFLAGFIHQLSEHGIHNLNDAETAKRIITYASAVGALTTTKAGAIA

SEQ ID NO: 19050 - protein, 260 aa, Anabaena PCC7120
MKIATWNVNSIRTRLEQVLDWLKQNPVDVLCLQETKVIDDDFPRSPFENLGYHSYISGQKAYNGVALISQQPLTDVTTGFTPILPDIEPIWDEQKRVITGVIDGVRIVNLYVPNGSAIASEKYEYKLRWLTVLREYLRSLLLLQPAICICGDFNIALEDKDIHEKVKAENHIMASLAERQALRDVLELGFADAFRKFTTEGGHFSWWDYRAASFRRNQGWRIDHHYLTPVLYAQAKSCTIDVSPRKLTQPSDHTPVIVEI

SEQ ID NO: 19051 - protein, 320 aa, Anabaena PCC7120
GGIELVVSHLTNELVRRGHEVTLFASGDSQTLAHLETVYPRALRLDKNVQDYAAYETLELSQVYQNATGFDIIHSHLGIAALPLASLVKTPTVHTLHGHFTKDNQNVFSHHHQQPYVSISNAQRQIHLNYIKTVYNGIEPKDYPFISQPKEPPYLAFLGRFSPEKGPHKAISIAKQSGWHLKMAGKVDTVDAKFFEQEILPHIDCQQIEYLGEINHTEKAELLGNAAATLFPINWQEPFGLVMIESMATGTPVIGMNFGSVPEVIDQGKTGFICQNYEEMIQMIPATLELDRRDCRESVENKFSVSQMVDGYEAVYQQII

SEQ ID NO: 19052 - protein, 416 aa, Anabaena PCC7120
  unsure (1)..(416): unsure at all Xaa locations
IHRTVLDNGIVVLVAENPAADIIAGRIFIRAGSCYEKREQAGLAHLLAAVMTKGCEGLSSLEIAEQVESVGASLSADTSTDYFLVSLKTVTSDFPEILALAGRILRSPTFPETQIELERRLALQDIRSQKEQPFTLAFEQMRQVMYQNHPYAMSVLGDETTLNSITRTDLVEYHQTYFRPDNLVISVAGRITLQEVVALVEQIFGDWQAPTIAPAVVNLPEISVNPQHRLKPVQTQQSIVMLGYLGPSVSSPDYAPLKLLSTYLGNGLSSRLFVELREKRGLAYEVSAFYPTRLYPASFVVYMGTAPENTSIALEGLRTEVELLCSEEVSTTNLQAAKNKILGQYALGKQTNGQIAQIYGWYEILGLGIDFDGEFQELIASVTAQDALTSAQQYLQQPYVSLVGQEEAINRAINXV

SEQ ID NO: 19053 - protein, 1140 aa, Anabaena PCC7120
DLGICPYRGLQAFQEEDVQYFYGRETLTQQLIADLANKSFMAVVGASGSGKSSVVQAGLIAQLRRGQQLPGSQEWWMKSFRPGEYPLVSLSHCLVDSGTEKEKAYQQMQLEGMLYQGAQGFVHWLHHRREPMVVLVLDQFEELFTLAASEDRQRFLDTVLGALELSPDKFKLIVTLRADFIAPCLEIPTLAKLLQQSSILLPPCLTQEEYRRIIIHPAEKVGLTVDPELVEVLLQELHNSPGDLPLLEFVLEQLWEYRDKGVITLQAYQQYLGGIKGALEKKAQGVYDTLDSEAQECTRWIFLSLTQLGEGTEDTRRRVLKSELIVKKYPVALVERTLQVLTVAKLVVVNGEWEEGRGKRQGAGGRGQGENILLTTPSVTIEVAHEVIIRYWSTLRWWLEENRSRLRSHRQIEQSAALWQQNNQQPDFLLQGVRLAEAEEIYLNYTDELSWDVQHFIEACLHERRRKQNQEQSRLRQAQRAVSIISTLGLTAFGLAVFAYQQTQNAQLKEIQALNSLSENFLLSHKQLEALMTSVQAGKEVQNISLGIPPDTRTQTATILQQAVYNTQERNRLLHNAWVTSVSYSPDGEVIASGSVDNTIHLWRRDGKLLTTLTGHNDGVNSVSFSPDGEILASASADSTIKLWQRNGQLITTLKGHDQGVKSVSFSPNGEIIASGSSDHTINLWSRAGKLLLSLNGHSQGVNSIKFSPEGDTIASASDDGTIRLWSLDGRPLITIPSHTKQVLAVTFSPDGQTIVSAGADNTVKLWSRNGTLLTTLEGHNEAVWQVIFSPDGRLIATASADKTITLWSRDGNILGTFAGHNHEVNSLSFSPDGNILASGSDDNTVRLWTVNRTLPKTFYGHKGSVSYVRFSNDGKKITSLSTDSTMKTWSLDGKLLQTLSSPLPDVTSISFTPDNKIVALASPDHTIHLYNRQGGLLRSLPGHNHWITSLSFSPNKQILASGSADKTIKLWSVNGRLLKTLLGHNGWVTDIKFSADGKNIVSASADKTIKIWSLDGRLIRTLQGHSASVWSVNLSPDGQTLASTSQDETIKLWNLNGELIYTLRGHSDVVYNLSFSPDGKTIASASDDGTIKLWNVPNGTLLKTFQGHRGGVRSVSFSPDGKILASGGHDTTVKVWNLE

SEQ ID NO: 19054 - protein, 256 aa, Anabaena PCC7120
PLYGKRILVTAPRNYASRLSAQIICKGGLPILMPTIETCYLSNFSKLDAVISSINEFDWIAFTSRNGIIAFFERLHNLDISITKLQNCQLCALGKDIDILLSLFGKVDLIPDESSPAGIVAEFSQICGIREQKILVPVPEVIGIPEPNIVPNFIKDLEELGMQVIRVPAYITQSLDKDIYSVEINLIQQGLIDIIAFSSTAEIESFLAMFNSKSEFQHCVVACFGPYTAANAEQLGLNVSIVSTDFSSFEGFVEAI

SEQ ID NO: 19055 - protein, 180 aa, Anabaena PCC7120
IFDMDGLLFDTESIARWAWQQALASHGYIMSDNFYSEFVGRDLSWREKILKQRYGNDFPFDAIKRHRIEIGDRRELQEGLPMKVGALNLLCQLNSLGIIIALGTGTSRSRTIRRLSNAGILPYFTTIVTSEDVPQGKPAPDIYLEVSRRIHVAPVQCVVFEDSCVGVEAAFSAGMYPIMV

SEQ ID NO: 19056 - protein, 317 aa, Anabaena PCC7120
PGMGCGTWAWGNQLLWGYNESMDAQLQAVFNLCVSNGVTLFDTGDSYGTGRLNGRSELLLGKFSQEYQGVNQENICIATKLAAYPWRWTRQSMINACKSSAQRLGRNVDLVQMHWSTANYAPWQEVGLLDGLADLYEQGLVKGVGLSNYGTKRLQRVHQKFAERGVPIKTLQVQYSLLSTYPVTELGLKDVCDELGIKLIAYSPLALGILTGKYSEKGPFPRGVRGLLLRQLLPGVRSLLQCLQDVAQSRNKTMSQVALNWCIAKGTMPIPGARSVKQAQENIGALGWQLNSGEIAELDKAAASSDKKMVQNIFQTK

SEQ ID NO: 19057 - protein, 528 aa, Anabaena PCC7120
NQILRYVVIIILLSSAMLLIRMASRIWLFGVGRQVEFDLKQRIFEHLLKLEPAYFATNTIGDLISRATSDVDNVRRLLGFAVLSLANTLFAYVLTLPVMLRISVDLTLAALAVYPFMFVLVNLFSNRLRQEQAKVQEQLSDISELIQEDISGIALIKIYAQEENERRAFAQQNQKLLGVNLELAKSRNILFPLIGGLASLSSLIVIWLGTSRIAEGTLAVGDFLALLIYIERLVFPTALLGFTISAYQRGEVSVDRLEAILSVEAKIQDADAAIHLELGEVKGELTAKNLSYTYPGVENPALNKVNFTIAPGETVAIVGAIGSGKSTLANALPRLLEVAPGQLFLDGQDITQIALADLRSAIAYVPQDSFLFSTTIKNNIRYSDPVSPPENVEYVAKLAQIHPEIINFPQQYETIVGERGITLSGGQRQRTALARAMLVNAPVLILDDALSSVDNQTATQILNNLSSGTERKTVVFITHQLSAAAAADRIFVMDKGQIVQVGNHLELLQQAGLYRKLWSQHQVAELLS

SEQ ID NO: 19058 - protein, 414 aa, Anabaena PCC7120
MSFSHLGLSNEIINAVTELGYTKPTPIQMQSIPAVLSGRDLLAGAQTGTGKTASFTLPLLHLLSQDSLKSASNASSPIRALILTPTRELAAQVESSVRDYGKYLKLNSMVMFGGVSINPQKQRLKGRVDILVATPGRLLDHVQQGTVNLSQIEILVLDEADRMLDMGFIRDIRRILSLLPKQRQNLLFFATFSDKIKELAAGLLNRPQMIEVARRNVTADTVTQKVYKIERDRKRDLLAHLIRKDNWYQVLVFTRTKYGADRLVKQLGHERIQALAIHGNKSQSARTHALAKFKNGSLQVLVATDIAARGLDISELPYVVNFDLPYVPEDYVHRIGRTGRAGASGEAVSLVSADEYHLLADIEKLIEKRLPFELVAGIGANSQAKPEPTQDERKQKPKDSQHQPRSAAQGVPKK

SEQ ID NO: 19059 - protein, 172 aa, Anabaena PCC7120
ECPVREGLLDTPKRVVKALQFLTKGYNESLDELLNGAVFTEDANEMVLIRDIDIFSSCEHHILPIIGRAHVAYIPNGKVIGLSKIARVCEMYARRLQVQERLTLQIADALQGLLKPQGVAVVIEATHMCMVMRGVQKPGSWTVTSAMRGVFAEDARTREEFMNLVRHNANFH

SEQ ID NO: 19060 - protein, 427 aa, Anabaena PCC7120
SSLNDIAQQTRQAASLLAMLSTEAKNQAIAAVAQALESAKEEILQANIDDCEAATAEGIAKPLYKRLQLDEHKLRDAIAGVRDVGKLADPIGQVQIQRELDTGLVLKRITCPLGVLGIIFEARPEAAIQIISLAIKSGNGVILKCGKEAVRSCEAIVKAVKQGLSTTDVNPEVVQLLTTREETLELLRLDKYVDLIIPRGSNSFVRFVQENTRIPVLGHADGICHVYIDKSADIEKAIAVSVDAKVQYPAACNAIETLLVHQSIAAEFLPKVAQALAEREVELKGDERTLQILPEIAAATAIDWETEYSDFILSIKIVDSLTEAIAHINQYGSRHTDAIITEDVAAVKTFFGLVNSAGVFHNCSTRFADGFRYGFGAEVGISTQQMPPRGPVGLEGLVTYKYQMTGAGHIVATYTGENAKPFTHKDF

SEQ ID NO: 19061 - protein, 370 aa, Anabaena PCC7120
EVISALGVRLTRQADIIDINASEIKTSKAPYELVTQLRASFFAIGAILARLGVAQMPLPGGCAIGARPVDLHVRGLQAMGAEVQIEHGICNAYVPGSGGRLKGAKIYLDTPSVGATETLMMAATLADGETILENAAREPEVVDLANFCKAMGANIQGAGTSTITIVGVPKLHSVDYSIIPDRIEAGTFLVAGAITRSEITLSSVVPEHLIPLIAKLRDIGVTIIEESPDCLRILPAEILKATDIDTLPHPGFPTDMQAPFMALLTLAEGDSIINESVFENRLRHASELNRLGADIRVKGNTAFVRGVPLLSGAPVIGTDLRASAALVIAGLAAEGKTTIQGLHHLDRGYDQIDVKLQQLGAKILRVREEP

SEQ ID NO: 19062 - protein, 547 aa, Anabaena PCC7120
IEFRQETIYFLVVDRFYDGDPENSEGYNPELYDPNGEDWGKYWGGDLQGVIDKLDYLKDMGVTALWLTPLFEQVEELFVGNAAMHGYWTKDFKRLNPRYIGKDENPSLNNTQETRNTTFDRLVTELHKRKMKLILDIVCNHSSPDTSGSKGELYDDGVKIADFNNDVNHWYHHYGEVEDWEDDWQVQNCELSGLATFNENNTEYRQYIKLAIKQWLDRGVDALRVDTVKHMPIWFWQEFTGDMYNHKPDVFIFGEWIYNHPSDDLSVEFANNSGMTLLDFGLCVAIRGALAQGAEGGFHLIQEVFDQDYRYNGATELITFVDNHDMPRFQSLNPDPAMLKVAIALIMTSRGIPCIYYGTEQYLHDDTNGGNDPYNRPMMGNWDTDTEVYRYLRLLSGIRRLNPAISMGSQWQKYLTSDVYCYVRRYRSSVCFVALNRGAELILPEVQTDLPDGEHTCAVTRNKFEVKDGKIYNLQLEERGVMVLSHVGERVKAQTIVRVQLNGVHTQPGETIVVVGDCPELGNWDISKAYPLEYINSNTWFAEIPFD

SEQ ID NO: 19063 - protein, 239 aa, Anabaena PCC7120
ENVYKFYNNTPVVNDLSFNIEAGEIFALLGPNGAGKSTTIRMLTTLTKPSQGKMEVAGYDVVRQPMLAKQSIGVVLQQTSVDGDLSVWENMELHGRLHHIPNPQRQRLINQWLDYVELADRRESLVKTLSGGMKRRLQIARALLHQPQILFLDEPTVGLDPQTRRRLWEIIGDLNKQGMTMLLTTHYMDEVEFLCDAFGSAKPGRIGIMDGGKLISLGTLQQLRSAHGEGLVMKQLRVT

SEQ ID NO: 19064 - protein, 284 aa, Anabaena PCC7120
SLAISPDGNKLASGGDDKIIRLWELNTQKLLACFSGHSQAVTSVSFSPQGEILATASDDKTIKLWHLPTSSEVFTLNGHTNPVKSVSFSPNGQILASGSWDKQVKLWDVTTGKEIYALKAHQLQVSAVAFSPQGEILASASFDRTIRLWQITQNHPRYTLIKTLSGHTRAVLAIAFSPDGKILATGSDDNTIKLWDINTGQLIATLLGHSWSVVAVTFTADNKTLISASWDKTIKLWKVSTTEEIVTLASHLDSVCAVAVNPVTQVIASSSRDKTIKLWQLVIQ

SEQ ID NO: 19065 - protein, 599 aa, Anabaena PCC7120
  unsure (1)..(599): unsure at all Xaa locations
PKKSAVPGLWGVLAYFWPDIRPQYGLLLVSAIALIADVGLRVLEPWPLKFVFDYVLLRGERLNTVPLIANLEPITLLTFSAVAVLIITGLRALAAYGSTVGLAIVGSRVMAKVRNRLYCHLQNLSLAYHTKARSGDLIIRVSSDASRLQEIMITAALPLVVSILSLFGMIGVMFWMNRSLTLLSLITLPFFWLVTNRLSQRIKDSSLKQRQQEGAVAATAAESIAAIKLVKALSLQDAFARVFAQQNQSSLKESVKTQRLAAHLERTVDGVIAMGTAIILWYGSWLALRDALTPGDVLVFLTYLKNAFKPVQNLAKYTGRLAKAAASGERILDVLNQKPDISDSPEAFPAPIFRGAVRFDRVHFAYNSGRVLLEDINLNIQSGQQVAIVGTSGGGKSTLVSLLLRLYDPTSGRVMIDGRDIREYTLASFRSQISVVLQDSLLFAASIKENIAYGIAGVSDAEIEEAARLAHAHDFIQALPQGYDTLVGERGSTLSGGQRQRIAIARAAIRQAPILILDEPTTGLDKESEKAVIDALQRLSANRTTFLITHDLDFATRADMIIYLENGRIAEQGSHLELMRKHGRYAALYEVQASLRVXR

SEQ ID NO: 19066 - protein, 508 aa, Anabaena PCC7120
MSNSELDRVIVRPVDEYNQKLVAYVHPPDWVNPQPADNYDLVVIGAGTAGLVVAAGAAGLGLGLKVALIEKHLMGGDCLNVGCVPSKTIIRSSRVVGEIWNGKNLGVNIPSQIDIDFPAVMARMRRVRAGISHNDSAERFASLGVDVFLGSGRFASSNTVEVAGKTLKFKKAVIATGARATKPAIIGIEQAGYLTNETVFSLIQRPEKLAVIGGGPIGCELAQAFRRLGSEVVLIHSGSHVLNKEDNDAAQIVQQTLIKEGIRLVLNAKVEEVVTVTEGKRLYFSTNGHRDSVTVDEILVGAGRSPNVEGLNLEAVGVKYDKRRGVEVNDYLQTTNPKIYAAGDICMDWKFTHAADAAARIVIKNTLFSPFGLGRSRLSSLVMPWVTYTDPEVAHVGLYESQDVETIKIPFSSVDRAIADGQEDGFLKIHHKKGSDEIVGATIVASHAGEMISEVTTAIVNKIGLNKLSNVIHPYPTQAEAIKKAADTYRRTLLTPRTKKLLGFLTKF

SEQ ID NO: 19067 - protein, 277 aa, Anabaena PCC7120
QPPQQQQPPGTESKMQPKPQADDAQYRGSGKLKDKVALITGGDSGIGRAVAIAYAKEGADVAFVYLSEHDDAEETKNLVEEQGRRAVSIAGDITDEAFCQRAIQQTVDEFGKLDILINNAAEQHPQESIEDITKEQLERTFRTNIFSMFYLTKAAIKHLKKGSAIINTTSVTAYKGSPQLLDYSSTKGAIVAFTRSLSQNLISKGIRVNAVAPGPIWTPLIPSTFPAEKVETFGKQVPMQRAGQPEEVAPSYVFLASDDSSYMSGQVLHPNGGEVVN

SEQ ID NO: 19068 - protein, 394 aa, Anabaena PCC7120
LKKIQSLQQKSQNLGISNQELERTNQLKNQFLANTSHEIRTPLSSIIGFTHLLLAQGYDPTRERHHEYLNIIQSSGKHLLALINDILDLSKIEANQLEVQWEKVNVPELCQNVLTLIKEKAANKGVKLSLELDPNIKTFVADPLRLKQMLLNLLFNALKFTNQGTVGLKVTQQDSFIHFTVWDTGSGISPENLALLFQPYFQIPNSSVAQHEGTGLGLVVTRKLAEIHNGSVEVESQVAHGSRFTIILPLQQNEQVLVGEDVEDEETKSAASLTPNSSKEILLVEDDLPNGELMQTHLSKLGYNVTWVKNAHEMWAKLDEQQAAVILMDVRLPDGDGLDLVKQLREKSQYQQIPIIAQTAMAMKGDRAVCLSAGVNDYISKPIDLNLLASLVAK

SEQ ID NO: 19069 - protein, 425 aa, Anabaena PCC7120
MTATSPRLKHEVKDLALAPLGRQRIEWAGREMPVLRQIRDRFAQEKPFAGLRLVACAHITTETAHLAIALKAGGADAVLIASNPLSTQDDVAASLVLDHEIPVFAQKGEDNATYNRHVQIALDHRPNIIIDDGSDVVATLVQERQHQIADLIGTTEETTTGIVRLRAMFKDGVLTFPAVNVNDADTKHFFDNRYGTGQSTLDGIIRATNILLAGKNVVVVGYGWCGKGTALRARGMGANVIVTEIDPIKAIEAVMDGFRVLPMAEAAPQGDIFITVTGNKHVVRGEHFDVMKDGAIVCNSGHFDLELDLKYLAANAKEIKEVRPFTEEYKLTNGKSVVVLGQGRLINLAAAEGHPSAVMDMSFANQALACEYLVKNKGKLAPGLHSIPVEVDQEIARLKLQAMGIYIDSLTPEQIEYINSWTSGT

SEQ ID NO: 19070 - protein, 257 aa, Anabaena PCC7120
MNIRGKVALVTGASRGIGRAIALELAQQGIHRLILVARDRQKLREVAQEVEAMGVEATTLAIDLTQATEVNIAIAQLWRNYGPIHLLVNCAGVAYQSSFLQSKLPQVQEELSVNLLGMYTLTSLIAKRMASQRQGTIINVSSLMGKVAAPTMATYSATKFAILGFTQALRRELAEYNIQVKALLPSLTDTDMVRDLKLFRWVIPMTPQEVAKALIAGLEKDAPEILVGWQSHLAVWCQRLAPWLLELVLTIATPPAI

SEQ ID NO: 19071 - protein, 299 aa, Anabaena PCC7120
  unsure (1)..(299): unsure at all Xaa locations
YWRDPYHLLLTIPWTGFLLLICLSYLAINLIFALAYWLGGDCIANAKPGNFLDLFFFSVQTLASIGYGAMYPKTLYANTVVTIEAMIGLVGIAVMTGLAFARFSRPSARVIFSRVAVITPYNDVPTLMFRTANQRRNLILEAQMRVYLMRDEITAEGGFIRRFHDLKLLRNQTPSFTLSWLALHPIDEFSPLYGMSAESLIQTNTNIIISVSGIDETVAQVVHARYTYTASNILWNSRFVDIFHHTSDGHRYIDYKYFHDVLPLDKIGXEIQDLKPDYLFYPLIKNCRNISPGLRSQVS

SEQ ID NO: 19072 - protein, 90 aa, Anabaena PCC7120
GFALFFHNYSTFLTKPGIYLEDLFVLPDYRRQGIGKALLTKLAQIAVERDCGRLEWSVLDWNESAQAFYRHMGATILDDWRICRVTEDAM

SEQ ID NO: 19073 - protein, 410 aa, Anabaena PCC7120
FDQACSYLEAAAKELRLDQGALEILSHPRKVVTVSIPVRLDNGDIRVLAGHRVQHSDILGPYKGGTRYHPAVTLREVSALAMLMTWKCALLGIPYGGAKGGIAIDPEHYSVGELERITRRYTSELIKDIGPSVDIPAPDVGTSAREMAWMMDTYSMNVGHAVPGVVTGKPISIGGSRGREMATGRGVMIIVREALADMGRTLEGVKVVIQGFGNVGGAAAELLYQAGAKILAVSTGAGGLFASDGLDIPALKAYAAENHRSIVGFPQAVPISNAELLTLPCDVLIPAALENQITEENVDQIQAQIVAEAANGPVTLEANRVLEGRGVTVLPDILANAGGVVVSYLEWVQGLSYLFWDEERVNREMEHLMVQAYHQVIKQSQMRQVPLRLAAYTLGVGRVAQALSDRGLYP

SEQ ID NO: 19074 - protein, 474 aa, Anabaena PCC7120
LIDAQAKVVVTADGGWRKDAIVPLKEQVDKALADDAVPSVENVLVVKRTGQDIYMQLGGRDHWWHDLQKGASADCPAEPMDSEDLLFVLYTSGSTGKPKGVVHTTGGYNLYTHMTTKWIFDLQDTDVYWCTADVGWITGHSYIVYGPLSNGATTLMYEGAPRASNPGCFWDVIEKYGVNIFYTAPTAIRAFIKMGEHHPNARNLSSLRLLGTVGEPINPEAWMWYHKVIGGERCPIVDTWWQTETGGIMITPLPGAISTKPGSATLPFPGILADIVDLEGNTVPENEGGYLAVRYPWPGMMRTVYGDPERFRRTYLGTHPPKDGNYTYFAGDGARKDEDGYFWVMGRVDDVLNVSGHRLGTMEVESALVSHPAVAEAAVVGKPDDLKGEEVVAFVTLEGTYQASEDLSKALKQHVVQEIGAIARPGEIRFTDALPKTRSGKIMRRLLRNLAAGQEVSGDTSTLEDRSVLDKLRE

SEQ ID NO: 19075 - protein, 145 aa, Anabaena PCC7120
IKTTFTSEEIQKLLPHRYPFLLVDKIIDYTPGKQAVGIKNVTINEPHFTGHFPDRPLMPGVLIVEAMAQVGGIVMTQLPGLEGGLFVFAGIDKVRFRRQVVPGDQLVMTVELLWIKQRRFGKMQARAEVDGQLAAEGELMFSLIN

SEQ ID NO: 19076 - protein, 333 aa, Anabaena PCC7120
TTTLPFTLQDLKAAIPAECFQPNVSKSLFYFFRDVLIVGLLYAVAHYLDSWYFWPIFWLIQGTMFWALFVVGHDCGHQSFSKHKWLNDLIGHLTHTFILVPYHGWRISHRTHHKNTGNIDNDESWYPVTQSQYKEMPLGQKIGRYYVFLLAYPVYLFKRSPNKEGSHFLPSSSLFKPSEKWDVITSTVLWSCMVGLLGFLTYQWGWMWLLKYYAAPYIVFVIWLDLVTFLHHTEADLPWYRGEDWTFLKGAISSIDRNYGLVNHIHHDIGTHVAHHIFLNIPHYNLLKATEAIKPVMGEYYRKSEEPIWKSLWRSCVSCHFVPDTGGKVYYTS

SEQ ID NO: 19077 - protein, 350 aa, Anabaena PCC7120
MTTSIIKNQEIKNKLSNPELRLKDIIKTLPKECFQQNRRKAWTQALLSVVMVGLGYWSLAIAPWFLLPIAWIFTGTALTGFFVIGHDCGHRSFAKRRWVNDLVGHIFMMPLIYPFHSWRIKHNHHHKHTNKLDEDNAWHPIRPEVFASWGKTRQSAFKLFMRQRLWWVGSVGHWAVVHFDWRKFKVKDQADVKLSVAVVVLFAAVAFPTLIATTGIWGFVKFWFVPWLGYHFWMSTFTIVHHTYPDVPFEAENKWHEAMAQLFGTIHCDYPKWVEVLCHDINVHVPHHLSTAIPSYNLRLAYSSIQENWGDYLHDELRFSWSLMKLITDECQLYQTDVGYQPFKDYYAGR

SEQ ID NO: 19078 - protein, 272 aa, Anabaena PCC7120
MTIATSTKPQINWVNTLFFLGLHIGALFAFIPSNFSWAAVGVALLLYWITGGLGITLGFHRLVTHRSFQTPKWLEYFLVLCGTLACQGGPIEWVGTHRIHHLHSDTDPDPHDSNKGFWWSHIGWLIYHSPSHADVPRFTKDIAEDPVYQFLQKYFIFIQIALGLLLLYLGGWSFVVWGVFFRIVWVYHCTWLVNSATHKFGYRTYDAGDRSTNCWWVAVLVFGEGWHNNHHAFQYSARHGLEWWEVDLTWMTVQLLQILGLATNVKLADKKQ

SEQ ID NO: 19079 - protein, 648 aa, Anabaena PCC7120
GLRAQLAVVPAIAISRLQTPVMLQWQNRFAILYKATDSELVLGVPGKGIQRHKPKAFIETWGEQGEILLLQPTKETPRKRFGLSWFLPFVSQYRRVLSEVLISSFFVQLFGLANPLITQVIIDKVLIQNSPATLNVLGTLLVATALFEAVLTTLRTNLFVETTNRIDMALGSEVINHLLRLPLGYFEKRPVGELSTRINELENIRQFLTGTALTVVLDAIFSVIYIVVMLYYSWLLTLVALATVPLFALLGVIVAPVIRQQTRTRAERNAQTQSYLVEVVSGIQTVKAQNIELRSRWQWQDRYARYVADSFKNALTSTTAGSISKFLNQLSGLLLLWVGAFLVLQGTLTLGQLIAFRIIAGYTTSPLLRLVQLWQNFQETALSLERLSDILDTPQEEAVRQDIPLPDIQGAVKYDHITFRFTNSPTPQLDNISLDIPPGKFVGVVGQSGAGKSTLTKLLTRLYDPEVGRILIDGYDIHKVELYSLRRQIGMVLQDTLLFDTTVQENIALNNPEATPEEIINAAKIAYAHEFIMSLPMGYNTRVGERGSALSGGQRQRIAIARTVLQNPRLLIMDEATSALDYNSERQVCQNLQQALEGRTVFFITHRLGTIRHADIILMMEQGRIAEQGTHDELMALRGLYYCLYRQQ

SEQ ID NO: 19080 - protein, 677 aa, Anabaena PCC7120
FGPFYDYTPTIRDPKNIGKGVQYLNRYLSSKLFQDSQQWLESLFNFLRLHNYNGIQLLINHQIQSQQQLSQQVKNALNFVSDRPNDEPYEQFRLQLQTMGFEPGWGNTASRVRDTLNILDELIDSPDPQTLEAFISRIPMIFRIVLVSAHGWFGQEGVLGRPDTGGQVVYVLDQAKNLEKQLQEDAILAGLEVLNVQPKVIILTRLIPNSDGTLCNQRLEKVYGTENAWILRVPLREFNPKMTQNWISRFEFWPYLETFAIDSERELLAEFQGRPDLIVGNYTDGNLVAFLLTRRMKVTQCNIAHALEKSKYLFSNLYWQDLEEKYHFSLQFTADLIAMNAANFVISSTYQEIVGTPDSIGQYESYKCFTMPELYHVVNGIELFSPKFNVVPPGVNENSYFPYTQTQNRIESDRDRLEEMLFTLEDSSQIFGKLDDPNKRPIFSMARLDRIKNLTGLAECFGQSQELQERCNLILVAGKLRIEESEDNEEKDEIVKLYRIIDEYNLHGKIRWLGVRLSKNDSGEIYRVICDRQGIFVQPALFEAFGLTILESMISGLPTFATQFGGPLEIIQDKINGFYINPTHLEETATKILDFVTKCEQNPNYWNIISEKAIDRVYSTYTWKIHTTKLLTLARIYGFWNFTSKEKREDLLRYLESLFYLIYKPRAQQLLEQHKYR

SEQ ID NO: 19081 - protein, 288 aa, Anabaena PCC7120
LVTGATGDIGRRVIRLLREHNHSVRGFARLTSRYGELEHRGANIFIGDLRREQDIEKACQGVQYIISAHGSDNDALTLDYRANIALIDQAKANGVQHFVFISVLGAERGYEDAPVFKAKRAVENYLAASGLNYTILRPAGLASNLLPLAERFRETGLYLLIGDPKNRTSIVSTDDLARIVVDSVTVPEARNQIFSVGGPEILLREDIPQIFSHIFKKEPIVVNSPLLVIDGLRGVLGLINPEAQQALGTFRTLLSNEFFCRKDEIAKLEQTFNFPLETLESFLRRYLA

SEQ ID NO: 19082 - protein, 640 aa, Anabaena PCC7120
PPTTGRKPSKVEGLKENSNFLREPVATQILEDTTHFTEDAVQILKFHGSYQQDNRDNRTKGQEKDYQFMLRTKNPGGLVPPQLYLALDKLADEYGNHTLRATTRQGFQMHGILKKNLKAAIATIVRNLGSTLGACGDINRNVMAPPAPFKNRAEYQYAWEYAQNIADLLSPQTGAYYEIWLDGEKAISAEESPEVKAARQSNGNGTIIHDTEEPLYGTYYMPRKFKVSVTVPGDNSIDLYSQDLTLVVLTDKKGNLEGFNIFAGGGLGRTHNKEETFARLADPIGYVAKEDVYSAVKAIVATQRDYGDRTDRRHARLKYLINDWGVDKFRAKVEEYFGKPIAPFKQLPEFKYHDFLGWHEQGDGNLFLGISIDNGRVKDEGAFQLKTALREIVEQFNLPIRLTPNQNLIFYEITPENKPAIQAILDRCNVVSDPTTIEPLVRYAMACPALPTCGLAITESERAIPGILERIRTLLDKLGLQNEHFVVRMTGCPNGCARPYMAELGFVGSAPESYQVWLGGSPNQTRLAQPYVEKLHDNDIESFLEPIFVYFRKYRKSGESFGDFCDRVGFDAIREFVAEYQPETTPVTIEPEQPEVVSKSRKARYRVSLHDDLYNKVKATATSQGRSMTDLVKDALEAYF

SEQ ID NO: 19083 - protein, 374 aa, Anabaena PCC7120
MRIAWIGKKSPFCGNVTYSREVTNALLDRGHEVSFLHFAQEETEPDNWPKFQEVPLPFIYKSQVYTIPTFKATKLLTDSLREIKPDIVHASLTLSPLDFFLPEICDQLNLPLIATFHTPFAGKGAKLISGTQLLAYQLYAPFLGNYDRVIVFSQIQRELLASMGVREKNIAVIPNGVDTSKYSPGSSLVKKEFQAERLFVYQGRIAPEKNVESLLRAWKQANMGADSKLLMVGDGPLRATLEPFYGSEYGIIWLGFVADEDRRIQILQGADVFILPSLVEGLSLSLLEGMACGLACLATDVGADGEVLEKGAGVVMNTKTVRSQLRTLLPLFQDHPELTTVLGQKARKRVEERYTLEKNITHLEELYREVLAQQ

SEQ ID NO: 19084 - protein, 508 aa, Anabaena PCC7120
PVVLVILDGWGYCEETRGNAIAAAKTPVMESLWTAYPHTLIHTSGKAVGLPEGQMGNSEVGHLNIGAGRVVPQELVRISDAVEDGSILSNSALVKICQEVRNRNGKLHLVGLCSEGGVHSHITHLFGLLDLAKEQRISEVCIHAITDGRDTAPTDGINAISALEDYINHVGIGRIVTVSGRYYAMDRDRRWDRVQRAYDVMTQDGVGDGRKAVDVLQASYAEGVNDEFIVPVRIAPGTVEPGDGVIFFNFRPDRSRQLTQAFVSPEFTGFARQQIKPLSFVTFTQYDSDLSVSVAFEPQNLTNILGEVIANQGLNQFRTAETEKYAHVTYFFNGGLEEPFAGEDRELVSSPMVATYDKAPAMSATAVTDTAIAAIQKGIYSLIVINYANPDMVGHTGQIEPTIKAIETVDRCLGRLLEGVSKAGGTTIITADHGNAEYMLDEAGNSWTAHTTNPVPLILVEGEKVKIPGYGTNVELRSDGKLADIAPTILDILQLPQPPEMTGRSLLQ

SEQ ID NO: 19085 - protein, 337 aa, Anabaena PCC7120
MKVRVGINGFGRMGRLALRAAWDWPELEFVHINEIKGGAVAAAHLLKFDSVHGRWTPEVEAEGERVLIDGTPLSFSEYGKPDDVPWEDFGVDLVLECSGKFRTPATLDPYFKRGVQKVIVAAPVKEEALNIVMGVNDYLYEPEKHHLLTAASCTTNCLAPVVKVIHEGLGIKHGIITTIHDNTNTQTLVDAPHKDLRRARATSLSLIPTTTGSATAIALIYPELKGKLNGIAVRVPLLNASLTDCVFEVTRPTTVEEINALLKAASEQAPLQGILGYEERPLVSIDYKDDPRSSIIDALSTMVVDETQVKILAWYDNEWGYVNRMVELARKVALSLK

SEQ ID NO: 19086 - protein, 270 aa, Anabaena PCC7120
MTIKFGLIGGGVMGEALLSRLIARGIYQPSEVIVSEPQTARQAFLQQKYHVGVTTDNSLVFTQAQDVVFLAVKPQVFSAIAQELADTVFTDHSPLVVSILAGVSLSQLEAAFPQSPVIRAMPNTPATVGSGMTAICSGAYTYAQHQKLAQQIFSAVGEVVEVSESLMDAVTGLSGSGPAYVALLVEALADGGVASGLPRGIANQLALQTVLGTAQLLHESKLHPAELKDRVTSPGGTTIAGIAQLEKAGFRSALIEAVKAATWRSQELGK

SEQ ID NO: 19087 - protein, 1104 aa, Anabaena PCC7120
NPTTMPRRQDIQKILLLGSGPIVIGQACEFDYSGTQACKALREEGYEVVLVNSNPATIMTDPETADRTYIEPLTPELVEKVIARERPDALLPTMGGQTALNIAVALAKNGVLDQYNVELIGAKLPAIEKAEDRKLFNEAMDKIGVKVCPSGTASSLDESKAIARRIGTYPLIIRPAFTMGGTGGGIAYNQEEFEEMAQVGIDASPVSQILIDQSLLGWKEYELEVMRDLADNVVIICSIENIDPMGIHTGDSITVAPAQTLTDKEYQRLRDMAIKIIREIGVETGGSNIQFAVNPVNGDVVVIEMNPRVSRSSALSSKATGFPIAKMAAKLAVGYTLDEIRNDITKKTPASFEPTIDYVVTKVPRFAFEKFPGSEPVLTTQMKSVGEAMAIGRTFNESFQKALRSLETGRAGWGCDKAEKLPSGEQIRAQLRTPNPDRIFAVRHALQLGMSPEEIYELTAIDPWFLDKMQQLLEVEKFLKRTPLKQLTREQMYAVKRDGYSDRQIAFATKTTEDEVRAYRKELGVTPVYKTVDTCAAEFEAFTPYYYSTYEEETEVIPASKPKVMILGGGPNRIGQGIEFDYCCCHAAYALKGAGYETIMVNSNPETVSTDYDTSDRLYFEPLTKEDVLNIIEAENPVGIIVQFGGQTPLKLALPLQDYLRQVGNGSLVIGNGNEETAITDDQLPITKIWGTSPDSIDSAEDRERFEKILQKLNISQPPNGIARSYEDALIVAKRIGYPVVVRPSYVLGGRAMEIVYSDTELERYMTFAVQVEPEHPILIDKFLENAIEVDVDAIADHTGKVVIGGIMEHIEQAGIHSGDSACSLPSISLPPAVLNQIRTWTVQLAQELSVVGLMNIQFAVIGASSYSPQVYILEANPRASRTVPFVSKATGVPLAKLASLIMSGKTLEELNFTQEVIPSHIAVKEAVLPFNKFPGTDTILGPEMRSTGEVMGIDSDFGRAFAKAELGAGERLPLTGTVFVSMSDRDKSAAVPVVREFIDLGFKVMATFGTRRVLLENGLNVELVLKLHEGRPHVIDAIKNQKIQLIINTPSGEEAQTDARLIRRTGLAYKIPIITTIAGAKATVAAIRSMQNTTLDVKTIQEY

SEQ ID NO: 19088 - protein, 353 aa, Anabaena PCC7120
LHQLGQAYLSHIKPEKAREYLEEAERISENLQDELFQAEVINTLGDTYSLQRQFNLGIKYYEKSLLIARRLENRLSEINALFKLGNAYLDLRQFSQAAKFYQQCLDIEQEIGDRYSQASTYHELGRVAQNLREWEQAKTYYQQALDITIEFGDRYNQASTYHQLGMVAQKLRKWEQAKTYYQQALDITIEFGDRYNQARIYHQLAIVAQNLREWQQAKTYYQQALDLKIEFGDRYNQASTYHQLGMVAQNLREWEQAKTYYQQALDITIEFGDRYSQASTYHQLGIVAQNLREWEQAKTYYQQALDLKIEFGDRYSQASTYGQLGTLAEAQENYVEARLNLQTALEIYVEYKD

SEQ ID NO: 19089 - protein, 231 aa, Anabaena PCC7120
MKGRQVLLTGGTGGLGLGVTPVVLAQGANLTITYRNLKEVERLKEVLPPADFARVNFLPANLEEESSVDNLITRIGRVDVLIHLVGGFSMGKTHEYSYYSWKREFEINLNTTFLVCKYSLKSMLDHGYGRIITIGSKAAVEPSGGLAAYSAAKAGVVAFTKAIADETKGTNITANVILPTVIDTPANRQAMGTENADKWVKPESIGELICFLASEKAKDIRGAAIPIYGGV

SEQ ID NO: 19090 - protein, 295 aa, Anabaena PCC7120
VEPIVVPGGEAVKNDPLLLNKIHQLVEAAGICRHSYVLGIGGGAVLDLIGYAAATAHRGVRLIRIPTTVLAQNDSGIGVKNGVNAFGKKNFLGTFAPPYAVINDSAFLSTLCDRDWRCGIAEAIKVALIKDVGFFDFIHEHTTALVRRDMDTMQQLIYRCAQLHLEHIAGGDPFEKGSSRPLDFGHWAAHKLEQLTDYNLRHGEAVAIGIALDSTYSYLLGWLTYAEWQQILNTLAGLGFKLYVPELAATSSLFAGLTEFREHLGGELTLTLLQHIGKGVEVHEVNMSLYQQAIS

SEQ ID NO: 19091 - protein, 351 aa, Anabaena PCC7120
MIVILKNGTPAEEITRISEGLSEVWEVKVEKSIGKHKVILGIIGDTATIDTLQIQEFSPWIQQVMRVQKPFKRVSREFRYGEASEVIVNTPNERVYFGEHHPIVVVAGPCSVENEEMIVETAKCVKAAGAKFLRGGAYKPRTSPYAFQGHGESALGLLAAAREATGLGIITEVMDTADLAAVARVADVIQVGARNMQNFALLKKVGAQDKPVLLKRGMAATIDEWLMAAEYIMASGNSNVILCERGIRTFDSKYARNTLDLSVIPVLRSLTHLPIMIDPSHGTGKSEYVPPMAAAAIAAGTDALMIEVHPNPARALSDGPQSLTFERFDRLAQEMSVIGKVVGRWPQPVLA

SEQ ID NO: 19092 - protein, 320 aa, Anabaena PCC7120
LLITGIDEFIGLRAAELAIAQGMKVRGLQSSTNKDKAQKLGAEVIVGSITDAAIAQKACQGVDVVLHTAQLSEEAGPLKDFREINVAGAVNMAKAAKNAGVKCFVHLSSVMVYGFNYSDRITESGPLSSDNNPYCQTKIEAETELLPLNSPPDFGLIIIRAGDIYGPGSIPWIVRPILMMRQKLFAYANEGQGVINHVYIDNLIDAIFLAVAKDAYGEIFNITDGEETSWKEYFMRLAAMEGASAPMSIPKDEMKLFLKLRNQGQKLFRKKADILPESVDFMTRPHAYSIAKAQRLLDYKPKVDLEKGLSQTKNWLQNTD

SEQ ID NO: 19093 - protein, 1513 aa, Anabaena PCC7120
  unsure (1)..(1513): unsure at all Xaa locations
NKINRQLQHNPIAIIGMASLLPEARNLREYWQNIVNKIDCITDVPATHWSVEDYYDPNPRTTEDKTYCKRGGFIPEVDFNPMEFGIPPSILEVTDVSQLLSLVVAKEAMEDAGYGESREFNRDLVGVILGVAMAKQLGMPLSARLEYPIWEKVLKNSGLSDEDTKKIVDKIKSAYVKWDENAFPGMLANVVAGRIANRLNFGGMNCVVDAACASSFGALKMAISELVEHRADMMLTGGVDTDNTIMAYISFSKTPAVSPSDNVKPFDAKSDGMMLGEGICMLVLKRLEDAERDGDRIYATIKGIGTSSDGRYKSIYAPRKEGQVNALRRAYEDAGFSPATVGLMEAHGTGTMAGDPTEFGSLRDYFGEHDKKKQHIALGSVKSQIGHTKAAAGAASLIKTALALHHKVLPATINITEPNPKLNITESAFYLNTETRPWIRPEGEAPRRAGVSSFGFGGTNYHVVLEEHEAEQNRPYRLHNSASEILLFAANPAELLKQCEEVLGKLQSAGGNKHYSQLVQDCQSVEIPQNAARLGFVAENMQEACKFMQTSIDWLKHKAGAANWEHPQGIYYRASGMELNGKVVSLFSGQGSQYLEMGRELVMNFPTLRRLFGYMDGLLLKNNLRPLSEIVFPNPVFDEAQKNAQVAALQRTEYAQPAIGAFSAGLYSILKQAGFKSDFVAGHSFGEITALWAAGVLSDADYMYLVKARGQAMAAPEDPDHDAGTMLAVKEDLNKIEPILKQFPQVSIANYNSPTQIVLAGPTGEIAKVRQALQAQGYAAVPLPVSAAFHTSLIAFAQKSFAIATKSVQFNEPKIPVFTNVTGKPYPKDPQAIQKILETHLANSVLFKQEIENIYAAGGHCFVEFGPKRILTNLVKDILGDRPHITVSLNPSTQKNSDRSLREAAVQMRVIGMQLHNLDPYQAPPALPPAETKKGLNVTLRGINYRSEKTKKAWEDAMNDGFKVSLPSAPTVTVPPVISEPVTPVKETNGNGHGKIAELPKILNNSTSITPAKPEMNSAIVSPKLVEEKKMQTPEKLDNYKRVLESLEYLTTQFQKNQTENLQVHGTYLNHQMEYTKAFFQLMQQQNALFANAKSSQEAAQLKLVVMESLDRSMMQFHSQQGETLRIHEKYLQEQVAYARNFFELIQQQYSMVLSGQVNTPVIETPVKETPAFTIEAPVTPTAKIVEPQPESVVKNGFNIVDAPVTLAPTAWQIQSEPVVAATASVVSTIEPEPVIEAPVAAPVVNQVVEFTSAPAPVAAPAIDVADLDKNLLAIISDKTGYPVEMLELEMDMEADLGIDSIKRVEILGGLQEVYPDLPKPNLEELAEKRTIGQIVDYLKANTAISQSVGIAIQQAQQAAEIPAPVVTASIAAPEPVVAPTPIAPEPVAIPATPEPEAVADTTDYADLAQTLLNITSDKTGYPVEMLELDMDMEADLGIDSIKRVEILGAMQETYPNLPKPNIEELGDLRTIRQIVDYLQKLAGGEKKSLSLSGTGSQSVXSGTSHAVQPNSN

SEQ ID NO: 19094 - protein, 468 aa, Anabaena PCC7120
  unsure (1)..(468): unsure at all Xaa locations
FDXISHIGXVXGHGXSXTGVSCGLKTAIIEQADMGGTCVNRGCIPSKALLAASGRVRELRDAHHVKSLGIQIGNVEFDRQAIANHANNLVSKIQGDLTNSLKRLGVDIIRGWGKIAGTQKVTVTGDGGEKTITAKDIILSPGSVPFVPPGIEVDGKTVFTSDQGVKLETLPEWVAIIGSGYIGLEFSDIYSALGCEITLIEALDQLMPGFDRDIAKLAERVLITPRDIETKVGIYAKKVIPGSPVVIELADFKTKEVVDVIEVDACLVATGRIPATKNLGLESIGVELDRRNFIPVDDRMAVLSAGEVVPHLWAIGDANGKMMLAHAASAQGIVAVENIIGRERTVDYRSIPAAAFTHPEVSYVGLTETGAKELGQAEGFEVATSRSYFKGNSKALAENEADGIAKVIYRKDTGEVLGVHIFGLHASDLIHEASAAVANRQTVQTLAHIVHAHPTLSEVLDEAYKRAI

SEQ ID NO: 19095 - protein, 487 aa, Anabaena PCC7120
  unsure (1)..(487): unsure at all Xaa locations
ELMKAGATDYLSKFRVSSETLAQVLRNAIRLYRAEMQTTIAYQQLRESHEQLVRKNQELERQRQQIQIQNLKLLEASRLKSQFLATMSHELRTPMNAIIGFAQILSRPKFGNLTGQQADMVERILNNGKHLLMLLNEVLDFSKLEEGRLELKPELFDLTKVINAVVMEMRSLAEAKKLSLLVQIDLQNSLLVNDPVRIKQILINLLSNAIKFTDSGSIWIDVKDLPGSWVEIKVKDTGIGIAAKDFKYIFEAFRQVDQSITRKYPGTGLGLAIIDSLVQMMSGKIFLESQLGVGSIFTITLPRQLPLSNSSLSSSSVARCERNDAARSQSTPPYGXIQPNRQKISXSXVINLYIXNKFIIMSVVENHQIDRILAVDDTRDNLILVQTILESEGYEIDLASDGISALQKVEQSPPDLILLDVMMPGMDGYEVTRRIRNNPALSYIPILLITAFHESSVVEGLDVGADDFIRKPFDTDELLARVRSLLR

SEQ ID NO: 19096 - protein, 614 aa, Anabaena PCC7120
ELAQQLRIDSIRATTGATSGHPTSSMSPADLMAVLLTNYLHYDFDNPHHPNNDRFILSKGHAAPLLYAMYKAAGVITDEELMSLRQMGSRLEGHPTPVLPWVDVATGSLGQGLPIGVGLGLAGKYLDQLPYNVWVLLGDSETAEGSVWEAFDHAAHYTLDNLIAIIDVNRLGQRGQTELGWNTQAYANRAKAFGWQAIEIDGHDLTEIDQAFSAAVSINDRPTVIIARTKKGKGVASLEDLGGWHGKALKPDAAKQAIAELGGERQITIQVAKPEPEQPALANPQPFQLPTYEQGAEVATRRAYGDALKALGAAQPDVVALDAEVSNSTYTEDFAEAYPERYFEMYIAEQQMVAAAVGLQVRQYKPFASTFAAFLSRAYDFVRMAAVSRANIKLVGSHAGVSIGQDGPSQMALEDLAAFRAVWNSTVLYPCDANQTAKLVEQMSDLQGIVYLRTTRENTPVIYGTEEDFPIGGSKVIRSSDQDQATIIGAGITLHEAIKAGDHLKNEGIIVRIIDAYSVKPIDVKTLHQAANDTEGNLVVVEDHWHEGGLGAAVLDAFAGVGNLSSYDGPPLQLIKLAVHNMPGSGTPEELLHAAKIDADAIVEAVKLQVRHPI

SEQ ID NO: 19097 - protein, 365 aa, Anabaena PCC7120
LPSMSEAIGGVMISASHNPPEDNGIKIFGANGGKLSQALQAEIEKGLRGNLPITSNVSNCGRHYSRWELVKNYGEALKRPWQNKVNLQGMKVVLDLAWGAAVGLAPSVFAEMGAEVISLHNAADGDRINVNCGSTHLEMLQAAVQEHNADLGFAFDGDADRVLAVDPTGRPVNGDYILYLWGLYLKQQNQLPDNLIVSTVMANLGFEKAWQQQGGKLIRTAVGDQYVQAEMIKTGAMLGGEQSGHILCSHYGMTGDGLLTALHLASLVKQSGVSLAELIDQSFQTYPQLLRNVRVVDRDRRLSWQNCTPVQQAIALAEKAMGDTGRILVRASGTEPVIRVMVEAANAELANYWTNELVAQVQQHL

SEQ ID NO: 19098 - protein, 1201 aa, Anabaena PCC7120
MVHIKRVELTNFKSFGGTTSVPLLSGFTVVSGPNGSGKSNILDALLFCLGLASSKGMRADRLPDLVNNTQTAKSRSAVEAVVTVTFDLSDLVDASDQFLSVSDDAELSQNEAPTVNGNGHRATEWSVTRKLRVTHQGSYTSNYYINGVSATQTELHEELERLRIYPEGYNVVLQGDVTSIISMKGKERREIIDELAGVATFDRKIHQAKGTLDEVKDKEDSCKIIESELTLQRDRLSQDRAKAERYQKLRTEFLEKQCWEAVLSWRSLQAQQEKLVTDIQAGDRHYGELTTQLASLNTEISQKTAELEQLNAHVKAMGEEELLAVQSTLATQEAERKQLQRQQTELDTALQETTKRLAQTQHDIQQHQQGLGELAQAQDLERQSIVYCQQQRDEAQQALEKSREAAAEIASASEAWVQQQTALNRQIEAVLQTLEPQRTEQAQLRERNNQLQQLIGEQTELIAGLEPQLAEKQADCERIETEFNSSGEPIQDLAQNLAATEQELQIQQDTQKRLLQEQRDKQRQLDRIEAQAQAQQEVQGTQASKVIIQSGMPGVCGLVVHLGRVEPKFQLALEIAAGARLGHIVVEDDGIAAAGIELLKQKRAGRATFLPLNKIQSHKFTQDATLRLANGFVNYAVNLVDCDRRYKDIFNYVFGNTVVFANLEAARKNLGLYRIVTLDGELLETSGAMTGGSSNQRSSLRFGNTEAAESDEAIGLKQRLADIDRILNRCGDAIANLVIKTKQLSQELTETRQARREQQLQLEQLRKDIQSLTAQLTGTRSQLTQNTEKFTTAQSRLEILDRDLPGQESQLQQLRHTLAELEASQTPSEWQQIQATIKTQEQQIQQRETAFREAEQRLKNLENQQQRLQERIQEAQQRITEYQTQQTTCTEAINRVSQQTTTINAQITQTRAKLSELEQHLGAEKQKRDTIEQEVRSHLLRQQQLEWEIQKLEETQLKRREDLTALQSQLQELVPELPNPLPEVPDKVDLEELQKELRSLAKRLQAMEPVNMLALEEYERTQKRLEELSQKLQTLEGERTELLLRIENFTTLRQIAFKEAFDAVNENFQSIFATLSDGDGYLQLDNPEDPFNSGLNLVAHPKGKPVQRLASMSGGEKSLTALSFIFALQRYRPSPFYAFDEVDMFLDGANVERLSRMIKQQAQQAQFIVVSLRRPMIESAERTIGVTQARGAYTQVLGIKL

SEQ ID NO: 19099 - protein, 230 aa, Anabaena PCC7120
FKSVDGLELYYQNWYPEVKAKAILVIVHGLGGHSDKYSNIVNHLTAKDYAVYGLDLRGHGRSPGQRGHINAWADFRGDLSAFLELIQTQQPQSPIFLLGHSLGAVVVCDYILRCPKEAAKLQGAIALAPAIGKVGVSKFRLLVGKLLSQIWPRFSLTTGLDLSAGSRDEKVVAAYAQDTLRHNLGSARLATEYFTTVAWIHAHAPDWQIPLLILHGSSDRIASPKASRSY

SEQ ID NO: 19100 - protein, 1005 aa, Anabaena PCC7120
ISDTIEQLRSCCQVNVQSTWLYQDSTREINGVATSSVSNWQSVELDTKGNIAWSGGQQVLWLEQKFVVPQNLHDYPLAGLSLRLSLLWWADSAKIYVNGELVLEGDLFDCSPRVLLSREVSPGQEFVVALRLASPGHCDGALVRSLLVYESTDYNYPDPGFIADELAILQLYLEKSAPEKLNILTAAIPEINPSNPESLITIRQNLINHLSISDPKFKIYLLGHAHLDLAWLWPVSETWNAAQNTFASVLKLQQDFPELIFCHSTPALYAWIEEHRPDLFTAIQQAVAAKTWEIIGGFWVEPDLNLIAGESIVRQLLYGQRYFQEKFDKLTTVVWVPDTFGFCATLPQFLANAGIEYFVTQKLRWNDTTKFDYGAFWWRSPDGSQVFSVMSAPIGEGIDPIKMAAYSLEWQTQTNLTESLWLPGVGDHGGGPTRDMLETAQRWQTSPFFPDLEFITAEKYLQQIQSTVNSQQSIVPTWNDELYLEFHRGCYTTHADQKRWNRHSENLLYQAELFATLATFICGVTYPKTAIETAWKQVLFNQFHDILPGSSITQVYIDALHEWQQVEQTGTRILKESLQAIASHFTLPEPPKADSFPIFVFNSLNWQRSEVVSVTLPPPPTNQQWQVYDTTGEQIISQLTEPSTLLFLAKDIPSVGYRLFWLSPTSPPSPTSPTSLDYVLENEHLRVIVDPDTGDLSSIYDKTHQREILSGAGNQLQAFKDSGQYWDAWNIDPSYSQHPLPATNLKSIQWLEQGAVQNRLRVVRQLGESEFCQDYILQVGSPQLKIASRVNWREKQVLVKAAFPLNLTADFATYEIPCGAIRRPTQPQNPQDKAKWEVPALRWADLTADTDKGIYGVSLLNDCKYGYDSQPQLLRLTLLRSPTWPDPEADTGIHEFTYTVYPHADSWESAHTVQKGYELNIPLQVILNPVPNSQLLTSHYPPNMRDRVSFVNLPAENLVLMAIKPSEDDQQQLILRFYESHGVTTELSLQTDLNLTLGTPVDLLE

SEQ ID NO: 19101 - protein, 464 aa, Anabaena PCC7120
IIKAFEAVLGKNGVVQRREELITYECDGLTSYRQRPAVAVLPRTTEQVAAVVKICNQYSVPFIARGSGTGLSGGALPSEDSVLIVTSLMRQILSVDLDNQRIIVQPGVINSWVTQTVSGAGFYYAPDPSSQIICSIGGNVAENSGGVHCLKYGVTTNHVLGLKIVTPEGEIVDLGGQIPESPGYDLTGIFVGSEGTLGIATEITLRILKSAESICVLLADFTSVEAAGATVSDIISAGIIPGGMEMMDNVSINAVEDVVATNCYPRDATAILLVEIDGLEVEVAVNKQRVIDICKQNGARSVTSASDPEMRLKLWKGRKAAFAAAGHLSPDYYVQDGVIPRTQLPYVLQEIEVLSQKFGYPIANVFHAGDGNLHPLILFDNAIPGALEKVEELGGEILKLCVRVGGSISGEHGIGADKKCYMPDMFSDADLETMQWVRQVFNPQGLANPGKIFPTPRTCGEAAN

SEQ ID NO: 19102 - protein, 417 aa, Anabaena PCC7120
PPSKPPVPKYISWDCCSALGPQFVVEALAPEFPPLKIHFMANTDPAGIDRIFTPLGNHLASTLVLVISKSGGTQDLATGMIEVKKAYAGQNLDFAQYAVAITSTGSNLDKVAQSEGWLATFPMYDWVGGRTSEMSSVGLVPAALQGIDVRAMLEGAKEMDDATRVPEVKNNPAALLALSWYYSGNGKGEKDMVVLPYKDSLLLFSRYLQQLVMESLGKEKDLDGNTVYQGIAVYGNKGSTDQHAYVQQLREGVPNFFATLIEVLEDRHGASPEIDPGVTSGDYLSGFLLGTRQALYENQRDSITVTIPQVNARTVGALVALYERTVGLYASLVNINAYHQPGVEAGKKAAAVILDLQTKVVGLLQKEKTALSLEQIAEKIGAADQVEAIYKILRHLQANQRGVVFQGNLGQPSSLKI

SEQ ID NO: 19103 - protein, 324 aa, Anabaena PCC7120
FVTGATGFVGANLVRLLLQQGYTVKTLVRPQSNLGNLRGLDVEIVEGDFDNQFLWQQMSGCRYLFHVAAQYSLWQKDRDLLYQNNVLGTFQVLEAAQKAGIERTVYTSSVAAIGVNPSGEIADETYQSPVDKLIGHYKKSKFLAEQEAVQAAAKGQDIVIVNPSTPIGPWDIKPTPTGDIILRFLRRQMPAYVNTGLNLIDVRDVAWGHLLALEKGKSGDRYILGHQNLSLQQLLEKLAEITGLPAPQWTVPGWLPLSVAWMEEKILAPLGKTPSVPIDGVRMAQQTMYYDASKAVKELGLPQSPVDIALKDAVNWFVSQGYVK

SEQ ID NO: 19104 - protein, 227 aa, Anabaena PCC7120
LVAQSHPNHQTIVQISETVAFGGKELVIIGGPCTVESLEQMETVAQHLEGSSVQALRGGVYKPRTSPYAFQGMGEAGLDVLAQVRSHYNMPVVTEVMSIAQIEAIATHVDMLQVGSRNMQNFDLLKALGQAGKPILLKRGLAATIEEFVMAAEYVVSHGNPDVVLCERGIRSFDNYTRNVLDLAAVVALKQITHLPVIVDPSHAVGKRELVAPLAKAAVACGANGFN

SEQ ID NO: 19105 - protein, 438 aa, Anabaena PCC7120
AASSHYLERQQARESNARSYPRRIRIAISEAQGIYLKDADGNVYIDCLAGAGTLALGHNHPVAIEAMRRVLDTGLPLHTLDLTTPVKDQFVEEIFASLPAEFAQNAKIQFCGPSGADAVEAAIKLVKTATGHRSVLSFHGGYHGMTHGALSLTGNLNPKQAVTGLMPDVHFLPYPYHYRCPFGLGGEAGQITSSRYIESILDDPESGIVTPAAMILEVVQGEGGVIPAPDDWLREMRRITRDRHIPLIVDEIQTGLGRTGKLYAFEHSGIVPDVLLLSKAIGGSLPLSVVLYNKALDKWSPGAHAGTFRGNQMAMAAGTATLQYILENSLTEHAAAMGDRLLKHLHQIQGETYCIGEVRGRGLMVGVEIINPQASADRRGKYPVHPQLASCIQAECLRRGLIVELGGRFGSVVRFLPPLIVTPAQIDSISEIFSSAVQ

SEQ ID NO: 19106 - protein, 479 aa, Anabaena PCC7120
EGLREAIAAAGEVLIDYFATQEKPYSGRSPQDLTRTIADIAVCPDEGVALSQVLAEVGENIIKHSVVVTHPTCMAHLHCPPLLPAVAAEVLISGTNQSLDSWDQSPAATVLEQQVVNWLCASFGYDADADGIFTSGGTQSNFMGLLLARDAYARHQLNWSVQQQGLPPEAQRFRILCSQAAHFTISQAASLLGLGQQAVVTVETDSDYQLCAAAVEQKLEELQQQNLLPIALVATAGTTDFASIDKLPELAACAEKYGLWFHVDAAFGGALVMSDRHRDKLDGIALADSITVDFHKLFYQPISCGAFLVKQRQNFDLIKLHADYLNPETNEVASIPDLVTKSIQTTKRFDALKLFVSLRTLGRKQFAQMIDTTIELAKETASLIDAEPALELANNPTINAVVFRYLPSETPAHIDSTTWANQINSHIRMSLLQQGIAVIAQTKIGQLTYLKFTLLNPQTAIADIQEVLNSITTIGEKYL

SEQ ID NO: 19107 - protein, 256 aa, Anabaena PCC7120
ALVTGGSRGIGRAITLKLAEQGVKVAIHYHKNDEAANNTLVQIREQGGDGFIVQADVLQPQDINRMFSQVKDKFGSLDIFVNCARPDLATFYSSPMKMTLDHWRAAMDSQAQAFLLGTQQAANLMRDGGRIIAITYSPSGRTGSWQPWMAMGTAKAALESLCRYFAVALGSRGITVNGISPGVIFGEPNPLEGGVLRSLPTAAQEATQNWHESGWTPMRRVGTPDDIANAAMLLCMQEASFITGQIIHVDGGASIM

SEQ ID NO: 19108 - protein, 606 aa, Anabaena PCC7120
MALIVQKFGGSSVGSVERIQAVAQRVYKTVKAGNSLVVVVSAMGKTTDGLVKLANEISRNPNRREMDMLLSTGEQVTIALLSMALQELGQPAISMTGAQVGIVTEAEHTRARILHIETERVEGHIKEGKVVVVAGFQGISSNGSLEITTLGRGGSDTSAVALAAALQADFCEIYTDVPGILTTDPRIVPEAQLMGEITCNEMLELASLGAKVLHPRAVEIARNYGMPLVVKSSWTDDPGTWVTTPKPQGRSLINLELARPVDDVELDTDPAKVALLRVPDKPGVAAKLFGEISRQKVDVDLIIQSIHEGNSNDIAFTVTTPILKRAEAVAAAIAPSLRSPSHPKSDEAEVMVEQNIAKVSIAGAGMIGRPGVAAQMFATLAEAGVNIQMISTSEVKVSCVIDAQDGDRAIIALRKAFEIETPLHSQLPTPSSLSTHNSPPVRGVALDLNQARLAIRQVPDRPGMAAQLFGILSQHNISVDMIIQSQRCRIVDGVPRRDIAFTVPRMDGETAQKLLCQVAPELGWGDVVLDSAIAKVSIVGAGMVGQPGVAAKMFEALAKHQINIQMIATSEIKISCVVSQEQGVQALQVIHTAFELAGTEKFVVPA

SEQ ID NO: 19109 - protein, 628 aa, Anabaena PCC7120
MKFSWRVLVLWTLPALVIGFFFWQGTFAGAPADMSKNAANTRMTYGRFLEYVDAGRVTSVDLYEGGRTAIVEAQDQDIENRVQRWRVDLPVSAPELISKLKDKKVSFDAHPARNDGAIWGLLGNLVFPILLITGLFFLFRRSNNLPGGPGQAMNFGKSKARFQMEAKTGVKFDDVAGIEEAKEELQEVVTFLKQPERFTAVGARIPKGVLLVGPPGTGKTLLAKAIAGEAGVPFFSISGSEFVEMFVGVGASRVRDLFKKAKDNAPCIIFIDEIDAVGRQRGAGIGGGNDEREQTLNQLLTEMDGFEGNTGIIIIAATNRPDVLDAALLRPGRFDRQVTVDAPDIKGRLEVLQVHARNKKLDPSVSLEAIARRTPGFTGADLANLLNEAAILTARRRKEGITLSEIDDAVDRVVAGMEGTPLVDSKSKRLIAYHEVGHALVGTLLKDHDPVQKVTLIPRGQAQGLTWFTPNEEQGLISRSQLKARITGALGGRAAEEIIFGSAEVTTGAGGDLQQVSGMARQMVTRFGMSDLGPLSLESQQGEVFLGRDWMTRSDYSESIAARIDSQVRLIVDECYQNAKKIMREHRTVTDRIVDLLIEKETIDGEEFRQIVAEYTDVPDKQQFVPQL

SEQ ID NO: 19110 - protein, 134 aa, Anabaena PCC7120
VSSLLQGVNLYLIGMMGAGKTTVGHLLAKELGYGFLDTDNVIAQATKKSINEIFAEAGEAGFRQIESDVLAQVCSYTKLTVATGGGIVLRRENWSYLHHGLILWLDVPVDILYARLAADTTRPLLQDDDPKGKL

SEQ ID NO: 19111 - protein, 884 aa, Anabaena PCC7120
  unsure (1)..(884): unsure at all Xaa locations
MQPTDPNKFTDKAWEVIVKSQDIVRAYQQQQLDVEHLILALIEDPTSLAVRILGRAEIDPIRLQQQLEAFTQRQTKVGKSDQLYLGRSLDVMLDRAEEIRERMKDGYISVEHMLLAFVDDERVGRKVLKGFNVDSAKIEASIKAVRGSQKVTDQNPESRYEALQKFGRDLTEQAKSGKLDPVIGRDDEIRRVIQVLSRRSKNNPVLIGEPGVGKTAIAEALAQRIVNGDVPESLKNRQLISLDIGSLIAGAKYRGEFEDRLKAVLREVTESNGNIVLFIDELHTVVGTGSNQQGAMDAGNLLKPMLARGELRCIGATTLDEFRKFIEKDAALERRFQQVYVDQPSVENTISILRGLKERYEVHHNVKISDSALVAAATLSARYIADRFLPDKAIDLVDEAAAQLKMEITSKPADLEAIDRRLMQLEMEKLSLAGEEKVAAPTKERLQRIELEITNLTEKQQDLNNQWQGEKQVLEAISLLKKEEDALRVQIEQAERAYDLNKAAQLKYGKLEGVQRDREAKEAKLLELQSQGSTLLREQVTEADIAEIVAKWTGIPVNRLLESERQKLLQLESHLHQRVIGQQEAVEAVSAAIRRARAGMKDPNRPIGSFLFMGPTGVGKTELARALAQFLFDADDALVRLDMSEYMEKHSVSRLVGAPPGYVGYEEGGQLSEAVRRHPYSVVLLDEVEKAHPDVFNILLQVLDDGRITDSQGRTVDFRNTVIVMTSNIGSEHILDVSGDDTQYETMRNRVMDALRSHFRPEFLNRVDDTILFHALSRSEMSHIIRIQLKRVESLLRDQKISFEISPAACDFLVEKGYDPVYGARPLKRAIQREIENPLATKILENTFISGDTIYIDQDENGLSFTNKAPVKVSVTQITTXPIL

SEQ ID NO: 19112 - protein, 215 aa, Anabaena PCC7120
VKGLYEEKEKLRKLLKLQSQGYKGAVGGILFYGLPGCGKTLLANAFANESGRYFFKFSPADIVSVWIGQSQKNIRDIFAQAKKKSPSVLFIDELDSIGFNRHEDNAHTDQKATINQLLIELNNIKDSDVIVIAATNYLSGIDSALKRSGRLDWKIPIFPPNQAERVELFQHYLSQINLNQLVNFEMLAEKSVRFTSSDIELVCREVNNAILLEEI

SEQ ID NO: 19113 - protein, 274 aa, Anabaena PCC7120
  unsure (1)..(274): unsure at all Xaa locations
MGICRNLGVAALVALIVGCSPVQSQVPPLTELSPSISVHLLLGNPSGATPTKLTPDNYLMVKNQYALSYNNSKGTANWVAWQLNSSWLGDADRQNNFRPDNTLPAGWVRVTPSMYSGSGYDRGHIAPSGDRTRTAEDNAATFLMTNMMPQTPDNNRNIWGNLEDYCRELVSQGKELYIVAGPSGSXGQPLKGKVTIPQSTWKIIVVLDSPGSGLTGITANTRVIAVNIPNEPELNNDWRAYKVSVDELETLTGYDFLSNVSPNIQASIESKVDN

SEQ ID NO: 19114 - protein, 196 aa, Anabaena PCC7120
IKQLNKKYPNGIQALRDISLKIDYGIFGLLGPNGAGKSSLMRTLATLQDADSGSIELDGVNFLKNPQSARSILGYLPQDFGVYPSVSAEDLLDQLAVFKGFIHHQQRREIVAQQLQLVNLYEQRQQKLGTFSGGMRQRFGIAQALLGSPKLVIVDEPTAGLDPAERIRFHNLLSEISPDRVLLLSTHIVEDVAEIC

SEQ ID NO: 19115 - protein, 275 aa, Myxococcus xanthus
ALQMASYLIKAGAGTCYLAGGVESTSTSPFEKRARFSPDKIGDPDMGIAAENVAQRYNISKDQQDRYALLSHKRSWESFEKRLFEEETLPLRNVMQDEAFMKKRNLTKLLQKASPVFLKNEGTVTAANSCGINDGACITLVMEEQKARALGFQPVLRFIDADISGVSPLYPAIAPVSAIKNILKRNSLTVDDIDLFEINEAFAVKVVACMQKLGISEEKVNICGGALTLGHPYGASGAILATRLFYESKRRDVRYVIAALGSGGGIGTAVLFEVI

SEQ ID NO: 19116 - protein, 460 aa, Myxococcus xanthus
LIGIDLGTTNSIVATVQDGQPVVIKNRTGQGLTPSVVAMAKNGKRLVGSIAKRQAITNPQETVYAAKRLIGRKFSSHEVQDSLRALSYEVVAGQHDDLRIRMGGKDLSVPEISAMILQELKADAEAHFGRPVSKAVITVPAYFNDAQRQATKDAGRIAGLDVLRIINEPTAAALAYGFGRTVNGRVAVLDLGGGTFDVSVLDISQGVFDVVGTGGDTYLGGEDWDNRIIEWLVFGFAKEHGIDLRKDRMALQRLKDAAEKAKVELSSVREAGLNLPFICTPPGGGAALHLQATLSRDKLDDLTSDLAERVVGLTTEVLGEAGVRASELKEVILVGGMSRMPKIVEAVRGYFRREPCKGVHPDEVVALGAAIQAHALVQPEHELLLLDVTPQSLGVAIAGGTVRRLIPKNTTVPTSATEVFATSKDFQRVVKIMVLQGEHDLAHQNELLGEFVLTGLREAP

SEQ ID NO: 19117 - protein, 278 aa, Myxococcus xanthus
GTDAHNEHILAPFARGEKLGCFGLTEPEAGSDAAAQNTVAVRKGDEYVINGSKNWITNGPKADAIVLMTMTNKEAGHKGITAFMVPTDTPGFIRAEPDKKMGISAAWSCSMFFEDMRVPAKYMLGKEGEGFKIAMSTLDGGRIGIASQALGIARAAYEEAVRYSGERKSFGKPIREHQAIQFMIADMATEIDAARLLVWRAALQKDKGVRHSAESAMAKLYASEMASRVANKALQVHGGMGYSKEMDVERHVRDARITEIYEGTSEIQRIVIAANLLR

SEQ ID NO: 19118 - protein, 289 aa, Myxococcus xanthus
GDHVIPLYTAECGQCLFCKSGKTNLCVAVRPTQGKGVMPDGTTRFSYNGKPVYHYMGCSTFSEYTVVAEVSLARINPNANPEQVCLLGCGVTTGLGAVKNTARVQEGDSVAVFGLGGIGLAVIQGAQMAKAGRIIAIDTNPAKFELAKAFGATDFVNPKDHDRPIQQVIVEMTGWGVDHSFECIGNVGVMRAAIECSHRGWGQSIIIGVAGAGQEISTRPFQLVTGRTWKGTAFGGVKGRSELPGMVEDAMAGKIQLAPFVTHTRSLTDINEAFDLMHEGKSIRTVVRY

SEQ ID NO: 19119 - protein, 288 aa, Myxococcus xanthus
KERMTGFIRSLQDDICGGLERLDGSTRFREDSWTRPGGGGGRSRVLEDGAVLEKAGVNTSVVYGELEEQFAQKLQGEGRHFWAGGISLVLHPRNPHVPTVHANYRFIQQGGKAWFGGGADLTPYYLYEEDAAHFHRVHQAACDKHDAGYYPRFKSACDKYFYLRHREETRGVGGIFFENMGGELEKEFAFVQDCGRAFLDAYLPIAERRKDTPATEGQRFWQEVRRGRYVEFNLVYDRGTVFGLETRGRTESILMSLPPQVRWRYDYHPEPGTPEARLVEVLRQPRDW

SEQ ID NO: 19120 - protein, 252 aa, Myxococcus xanthus
LLHKHLTPELKSRLERLTTRNGWTLRKTIQSGLDHGDSQMGVYAGDSESYALFSPLLHPIIRDHSGHDLSGHTSDFSLDGLPQGDLDPTGEFILSTRVRVGRNLARYAFPPAIGARDRAALEAEVVQVLSGLRGHLTGKYHPLASLSEAERLELVHHHVLLQQSDRFLDSAGVNRDWPRNRGMFHSADMRFIVWVGEEDALRIISMQPGSGLAQTYLRLQTGLEQFDGQVDFAQDSRVGFLTGCPTNLGTRM

SEQ ID NO: 19121 - protein, 428 aa, Myxococcus xanthus
VADVLATNGDTHLGGDNIDLRIMDWLITEFKKDTGLDVSKDKMVLQRLKEAAEKAKIELSAAMETDINLPFLTADATGPKHLNVKLTRAKFEAMIDDLIERSLEPCRKCLKDAGVEPKDLNEIVLVGGTTRIPKVQEAVKRLFGKEPNRSVNPDEVVAVGAAVQAGVLSGEVKDILLLDVTPLSLGVETLGGVMTKLIERNTTIPTRKSETFSTAADGQTQVEIHVLQGEREMAGDNRSLGRFHLTGMPPAPRGVPQIEVTFDIDANGILNVSAKDKATGKEQKVTITHSSGLAKDEVEKMVADARSNEAADKGRRELVEMKNQAESQSYAAEKLLKENKDKLSADTAKALEDAVAELNKVRDGQDKDAIKTALDALQAASYKAAEEMYRATGGAPGAEGAPGAGPSAAPGSQASAKKDDVVDAEFRQ

SEQ ID NO: 19122 - protein, 311 aa, Myxococcus xanthus
  unsure (1)..(311): unsure at all Xaa locations
FALAPAQMPVTXSGIPIGPDAPHGYIPEKVGVIVGSGIGGISSLEEQHRKGLEKGFDRLSPFFIIQMIINMAPGLISMRYNCKGPNWAPVSACATSAHAIGEAWKSIRLGETDAVIAGGAEAAITPLGLGGFSVMKALSTRNDDPAGASRPFDKDRDGFVMGEGAGILVLEEMEAAKKRGANILAEVVGYGANSDAYHVTQPAPEGEGAARCMRLALQSAGMNPEDVGYINAHGTSTPFNDANETKAIKTVFGDHARKIAVSSTKSMTGHMLGAAGGFEGVVSALALARNILPPTINQTTPDPDCDLDYVP

SEQ ID NO: 19123 - protein, 195 aa, Myxococcus xanthus
MSFINYSSREINCKIVYYGPGLCGKTTNLQYIYNKTAAETKGKLISLSTETDRTLFFDFLPLSLGEIRGFKTRFHLYTVPGQVFYDASRKLILKGVDGVVFVADSQIERMEANMESLENLRINLAEQGYDLNKIPYVIQYNKRDLPNAVTVEEMRKALNHRNIPEYQAVAPTGVGVFDTLKAVAKLVLTELKKGG

SEQ ID NO: 19124 - protein, 274 aa, Myxococcus xanthus
FGTDAQREKYVTRLASGEAIAGSFALSEPPAGSDPGALRTTAVRRGDVWVLNGSKQWITSGAYAGVMVVWARTSPAGNKGLSCFIVEGGTKGLIIGKHEDKMGLRSSNTVSLTFEDCEVPAENLLGAEGQGFKLAMVALDGGRIGIAAQACGVGRAALEATVAYVKDRQAFGQPIGEFQGPRFMLADMQTQLEAAELLTLRAASMKEKGQPFSREASMAKLFASEMSNKVADKAVQLHGGYGYIDEFPVERFFRDARVQTIYEGTSEVQRMVIA

SEQ ID NO: 19125 - protein, 169 aa, Myxococcus xanthus
  unsure (1)..(169): unsure at all Xaa locations
TXYENVRVLLLGQDPYHGPGQAHGLAFSVKPGVAPPPSLVNMFKELESDVGVPRPKDGSLIPWARQGVLLLNAVLTVRQAKPNSHAGHGWEDFTDAVIRAVSAKDDPVVFLLWGRYAQKKKKLIDSKRHVVIEGTHPSPLSASNGFFGSRPFSAVNEALESHGRPPIDW

SEQ ID NO: 19126 - protein, 677 aa, Myxococcus xanthus
AKQYPMAPGRTGIPERREYKVVPDHLGRGRELVDVSKNKERGQRKRTSGDTQSVSKQELTDMVWGRVTIPIRGKKRKPTKKGAKTQITQMAEEKKVIKLQEGISVSDLGQRMGVRSAELIKKLMGLGKMATANQLVDADTAEMIAGDYGWKIDRVGFEVEDYLPEVETRPEDERPRPPVVAIMGHVDHGKTSLLDAIRKASVAQGEAGGITQHIGAYSITTARGDVTFLDTPGHEAFTSMRARGADVTDIVVLVVASDDGVMPQTVEAIKHAKAAEVPIVVAINKMDLPTANLDRVKKDLATHELVPEEWGGDTIMVPVSAKTKENLELLLENLALQAEVLELASNPLRPSVGAIIEAKLDRGRGPVATVLVQEGTLKLGDAVVTGSHYGRVRAMTNSRGEQVKEVKPGYCAEVVGLSGVPGAGDAINVVADEKAAKQIAEHRNMKERQTELSKVSRESLEQLFAKTKAGGGPKELRVVIKADVQGSAEAVKQAVQKLSTHKVKVEVVHCRVGAITEGDVMRAAASKGVVLGFNVNPESGAEAAAKAQEVVLKSYSIIYELIDGVRTEMEGLLEPIRTERKLGRAEVRNTFNVPRVGTIAGAAVLDGVMKRGAIVRLMRENKQLFSGKMASLRRFKDDVKEVAQGFECGIGIESFNDLKPGDIIEAYEIVETRQSLT

SEQ ID NO: 19127 - protein, 285 aa, Myxococcus xanthus
KKKIGLIGGGQIGGNLALLAVQKSLGDVVLYDIPAAEGLVKGKALDINQLAAVDGYDCRVKGTTDWKDVAGSDVIIITAGMPRKPGMSREDLLEINLKIMTDVAGNIKQHAPNAFVINVANPLDAMVFALHKIAGLPKHMVAGMAGVLDTSRFKCFVAEALGCSIRDVEALVLGGHGDDMVPLVRHRTVGGVPLTELIAKDKLDAIIKRTREGGPELVGLYKTGSAYFGPAACAIAMAESFLQDRKRVLPAAALLEGQYGINGYFFGVPVQIGAGGVEKIHTVEL

SEQ ID NO: 19128 - protein, 498 aa, Myxococcus xanthus
AQFYFMGLFAQRVVKDLRRDLFQRLTALSPAQLARERMGDLLSRFSSDVSAVEAAAMYTVGSYLRDTLQVIILAGVALAMSPMLGGLMLLVIPLAALPASKLTRKVLKRTREGQTQLGNLAGQLHEGLGGLRTIQAFNGQAAELARFSAFAQAHEKAVVSAAWARGAVPGLMEVLAAAALAGALAYAASARLMEPEALLSLLTAVILVYQPVKDLGRVTQFAVQAGAAGERLFSLLDMKHPVEDAPDAVPAPTLSRSIQFEGVRFAYGERPALDGLTLELKAGQVTALVGGSVGGKSTVTSLLLRFERPQKGQLLLDGVDADRYTATSVRAQFALVTQEPLLFHGTVLDNLRYARPDATREEVEAAAKVAHADGFIRALPEGYDTRIGERGVALSGGQRQRLCIARAVLAQAPVLVLDEATSSLDPESEREVQAALAAVLPGRTALVIAHRLSTVVNADVLNVMEAGRVVESGSHAELLQRGGRYAALWRMQTEGSSE

SEQ ID NO: 19129 - protein, 495 aa, Myxococcus xanthus
WDSGLMYFAFTDRFHNGRLENDAPVADVDPIANYLGGDFAGITQKLEEGYFDALGIRTLWISPVDQNPEGRFIGTGGKYYTGYHGYWPSKPRETQHRFGSLEELRTLTAAAHKRGIRVIADLVLNHVHEEHPYWANHARDGWFNTAASCVCGTQDCDWEAKRLTCKFTDYLPDFNWRSSDFVDQFAADTLWWLEQADFDGFRMDAVKHMEQVAGRTLRGKLKEITAMTGTEFYLVGETYVFTDGRPQIARYISPRELDGQFDFPLYWPVREAFADGKGLQRVDDAVRANEEAYVPGTLNSPFLGNHDVARFISQAAGQLHEGGSDPFGPNRPSTVVTDPAALEKMKYGFAFVLTQPGVPLVYYGDEVGLPGAADPDNRRFMRFGSTLAPLERELLDFVRKLGQARRAHEALQTGARRTLRVENDLYVFQRDLPNGKGALVAINRSAVERSLVLELMGSLAASSGTYVDIFSGQTLQLTGTETVLVVPPRGVAVYV

SEQ ID NO: 19130 - protein, 508 aa, Myxococcus xanthus
TYKTDLREIFFTLFEQFGFGQVAGQAPFDAWGPDEAKAVLSETYRFAREVLGPLNSVGDREGCRVENGAVFTPTGFKDAWKKLYEQGFKTVGVSPEHGGQGSPMMLQVTVEELLSGANSAFNMYPGLAFGAAEVVAECGTPEQQKQFVERMLNGTWGGTMCLTEPHAGSDVGAAKSTARRNGDGTYNIRGTKIFISGGDHDMGDNIIHLVLARIDGASPGTKGLSLFIVPKLRINADGSSGQPNDVGVGSIEHKMGINGSATCVINFGESDNCVGELVGTVEHVGMSQMFKMMNGARIAVGIQGIGLASAAYYNALDYAKDRKQGSHFTKWKDPTAPRAAIIEHPDVRRMLLDIKAHVEGIRSLIIKLAMHLDKARQLAGKDDDAATYHKGQVELLTPLVKAYSSEQAFRLCAQAIQIYGGAGYIQDYPVEQYTRDSKIFSIYEGTTHIQAMDLVGRKMGQAGGMHFQQFMGDVGSFIEAHREHAVYGEAVKSLAAAQEALMASAMVV

SEQ ID NO: 19131 - protein, 66 aa, Myxococcus xanthus
VKLIVKDHSGADFESITPEARLIEDLGMDYLDHIEFVMDLEDTFVIEIPDEEAEKIITVGDACDYV

SEQ ID NO: 19132 - protein, 470 aa, Myxococcus xanthus
APMTTHSIRTRLVAPALMVLGMLSTPAFAAAPASAPTKEAPPAAAAPKPFKVPVRTEFTLDNGLEVSLLPYGDMPKVAIQLAIDTGNIHEKATETWLADLTGKLLSEGTTTRSAEQLAQAAAQLGGSLNIGTTMDQTYVGLEVLSESAPDAVALIADVIQNPAFPPAEVERVKGDLVREMAIYKSRPGTLADERLLQSLYGDHPYGRYFPPEAQLKGYTPEAVRAHYDANIGAARARLYVVGRFEPAPVEKAIRDAFTGWKAGAARLRNVPKQKVAKAVQFIDRPGSVQSTVRVAVKGLPPSSPDYVKQTVMNTLLGGYFSSRITANIREAKGYTYSPYSDVSTHLEDAYWVQNADVTTAVTGESLKEILKEVATLRKTPPPADELSAVQSYLAGSFLLQNSSRSGIIYQLRFVDLHGLPDSYLQNYVQSVMAVTPEQVQQLAAKMLTREAMTFIVVGDQKLVAPQLKVV

SEQ ID NO: 19133 - protein, 243 aa, Myxococcus xanthus
LTDVGRRRQHNEDAMLVDAALGLYVVADGMGGHSAGEVASNRATEVVKQHISANRHLLKDLGINPTPDSRSAAAALVEVSVQRACADIYRTAMSDATKRGMGTTFVCLAVGGNKGVIGHVGDSRVYLVRHGQCHRLTEDHTLVAAQLKAGTITKDQAANSQYRNVITRAVGIQESVQVDTLIVDLVPGDMFILCSDGLHGYVEDEEVLPLIAGIAPADLPKRFIDVANERGGKDNITAVVVKV

SEQ ID NO: 19134 - protein, 397 aa, Myxococcus xanthus
YVDIEDLARARGVDPAKYTAGLGAREMAVTDPGEDTVALAATAAARLIRQQDVDPSRIGMLVVGTETGIDHSKPVASHVQGLLKLPRTMRTYDTQHACYGGTAGLMAAVEWIASGAGAGKVAVVVCSDIARYGLNTAGEPTQGGGAVALLVSEQPDLLAMDVGLNGVCSMDVYDFWRPVGRREALVDGHYSITCYLEALSGAYRGWREKALAAGLVRWSDALPGEQLARIAYHVPFCKMARKAHTQLRLCDLEDAADAAASTPESREAQAKSAASYDAQVATSLGLNSRIGNVYTASLYLALAGLLQHEAGALAGQRIGLLSYGSGCAAEFYSGTVGEKAAERMAKADLEAVLARRERVSIEEYERLMKLPADAPEAVAPSPGAFRLTEIRDHRRQY

SEQ ID NO: 19135 - protein, 421 aa, Myxococcus xanthus
DVHEATLPNGLQVRLLANHQAPVVSLYTVFQVGSRNERPGITGISHLFEHMMFNGAKKYGPGEFDRVMEANGGRQNAFTSEDVTVYMDWFPRSALDVIFDLEADRLQHLAIDPKVTESERGVVYSERRSAIDNDNMGALMEQVQATAFVAHPYQFPVIGWPSDIESWRIEDLQRYYKTYYAPNNATLIFTGAVTPAEIFALAEKYLEPIPSQPAPEPVRTKEPEQQGERRIVVKKQAQAPLIQLAYHGISGKDADVEALTLLLSILTNGDSSRLHRRLVEEERAALRVNTHFSPGFDPSLVWVYADLPPGADVAKVEGLLTEELARVVKDGVSDAELKKARNITLSQFWRSLETNNGRGRALGAAETFRGDYRQLFDAPDRYERVTRDDVRKVAARIFNSQRRTVGWLVPADAQAATPDSR

SEQ ID NO: 19136 - protein, 348 aa, Myxococcus xanthus
IRAVGRALPPHYASQEELIAAFRELWATRHFNLERLEDLHRAVQVGGRHLALPLEAYPPLLTFQQRNDAWIRSATELGETVVRKALDAAELTPGEVDHVFFVTVTGIATPSIDARLANRMRFREDFKRTPLFGLGCVAGAAGVARAADYLRGFPEHTAVVIAVELCSLTLQREDLSIPNIIASGLFGDGAACAVLRGAAAPGARGPRVVASRSVFYPDTERIMGWDVVDTGFKVVLSAKVPGLVKDHIRGNVDGFLAQHGLKRGDIRHWVAHTGGPKVLEAFEEALELAPSALERSWASLREVGNLSSASVLFVLGETLESVRAQPGEWGVMMAMGPGFGAEMVLLRW

SEQ ID NO: 19137 - protein, 533 aa, Myxococcus xanthus
PPSRAARLRALATETFDVLIIGGGVTGAGSARDAALRGLKVALVERDDFASGTSSRSSRLIHGGLRYLEHGHLGLVFESSIERQRLLRLAPHLVRPLAFIWPVYAGARVPRWKLNAGLMLYDALSLFRNVKGYRRLNARQVHAAEPGLRTDHLKGGARYYDAATDDARLTLANAVGASEAGAVVLNHASVKALVLEQGQAHGATVVDHLTGEEVTVRARALVNATGPWSDEIRRLDAPNGASPAVRGSKGVHLAVPRERINHRDAFTLLSPKDGRVMFVLPADNFTIIGTTETSTRAHPAEVRASESDVAYLLESANAFFPEARLTRADVVSAWAGIRPLVASGYHGTQADAGSASREHAIDVSPSGVLAISGGKLTTYRVMARDVVDAVERRLGQPRRRSPTDVLPLPGGDIRALDAEFAAARTEVGDDATAVHLVRAYGSRWRRVWALTREDAALSRPLAEGLPYRAAEAAWGVTHELVHTLSDLLIRRLKVAFETRDQGQAAARVAAEVMAPRLGWDAAETQRQLDVYAA

SEQ ID NO: 19138 - protein, 131 aa, Myxococcus xanthus
YDAVMTPLGWLGLTAARRKLVRGLSGHVLEVGTGTGLALPGYPDTVTAVTAIDVDEAALARAQRRRPDARLLYASVESLPFPTASFDAVVSSLVFCSVEAPAQALTEIFRVLRPGGALRMLEHVRAPSPAL

SEQ ID NO: 19139 - protein, 530 aa, Myxococcus xanthus
LPGCPTWPEAYAARYREAGYWRSETFGQLLHERAQRHGERTALVAGERRLTYANLDARVSQLAAGFHALGIQARDRVVVQLPNVAEFFEVIFALFRLGALPVFALPAHRASEIGYFCAFTEAVAYVIADKQAGFDYRTLAEQVRGTCPTLKHVIVAGDAGPFTALSSLYAAPTALPPGPAPSDVAFFQLSGGSTGVPKLIPRTHDDYIYSLRGSVDICQLDETSVYLCALPAAHNFPLSSPGVLGTFYAGGTAVLAPNSSPDTVFPIIERERVTITAVVPPLAMVWMDAAKTRRHQLASLRVLQVGGARLSTEAAMRVKPTLGCTLQQVFGMAEGLVNYTRLDDPEDVIVSTQGRPISPDDEIRVVDEDGEDVAPGETGQLLTRGPYTIRGYYKAEAHNAKAFTDDGFYHTGDVVRVTPQGYLVVEGRAKDQINRGGDKVAAEEVENHLLAHPDVHDAAVVAVPDAFLGERTCAFVIARGTPPAPNVLTAFLRQRGLAAFKIPDRVEFVEAFPKTGVGKVSKKALRDVLA

SEQ ID NO: 19140 - protein, 663 aa, Myxococcus xanthus
  unsure (1)..(663): unsure at all Xaa locations
ALKRFATSFTGRVREGKIDPIFGRHREIRQMVDILSRRRKNNPILVGEPGVGKTALVEGLAWAIVRGEVPDALKNVELLGLDLGLLQAGAGVRGEFENRLKAVISEVKASPTPIILFIDEAHTIIGAGGSQGGTDASNLLKPALARGELRTLAVTTXAEYKKYFEKDAALERRFQPVKVEEPSEEDAELMLRGLRPTXEAAHGVIIREEAVAAAVRLSSRYISGRQLPDKAVDLLDTSAARVKIELSTRPEELVQLDQEISALERERDTRKRDLAEGTGGPDEQTSLEAAEAKLSATVDARATLHARWETERTAVAALMEARKALREAAPDTDSAPLKAAVDEAAAKLAATRGEVPLVHADVDADIVARVVAGWTGVPVGKMRSDLLESVLNLEDKLRGRVRGQEAALKKVAEIIRISQAGIRNPDTPIGVMLFVGPSGVGKTETALALADALYGGERFMTTLNMSEFQEKHTVSRLIGSPPGYVGYGEGGLLTEAVRQRPYSVVLLDECEKADLEVMNLFYQVFDKGSLTDGEGRAVDFKNTVLILTSNLASDLVMRMFEDGAQPTSDEVLSVIRPALSQHFKPALLARMTVVPFGPVQRDVMRQIAEMKLAKLVSRLRTAHNVETTLAPELLDELARRCTESEMGARNMEQILQGSLMPAL

SEQ ID NO: 19141 - protein, 456 aa, Myxococcus xanthus
LLDFMMKSWKPRSKKLPPKIKQAEAFKARRRALSKLFPGETLIIPTGHEKVRANDTNFRFRPGSDFYYLTGNLEPDCVLVLQPKEKGGHTDVLFVEPNPGRTDATFFTDRVKGELWEGPRLGVKESQARYGVDQARSLNELPAFLSGLSGAESRPTRLLRGLSPKVDGAVPAPGEKDKGLAQALSEMRLLKDAQELRELQTSIDSTHRGFEDVIRGLKTAKTERYVEGIFNLRARVEGNDVGYRTIAASGAHACILHWHHNDGPLVPGDLLLLDAGVEGQTLYTADITRTLPISGKFSKEQREIYELVLEAQDAAFAEVKPGNDFMEPNRAAMRVLAEGLEALGILEDAEEALKDEHQFYKRYSLHNVSHMLGLDVHDCAQARQETYKYGKLQAGMVLTVEPGLYFQMDDLTVPKRYRGIGVRIEDDVVVTARGCKVLSADIPRKAKDVEAWMKSL

SEQ ID NO: 19142 - protein, 482 aa, Myxococcus xanthus
RVPVLLRQQRLLRGLAATEARVVCLDADAAALGAEPEVNPGRVTTPDSLAYLIYTSGSTGKPKGVMIDHRNAVAFLQWAQSVFSPESLAGTLASTSICFDLSVFEIFTPLCCGAKVIVAKNALELPELPAAKEVTLVNTVPSAMGALLRGGGVPASVTIVNLAGEALAGALVDSIYALGHVRDVFNLYGPSETTTYSTFTRVNRGETPTIGRPVGNTQVYVLDANREPMPVGVPGEVYIGGHGVARGYLGRTELTAERFVTSPFAGDAGAHLYRTGDLARWLPDGQLEYLGRMDHQVKLRGFRIELGEIGAALQEHPGIRDAVVVVREGPGADKQLVAYVVGRDGKAPEPGALRDHLKSRLPEYMVPFVFVGLEALPLTPNGKVDRAALPAPDRVGSGTAKAHVAPRTPGEATLADIWRQVLGVEQVGVHDHFFELGGHSLLLYRVLVLARAASGADIPLRALLQSPTLEEMARTIEAAKTG

SEQ ID NO: 19143 - protein, 557 aa, Myxococcus xanthus
PTLHFPPELPISSRVEDITAAITAHQVVIVAGATGSGKTTQLPKVLLAMGRGRPRQIGVTQPRRIAATSVAARVARELGTELGTDVGYQIRFEDRSSRQTAVKFMTDGVLLAQIHSDPLLRRYDTIVLDEAHERSLTIDFLLGWLKRILPRRPDLKVVVSSATIETERFSQFFGGAPVIQVEGRTFPVDVLYEPPPEDTELADSVADAVANVISLDPDGDVLVFLPGEREIREAENALNARELRGTVVQPLYARLSASEQSRVFATIPQRRVILATNVAETSVTIPGIVYVVDTGVARLSRYESRSGTTRLHIEPVSQASADQRKGRCGRVREGICVRLYDEVSFTTRPAFTDPEIKRTGLAGVILRMKSLGLGDVEDFPFLDPPQPRAIAEGWRVLEELGAIEGKERTLTPLGQQLARFPVDPRIARMILAGAEYGCLDEVLIVAAALNLQDPRERPRESAQKADELHRRFRDEHSDFTGLLKLWAFVREAEGRGTSHLRRVCRDNFLSFLRVREWRDVQRQLEETVRELRIPRKGRGAPARGYVLHQALLTGLLS

SEQ ID NO: 19144 - protein, 527 aa, Myxococcus xanthus
VIGIDLGTTNSAVATVEDGRPRMIPPRAGGRLTPSTLGVNKAGERVVGVAAQSLGEEHPDSVVWATKRFLGRRYTPELVQEAKALVPYPLVAGPSGDVRVRLAGRVMPVTQVSAMILGELALDAQAHFGRPVTKCVITVPANFDDNQRQATREAASIAGLDVVRLVNEPTAAALAYGLSRGFEGNALVFDLGGGTFDVSILEVKSGVFEVRATGGDPRLGGEDFDQRIVQWLLAQVDDELRHVVSQDAQSLRRLKVAAESAKRELTEKEEASIYVAGLGDHSAPGKRMAELETVLTRSFFETLSEPLSRRCLDVCESVMREAKMDPHAVDVVLLVGGMTRVPLVRRLVADFFGRAPSTDVHPEEAVALGAAVQADELVRQSGQALLLDVAAQSLGVGVMGGRVKRLIPKNTGVPVVARDIFYPGSSGQQEARIPVYQGESEFQDENYKLGEVVLKRLHVAARGEVPLEVVFELSSEAILSVKATDLTSGNMEAVRLEARAGLPQGEAEKLGAEQAHYARSQGVVDAK

SEQ ID NO: 19145 - protein, 450 aa, Myxococcus xanthus
MNAHIFREYDIRGLVDKDLTTEVVELLGKGLGTIIRRQGGRSIAVGRDCRESSTRFRDALCAGLTSTGLNVFDVGVVPTPLTYFAANTLPVDGLAMITGSHNPPEYNGFKIGAGKTTFHSHEIQALRKLIEARDFEVSPKPGTVTPYDIITPYNHFVRQTVKVGRKGMRIVIDAGNGTGGAIAVPLFESMGFDVVPLFCEMDATFPNHHPDPTVVENLEDLIAAVKREKAEVGIAYDGDSDRIGVIDDQGNILWGDQLMVLFSRYVLKESPGAAIVGEVKCSYTLYDDIAKRGGKPIMWKAGHSLIKSKMKETQAELAGEMSGHIFFKNRYFGFDDAIYSTARLLEILTHEKATMSELLSDVPKTYASPELRFDTKEEKKFEMVKRATETLRDAGHDIIDVDGVRVTFPDGWGLIRASNTQPILVLRFEANTPERLKEIQALIEGTVEKV

SEQ ID NO: 19146 - protein, 350 aa, Myxococcus xanthus
  unsure (1)..(350): unsure at all Xaa locations
RSPDIISGYHLDKLVGSGGMGEVHKATQLSLGRTVAVKLLNPELAKDPSFIARFQKEAAALAALSHPHIVSIVDKGKTDTTYYLVMEFVDGPSLRELIREPQLDVMGALRRMLQICRAIEYAHGRGVIHRDLKPENILLDQQAGGIAKVSDFGLASFLEDASPSSRYALTSTHVSMGTLSYMAPEQRVDAKSADARADIFSLGVILYEWLTGEVPLGTFDPPSRRKPGLDSRLDAIVTRCLKPDPEDRYPSVTTLIADLELLVPGSLPSLAPGEADAPPARPPGCAQGGAHGPAGRGRAAGGGGAAPCWAGSGCAAGRSPCRRSPAPRXTRTWARHRPGPCPAGWRQAPR

SEQ ID NO: 19147 - protein, 202 aa, Myxococcus xanthus
MLDLDALDFAKGNGLVTVVTQDASTGDVLMVAHADREALERTLATGEMHYRSRTRGPWHKGATSGNVQRVVALRADCDGDAVLARVAKAGPACHLGTKTCFGPGRWDALSALDDTLARRAAPAERPDDAPPSYTRRLLEDRNLRLKKLGEEAAELVTACADVDPSRAAEEAADVLYHVLVAVRPLGLSLDDVKAVLARRASR

SEQ ID NO: 19148 - protein, 447 aa, Myxococcus xanthus
GSILGIDFGTTNTAAAFFDKAGKLRVVPVTDKSVTLPSVVWFHAADKAIVGHAARRQIIDDPRHTVFGAKRFLGRRFQSEYVTQHKDKYAFGLVEAEDGYTAVTMYGKQTSLTDVAHLIIKQIHTLANHAAGTPFRECVLTVPAHASSRQRAAVRHAAEQAGLQVRAIINEPTAAALYYANLRNPEQTVMVFDLGGGTFDATLLAVQNKVVKVLATGGDAFLGGANFDERIVEMLVNDFQQKHGIDLRGNKVVMQRLVFAAESAKMALSQRDATVLRVPCIAQKDGGFIDFDYTLTRKRLEEMAFQLIERTASACDDVLERAKLKADQIDELVLVGGQTRMPAIRQRFSHFKRMSSDKEVNPELGVAVGAAILGRNLARGITGLADVVPMPISIMVPGGAQHEVIPANTPVPATKSVTMELPMIPGPLSIALFEALDTTTVDRELLG

SEQ ID NO: 19149 - protein, 284 aa, Myxococcus xanthus
LLKIALPNKGRLSDEVRELFNDAGLEVRARGERALTASLGGEFEAIFVRAQDIPEFVADGAAHAGVTGWDLVCESGRELDLLMDLEFGRCRLVVAAREEGGFASPEDVKEGMRVASCFPRLTQEFFARRGQRVAVVPVSGAAEIAPHLGIADIVVDLTSTGSTLKMNGLREVGTVLESSARLVACKGNPVDTQQKLDELKQALGSVLAARDKRYLMANVPKDSLIRVREVLPGLNGPTVVDVLDGGDFVAVHAVVPAKTIYRTINALKALGCEGILVTRIERLM

SEQ ID NO: 19150 - protein, 268 aa, Myxococcus xanthus
MIRTVITGITGRMGSTLLRLALDSGDLRVVGGTARPGSASVGQDAGVATRLGPVDVTVVDSLERALDAAQADVVIDFTSAELSVAHAKVCAARGVALVVGSTGFTPEASAALAESAKAVPIVAAPNMSVGVNLVIRMAAELARVLGPGFDVEVLEAHHRMKKDAPSGTALRLAEVLTEALGRTQEDLTFARHGQIGARPAREIGVQTLRGGDVVGEHTVYFLGEGERIELTHRATNRDQFAAGALRAARWVAGRAPGLHDMADVLGFQ

SEQ ID NO: 19151 - protein, 295 aa, Myxococcus xanthus
AGMKTFEGSMTALATPFRNGALDEPAYRALVRQQIEGGTSVLVPMGTTGEAVTMTATELARAVKVVVYKAKGRVTVVGGSGSTSSAETIDGVPSVRYAGADGTLIVTPYYNKPTQEGLLEHYRAVAKAHPGFPIIAYNVPGRTGVDLLPDTVLRLCDIPEVVALKEATGSMPRAIDILEKCGDRMTLLSGDDFTVLPFIACGGKGVISVSSNVAPRMMADLVAAARAGNIAVARDLQVRMNELHRLLFIESNPTPVKWGLHVMGLFGPEVRLPLVQMTEPNAAKLRDTLRQLGLL

SEQ ID NO: 19152 - protein, 397 aa, Myxococcus xanthus
HAADVPLAAIAESVGTPIYVYSTATLTRHIRVVTEAFGDRPHLICYSVKANSNLAILRLIAERGGGFDIVSGGELARVRHVGGDAGKTVFAGVGKTHEEMEAALAAGILLFNVESAEELEALDAVGRRLGRRAPFALRVNPDVDARTHRYISTGLKTSKFGVPFEEAVALYARAKKMKGLLAAGLDCHIGSQLTQTAPIRAALSKVAGLYSALKEKGHPLAYLDVGGGLGITYLDETPPSPEEYARTVLAAAGATGATLILEPGRALVGNAGVLLTRVLYRKKTPARHFVVVDAGMNDLLRPALYEAHHGLQPLVKRRGKAVEVDVVGPVCESTDVLAKARPLVLPQAGELFAFMSAGAYGMSMSSTYNSRPRPAEVLVDGAAWRVVRERERVEDLW

SEQ ID NO: 19153 - protein, 738 aa, Myxococcus xanthus
LIAKELQASFRTALDEARKMRHEYLTLEHLLLALTTDARTREVLKGCGANVKQLQERLVSLMQETFERLTQGVDPEPQQTIGVERVLHRAAMHALSAEQKLIDGGDVLVALFREDESHALYLLQQEGVTRLDLLNYISHGVTKDGEGEGEGEESAGHATPAGDDDEGESPKKSPLEAYTVQLNIEAKEGRIDPLIGREKELERTIQVLCRRRKNNPLYVGEAGVGKTAIAEGLALHIHEGRVPEVLKDAIVYSLDMGALLAGTKFRGQFEERLKGVLKALKEQQNAILFIDEIHTIVGAGATSGGSMDASNLLKPALASGRLRCIGSTTYQEYKSAFERDRALSRRFQKIEVGEPSVEDTILILEGLKSRYEEHHGVKYQPEAIRAAAELSAKHINDRFLPDKAIDVIDETGSAERLKPEGQRSNTVSGADVEAVVAKMARIPAKSVSASEGVQLQNLEKELQGVIYGQDSAIKDLVSAIMLARSGLRAPEKPIGSFLFSGPTGVGKTELAKQLAQSLGVEFLRYDMSEYSEKHTVSRLIGAPPGYVGFDQGGLLTDAVRKHPYSVVVLDEIEKAHPDLFNILLQVMDHATLTDNNGRKADFRNIVLILTTNAGAQEMSTKAIGFGDLAKPVDATRAKKAIERTFTPEFRNRLDGWILFSGLPPEVILKVVDKEVRLLQKMLDEKKVKLALTPAARAWLAEHGYDPAFGARPMARLVDNSLKKPLAQALLFGDLKNGG

SEQ ID NO: 19154 - protein, 499 aa, Myxococcus xanthus
IIGIDLGTTNSCAAIVEDSGNVKLIPYKGGEYTIPSIFAIDDKGNELIGYEAKRQWQLNPRNTVYGSKRLVGRGFGSEVVDTMKQVVAYNMRPGKQSDVILDVGKKEFALQEISAKILGKIREVASNYLKMPIKRAVVTVPAYFNDRQRQSVKDAGKLIDLEVVRIINEPTAAALAYGVGKGLKEKVVIYDLGGGTFDVSIIEIRDRVFEVKATGGDVFLGGIDFDNAIIHHVLKDFAAKTGLDLATDPVAMQRIKDLAERTKIDLSAREEVPFNIPFITMTSQGQPLNIEMKFSRKMLEQLTNQLVDRTLQMVARVLVDSGLSTKDVDEVMLVGGQTRMPIVQDRLTKFFGKPPSKGVHPDEAVAIGAALYAHSLQDDTNLRIQLLDVIPMAIGLEKAGGAFHTVFPRNASIPNAKQLLATTSMDNQTELAVRIFQGDNELVARNDMLGEFTFSGIQPGRAGPALVEITFDANVEGILTMRARDPVSGREMKTTVRVS

SEQ ID NO: 19155 - protein, 310 aa, Myxococcus xanthus
PHIVTLTLNPTIDVATSVPEVTPEHKLRCGPVRRDPGGGGINVARVVRELGGEAIAVYTRGGATGSQLEELLEEKGLLRRSVPLQDATRESFTVAEGTGAREYRFILPGPTLSEREWQRCLDALEDVAVGATYIVASGSLAPGVPEDFYARVARLGKRLAVRVVVDTNGPPLRAALEEGVFMAKPNRRELRDLSGASVEDFATQAAAARELVAQGRAEVLAVSMGADGALVTTRTAQFRATPPPVRTYSSVGAGDSFVAGMTLALARGQSTEDALRWGIASGTAALLTQGTDLCYRADVERLFTQVKAEP

SEQ ID NO: 19156 - protein, 144 aa, Myxococcus xanthus
LSAIVAMAANRVIGAGNQLPWRLPADLARFKRITMGHTLVMGRKTYESIGRPLPGRTFIVVTRQRDFAPPGVQVAHSVDEALSLAKASGDSEVFIAGGADLYAQTMDRVQRIYLTHIARNFPGDTWFPDVDLSGWTCVEEQAHP

SEQ ID NO: 19157 - protein, 489 aa, Myxococcus xanthus
GVVIGIDLGTTNSCAAYVRNGKPGVLPSREGHNTVPSIIAVNTRGKLVVGHPAKGQMLTNPRQTVYGAKRLVGRPFASPVVEQLKDRFHYEIAASENGDAGVKLGEDVYTLQQISALILREVREVAQNQLGHQVSRAVVTVPAYYNDNQRQAVREAGKLAGLYIERILNEPTSAALAYGFGRKLNQRVLVYDLGGGTFDASVLELNDNVYEVISTGGDTFLGGIDFDSSLVTYLLDEFQKTTGRAFQGDRVALQRINDAAERAKCALSERSEVRVHVAFVTMIDSKPCDLDVMLSRQKLVELTEGLVDRTLQVCEEVLRAKKVTPQDIDEVILVGGQSRFPLVHEKITKFFGKPPSKGVHPDEAVALGAALLAHSLGQLEGVVLIDVLPMAIGVGLPGGRFKAVMERNTSLPSTKSYTLATHRDGQTELELTVFQGDSDKAADNEYLGTLKLEGLPKLPRGAVQVNVTFEVSNESLLKVTAREASSGRE

SEQ ID NO: 19158 - protein, 381 aa, Myxococcus xanthus
IRLALTFDDVLLVPGESSVVPKDVDLTTRLTRNLRLNIPLLSAAMDTVTESRTAIAMAQEGGIGVIHKNMTPEQQALEVLKVKKFESGMVVDPVTIEPEAPLGRALELMRLHGVSGIPVVKGQRLVGIVTSRDVRFETNFTQTVESMMTRKLVTGREGITQEDAQKLLHEHRIEKLLVVNDAFELKGLITIKDIEKRRTHPNAAKDGMGRLLCAAAVGVSADREARVEALIKAGVDVIVVDTAHGHSTAVLDGVRDTRKNFQGFELIAGNVATAEATRALIQAGVDAVKVGIGPGSICTTRVVAGVGVPQVTAVDDCVREAQKHDVPIISDGGIKYSGDIVKALAAGANTVMVGSLFAGTEESPGDVILYQGRSYKSYRGM

SEQ ID NO: 19159 - protein, 564 aa, Myxococcus xanthus
GIGASPGVAVGHAFILDRKRIRTPKLRLAEAEVEPERMRMKTAIDLSDRQLAELKEQITRTEGSDHALILEAHRLMLHDPMLVDEVNRLIIEDRINAEWAVRRVARKIKHLFDNIPDEYFRERRSDVDYVADRIIRNLMGQVVDEEVEVPAEAIVVAHDLSPADAALMARSGRVGGFVTDLGGQTSHTAIVARARETPAVVGAGRASEQISPGDLVAMDGIRGVVLVNPSDEQLAVFREEQRRYQESERLALATKDLPAVSTDGFQIRLNGNIEFLEEIPSLLAHGAEGIGLYRTEFMFLDRKTAPTEEEHYRAYRQVLEAMGGRPVTIRTLDLGGDKVPGKTKHEKEPNPAMGLRAIRYCLSNRELFRTQLRALLRASVHGNLRLMFPLICGVSELREARSELEACRTELGRAGVPVGKRFPVGIMVETPSAATIADRLAQEADFFSVGTNDLIQYSLAIDRQNREVAYLYRPLHLSVLRQLRGIIDAGRAANIPVSMCGEMAGDPLYTLVLLALGFDELSMTSGQIPVVKRFLRRVSRVDAMELLQNAMELTTAEEIERYVR

SEQ ID NO: 19160 - protein, 292 aa, Myxococcus xanthus
  unsure (1)..(292): unsure at all Xaa locations
TCPWGLARAXMPGPMNKRDLEPGIITDLAGRTTYGDYLQLDRVLSAQVTRSQPPHHDELLFIMQHQTSELWMKLLIHXLGACMRYVQADRLEAXFKKFARVAHIQPMLFKQWSELETLTPNEYLEFRDTLGSFSGFQSFQYRAVEFLLGNKDAQALMPFRHVPAIHGELERLFESPSLYDEFLRHLSRMGHPVPQSHVQRDWRKPYEKSPEVVEVFRRIYQDAEAHWDAYEMCEKLVDTEERFQLWRYRHMMTVMRIIGFKQGTGGSSGVGFLRKALDLRFFPELWDVRTEL

SEQ ID NO: 19161 - protein, 78 aa, Myxococcus xanthus
GATLVDVRTPEEFASGHLPGAVNIPVDELARRFGELGSLQTPLVVYCRSGARSGRAERLLKEQGFQDVFNLGPMSTWP

SEQ ID NO: 19162 - protein, 378 aa, Myxococcus xanthus
YKLDNGLKVVLSRDSSAPKAVVAVYYNIGFRIEPKDRTGFAHLFEHMMFQGSTNLGKMEFIRLIQKNGGVLNGSTRFDFTNYFEVIPSNALEPILWAEADRMRGLDVTEENLKNQQGVVTNEVKVNVLNQPYGGFPWLDMPQVANTNWYNAHNFYGDLKDLEAASLEDVRAFFKTYYAPSNAALVIVGDFEPEQVKGWIQKYFGPLPTVAQPSKPDISEPRQTKEKRHDKQDKLAQRPALAVGYHMPDVGTPEYFAMALVDEVLLQGNDSALYQQLVQKKGLTGEVSGGVNQLGNHWNYNGPMQWTAYLFHDADTTTETLLAEIDGVVAQLQNQPIDAATLERARVKARSGLYGQLEGFLGFGRADLLASFALFFDDP

SEQ ID NO: 19163 - protein, 325 aa, Myxococcus xanthus
LGHFHPPNLLTNAFFEELGLETSDAWIVDRVGIRTRHTVLPLDYLRETRNRDVRAAQEAALFSNAETGRRAALMALERAGLKPSDIGLVVAGGCSPDECIPAESNRVAQLLNIHAPAVDLQSACSSFCMQLHFLAGMRPERLPDYVLVVNMDNSTRVVDYTDRSSAVLWGDGASAAILSPRVPGRWQLTETLLAGDPSGADKVRVPRMGHFTQNGGEVQKFAIRRAGETFQALRTRFMERHPDKGAGAVSFIGHQANLRMLEAVQRRCEVPDARHFFNVHTRGNTGAAGAPGVLSEHWDDPAVGDAVVLSVVGSGLTWAGALLER

SEQ ID NO: 19164 - protein, 242 aa, Myxococcus xanthus
MDFGLKGRRALVMGASAGLGYAIAEALVKEGATVAICSRGGEKLERAAKALGAALAVPCDLTQPQAAKALVETVTAKLGGVDVLVVNTGGPPSGGFESLTAEQWQLGFQSLWMASVDGIHPVLPGIKERQWGRIVLVTSLAAREAMNNLTISNGLRAGLLGLVKTVSNEVAQHGVTLNAVLPGYHATERMQQLGLTDEKVAPQIPARRLGRPEELAALTAFLASEQASYITGQSIAVDGGAQ

SEQ ID NO: 19165 - protein, 530 aa, Myxococcus xanthus
FPGVIGRTDEESSPAWPAPLRAKPGAPNVLFIVLDDTGFGQLGCYGSPIRTPNLDRLAKGGLLYNNMHTTALCSPTRSCILTGRNHHSNGMAAITEISVGYPGRNGTIPFENGFLSEMLAGHGYNTYCVGKWHLTPAEQTSAAGPYSRWPLGRGFERYYGFLGGDTHQYYPDLVHDNHQVRPPKTPEEGYHLTEDLVDRAIGFIADAKQVAPDKPFFLYFCTGAMHAPHHVPREWADRYKGQFDDGWDAYREKVFRRQLETGVLPPGTRLSRHDPDVQDWDSLSPEERRLYARMMEVFAGFLEHTDHHIGRLIQSLEASGELENTLIMVISDNGASPEGGLHGSVNELKFFNNAPESLEQNLAALDELGGPRHFNHYPWGWAWAGNTPFKRWKRETYRGGTTDPFIVHWPRGIQARGEIRSQYCHAIDMVPTVLDCLGIDPPTELRGVTQSPIEGVSFKYSFQDADAESRHHTQYFEMFSHRALYHDGWRAVCPFPGPSFTESHEPFGMLKLTEARLREFDTEGWELYHV

SEQ ID NO: 19166 - protein, 125 aa, Myxococcus xanthus
NIPGDLKYTREHEWARVQGTSVVVGVTQHAQESLGDVVYVELPKVGSTVTEGKQFGVIESTKAVSELYSPLTGKVVKVNDGLSDNPSTVNTDPYGAGWIVEIEPSDPKQVDGLMDAAAYTALLQN

SEQ ID NO: 19167 - protein, 339 aa, Myxococcus xanthus
LARAARNIALAHAPQKPQWVEVETEPGVLVGRRPDPLGRVGVYAPGGRAVYPSSVLMGVVPAKVAGVGEVIVCSPPGPDGLPHPSVLAAASLAGADRVFSLGGAGAVAAMAHGTESVPRVDRIVGPGNAYVAEAKLQVVGAVAIEAPAGPSEILVVADDTANPAAVAREMLAQAEHDPEAACVTLALGDALADAIAAEVERQAERAKRWEIVTSALGSRGAVLTVASLEEAWPFVADFAPEHLLIATASPREDLGQVRNAGTVFLGERSSVAYGDYMTGSNHVLPTAGLARAYSGLNLLDFYRWTTYQRVAPTAAASLAEDVGRLADSEGLFAHADAAR

SEQ ID NO: 19168 - protein, 329 aa, Myxococcus xanthus
AMIPRRASYRDIPLYAPSTRPCRVDLSDNTNLFGVPPSVERVLATTVSRVPRYPRGYAPDLRRALAASIGAAPDEITTGCGSDDVIDSALRAFLEPGDTLAYQDPTFVMVPLFAKVNGLEGVPVPLKPDFDVDADALLGTGAKVIFLCSPNNPTGTALSRAAVERVVEDAPGIVIIDEAYADFAPGKDFLDLARRRSNVLVTRTFSKAFGLAGLRVGWGVGAPELVAELEKARGPYKLTSVAEAVAVSVLKGDADWVRARAEEAVACRERLRGELVSLGLTPLPSEANFLMVPLPGALAVAERMRERDVNVRAFQALTGVGDALRIGVG

SEQ ID NO: 19169 - protein, 175 aa, Myxococcus xanthus
RGMTTVIRETKETQVRVELAPGKGVTNVDTGLKFFDHMLATFARYAGLDLSLHARGDLTHHVMEDVAITLGTAVQQVIPATAARFAERTIPMDDALVQACLDAGGRFYYQGPLKNRLYEHWMRSFSEHARVTLHLRVLRGKDSHHATEASFKALGLALRDAMVDSGSVFSMKGSV

SEQ ID NO: 19170 - protein, 580 aa, Myxococcus xanthus
DAAKPQRRQAPPPGLAEASRCLNEEARAGLLERAWERDLEVSRLAEAVTSRTRASVLLVGPSSVGKTALVHELVQRAEAATTGSPLHGLEVFSSSGGRIMAGMRYLGQWQERVKHMVEALRVRQAVLHLDSLSELLSLGSGDTGLDVARQLLPALESGEVSLVLEATPEDVARAERTHAAFLQSLRHIAVAPLSAQAARNALQQASHRVGRARKVRFTPDALDRAGELTERFGSGPSPGGAVSLLRAASTEPGAAGEVNAASVTRAFCTRTGYPLELVDSAIRLDPDALLRRFRERVVGQDEATLLLRNLVVTLKTGLADPSRPLGAFLLLGPTGVGKTESALALAEYLFGDVARLARFDMAEYAAPGSATRLVGEAGGQQGSLARRVREQPFGVVLLDEIEKADAGVHDLLLQVLGEGRLTDATGRTVSFRNTVVLLTSNLGADSAGRSLGFGERGPLERAAHYLGAAAAFFRPELLNRLDRVVPYRALTEDVIQSLARRTLEAALSREGLSRRGVKVTFDEDVVKHLARTGFDARYGARPLKRAVEQQVVAPLARWLAAQATSAPPQVVLRVEAEGRI

SEQ ID NO: 19171 - protein, 446 aa, Myxococcus xanthus
QKLLIANRGEIARRIGVVARGMGLKTVAVYSDADAELPFVKEADEAVRIGPAPAKDSYLNTAAILEAAKQTGAQAIHPGYGFLSENGEFAQACADAGLIFVGPPPEAMARMKDKSQARKLVSAAGVPVVPGSEGVVPDVASALAEAERIGYPVLVKAASGGGGIGMAVARNAAEMEKVYRQCTDRAKAAFGKEGVYVERYFPAPRHIEVQILGDQHGHLIHCLERECSIQRRHQKVVEEAPSVLFADGRNPELAQKLFTAAVAAAKAFGYANAGTVEFLYSDGEVYFIEMNARLQVEHPVTELTTGLDLIGWQLRIAAGERLTVKQEDVKRRGAALEFRIYAEDPVKFFPSPGPLKVFQPPTGEGVRLDAGYGEGNTVTPNYDPMIAKLIVTGETRAQAIERSVTALQSFRIEGIKTNIPLHLRIVQDAAFQAGELDTNFLEHHAK

SEQ ID NO: 19172 - protein, 265 aa, Myxococcus xanthus
GLEKQWAEVGIAERLLLVDLSSDFRLDHPGRYAGAYGRPHPSPELLGTFTYGLTEWKRDAVKTAKRIANPGCFATAVQLALLPIASTPGLGLLAVSGVTGSSGSGSLPGEGTHHPTRAQDFRAYKPLEHQHEAEVEVMLVAHGAQRHRLAFVPHSAPMVRGIFATVQFEWPEHGGAVVTASLMEKYRRYYEGSKFVRIVEGTPRIAAVAGSNFCDIAVATKGRSVAVMAALDNLVKGMAGQAVQNFNVALGLPEDTALRQAACYP

SEQ ID NO: 19173 - protein, 246 aa, Myxococcus xanthus
FKDKVVLVTGGSRGIGRACAVAFAKAGASTVVISYAGNEAAAQETVALLQAEGAKAEAIRFDVSDSAACASAVDGIVKGHGRLDVLVNNAGVAVDGLVMRVKDEDWDKQLDTNLKGAFSLIRAVSRPMMKQKGGAIINITSVVGEMGNGGQAAYSASKAGLIGLTKSVARELSSRNIRVNAVSPGFIGTDMTHQINDEMRQKMLEGIPLGRLGNPEEVAGAVLFLAGDAASYITGEVLKVNGGMYM

SEQ ID NO: 19174 - protein, 306 aa, Myxococcus xanthus
MSKVAFVFPGQGSQAVGMGKDLYEKFPEARAVFDAVDAALGEKLSTLCFEGPDEALKLTANTQPAILTVSLAAHAVFAKRGPAPSFVAGHSLGEYSALVAAGAMDLGDAVRVVRARGTFMQEAVPAGVGAMAAVLGLVPEKVKAPCDAAAEGQVVSPANYNSPEQTVIAGDAAAVERAGVKCKEAGAKRVMPLPVSAPFHCALMAPVQPRLAEVLGGIQVSAPSVPVVTNVEARPNADASRVVPLLLEQVSSPVRWIECVEALKAEGVTRIIELGPGKVLVGLVKRITKDIELFNVEDSASLDKAL

SEQ ID NO: 19175 - protein, 443 aa, Myxococcus xanthus
PSAAPLVDSATFPPGRASWISELNSTRRSSPTSSPITRSRRDPDLLGRTEPFFEWQESRRQAGLWPYSRSLEAAPKAECGVRSETGAVRQGLNFGSQDYLSLSTHPAVVEAAQRAIQDYGLHSAGSAMLGGNTTPSLMLEKALAEHLQTPHVALFSTGWGAGFGVIAGLVRPDDHVVLDALSHACLQQGAAAATTNVSRVPHLNNRAMRRKLQEIRARDTQNAVLVVTEGLFSMDSDVPRIEELQSICREYGATLLVDVAHDLGAMGPRGTGSLGVQGLLGKVDLVVGAFSKTFASNGGFVATRSPAVRQFIRIMGGPHIFSNALLPMQAAVVLESLRIVRSEEGDALRAKARENILALRGAFEARGVTCLGEPSNVVPVQVGDAKVARLASKKVFDRDIFANLVEYPAVRLRETRFRMQVMASHTLEQVQRAADGVCDAIEE

SEQ ID NO: 19176 - protein, 647 aa, Myxococcus xanthus
MAASKHEIHSVLTEARVFPPPEAFARRAHIRSMEQYQQLWDEAAKDPDKYWGDRAREELYWKAPFQTVLDWKPPHARWFVEGKTNLAYNCLDRHLATRKDKPAILFEGEPGDRRSLTYGELSTEVNKLANALKSLGVRKGDRVGIYLPMVPEAAVAMLACARIGAVHSVVFGGFSAEALHERMNDAGAKVLLTADGGWRKGAVVPLLKNVEAALPHMPTMEKVVVLRRTGSTLALSGPKLVAWDTLVSGQSAECEPEWVESEHPLFILYTSGSTGKPKGVLHTTGGYAVNTSLTTRWVFDLREDDVYWCTADVGWVTGHSYVVYGPLMNGVTTILYEGAPTQPGPDRFWDIIERYKATILYTAPTAIRAFMRLGEEPVRKHDLSSLRLLGSVGEPINPEAWMWYRDVIGGGRCPVVDTWWQTETGCIMVSPLPGATPTKPGSATLPLPGIHAEILDREGNTVPRGQGGLLFVTRPWPSMLRTVYGDPDRYVRTYFNELPGMYFTGDGARTDAEGYIWLMGRVDDVVNVAGHRLGTAEVESALVAHETVAEAAVVGRPDDLKGTALVAFVTLKQGHTPSDALKKTLAAHVGREIGAIARPDEIRFAEALPKTRSGKIMRRLLRDVAAGNQASGDTTTLEDLNVLAALR

SEQ ID NO: 19177 - protein, 377 aa, Myxococcus xanthus
WAREDLEALSERGLRRYLEPLDSPQGPVVRVGGETLVNFSSNDYLGLAASPTVRAAALAAVERYGVGTGASRLVVGDTAAHHRLETRLAAFERAEAVRLFNSGYAANTGIIPALVGSEDAVFSDALNHASLVDGCRLSRARVCVYPHADVEALTRALAETPARRKLVVTDTVFSMDGDVAPLRDIVAACRAHGAALMVDEAHATGVLGARGAGLCDELGLESEVDLRMGTLSKALGVMGAYVATSREVADLLVSRARPFVFSTALPAHLCAAAEAAVDAVEGDPDLRERLWRNIRRFADGLRGLGVRAEPRSAVFPLILGEPERALDAARRLREAGVLVKAIRPPTVYEGTNRLGFCLSASHSVGHVDLALEALRSV

SEQ ID NO: 19178 - protein, 581 aa, Myxococcus xanthus
RPIQKVLCANRGEIAIRVFRACNELGIRTVAIYSDEDRTHEHRHKADEAYLVGRGKRPVEAYLGIDEILDVAVKAGVDAIHPGYGFLSENAAFAEACERRGIRFIGPRSDVVRTMGDKVAAKHLADACGVPVVPGITLEGDDAHVLEQARAFFAKQGGPILVKAAHGGGGRGMRVVREAKALEDALASARSEAKSAFGSSSVFLERFLEHVRHIEVQLLGDLHGNIVHLHERDCSVQRRHQKVIEIAPAPNLAPAVKEAICDAAVRLARKAGYTSAGTAEFLVAGDAFYFIECNARLQVEHTVTEQVTGVDLVQSQLRIAEGFRLDAPEVGISRQEDVVPRGYAVQLRVTTEDPANQFMPDAGVITAWRAATGFGIRLDGSNGYTNAVISPYYDSMLVKVIAYAPTFQGAVMKGQRALREFRIRGVKTNLPFLENVLAHPAFQQGETYTRFIDETPVLFQLEPRRDRATKLLQYLGDVIVNGHPTIKKDQRLKPTQFLEPRLPKTPSGPVPRGTAHILAEKGPRGLADCVLAQKRVLLTDTTMRDAHQSLLATRMRTRDIPRVAPATAHLALELFSLKSWG

SEQ ID NO: 19179 - protein, 507 aa, Myxococcus xanthus
MEIRADEISRIIREQIKDYGKKVTVAETGTVLSVGDGIARIYGLEGALAGELVEFANGVQGLVLNLEEDNVGVAIMGDFQAIREGDTVKRTQQIASVPVGKELLGRVVDPLGKPLDGKGPIAATETRRLEVKAPGIVSRKSVHEPLQTGIKALDALVPVGRGQRELIIGDRQTGKTAVAIDTIINQKGLNVYCIYVAIGQKQSTVAQVVEKLNRYGAMEYTTVVASNASDPAPMQFFAPYAGVAMGEYFRDNKMHALIVYDDLSKQAVAYRQLSLLLRRPPGREAYPGDVFYVHSRLLERAAKLSDEEGAGSLTALPIIETQAGDVSAYIPTNVISITDGQIFLETDLFFAGVRPAINVGLSVSRVGSAAQIKAMKQVAGTMKLELAQYRELAAFAQFGSDLDKATQETLARGARMVELLKQGQYEPMPVEKQVMQIYAATNRDDPKKRGWIRDIPTADVVRWMREFLEFADGKHPNVAKDLASKRELTADIKTALSKAITEFNEVF

SEQ ID NO: 19180 - protein, 459 aa, Myxococcus xanthus
MNVLFISSEVAPFSKTGGLGDVAGALPAALASLGHDVKVITPRYRDLRGAERLEPTGQSLLLRFPFGELSGPILSARVSERLEVLFLENAFLFGNRHGLYGDAGGAFADNHRRFAYLSVGALQAAQRLRFIPDIIHANDWQTGLVPVALRRGFQTGPLAHAKSVFTIHNLAYQGQFPKDVMGDLALPWDLFTAHDGLEFHDTVNFLKAGLVFSDALTTVSPTYAREIQTPEQGYGLDGLLRHRAHRLHGILNGVDTHEWNPEDDAFLPARYGLKDLSGKAVCKRELLARFGLEDGPAPVFGFVSRLAWQKGMDLLLEALPAALHADIRVVGVGSGEGPLEEGLLALQSRYPKQVGVHIGFDPGLSHLVEAGADFFLMPSRYEPCGLNQMYSLRYGTVPIVRATGGLVDTVEGGLDGNGILFEAFHKSALLAAIRRALALYADPSRLDEFRRRGMEKDFS

SEQ ID NO: 19181 - protein, 279 aa, Myxococcus xanthus
MGIKKYKPTSAARRLMTVSDFADITKDSPEKSLTEPLKRSGGRNVHGHITRRHQGGGHKRRYRVIDFKRRDKDGVPAKVVAVEYDPNRTANIALLHYADGEKRYILAPVGLSVGDTVFAGEGADIRPGNSLPLQNIPVGTVIHNVELKPGRGAQVIRSAGTSGQLMAKEDRYAQVRMPSGTVRKVLIECRATVGQVGNIEHEIIRIGKAGKSRWLGIRPTVRGLAMNPVDHPHGGGEGKSGQGNPHPVSPWGKKTKGLTTRTNKRTDKFIVSGRRQGAR

SEQ ID NO: 19182 - protein, 442 aa, Myxococcus xanthus
  unsure (1)..(442): unsure at all Xaa locations
ALSPLXNLRPMAKDTLTITDNRTGKTYEVPIENGCIRTNALRQIKTGDDDFGLMGYDPAFLNTANCKSAITFIDGDKGILEYRGYPIEQLAEKSSFLEVAYLLLNGELPSEKELQQFNHLVTHHTYVHENVKSFMDGFRYDAHPMSMVSSTVAALSSFYPDAKNIKDPLSRRIQITRLIAKMPTIAAFSYRHTMGLPYIYPDNDLSYVANFLAMIKRIGTSTYKVHPVLERALDILFILHADHEQNCSTTSVRTVGSSEVDPYSAVSAGIGALYGPLHGGANEAVLRMLRDIGHVSKIPEFIKSVKSGEGEKKLMGFGHRVYKSYDPRAKVIKRVADEVFEVTGKNPLLEIAVELERIALEDEYFVKRKLYPNVDFYSGLIYEAMGFQVEMFPVLFAIPRTVGWCAQWEEMVTDNEQKIARPRQVFTGAPRRDYVPMDKRAV

SEQ ID NO: 19183 - protein, 568 aa, Myxococcus xanthus
GAYAPTSWFEYAQRVRRFALGLHALGVGAGQPVGILSFNREEWHVADLAAIAMGGVPVGLYTTSAPEQLEYILGHCEATLLVVENERHLRTALALRERLPKLRHVVVIDAPTVLPEGVLRYADVMALGTGADEKPYWDSVHALKPEAMGTLIYTSGTTGHPKGVMLSHHNLVWTAKQLTDSVTFGQPAASSLVSYLPLSHIAEQIISLYSPLLNGVQVYFAASVDTMPQSLREVRPSFFFGVPRVWEKFKAKAEEGLASQPPSKRRVVAWARRVASERHERVMRHQSVPMTLEAQYLLARRLVFAPLKERIGMERVSFFATAAAPVGREVLDFFASIDMVIHEVWGMTEVTGPGTVSTESHTRLGSVGRAMMGVELRIADDGELLVRGGNVCMGYYKNPEATAELLADGWLHSGDVGQLDADGYVQITGRKKDIIVTSGGKKTSPSNIEELLTALPGVGHAVVLGERRNFLVALLTLDVEKARALAKAQGWPEDAARLAEDARLRQFLQERVERDVNPKLSRFETIKRFAVLPKDFSVEGGELTPKLSVRRNVVAEKYAGLVESLYDE

SEQ ID NO: 19184 - protein, 201 aa, Myxococcus xanthus
RHFSMIRTFVLADFVTLGNGFAGAGAILSAMQYLASGDVGWLWVAFGLMPVALVMDVMDGRIARWRFKKSPLGADLDSLADVISFGMAPAALAFAVGMRGSLDVAALLYFVACGISRLARFNVTSADLSDETGKVKYFEGTPIPTSLALVMVMAAATWAGRIGPDLWGGEWRLGPLVLHPLALMYVASGSAMISKTLRIPK

SEQ ID NO: 19185 - protein, 403 aa, Myxococcus xanthus
  unsure (1)..(403): unsure at all Xaa locations
VLSGSNHLHHPRYVGHQVTAPVPLAALCDAVSSLLNNGMAVYEMGPVSTAMERNVLRWMAARLGLPETTDGVLTSGGSLGNLTALLAARQAKAGYDRVERRRPRRAPPLTVLTAQTTHYSLARATRVMGFGEGGVTPVPVDEHFRLRPEALDAALESATRAGRKPIAVVANAGSTATGAFDPLEPVADFCERHDLWFHVDGAHGASAVLSPAHRHLVRGIDRADSVVWDAHKGLLMPALVTAVLFRDGARSFESFSQEASYIFHGDAERPWSDVALRTLECTKEMMALKVYACLAVLGTRLFSDAVTESYEQAHRFAQRLSAASDFEVAVPPECNILCSRHTPAHVPGEQWDTLHTKLSERLGTRGDFYLVAXQSCTRDVYLRVTLINPLTTDADLDALMDAL

SEQ ID NO: 19186 - protein, 620 aa, Myxococcus xanthus
EKEDTAPETPEQREQRRNRRRLTLVELRAVARNLSHGARDGTLERCFGREALVRELVEALEGREGSALVLVGPPGAGKTALIHEAVSRLTARQDAAGVRRDVWRVDGNQFIAGMMYVGQWEARARGVVKELMEVGDLLYVDDLASLVYAGRTRNERTNVAQFLEPHMARGELTVLAESTPERFERVREEAPTLASLFRVIHVPALDARATLPALLGTVRDLEAEGTDSAVQLSPLALETLLSLQERFVSHEAFPGKAVRLLRRVMARQGVSTSGTRRFSSGDVIDAMREQTGLPDFILGSAQPKKREALTWEMQRQVAGQPEAVEAVVDAILTLQSALQPSDKPLATYLFVGPTGVGKTETAKALARTLFGGEQRLIRFDMSEYMEKHTVSRLVGAPPGYVGYEEGGQLTEAVRRRPYSVVLFDEVEKAHPRVFDALLQFLGEGRLTDAQGTVVNFKNTVIIGTSNLGSHLIQESTARKEPQERMRERVMGVLKGHFPPEFLNRIDETVVFEPLNRAQLRAIVDLMLEKTRRLLHGQGIDLEVTPAALEALVDKGWDPTFGARPLRREIQRAIEAPLAEKLISGDIHENSRVRADFKDGKFRFDEVEAAEAEVAQAEASA

SEQ ID NO: 19187 - protein, 336 aa, Myxococcus xanthus
IAVIPGDGIGIEVTREVMRILQVLDAEMRLGLSLEAFDFGAERFLRTGVGLPPGQMDVFRTEFDAILLGAMGDPRVPDNAHAREILLGLRFGLDLYVNFRPCSPLAERLSPLKGKGPQEIDMTIFRENTEGIYGAIGGSFKRGTLDEVAIAEEIHTRKGVERIIRAAFKWASAHGKRHVALGDKSNAIAAHGLWLRTFREVAAEYPQIEARHYYVDALALQMVTRPESLQVIVTTNLFGDILTDLGAALSGGLGVAPSANLNPDSTPLFEPVHGSAPELTGKGLANPAAMVLSAALMLEHLGQAGAARRLSTAVQQTVAEGQCTRDVGGTLSTTEA

SEQ ID NO: 19188 - protein, 250 aa, Myxococcus xanthus
VEINDETLRDGMQATAVTSPTVEEKRGLLELMQHIGVSAVSLGMPAAGPWALEEVVTLARHIREEALRLEPNCAARTLHSDIVPIVEAVQRAGQPIVVHTFIGSSPLRQCAEAWDLDFILRSSTAAIDFAVRQGLEVAFITEDTTRSTPETLELLFRAAVEHGASRLVLCDTVGHATPAGTRALVRWTRDLVERLGSPVKVEWHGHNDRGLALINALVALEAGATRVHGCGLGIGERTGNAPVELLLLNL

SEQ ID NO: 19189 - protein, 164 aa, Myxococcus xanthus
LNARLRDVPDFPKPGIVFKDITPVLADPRLFGRVIDAMSAPFRGQHVTKVVGVEARGFLLGAPIALALNAGFVPARKPGKLPHRSVVERYSLEYGSDGVEMHEDAILQGERVLVVDDVLATGGTAEATVRLVSRLGGELVGFCFLLSLDFLEGPNRLGRERVTT

SEQ ID NO: 19190 - protein, 575 aa, Myxococcus xanthus
LSRIGSPSDVRALPEEALPLLCQELREDIISICGRVGGHLGASLGAVELIVALHRVFHSPQDALLFDVGHQTYAHKLLTGRRDRMHTLRHAGGIAPFLDPRESPHDALLAGHSCTAVSAALGVLEGRRQQGHRGHVVAVLGDGGLTGGLTFEGLNNAGGSSLPLVVVLNDNQMSISANVGAIPALLRTREARDFFEGLGFTYLGPVDGHDLPALIRALREARASSRPVVVHALTLKGKGFPPAEADTQTRGHAMGPYEWRDGKLVRSRGGQRTFSEAFAAVLEDAMARDPRVVAVTPAMLEGSALNALKARFPDRVHDVGIAEQHAVTFSAGLASAGARPVCCIYSTFLQRAYDQIIHDVCLPGLPVVFAVDRAGLVGADGATHQGTYDVASLRPLPDLHLWSPMVGEDLAPMLDTALAAPHASVIRFPRGTLPPLPEGLGAGEAPLRGARWLLRAEQPRLTLVTLGPLGIAALEAARGEPGWSVLDARCASPLDEAALLEAGRSGHVVVAEEGTTRGGLGSAVLELFAAHGLMARVRLMGMPDAFVPHGDARVQRAEQGLDAEGLRRAGLALLA

SEQ ID NO: 19191 - protein, 287 aa, Myxococcus xanthus
TFQLNSFLAAQQARVEALLNERVARLGPSGTPPQLAEAMRYSLLAGGKRLRPVLCLAFADLVARGSAVSAVAGDAACALEYVHTYSLVHDDLPAMDNDDYRRGRLTNHKVYGEAMAILAGDALLTEAFTLVASGPESMRAALCRELAVASGAAGMVGGQVLDTAEDRPSALDYLIRMHRMKTGALIRAACRMGVLASGGDADALARADTYGDAVGLAFQIADDVLDVTATAAELGKPAGADAAAGRFTFPAVVGLEASRTLADQKVAEAIAAVRPLEGEDGPLAALA

SEQ ID NO: 19192 - protein, 404 aa, Myxococcus xanthus
LPNGLTVVFEEQHAAKVAAFQVWVKAGSADERPDQAGLAHLHEHMLFKGTERRGPGEVARDVESHGGEINAWTSYDQTVYHIVIASQFARMGLDILGDAVRRSAFHAGELSREIEVVCEEIKRSQDTPSRRASRDLFSTAYQVHPYRLPVIGTDESVRSFTREKVLEFYHRHYTPKNLVLSVAGDLREAELREWVDDIFGGDWGRPYEGRVARAPEPVAAGRRILLRPDEVKEAYLHLAFGIPQADHEDVPALDVLAMIAGQGDASRLVREVKRRHNLVNDIHTFAYTPTDPGLFSASMTLQPANAVRALEEAARGLATLRATPVTAEELATAKALVEAEAVYQRETVQGVARKMGFYQSGMGSLEAEARYYEAVRNLTPEHLRAAAERYLRFDRAVVTGLLPE

SEQ ID NO: 19193 - protein, 462 aa, Myxococcus xanthus
  unsure (1)..(462): unsure at all Xaa locations
VREALAAVLAPEQLRVDDAALAAYARDESDSGVHAPDLVVFPADTRQVSEVFKACAVHGVPFTPCGARSGKSGGSLPLHGGVAVSLERMNRILSISPEDLTAVVQPGVITGDLMKAVEAVGLFYPPDPNSWEVCTLGGNVAENAGGPRALKYGVTRDYVIGLEWVLPDGEVVRVGRRTIKGVAGYDLVGLFVGSEGTLGVATEITVQLIPLPREVLTALVVFPSVLHAARAVSAVLAAGILPRCLELIDDVALRAVDGRGFQFPPGAGSAVIVEVDGNGREGLLAELSQLGDICASQGATETLVAQDASQREKLWAARRVISPALRALKPHKISEDIVVPRSKIPEVIERLKAMGAELGLTVATYGHAGDGNLHANILYEGAHQRPLVEEALRRMLVMTVELGGTITGEHGVGHAKREYLSLEQSPALIDLQRRLKAFFDPSGLLNPSKIFPALMRSXFVAD

SEQ ID NO: 19194 - protein, 302 aa, Myxococcus xanthus
TQRRIPVVNLSHYRTGTPQERARFVQVFGDGIKEFGFVTVEGHGIDDGLIRRTYTDVERFFALPEATKAQYAQAGHGGQRGYIGYGQEHAKNRQVGDLKEFWHVGRELPPDHKYHALYGPNVWPTEVSTFREHTLSLFNALDGAAGVMLQALAEYFGVARDTFSGMATDGNSVLRLIHYPPLKERFIPGGVRAAEHEDINLITLLCEGTASGLELLTRDGEWLPVDTLRGQIVVDSGDMLSRVTNEIIPATTHRVVNPRSKEEDTVRYSMPFFVHPYADCVLQALPCTQTADTPARHAPSTV

SEQ ID NO: 19195 - protein, 204 aa, Myxococcus xanthus
PLRIVSLAPRRSGGFIAGTERGLAFYEPRSARLERLLDPEPEHPHNRCNDGKVDPQGRFWVGTMDDHEEAPTGGLYRFDAQGHLARIDEGYTVTNGPAFSPDGRTLYVNDSPRRVTYAFDLSPDGAASRRREFLRFDEPHGFPDGMTADAEGGLWIAFYGGGCVRRFSPDGAWLAEYRLPVAKTTSVAFAGDALDRLFVTTGRD

SEQ ID NO: 19196 - protein, 252 aa, Myxococcus xanthus
NFEAAITPKTKMVWVESPTNPMLKLIDLARIAEVAKKRNILSVADNTFMTPYFQRPLDLGFDVVAHSTTKYINGHSDVVGGFVCTSREDVAEKMYFLQNAVGGVSGAFDSFMVLRGVKTLHVRMDRHASNAMKVAQFLASHPKVKKVTYPGLEAHPQHALAKQQMSGFGGMVTFDIQGGLEAARTFLKTVKVFACAESLGGVESLIEHPAIMTHASIPKETREQLGITDGFIRLSVGIEDARDLVDDLSQAL

SEQ ID NO: 19197 - protein, 352 aa, Myxococcus xanthus
MANMAQAIRMALHYAEEHLGVTDIFGEDVGAPLGGVFTCTQGLKTTWNSPLDERGIIGAAMGIAMAGGRPVAEIQFCDYVYNTIDLLKLAGNTSWSTFGDWNLPMVVRTPVGSGIRGSIYLWHSFDATMTHIAGWKVVMPSTPLDAYGLLITACQEKNPVMFLEPKALLRVKGEERIPGEPEDDRALSKLIDAPLGDRSQWKPQWPTGLEAYAVPFGKGKIVREGTQLTVVSYGRTLPLCTKAAETLAADGISAEVIDLRSLWPYDWELIKASVQKTGRVLFVNEDTEVTNFGEHLVRRTVEELFYSLLAPPRLLAGKFLPGIGLADALEMASVPQLGDITTAIRSLAGEQP

SEQ ID NO: 19198 - protein, 360 aa, Myxococcus xanthus
MRLGVLTGGGDCPGLNALIRGLVKRGTHEFGYEFVGIENGYMGLVEPGLAHPLTEEDTRGILPKGGTILGTSNKANPFSYATREDGHWVERDVSDQVLLRCEELGLDGLIAVGGDGTLSIAHRLVEKGLKVVGCPKTIDNDLSGTDQTFGFDTARLIVTEALDRLHSTAEAHDRVMVVEIMGRHAGFLTLESGIAGGADVILIPEIPYSVESVVEKIRRRSTRRRSFSIIAISEGAFPQGGELAVLDTAEAIPGRGVVRLGGSGKALADLLARHIEAEIRVTVLGHLQRGGSPSAADRVLATRYGCKVLDLVSAGQWDHMVALRAGEIIAVPLSESRKERRVDPAGELVRFTKSMGISFG

SEQ ID NO: 19199 - protein, 145 aa, Myxococcus xanthus
MAIERTLSIIKPDGLEKGVIGKIISRFEEKGLKPVAIRLQHLSQAQAEGFYAVHKARPFFKDLVQFMISGPVVLMVLEGENAVLANRDIMGATNPAQAAEGTIRKDFATSIDKNTVHGSDSLENAKIEIAYFFRETEIHSYPYQK

SEQ ID NO: 19200 - protein, 292 aa, Myxococcus xanthus
MAILVNENTKVLCQGITGSAGSFHAKQMLEYGTKLVAGVTPGKGGTTFEGKVPVFNTVAEAVKETGANTSVVFVPPPFAADSIMEAADAGVALIIVITEGIPVNDMVRAKRYLQGKPGIRLVGPNCPGVITPGALCKIGIMPGHIHKPGRIGVVSRSGTLTYEAVHQLTQLGLGQSTAVGIGGDPVNGTDFVDVLKLFNADPDTDAVIMIGEIGGDAEERGAEYVAREFTKPIAGFIAGQSAPPGKRMGHAGAIISGGKGTATEKIKAMEAAGILMAASPAELGTTLQEALK

SEQ ID NO: 19201 - protein, 385 aa, Myxococcus xanthus
MKIHEYQGKEIFRKYGVPTPKGILAVSANDAEAAAKELGTSVVVVKAQIHAGGRGKGGGVKLAKSPAEAKELAKQMLGMKLKTIQTGPEGQTVHKVYIEEGLAIGQELYLGVTLDRATSRITFMASREGGVEIEEVAEKHPEKILRESVDPAVGFQDFQGRKLAFGLGLTGPTVNKFTQFCSALYRMFMDTDASLVEINPLVILKDGGVVALDAKVTFDENALYRHKDLLEYRDLAEEEPREIQAKEWDLAYIALDGNIGCMVNGAGLAMATMDTIKLVGGSPANFLDVGGGANKEKVTAAFKLILADPAVKAVLVNIFGGIMKCDVIAEGIIAAAKEVQLKVPLVVRLEGTNVEKGKELLSNSGLAITPADNLRQAAEKAVAAV

SEQ ID NO: 19202 - protein, 241 aa, Myxococcus xanthus
KTITFRIWRQDDPAKPGHFDEFKVPYAKGANVISCLMEIQRNPVTVEGKRVAPVIWDAACLEEVCGSCAMNINGRVRMACSALIDKLEQPITLEPMSKFPVVRDLTVNRDRMFDALKRIKGWVPIDGTHNLGPGPRQAPVDQSVMYVLSTCITCGSCLEACPQVTQENDFVGAAAISQARLFNMNPTGKMNSEERVRSLMGPGGIQDCGKAQNCVKVCPKEIPLVTSIAVMNREVTKLTIK

SEQ ID NO: 19203 - protein, 619 aa, Myxococcus xanthus
  unsure (1)..(619): unsure at all Xaa locations
VVGGGLAGLMTTIKLAEAGHQVDVLSLVPVKRSHSVCAQGGINGAVNTKGEGDHPDIHVKDTLRGGDFLAEQVSVKGMCHAAPGIIYLLDRMGVTFNRTPEGLLDFRRFGGTLHHRTAFAGATTGQQLLYALDEQVRRYEAEGKVTKYEYWEWLGTVKDDSGRCIGSVAVDLRTMEIRTFPAEAVCLATGGPGIVFGRSTNSIINTGTAAGRAYMEGAHYANGEFIQVHPTSIPGEDKLRLMSESVRGEGGRVWVPRKKGDTRAPQQIPEAERWYFLEEKYPKYKNLVPRDVATREIFMVCRELGMGINGRDGVYLDVTHIPAPVLDAKIKGVMEIYEKFVGDDPRKVPMVIFPGMHYSMGGLYVNFEADPKTQTPAEGSPKNQSTTIPGLYAAGEADYAFHGANRLGANSLLSCIYSGMIGGPAMVSFAKSQGTSAAAMPEKHFQAARQYWQDRFATMLKMSGTENPYGLAKELGDTMTENCTVVRYNDRLKKTIEKIRELKERWKNVNVLDTGNVANRALSYTNQLWNMFELGEVIATSALLRDESRGAHYKPDFSLPEPKTKDPTQDPEWMSLWRARHEKWAKTTVATYSEAGPKIHYEDIPTPVLDPEPRWYAXD

SEQ ID NO: 19204 - protein, 618 aa, Myxococcus xanthus
IGIDLGTSFSCVAVVQDGQPTVIPNEWGETTHASCVSFLEDGSVLVGNAAKKNIITNPEQTVYSAKRLIGRYYFSDEVKKAQAVMPYRIVEGDNNSVRIAMNEHSYSLPEISALVLKELKAVAETYLGQEVTKAVVTVPAYFNDNQRQATKDAGRIAGMEVLRILNEPTAAALAYGFGRDVNQRVVVYDLGGGTFDVSILEIGKDVFEVLATAGDTYLGGDDFDDRIMTWLADDFLARTRLDVRQNKFCLQMLKEAAEKAKIDVGQTGSAEILCQGICQDADGNVMDLRGQLNQDQFNRMVMDLVQRTFKVCDEALQSARLTAADIDAVILVGGPTRLPIIRNSVKHYFQKEPLEGINPDQVVAMGAALQSHALLDSKTQTFLVDVTPLSLRIGTVGGYTEKIIDKNTPVPIDRSKTFTTSRDGQEKVKIRVYQGESNRADECEMLGEFEFAGFRIGYRGEVKIEVTFEINTDGLVHVSACDTATGQKTSTSITLSSGMSEADIQQSIQANRNIRLAGHNSDDPARRGAVRPRLDHADVRAFRPQRRQTAGSNARDTGHARPAGSPARDGRRPRPRHARDDSVVARRQRADSAASAPGNTSRTSHRRDAPGAAPGHDD

SEQ ID NO: 19205 - protein, 382 aa, Myxococcus xanthus
DPLWYKKALIYELHLRAFHDSNGDGHGDIPGLIEKLPYLQDLGINCLWLLPHYPSPLRDDGYDIADFYGVHPDYGTLADFQRLVDEAHKRDIRVITELVVNHTSDQHPWFQEARSDPNSPKRNWYVWSDTDEQYKGARIIFLDTERSNWTWDPVAKQYFWHRFFSHQPDLNYDNPEVQEAMLDVMRFWLNMGVDGFRCDAVPYLFEREGTNCENLPETHAFLKRLRKTIDSEYKGKMLLAEANQWPADVRVYFGDGDEFHMGFHFPVMPRLYMAVRREDRTPIVEIMQQTPDIPDNCQWAIFLRNHDELTLEMVTDEDRDYMYREYATDPRMRINLGIRRRLAPLMDNGRRRIELMHSLLFTLPGTPVLYYGDEIGMGDNIY

SEQ ID NO: 19206 - protein, 268 aa, Myxococcus xanthus
ASPSVRASRVKIEQACRDSGFFYVTGHGVSGEVLARLERESHRFFALPRVAKEAIAMSMGGVAWRGWFPLGGELTSGRPDRKEGLYLGTELGSEHPRVKAGWPLHGANLWPAEVPELRAAVLDYVAACTRAAHALMEGMALSLGLDADYFRRHYTADPTVLFRIFHYPAEPQHEEVSWGVGEHTDYGLLTLLAQDDNGGLQVKTPRGWVEVPPLPGTLVCNIGDMLDRMTGGWYRSTPHRVKNVSGKDRLSFPLFFDPDFAAEVHPLP

SEQ ID NO: 19207 - protein, 230 aa, Myxococcus xanthus
ASALLAEAAEVKDAPAQDLLAWTERRFGARAAIASSFGVEDMVLIDLARQHAPSLRLFTLDTGRLPPETYELMEVVRKRYGVTVETYFPERARVEALESTNGYFSFRQSLEARKACCAIRKVEPLSRALAGQQAWVTGLRREQSVTRTDVATLEVDSAHGLLKLNPLATWSSRDIWAYVRAKSVPYNALHDRGYPSIGCAPCTRAVKPYEDERAGRWWWESAENRECGLH

SEQ ID NO: 19208 - protein, 364 aa, Myxococcus xanthus
  unsure (1)..(364): unsure at all Xaa locations
CYCSSDKDCSTGESCRSGVCRTVPPGSGACSSSLDCPGSQICINSVCSQFCSRDSDCGSGQRCDKNYCVGNGGTRPDAGSDGGTRPDSGTDGGTRPDAGSDGGTRPDAGVDGGAPQQCRVNMDCGAGNYCINNQCIRGCYDDSWCDAKDTCVSGLCRPRPVDPNTCSTAADCSGGKDCVDGQCRAACDSTTQCPDDYSCQIGYCMPIPDGGQCRANCECPAGQVCFNGKCKSPQPDPGQTCVANCDCPSGDVCTNGYCRPPAPPPDAGTGTACQANCDCPSGEVCSNGQCKVPPPPPVQDAGTSTPVCRANCECPSGQVCTDGVCKPVNTGSGNSCHATCECPAGERCIDNVCWLXSGRTPASG

SEQ ID NO: 19209 - protein, 418 aa, Myxococcus xanthus
ATTSALTLPTLHESTTSSGLKVIAAERGPLPMVSVRLVIRAGSATDPDGKHGLADFTARLLRRGTRLLNAQAIDEAVEFVGASLGVGVSEDTLSVALTTPSEHFVQMLDILGQLVREPTFPQSEVDDARERELAQFANDLDDPSIIADRAMVRALWGNHPYGHDVGGSSKSVKTFTRDDVVRFHQERMGPKVSMLIVVGAVDPQRVAAAAEDAFADWTGGPDAPVAIPAPERIALGGRVIIVDKPDQTQSQVRLGGPGMRMGHEDYFPATAMNIALGGGFTSRLMNEIRVNRGLTYGVSSWFDSMNAAGVFALSTFTKTESTREIIDVALAEIGGVREKGLKPRELADAQAYLAGLYPLRTETNESIAGSIAEARLHGLGDDWVERFRDRLRAVTPKQVVAAAKKYCFAQAPAVVVLG

SEQ ID NO: 19210 - protein, 392 aa, Myxococcus xanthus
LIVQKYGGTSVGDVARIKSVALRCLAAQEAGHDVVVVVSAMSGETNRLMKLVAQITDRPDEREQDVVVATGEQVSIGLLAMAIHAQQGKATSFLGQQVRIVTDSTFAKARIKSIDAQPIRAALARGHIVVVAGFQGVDESGSVTTLGRGGSDTTAVALAAALNADACEIYTDVDGVYTSDPNMVPSARKLDRITYEEMLELASVGAKVLQIRSVEFAMKYKVPLWVKSSFTDDPGTLVCEEDSSMEDVLVRGVAYDRNEAKITVCGVPDVAGAAAKIFGPLDEKHIVVDLIVQNPSKDGRTDVTFTVGKADFLTAQEVVRKVAEEIGASGIETDGDIAKVSIVGVGMRNHSGVAARMFRALSAEGINIQMISTSEIKVSCVVQAKYTELAVR

SEQ ID NO: 19211 - protein, 501 aa, Myxococcus xanthus
ILIDGDTLKLEEILQVARNEATVELSPDAATRVRASRALVDRVAAGDTPAYGINTGFGTLAEVRIDKKDLRDLQRNLILSHACGVGTPLPLPEARALLLLRCNVLAKGYSGIRMETLALALDMLNRDVVPVVPERGSVGASGDLAPLAHLALVFIGEGEAFYQGQRMPAKQALERAGLQPVVLEAKEGLALVNGTQAMCAVGTLLQLRAESLADIADVAGAMTLEGLLGSHKPFIPEIHDVRAHPGQKDVAAHLRRILVDSELVESHVNCSKVQDPYSLRCMPQVHGAAREGIAFSRRILEVEVNSATDNPLVFADTERIVSGGNFHGQPISLAMDVVAMALTQLSSISERRVEQLVNPSLSNLPAFLAKNSGLNSGFMIAQVTSAALVAESRVLSHPASVDSIPSSAGREDHVSMGMTAALKGRQVSDFARSCLAIEILVAAQALDFRLPLKPGKGALAAYELVRSKVPHMDKDRELHRDIEAVSQLVDSGELLAAVRSA

SEQ ID NO: 19212 - protein, 257 aa, Myxococcus xanthus
AVFRSRALESLLGWVGFSPFLVTPGNWRAWHVQAHHSAANVLVRDPDILPRQSEWRTQWFAKVFHAMSPGSGSLLSFVSFSFFFTAQGQAFLWHHSRLPQFKHVHMHRTRERVLTVLVMVGWGAVGWWMGPMGALYALILPLLIGNITLMIYIATNHWLLAAHEESDNPFVNTASVATHPVMDWLHYNFSHHQEHHIFPAMSPKFAPLLRKHLRDLNPEASQVYPHLHALRMLYRRPALYAEDGQTLMAPEGTPAIA

SEQ ID NO: 19213 - protein, 247 aa, Myxococcus xanthus
DSLPMKKVLVLGATSAIAQATVRLLAARGASLYLTGRNAANLDAVTKDAATRGAAKVASQVVDLNDFDTHEALVEAAYTALDGLDGVVLAHGVLGDQAEAQRSWAATEAVLRTNFLSAVSLLTVLANRFEAQKAGTLVVISSVAGDRGRQSNYVYGASKGALNVFLQGLRNRLAKSNVAVVTVKPGFVDTPMTAHLPKNKLFASPEKVARGLLSAADSRKNEVYVPGIWALIMLIIRTIPETVFKRM

SEQ ID NO: 19214 - protein, 814 aa, Myxococcus xanthus
DDSGLGHDAASLRRSFLDHVRYSRGKNYESSTPHDRFMALSLAVRDRLADRWVKTSRTYYEKDVKRAYYLSAEYLLGRALGNNLLNLGMYEAASESMQEVGVDLTNLLEMEPDAGLGNGGLGRLAACFMESLATLAYPGMGYGIRYEFGIFTQDIVDGYQVERADEWLKFGNPWEIVRPEKAVPVRFFGRVEHHQGPDGRPVARWVGGKTVVGVPYDTPIAGYHNNTVNTLRLWQARASEEFDLLLFNAGDYERSVVEKNDSEVISKVLYPNDAFQAGKELRLKQQYFFVACSIADIVRRYLKNHTDFKDFSRKAAIQLNDTHPAIGVAELMRVLVDEKRLLWDEAWTITQETFGYTNHTLLAEAMEKWPATLFERLLPRHLEIIYEINSRFLRQVQIRYPYDQEKMQRMSLVEEGAEKKIRMAHLAVVGSHSVNGVAALHTDLLRRDVLTDFASMNPERFNNKTNGVTPRRWLAWCNPRLSKLITSRIGEGWVTDLDKLTKLEAHAENPKFQQGFREVKRANKEDLARHIRDLRWVQLNPDAIFDVQIKRLHEYKRQLLNALHIVALWMKARRDPSTIIHPRAFIFGAKAAPGYHLAKLTIRLINGIAEVVNSDAGTTGLQVVFAPNYRVSLAERIIPAADVSEQISTAGMEASGTGNMKLMLNGALTLGTLDGANVEIRDAVGDENFFLFGLTADEVIARKREGYRPRDEYNQHQELREALDLISTGFFSPEDKHLFKPLVDSLLEEDRYLMLADFPSYMAKQEDVAHAYKDEDGWARKCIINVARGGIFSSDRTIKQYAEEIWRIQQTPVD

SEQ ID NO: 19215 - protein, 362 aa, Myxococcus xanthus
MRPLVPTHVETLKPYVPGKPIEETEREFGLKGVIKLASNENPLGPSPRAVEAMRNVSGATHLYPDATSFHLVRKLAAHVDVKPEQVVLGSGSNELIELLIRTFTTPEDEILLCQGSFSAYRISAQAHGRPFVEMPMREGFLYDLEAMAKAITPRTRMVFLANPDNPTGTAFSRDALTRFLAAVPPEVLVVHDEAYCEFVEWPEYTSAVPLVGQHPNLVALRTFSKIHGLAGVRLGYGIMNARLAAYLHRTRMPFNLTVLAQAAGLAALEDTEHVRRTREVNRAGLDYFAAELPMLGGTLTHSHANFVFVDFGRPAVALYEQLLRKGIIVRPFAGQGFPNHVRISVGTPAENARCVQVLKEIL

SEQ ID NO: 19216 - protein, 218 aa, Myxococcus xanthus
MVENVIFDVDGTLVDSVDEHAEAWRRAFLHFGRDIPFAHVRSQIGKGADQLIPVFFNDEEVERFGKELDEYRGKLFLDEFLPKGASLPPVRELFQRLRAGGIRIVLASSAKEQELKHYVKLCGIEGLFETKTSADEVDKSKPHPDIFEAALARLGKPSPDVTVVVGDTPYDALAANKSSLPSVGVLAGGFPPDDLRAAGCRTLVKDPAALLARLRGVP

SEQ ID NO: 19217 - protein, 817 aa, Myxococcus xanthus
MFFGRDDKKEAQKRGLTVPLLPLRDIIVFPHMVVPLFVGREKSIAALKDAMAHKGPDDKAVILLAAQKKAKTNDPTPDDIFHFGTLGHVIQLLPLPDGTVKVLVEGVRRAKVKKFHPNDAFFMVEVEEVEEQTEKTVELEALVRSVHSVFEAFVKLNKRIPPEMLMQVASIDDPARLADTIVAHLSLKLNDKQALLETESPAKRLEKLYELMQGEIEILQVEKKIRTRVKKQMEKTQKEYYLNEQMQAIQKELGERDEFKNEIQEIEEKLKNKRMSKEATLKVKKELKKLRMMSPMSAEATVVRNYIDWIISLPWYDETQDRLDVTEAETVLNEDHYGLKKPKERILEYLAVQQLVKKLKGPVLCFVGPPGVGKTSLARSIARATGRKFVRLSLGGVRDEAEIRGHRRTYIGAMPGKLIQSLKKAGSNNPVFLLDEIDKMSTDFRGDPSAALLEVLDPEQNHTFNDHYLDLDYDLSKVMFICTANTMHNIPGPLQDRMEVIRIAGYTEPEKLSIARRYLIPKEQEANGLSDLKVDISDPALRTIIHRYTRESGVRSLEREIGGVFRKIARDVLKNGKRDIDVDRKMAMKFLGTPRYRYGMAEAEDQVGIVTGLAWTELGGEILTTEATIMPGKGKLIITGKLGEVMQESAQAAMSYVRSRAERFGIDRKVFENYDMHVHLPEGAIPKDGPSAGVTICTALVSALTRVLIRRDVAMTGEITLRGRVLPIGGLKEKTLAAHRAGIKTVLIPKANKKDLKDIPLKIRKQLRIVPVEFVDDVLREALVLEKPEEFGRKPTTDGGKLGGTTELPASPAVAPA

SEQ ID NO: 19218 - protein, 337 aa, Myxococcus xanthus
TYRIVSLLGRGGMGSVYLAQHLRLPGKQVAVKVLRGGDHLTPEIFARFRREAEIASRLGHPNIVEVLDYDTLENGNPFLVLEYLRGESLQERLARGRLPMEDVVSFTRQMGSALQAAHGAGVIHRDLKPANVFLVPTDSGGVVGERVKLLDFGISKVLSSTTVQTQEATIIGTPQYMSPEQAQGKNRDIDARTDVFALGCIVYEMMAGKPVFGSGSLAQMIFRVVYEPPEPLAPLCPEATPEAISAVMRALAKGVDERYPDVSSFHRGLDGHAAALAVHHGGQSARPAPPGPGVRNRAALHGPGLTLRHRPARKPEGGTGHGPRGLRFHDGARHRPA

SEQ ID NO: 19219 - protein, 636 aa, Myxococcus xanthus
  unsure (1)..(636): unsure at all Xaa locations
MCGIVGAVSQRNIVPILVQGLQRLEYRGYDSCGVAVHEASMGNNPMGGLHRARSTARVAELQAQVDAEHLQGATGIAHTRWATHGAPAVHNAHPHFSHGPNAAPAETDRAGRVALVHNGIIENHQELRRMLQARGYAFSSQTDTEVIAHLVDSLYDGDLFDAVKAAVAQLHGAYAIAVMHKDEPHRVVGARAGSPLVLGVGVGENFLASDAMALAGVTDQVVYLKEGDLVDLQPGRYWLVDHDGQRLSEAQRPVRTVHAHSGAAELGPYRHYMQKEIFEQPRAIADTLEGVQGIVPELFDGLDADGNTRTAAWRVFKEIDSVLILAXGTSXYSAXASKNWMESITKLTVQREVTTEYRYRTSVPNPKTLVVTISQSGETADTLAALRHAQRLGMTHTLTVCNVATSAMVRECELAYITRAGVEIGVASTKAFTTQLAGLFLLTLALAQSKGHLSQEQEAQYLTSMRHLPVALQAVLALEPQVISWAEDFAKMENALFLGRGIHYPIALEGALKLKEISYIHAEAYPAGELKHGPLALVTSSMPVVTVAPHDELLEKLKNNMQEVRARGGVLYVLADGDSQIESEDGIHVIRMPEHYGALSPILHVVPLQLLAYHTAVARGTDVDKPRNLAKSLTVE

SEQ ID NO: 19220 - protein, 302 aa, Myxococcus xanthus
LLQLEGLTRRFKGRTAVDGLSLSVRPGEILGLLGPNGAGKSTTFQVLAGLLSPDAGLVRFEGRELSLSDPSLRRQMGIIFQRSSLDDLLTARENLMLGARLYGLGGERARERVEAMLSLIGLADRGDERVSTWSGGMRRRLELARALVHQPRVLLMDEPTQGLDEAAFRTFWAHLKRLRDSEGLTVLLTTHRADEADVCDRLAVLDAGKLVACDTPQALASRMGGDILSVEALEPEALATELRERLKLDAKVVEGRVQVEAPRGHALVPRLVEAFPAGRLTSVALRRPTLADVFLQLTGRAL

SEQ ID NO: 19221 - protein, 446 aa, Myxococcus xanthus
NPFTGDVAASVEPTSPVKLDTVLERARAASRALRALSVAERVKLVLRACEAMEKNADAIARDITRQMGKPLSQARGEVGGMAGRLRHMAAIAEESLADIVLPPKDGFERRIAKEPLGVVLDLPAWNYPLLTAVNAIAPAVLAGNAVIVKHSPRTPLCGGHFARAFAETGAPDGAVQAIFLDYPGTEQLVGDARVDHVLFTGSVLGGHKMQTAARERFLHMGLELGGNDPAYVAPDCDFDKSVENIVDGAMYNAGQSCCAVERVYVHRSLYERFVAAAEPLVRAYVLGDPESEQTTMGPIAQPWHPAELQSFVQDATNLGARLVTGGRAAQVGGRGRFFEPTLLRDVSPQARLMREESFGPLLPIAPVDSDEEALALMNASRLGLTASVWTSDRERADRLARQLEAGTVYMNRCDALDPALPWSGVKDSGRGVTLSALGFDALTRPK

SEQ ID NO: 19222 - protein, 194 aa, Myxococcus xanthus
SSSRGILFDLDGTLVDSLPDIIDSFLHAFGHLGLPAPTYEQVRALIGHPLDWMYSQFAPDHVPALCVAYREHYPLNFHRRSRPYPGVVEVLRALRERGYLLAVATTKRPDMARKFVDAMGLGPLLHHVQGTDGFPHKPAPDVIHHALAALGTGGLWMVGDTALDLRAGQAAGLRTYAVTWGTHPVDVLAGASPD

SEQ ID NO: 19223 - protein, 253 aa, Myxococcus xanthus
KNQVVVVTGASSGIGRATALALANKGAHVVLAARREEPLEDLARECRGLGVQAHVVPTDVSDVAAVQHLADEARNVFGHFDAWINNAGVYLMGRLEETPDDAFRQVMETNFFGTVSGARAAVAQFRRQGYGTLVNVSSTFGAVAAPYVSAYVASKHAVRGFSASVRQELLGTGIDVCTVLPAAIDTPLWQHTANYTGWRIRPVEPVYTPERVARAILRVLRSPKHEVFVGPAARSFAAMHGLLPRTFERTMNG

SEQ ID NO: 19224 - protein, 286 aa, Myxococcus xanthus
SAFGAGKVILLGEHSVVYGHPALAGPLSQGVTARAVPAKACQLALPSTLSRPQRAQLTAAFARAAEVTGAPPVKVSLEADLPLAVGLGSSAALSVACARLLLQAAGKVPTPKDAARVAWAMEQEFHGTPSGVDHTTSAAEQLVLYWRKPGAAKGTGQVVESPRPLHVVVTLAGERSPTKKTVGALRERQARWPSRYERLFAEIGRVSSEGAKAVAAGDLEALGDAMNVNQGLLAALGLSSPPLEEMVYRLRELGALGAKLTGAGGDGGAVIGLFLEPKPVVTKLTR

SEQ ID NO: 19225 - protein, 349 aa, Myxococcus xanthus
  unsure (1)..(349): unsure at all Xaa locations
KATALAHPNIALVKYWGKRDDALILPHQSSLSLTLSPLSVTTTVEFGAASDQVELNGHTAKGSERDRVLRLLELVRAQAKADLGPAKVVSRGDFPMAAGLASSAAGFAALAVAGRAAAGLPSEPRAASILARMGSGSACRSVQGGFCEWQRGERPDGEDSFAVQRFDAAHWPDVRMVVAILDRGEKEVKSRDGMKLTVDTSPYYPAWVKDAEVEVVQVREHIARRDLQALGELCERNAWRMHATSFAANPPLSYMSPGTLALILHLKEQRKKGIPVWFTLDAGPNPVLLTDAAHEVAAEALARACGALDVIRCVPGGDAELKAEHLFXWSAPSPRRGSCSSPGSTPCCG

SEQ ID NO: 19226 - protein, 100 aa, Myxococcus xanthus
  unsure (1)..(100): unsure at all Xaa locations
QELSEKARQLVAEGAVLLDVRTPQEFQEGHPEPARNIPVQELPRRLAEVGPPGTPVVVYCAAGGRSAQAVQLLRANGFPDVFDLKSVKNWXPTGGRXHGR

SEQ ID NO: 19227 - protein, 730 aa, Myxococcus xanthus
  unsure (1)..(730): unsure at all Xaa locations
LRSTNEELQEKAKLLSVQKTEVERKNGEVEQAKLALEEKAEQLSLTSKYKSEFLANMSHELRTPLNSLLILSQTLSDNVDGNLTSRQVEFAKTIHASGADLLELINDILDLSKIESGTMAVDVGPLRFGDLREFVDRTFRQVADKKGLEFHIGLGDSLPGELETDAKRLQQVLKNLLSNAFKFTESGSVSLHIGLAKGGWSPDHAMLSSAPSVVAFTVADTGIGIPKDKHQIIFEAFQQADGSTARKYGGTGLGLSISREIARLLGGEIRLESDVGRGSAFTLYLPLAFMAERPPEEHARWDYQPAGHHGAPRAHRGASLRVAGVFAEPDGHRRXPELHPAWRQGAAGRDAPGGPCRAPACRGAGHGLQAAGVYRGGGRAGRRPQHAASGRGGGPGPAGDGGLGGAGPAEARRVHSRAAGVHGVGGGPPRALAQPGRHWPPARGGGPGGGGGRAGVPQALRGAQGPRAARGGGRPRPPPDADGAPGQXXRADGGGGDRGGGPGRAGRAPLRLHGAGPGAAGHARHGAHPPRPXGARRGRPPLIVYTGRELTRAQETELRRVAEAIVVKDAQSPERLLEETSLFLHRSPSDLTEPKRRMLEKAREKDPLLVNRKVLVVDDDVRNIFALNTVLERYGMKVAFAESAREGLDQLEKDADIELVLMDVMMPEMDGYQAMRAIRRMERFVHLPILALTAKAMKGDREKCLEAGASDYITKPVDIEKLLSLLRVWL

SEQ ID NO: 19228 - protein, 379 aa, Myxococcus xanthus
MDFDLPESHRALQSSIRDFCERRVKPYAREWDKDETFPMEVVRELGQLGVMGMLVAEEFGGAAMDSLAVAVAVEEIARYDGSLALTVASHNGLGTSHLRVFGSDAQRQKYLPKLATGEYLGAWGLTEPGSGSDASSMKTTAMRKGDGWVLNGAKMFITQGTVGDVFVVLAVTSPQKRQKGITAFLLEKGLPGFSQRAIHGKLGMRSSDTAELVLENVEVPDSARVGELDHGFIDTMKILDRGRITIGALAVGLGRGALEESIGYSRERTAFGQPISEFQGLRWMMADMKTELDAARLLVHRAAKLADEGKPYSREASMGKLFASEAAMRACNKAVQIHGGYGYTREFPVERYLRDAKLCEIGEGTSEIQRTIIARETFK

SEQ ID NO: 19229 - protein, 471 aa, Myxococcus xanthus
MHHMPRTTGMNVAVVGGGISGLAVAHHLRSRGTDAVLLESSARLGGAVGTHALAGYLVEQGPNSFLDREPATRALAAALNLEGRIRAADPAAKRRYVYTRGRLRSVPASPPAFLASDILPLGARLRVAGELFSRRAPEGVDESLAAFGRRHLGHRATQVLLDAVQTGIYAGDVEQLSVAATFPMLVKMEREHRSLILGAIRAQKAQRQAALPAGTAPKLSGALSTFDGGLQVLIDALAASLGDAAHVGARVEGLAREDGGWRLIIEEHGRRAELSVAQVVLAAPAHATAKLLRPLDDALAALVAGIAYAPIAVVHLGFDAGTLPAPDGFGFLVPAEEQRRMLGAIHASTTFPFRAEGGRVLYSCMVGGARQPGLVEQDEDALAALAREELKALAGVTARPSFTRVFRWPLGIPQYNLGHLERVAAIDAALQRLPGLHLIGNAYKGVGLNDCIRNAAQLADALVAGNTSHAP

SEQ ID NO: 19230 - protein, 274 aa, Myxococcus xanthus
TARLDGGKVLRWSLLHVGALVGGTCFFSWSAVAVFAGMTAVTMCLGVSVGLHRGLIHRAFRASAPVERALALLGTLAGLGGPIAMSRMHDLRDFHQNQPEADCPPYFGYREGFTRAMAYALFHTWHPRSGAADVPAAPHVTQDVFFRGLERAGLWLQVPLALALYALGGAPWVAWGILVRLALTQDGFWCVHYVSHVEGEQPYELPGCAEQGRNAGWLALLSMGESWHNTHHVYPASAQMGLGWRQPDPGWWAVRGLAALRLVHDVKSLAHLPP

SEQ ID NO: 19231 - protein, 390 aa, Myxococcus xanthus
DVVIVGAARTPIGAFQGALAKLTAPQLGAIAIKAALERAGVKPEAVQEVILGCVLTAGVGQAPARQAAIFAGLPETVPATTLNKVCGSGLKAVSAGAQAIALGDADVVVVGGMESMSNAPYISHTMRGGARMGNVEFKDAMIHDGLWDVYGNVHMGICAEECATTQDISRSQQDEYALESTRRAIQAQKEGLFKAEIVPVQIPGKKPEDVVTVSDDEGPRNAKPEKIPGLKPVFKKDGTVTAANASSINDGAAALVLMSEERAKAEGRAILGRITGYAQAARKPVEFTIAPTDAINKLLKKQGISAGDVDLWEINEAFAVVSIANNRLLGLDVSKVNVRGGAVALGHPIGASGARVLVTLLQTMQDLDKKRGVASLCIGGGEGIALMVER

SEQ ID NO: 19232 - protein, 273 aa, Myxococcus xanthus
MDGKVCLITGATGGIGLEAAKALARMGATVVLVGRDAGRTEAAVAAVKEAAPSAQVDWLRADLASLKSVRELAQTFRSRYPRLDVLLNNAGLIIDRRQVTEDGLEATMATNHFAPFLLTNLLLDVMKATGPARIINVSSDAHAAGKLDFDDLQSERGFIGFRVYGTSKLANILFTRALAKRLEGTQVTTNALHPGVVRTGFGHNTQGFFRHLVKLGAAFMISAEKGARTSVYLASSPEVEAVSGQYFYKCRPKKPSSAARNDALAERLWQVSE

SEQ ID NO: 19233 - protein, 204 aa, Myxococcus xanthus
MIDLYTFATPNGQKVSIALEELGLQYKTHVVDITKGEQFKPEFLDINPNNKIPAIVDHATQDHRPLKVFESGAILIYLAEKTGQLLPSNQRGRAEVMEWLMFQMGGVGPMFGQLYHFARFAPKKVPYGIERYHAESRRLVGVLDGKLGSGDYVAGRYSIADIALYPWVAGARASFPELFRGNSNVVQWLHRVGSRPAVERGMKV

SEQ ID NO: 19234 - protein, 884 aa, Myxococcus xanthus
TVDQPLRRDVRLLGRLLGEVLVEQEGQALFDLEEEVRRLAIQRRRGPVAGRRAVAAELAEVLQRLPLERAEPVLRAFSVYFQLVNLAEQHHRIRRARTHAEVASAKPQRGSLEATLQVLKEAGIPAERVREAMRTMRVTLTLTAHPTQAVRRTLLEKLYRMAGLLEERDRCELTPRESSVNLALLREEITLLWQTDELRRERPTVGDEVKNVLWYVEEVLADELSLLPELLDWAFERAYGEPLGPVDTPVRIHSWVGGDMDGNPLVTPDVFADTLRAHRARGLRRLLLDLERLGGRLSQSARHAKPSEELLSSVAKDAEELPDTERRYGPRTPGEPLRHKLRFMEERLHRALHYVTQQRAGTSVPMPQGAYRTPEALLADLDVLGRALEASKGTHAGLRDVRQVRERVLALGLSLAELEVRAPAEDAVSAAGSFNGGPAPTEGGARLLEVLARLKEAQSESGESACRTLILSMASTAEDVLAAFRCLKHAGLWDEKRGCATANVVPLFEQLGALDSGPDVLRTLFADAEYRKHLDVRGGQEVMVGYSDSGKEVGLLAASAALYRAQVALTEVSREAGVPLRLFHGRGESVARGGGPAQEAILALPPGAVAGGYKATEQGEALDHKYARPELARRTVELILGGVLLHTLDAQPRPEPEAERTFRTVFDTLAETGRKAYRALVWEDPRFLEFFTAATPVEEIASLPIGSRPSKRRAGGLDTLRAIPWVFAWTQNRAILPGWYGVGSALEAFSKEEGGAAQLKRMYQEWPFFRAVIDNVTMVLAKSDMAIAGRYASLAPPATRSLWRRIQQEHRRTRRQVKRLTGESKLLDNNPQLQRSISLRNPYVDPMSFLQVELLKRKREGQAEVDRPLLLTLNGIAAGMRNTG

SEQ ID NO: 19235 - protein, 217 aa, Myxococcus xanthus
IEVQHLTKRYRDRVAVDDLTFQVEAGEILGFLGPNGAGKSTTMKILTGFLPPSEGVVRVGGYDVEAQPLEVKRRIGYLPEMPPLYVEMTVRGYLRFVASLKGLSGSALKAELERVAALMGVTHVMDRVIQNLSKGYKQRVGIAQALLGSPPVLILDEPTEGLDPAQRAELRALIKGLAGKHTVILSTHILPEVTMTCQKVLIIHQGKMAAYDDISQL

SEQ ID NO: 19236 - protein, 883 aa, Myxococcus xanthus
IASLTPMMRQYMEVKALHPDSLLFFRLGDFYEMFFEDAVKASEILQITLTARSKGADKVPMCGVPYHAARRYIGRLVSEGLKVAICEQVEEPGNGPGIVRREVTRVITPGMVLDEEVLEPQASNFLAAVSWNDKGWGAALLEASTGEFMALEAPGIAELAESLSRVEPRELLVPDGKRDAPEVAQLLARLVRTPAVAEGEAASFEPTRAAGYLRSHFAVQSLSAFGLDDAPLAAGAAGAALRYLKDTQKTAAAHVDRLSRQERGGNLLMDESSRANLEVLRSLRDGGRKGSLLGVLDKTVTSLGARKLARWLASPLGSLPEIHARLDAVEELSGRSVWREELAGILKEVGDLERLCGRLSLGAGNARDLRALGLSLAQLPRVVAVLARCESPLLKSLTGPLSALPELAELLSRAVAEEPPVTLKDGGMIRAGFHAELDKLVALSTSGKDLLLQIEQREKERTGISSLKVRYNKVFGYYLEVTKSNLDRVPKDYIRKQTTVNSERFVTPELKEYEEQVLTAEERRCALEIQLFEELRAQVVSAAPRIRSAAEAVATGDALLSFARCAAEYGYTRPEVDASVALSITAGRHPVVERMLGAGDSFVPNDVRLDPAEDAQLMVITGPNMAGKSTVMRQVALTALMAQAGSFVPAKAARIGLCDRIFTRVGAADNLARGQSTFMVEMTETSHILHHATNKSLIILDEIGRGTSTFDGLSIAWAVAEHLHDTVGARALFATHYHELVDLARERPRVKNLCVAVKEQNGKVIFLRKLVPGGASRSYGIEVAKLAGLPPEVVGRARELLQNLESGELDDAGRPRVAVRQPQGGRRGASTGQLGLFGMEPAQGGTGVTPAQQKALDALKGASIDRMTPLDALNLLAKLQREL

SEQ ID NO: 19237 - protein, 285 aa, Myxococcus xanthus
LWTGVLPAITTPFNTDLSVDHGTVRSHVRWLVSQGCTGIIPCGSLGEGATLSQEEKAAVMRTCVDAVKVPVIPGIAALSTAEAVQLARAAEEAGCAGLMVLPPYVYSSDWREMKAHISAVLRATKLPCLLYNNPVAYKTDFTPAHLAELAAEHDNAVAVKESSTDARRVTAIRALLGDRLAVGVGVDDCLVEGVDAGARFWVAGLVNAFPAESVRLFELALAGKKQAAFELYRWFLPLLRLDTVTKFIQLIKLVQQEVGWGHERVRGPRLELAGAEREECLRVLR

SEQ ID NO: 19238 - protein, 336 aa, Myxococcus xanthus
MATRIAINGFGRIGRCILRAVLSRKEDLEIVAINDLDKPAALAHLFKYDSVHRTWPGEVKATEKGIVVDGKEITVTAEKDPTALPWKSLNVDVVLECTGRFTARDAAEKHLKAGAKKVIISAPAKGPDITIAYGINHNEYDPAKHHVISNASCTTNCLAPIAKVLVDNFGIEKGLMTTVHSYTNDQRILDLTHEDMRRARAAALSMIPTSTGAAKAIGEVIPQLKGKMHGLAVRVPTPNVSLVDLTVNTEKKVTAEAVIEAFRKAAEGPLKGVLEFSDAQTVSVDYNGNPHSAIFDSTNCFVMGDNLLKVMAWYDNEWGFSNRMVDTAKFLVSKGV

SEQ ID NO: 19239 - protein, 649 aa, Myxococcus xanthus
  unsure (1)..(649): unsure at all Xaa locations
IDDLQLTGKRVFIRVDFNVPMEGRRVTDDTRIREAMPTIRRALEMGGKVILASHLGRPKGPDPKLSLEPVAVRLAELLGGKHEVILTDDCVGDGVKKQVKELKDGQVVVLENLRFHKEEEANDETFARELAALADVYVNDAFGTAHRAHASTAGMVPFVKEKAAGFLMRKEIEYLGKVLKNPDKPFVAILGGSKVSDKIKVIESLLPKVDALLVGGAMAYTFLKAQGVEVGKSRVEGDKLSLATRLLEAAHRFKTQLVLPVDHIVGTEPTENSPATETPDNAIPPDMMGLDIGPKTRAIFAQHIRDARTVVWNGPMGLFEVPKFAEGTRSVAAAMAINTQATTVIGGGDSAAAVEQMGFADKMSHVSTGGGASLEFLEGRDLPGIKALETRXAPRPTHHTPLGDTMATARRRKIVAGNWKMNKSVPEALALVRDLRGQVASLGDTVEVVVAPPFVALQPLHVALEGAPLALAAQNCHWESSGAFTGEISAPMLAELGCAYVIVGHSERRQLFGDTDEQVNKRAKAVRAAGMTPIICVGETLAEREANQTLAVVERQVRGALEGFGAKEVAGFVLAYEPVWAIGTGRNATAAQAQEVHAAIRGLVERLYDGETAGRVRIQYGGSVKPDNAAELLGQPDVDGALVGGASLK

SEQ ID NO: 19240 - protein, 274 aa, Myxococcus xanthus
VIASAVRTPFTRAHKGEFKDTRPDTLAAVAIKEAVAQVPGLKPEDIGDVVLGCAMPEAEQGMNVARVATLLAGLPVTVPAMTINRFCSSGSQAIAQVAQAIQAGMYDVGIGGGTESMTMVPMGGNKASANPEAMERLPEIYTSMGATAENIASRYGVSREDSDKFAAESQRRAATAREQGKFKEEIVPVTTTYYDDDGVAQNVTVTVDTILRPETTQEGLAKLRPAFNPKGVVTAGNASPLTDGAAAAVVMSEAKAKELGVKPLGYFIDAAVAG

SEQ ID NO: 19241 - protein, 573 aa, Myxococcus xanthus
PWLASTRTRTTTARSLRTETLDWRARVDFKTQRLHAEVTHTLKEASAGPLDLDTRDLEIRDVIDAAGRPLPYILSPSEPILGSRLRIELPVGLRQFTVRYRTAPHASALQWLTPSQTAGGKHPFLYSQCQAIHARSVVPLQDTPRIRIRYTASLRIPKALKAVMAASFLRREEHGVEAEEHYEMPQPVPPYLLAFAVGSLAPKELGPRSRVWAEPELLEDAAEEFSGVDDMLRAAESLFGPYDWERFDLLTMPPSFPYGGMENPRLTFLTPTLITGDKSLVNVVAHELAHSWTGNLVTNASAEHFWLNEGFTVFAERRILEVLEGPEVSALHGALGRRALDSALQHFRAHPQLTSLRTHLAGVDPDEAFSQIPYEKGYLLLRAMEDAAGRPAFDEFLRRYLATYRFRALTTEEFVAFAEKELPGVLTKVDAEAYLHRPGVPPGAPSPRSLRLEAMDALRGKVPTPEQAKDWTPAEWQLYLESLPWDIPRDVIQQLDARFSLTESRNSEVLVAWLVVALRADWEPAVARTETFLGEVGRMKYLKPLYGVLSASHAHRSLARALFKKHGERYHPI

SEQ ID NO: 19242 - protein, 501 aa, Myxococcus xanthus
WSNLERRIRALVPEAFDPTGRVLNLIAGEWGHPGKGKPYLSPVDGTVLGRLPMIDANTARVAASAAAAEARTWAHQDLDARKERVTQCLSLLREQRELLALILAWEIGKPVPQARVSVDRCISGVEWYVSQIEPMVEGRRPLGLISNIASWNYPLSVLVHAVLVQVLAGNSAIAKTPTDGGLYSLTLCMGLARRCGLPVSLISGSGGQLSDALVRNPEIACLSFVGGKANGRDIAASLYDRNKRYMLEMEGVNAYGIWHFSDWDGLAKQLKKGFEYGKQRCTAYPRFVVERSLMPRFLETYLPVVSALKVGHPLLAESPDGEPPALDFGPLINSQKVEELHGHMSEAEGRGAVPLFAGRLDAERFLPDQDVSAYLAPHALLHVPRNCKLYHGEPFGPVDTLVVVDSEEELIAEMNVSNGSLVASIACDEPDTCKRVSTELRAFKVGHNGPRSRGDRDEVFGGIGGSWKGCFVGGKYLVQAVTEGEPGERLHGNFHDYTQLP

SEQ ID NO: 19243 - protein, 473 aa, Myxococcus xanthus
LAERYPYYLANRPRQPNAELAVTHKYSGEVVTHVAVADAAAVEEAIAAAVRAAEPMRKLAPYARQAVLEHCVRRFRERAEELALALCIEAGKPLRDARGEVDRLIDTFKAAAEEAVRGGGEVLNLEVSKRAAGYRGFTQRVPVGPCSFITPFNFPLNLVAHKVAPAIAAGCPFILKPSDRTPVSALIMAEILAETELPEGAFSVLPVRLEDIGPLIEDDRLKLLSFTGSEKVGWELKARAGRKKVVLELGGNAACVVDEAPGAPLDFIADRVAQGAFFQAGQSCISVQRVLVHASLYDALREKLVERAKALRPGHPSDEATTLGPMIDEPAARRLEGWIQQAVQRGARVLAGGGRRGSVLDATVLEGVPEDASLSSEEAFGPVVLLQPFDSFDEALAQVNSGRFGLQAGLFTQDLSRAMKAWDELEVGGVVVGDVPSFRVDTMPYGGVKGSGIGREGVKYAIEDMTELRLLVL

SEQ ID NO: 19244 - protein, 428 aa, Myxococcus xanthus
DKAHVWHPYTAMEAYIAETDPLVVVRSEGAYLHDADGTRYLDANGSWWVSTLGHRHPRLMRALAEQAAALPHVSLAGITHEPAALLASELAAIAPGSDRPGLPSSERLSRVFYSDNGSTAVEVAIKMAAQYWAQNGQPRRTRFITLSGAFHGETMGATSVGGVPLFREVFGPLLFDVVHVPSPAEEGGWARAFEQVQSTLRAHPEVIAGVILEPVLQGAAGMVMYSPDFVRAVREATSEVDTFLIADEVFTGLGRTGARFAVDLAGVVPDMLCLAKALSGGILPFGATLASERVFSGFLGASNRALYYGHSYCGNPLGAAIAREVLAVYRDEDVMGQVARKAPRVKAAFERMAASIPGLVRPRAVGMVGAVDLGGGGYLARGGWRVYEAARRRGLYLRPMGDTVYIAPALTISDEALEELLSGVEASL

SEQ ID NO: 19245 - protein, 405 aa, Myxococcus xanthus
FEPSERAKDYLERVKRFMSEHILPAEARYHEELRATAQGGDWKTWRVPPVMEELKALAKTQGLWNLFLPDEKLGAGLSTLEYAPIAEETGRSFIAPEVFNCSAPDTGNMEVLWKYGSEAQQERWLKPLLAGDIRSVFCMTEPDVASSDATNMAATAIVDGDEVVLNGSKWWSSGLGHPNAKVVIFMARTPDTGGDRHHQHSMVLVPLDAPGVSIRRMLPVYGDYDAPHGHGEVHFDNVRVPRDNVIAGPGMGFEIAQGRLGPGRIHHCMRCIGAAERSLELMIDRGMKRTAFGKPLLNLGGNREKVAEARIAIDQARLLTLYAAWKMDQVGALGAMTEISAIKVVAPSVLQKVVDDAIQLHGGAGVSQDTPLAGFFAQARSLRLADGPDEVHKGLIARIELSKRG

SEQ ID NO: 19246 - protein, 233 aa, Myxococcus xanthus
ITGGASGLGKAIAVRFARAGWKVCIGDVNDTRGEEALKELSALAPQAHYLRCDVRREEDLREALDWLTAQWGGVDVVINNAGVAQAGAIEDVSIDDWQWIIDINLLGVVRGCKVFTPAFKKQGHGHIVNVASMAGLLDVPLMSSYNATKAAVVSLSETLHNELAEYGIGVSVVCPSFFKTNLGDSLRTTDPRLGATMARLLERSAITADDIANDVFDAVAERGFYVLPHADGR

SEQ ID NO: 19247 - protein, 596 aa, Myxococcus xanthus
AVGIDLGTTNSLVAAVVKDQPVCVPVDEGDALFLPSVVHYAKDGGVVVGARARKLASEHATDTIASVKRFMGRSPDDAETRKLGHYKFAPGAKVVRFDVAGGTPVTPIEVSGEVLRALKRRAEAHFSTKVEQAVITVPAYFDDAQRQATKDAGRLAGLEVLRLLNEPTAAALAYGLDKGSQGTFVVYDLGGGTFDISILKLVDGVFEVKSTGGDSALGGDDFDRAIAQRVLETLGASEAPAPALVAEVLAASRKAKEALTDAASVEFSAGGQTHSVKREDFDAWVQPFVQKTGTVCRRAMKDAGVTAGELDGVILVGGATRVPAVRRYVAELFGREPLGDIDPDQVVALGAAVLANLLTTADRQDDVLLLDVIPLSLGLETMGGIVEKLIQRNSTIPTTAGQVFTTFKDGQTGLDVHVLQGERELVEDNRSLARFTLSGIPPMAAGMARVEVRFQVDADGILSVSAQEQSTGVSQSITVKPSHGLTDEEIEQMLLDSIDYAEDDIQARQVREQRVDAERVLAEADRQLGEHGSLLQEGERATIDSAIARVRELMKGEDHLKLKEAVHALDEASRPFIERVMNQAITQVVAGHSVED

SEQ ID NO: 19248 - protein, 498 aa, Myxococcus xanthus
  unsure (1)..(498): unsure at all Xaa locations
SGERRAIVIGSGFGGLAAAIRLAARGWRVTVLERMDSPGGRANAFQQDGFTFDAGPTVITCPHLLEELWALGGQRMADHVELRPVAPLYRMRFPDGSTFDYHTDREAMRQSVRRLSPRDEAGFLALCARVERMYEAGIGPLMSTPVPDVLSLAPFTPALVRDEAFRSMFGLVSKHIRDERLQQALSFHPLLIVGSPFPTASAVYTSIQFVERRWGAFFPVGGTGALVRGLVELLESLGGEVRYGSEVTEIALEGRKATGVRLGDGTGLAADVVVSNADAAWTYRYLVPGHVRKHWTDERINRARYSMSAFLWYFGTRRQYPEVAHHTLLFGKDFRGMFSGLEGPGQPSADPLLYLHRPTATDAALAPSGHDAFYVLAPVPHLGTGAEWKQRAEAFRRELEARLSRTVLPGLGSELMTSRMATPEYFRDELRSFKGAAFSFAPTLWQTTFLRAQARSEDVDCLYMVGAGTHPGAGLPAVLCSAKIVDTVIPPTXRCSRE

SEQ ID NO: 19249 - protein, 259 aa, Myxococcus xanthus
QLLRATREEDGASVILKVPDAARLPSATTRLRHEWELTNALSLDGVLRPLAWAEARDGAPVLILEGFGDATLAQRLSQGRVEPRAACRIALSLARALGAIHEQGILHRDLNPSSILVGTDGESVKLTGFTLATRRPRAEVAPLAPERLEGTLEYLSPEGTGRTHRSVDSRGDFYSMGVVLYELLTGRRPFADTDALGLIHAHVALTPAPPVTVEPGLPQPLSDIALKLLAKSPEDRYQSAYGLVADLQRCLSALEAPGP

SEQ ID NO: 19250 - protein, 410 aa, Myxococcus xanthus
FEFKLPDLGEGVMEGELVKWHVKAGDSVKEDQVLAEVMTDKATVTVPAPKAGRVVKTHGNEGDMAKVHQLLVTLEVEGAAPAQAGGHSEASAPAAAPVAGGHVGGAPASASKVLATPVTRRMAREHGLDLASIAGTGPQGRVTKADVVAALEGGEKNVVAAPAEQKARPAAPAVSSGAADERVPLRGLRKKIAEKMVRSKFTAPHFAFVEEVDATELVALRARLNAQLAAAGENIKLNYLPFIIKATVAALKKFPHLNANFDEASQELVVRGEFNIGMAAATPDGLTVAVVKSADRLTLAELARETARLGAAARDRKLKMEELTGGTFTISSLGQSGGLFATPIINHPEVGILGVHRLKKRPAVVGDQVVVRDMMNLSLSCDHRVIDGSVAADFTYEIIKYLEKPDLLFL

SEQ ID NO: 19251 - protein, 569 aa, Myxococcus xanthus
QVVRATGKLRNLKTGWWRTSHQGNIGIGHTRWATHGRPSDENAHPHTYKDVAVVHNGIIENHLSLKEQLRSRGHVFSSETDSEVFAHLISEELERGLELPDAVRAAIAQVKGTYALAVLTASDPSRIVCTKDASPMVLGLGQGQNFLASDVPALLEHTRDFVYMEEGDLAVITAAAVDIFNRQGQKVNRPTRRIDWTPMMAEKGGHKHFMHKEIWEQPRAVADTLRGRMLLSEGDVHFEGWNLSAEKVRSLTKITILACGTSWHSGVAGKHMIESLARLPVEVELASEFRYRDPIVDGTHLAIAISQSGETADTLAAFKEAKARGATAMAICNVIGSAMTREADFSVLTNAGPEIGVASTKAFTTQLVALFLLAVKLGRMRGTLSVPAAQEHLTQLTKVPKMIEDVLKCEPAVTRVSREYMDSQDFLFLGRGPMHPVALEGALKLKEISYIHAEGYAGGEMKHGPIALIDEKMPVVVIAPKQPHVAYEKIIGNIEEVRARGGKVIAIIDEDDEHVATLADQVIRIPAACALLAPVVATIPLQLLAYHVADLRGNDVDQPRNLAKSVTVE

SEQ ID NO: 19252 - protein, 1552 aa, Myxococcus xanthus
LSYAGLDLRARRIGAALQALARAGERAVLLYPPGLEYVAGFFGCLYAGLVAVPAYPPDPMRLERTLPRLRAIIRDARASVVLTTSFIQEMGEGLFEGAPELAALRWVATDALPEGTEAGWRRPEPSRDTLAFLQYTSGSTGDPKGVQLSHGNLLHNLGLISHAFQVRSDSVGVIWLPPYHDMGLIGGILQPLYAGFPVALMSPLAFLRRPRFWLESLSRFGGTISGGPCFAFDLCVRKVPPAEREGLDLRRWELAFCGAEPIRPEVMTRFSEAFAPVGFQREALYPCYGLAEGTLIASGGRKGEGVLTRMWDAQALERNEALAAEDGPGARPLVGCGQTLPEQTLLVVDPETRRACPPERVGEIWVSGPSVAHGYWERPEESEAAFGARLADSDSGPRFLRTGDLGLLKDGELFVVGRRKDLIILRGRNLHPQDLELTLERSHSALRPGCGAAFSIDVGGEERLAVMYEVDSRKPWTAEDVVGAVRRGLAETHEVQLHTLVLIEPGALPKTSSGKIQRRACRAELLAGTARALLTWSESEADAPQAKAPAPDITASQPLTVEALEAWLLARIASRLRVRPEELATDAPITSFGLDSLGAVELANDVETLGVVLRMEVLLQGPTVGALALTLFAARGASTGAELTRGEERTPAPLSSAQQRLWLFEQLAQGSAAYHLPAAVRLTGALDDVALEHAFAAIVQRHAALRATFRDEDGTPSQVTSSVPVSSLRRVDLRDVPVDAREEAALRLAHEEARAPFDLERGPLLRATLFQLDAHEHLLVVVMHHIASDGASFAILARELSALYAGDVSLPPLAFQYPDFARWRREVEADGALATSLDWWKARLAGGAAALELPADRSRPPMPSYRGGRVAVRFPEALTARLEALGRSEGATLFMTLLAAFEVLLARHSGQADFCVGTAVNGRERAGLEGLMGCFLDLIVLRASVSGSSRFRELLGQTREGVLAAFAHRGVSFERLVDAVQPTRDPSRAPLFQVLFVLQPEPGAGLALPGLESRRVEVDPGATPYDLTLSLARGPEGLGGWLEYATDLFDADTAARLVARLGVLLESIVADPDQRLAMLPLLPEAEQRQVLVDWNDTRAEFPEACIHALVELQAQRTPDAVAVVCGDGVLTYRELNQRANAVAWRLREQGVGPECIVGLFADRSADLVVGLLGIFKAGGAYLPLDPSYPEARLALMLEDSGASVVLAHRHLAGALPFGDRTVVPLDVAGEADAAPPGAVGPDNLAYVLYTSGSTGKPKGVAVPQRAVVRLVRNTHYVHLGPDETLLQFAPLAFDASTFEVWGALLNGARLAIHPPTTPSLEELGSFIARQGVTTVWLTAGLFHQVVDHALESLASVRQLLAGGDVLSPAHVRRVVERYPGCRVINGYGPTENTTFTCCHTVSPDEPLVNAVPIGRPISNTRIHVLNAALEPVPVGAPGELCAGGDGLALGYLNDPALTAQRFIPDPFSPVPGARLYRTGDRCHVLPDGAVEFLGRRGEQVKLRGFRIEPGEIEAALALHPTVHEARVMAREDGPGEKQLVAYLVARPSRELP

SEQ ID NO: 19253 - protein, 498 aa, Myxococcus xanthus
  unsure (1)..(498): unsure at all Xaa locations
GRVRPLRRSRTRTTASWRPSXHRLALTWSSTXTPGSRGGKQGAPCXTGPMPKIRKVLVANRGEIAIRVMRTCKELGIATVAVYSEADRSALHVRTADQAIFVGPPPSRESYLVQQRILDAAKQAGADAIHPGYGFLSENAAFVRACEAEGLTFIGPPASAMDSMGEKTRARANMIKAGVPVVPGTTEPIPSVEEARAYVEKIGFPVMLKGAGGGGGKGMRKVERMEDFESSWRAAKSEALNAFGNDAVYIEKYLEKPHHVEIQVFADQYGNTIHLNERECSAQRRHQKVVEETPSPILTPELRAKMGEVAVKAAKAVNYVGAGTVEFLVDVHRNFYFLEMNTRLQVEHPVTEWVTGLDLVAMQIKAAEGEKLGLTEAPTPRGHSIEVRVYAEDPSRNFMPSPGKITYLRVPGGPNVRDDSGVFPGYTVPNVYDPMISKLSVWAPTRREAIARTQRALSEYVVKGITTNIRYLKAILAHPEFIEGDYDTSFLTRQHDAL

SEQ ID NO: 19254 - protein, 574 aa, Myxococcus xanthus
ALDLDSWEPRRRTAHRGPGEPPAKPPPTPTLDSVGVAWHRLAQEGQLDAAYEQDALVALLRTRLAAKDAEPVVLVGPSGVGKTSVLHALAQSLRAPTATEAERARPFYFLDGSRLIAGEGFFGDWQQQVLRAFREATEARALLSLGHAVELLDAGKSAHSDQNVAQLLLPLLAARDVAVMAEATEETWAQVEQRNTSFARLFSVVRVAEPTPDALGRIVAKVAEDDALAAAMQVQPDALDEARFLCRRFLPYGAQVGNTVAFVRRLLASCAQASRTSVTRLEATRQFASESGIPEHLLRDDQPLASAHVRDFLASRVMGQDAAVERAASVVSVLKAGMSDVRRPLGVLLFVGPTGVGKTELSKALAELLFGAKERMVRLDMGEYAGPDALLRLMGDGETPGYLTSAVRRQPFCVVLLDEVEKAHPAVHDALLGVLGEGRLTDASGRFTDFRNALIILTSNLGADTLRARVGFDASGGAPDMASLRAHYLSEVQRFFRPEMFNRMDDVVVFSPLSAPLLRRLVVRELEAVCRRPGLSLHDALLEVTPAAQDWLALRGFDARYGARPLKRALEREL

SEQ ID NO: 19255 - protein, 254 aa, Myxococcus xanthus
GKTVVVTGASAGIGEALAVVLAGRGANLVLAARNEEALQRVKARCESAGGRAVVVPTDVGDAEACRHLVERAVEAFGGVDVLVNNAGVTMDARVDEVKDLSLFDRLMRINYLGAVYCTHHALPHLKARRGLVVAVSSLTGKTGVPNRSGYAASKHAMHGFFDSLRIELRGTGVDVTVVCPGFVATNIRDSALGADGQPVRQSKHDESAGNMDVDTCVAIILRAMERREREVVMTTKARVAQFLKLVAPGVVDRI

SEQ ID NO: 19256 - protein, 716 aa, Myxococcus xanthus
PQVHFRTCNLCEAMCGLRIELDAGRITSIRGDAEDPFSRGHVCPKALALEDLHQDPDRLRGPMRRTASGWEPVSWDDALDETARRLHAIQREHGRDAVGAYLGNPNVHNLGNMLFGPELLRTLRSRNRFSATSVDQLPHQLTAYLMFGHQLMVPIPDIDHTGYMLVLGANPLASNGSLMTAPDVRARLRAIQQRGGRIVVMDPRRTETAAIADTHVFIRPGTDALALLALLHVAVVEHAPRLGPLDAFTDGLETVCALARDFPPEKVSPHTGVPAHTLRRIARDFLSARAAVCYGRMGVSTQSFGALCQWLITVLNVVSGNLDRRGGAMFTLPAFDVVGGPRALAVGRGGFGRWKSRVRGLPEFAGELPTAAMAEEMLTPGPGRIRALLTVAGNPALSTPDGARMEQALAGLDFMVSIDPYLNETTRHAHLILPPVSPLERSHYDIAFHALAVRNTAKYSPALFEPGPGSRQDWQILLALQHRLLTLRKGRPSVRATLKYQALSRLGPERVLDLGLRLGPYGARFHPAKQGLTLEKLRQSPHGIDLGPLQSCLPQRLQTKDRRIHLAPELLVADVRRLQAAFPQDTVPEQHSGELLLIGRRHLRDNNSWMHNVPGLLKGKPRCTLMMHPEDAARRALADGMEATVTSRVGTVTVPIHVTDEVMPGVVSLPHGYGHGRQGTRLAVATAHAGASHNDLTDAQAVDALCGNAAFSGTPV

SEQ ID NO: 19257 - protein, 485 aa, Myxococcus xanthus
PSRGDAGRFTYRAMNTRATALGGWLRDVAGVQKGDRVGIVAHNGVEYLDALFACAKIGAVFVPFNWRLHAAELADLVRSIRPGVLFFGDDFRDTVADVRERLGGGPRLVSLESQGLPGADAYAATLAHVPGSPVTQDAVSEEDILCLIFTGGTTGRSKGARVSYRMVAWNTLNTLVHEVRPGDVTVTHTPMFHTGGLLVYTLPLLTVGGTVVLMRRWEPEALLDLIPREKVTLFFAVPTQYQQLLESPRFKTTDFSSVRFMTSGGAALPVPLIQAWQAVHPVPFKQGFGMTEFGPGLFSMGPEYAVSKAGSIGRPNYFIAAKLVDDDGREVPTGEVGELLLKGPSMCSGYFEDEAATREAIDAEGWLHTGDLARVDADGFFTIAGRKKDMFISGGENIYPLELESALYEHPAVAQCAVVGVPDAKWGEVGRAFVVLKPDGKVSAEALLEHLRGRVARFKVPKRVELMERLPISAAGKILKRELRD

SEQ ID NO: 19258 - protein, 326 aa, Myxococcus xanthus
AQILSTGRYVPEKVLTNADVEKILGEKVDEWLQQNVGIRERHMMADDQATSDLCVGAARQALERAGTKPEELDLIIIATDTPDYLSPATASVVQAKLGAVNAGTYDLNCACAGWVTALDVGSKTIAADDSYQRILVVGAYGMSRYINWKDKKTATLFADGAGAVVLGAGDTPGFMGAKLLANGEYHDALGVYTGGTNRPATAESLELTGGKPAVQFVRKFPATFNTERWPMLLDQLLKRQNLKLDDVKQFVFTQLNLRTIEATMKILGQPMEKAHYTMDKWGYTGSACIPMTLDDAVVQGKVQRGDLVALCASGGGLAMASALYRW

SEQ ID NO: 19259 - protein, 246 aa, Myxococcus xanthus
MQLKDLKIIVTGGAQGMGAHFAQRLHEAGAQVAVGDVAEERLAALPAGIHRRKLDVSSEEDIVSFVNWAQGAMGGLNGLINNAGILRDALLVKKDRTTGEVKKLSTADWNAVIGVNLTGATLMVREVVAKVAESGQKGGVVVNMSSIARHGNRGQSNYVSAKAALAANTVTWSREFSPFGVRVGAVAPGMIETPMTQGMNQKARDALVSNIPVGRIGVPEDIWLAVKFILECDYFNGRTIDVDGGL

SEQ ID NO: 19260 - protein, 537 aa, Myxococcus xanthus
GRMMDFPLTLSHLMERARTFYPRSEIVSRNPDKSLHRYTYADFYARTCRLANALTRLGVKAGDRVATLSWNHYRHLEVYYGVPCMGAVVHTLNLRLHPNDLGYIARHAEDSVVVVDRSLLPLFEKFKDAVPSIRHVIVVPDAGPAPEGTLDYEALLAAESPDFDFPQLDENSASMLCYTSGTTGNPKGVLYSHRSTVLHALACCMTDVTGMREADAVMPVVPMFHAAAWGLAFDAVLTGAKLVLPGPHLDPPSLLDLMAAEKVTLAGGVPTIWIGILALLDQAPNKWDLSSMRSMLIGGSAAPPSLIEGFQQRHGLEVVHAWGMTEMSPVGTMAKVKGPLRQAAHEAKSSARASQGFALPFVETRVASDDGTLLPWDGETMGELEVRGPWVASSYFSDEGADRYTKDGWFKTGDVVTIDSHGYVRICDRSKDVIKSGGEWISSVALENALMAHPAVLEAAVFAGKHPKWDERPLAAVALKEGQQVTKEELTAHLAGQFAKMWLPDDYVFVPQVPRTSTGKFLKTKLREDYGDHLLKN

SEQ ID NO: 19261 - protein, 345 aa, Myxococcus xanthus
MKVAVLTGGGDCPGLNAVIRAVVRRANAHGFEMMGLRDGWKGLLEDNHFRLTRETTSGILHRGGTILGTSRVNPFKVENGLERVKRAIERNGIHAVIAIGGEGTLSAATRMSQEGLRIVGVPKTIDNDINATDFTFGFDTAVAIATEAIDRLHSTAESHKRVIVCEVMGRHVGWIATYAGIAGGADVILVPEIPADLAKVAEHIQRRHAGGRTFSIVVVAEGTRIKLSADQQEQLVTSGALDEAGRPRLGGVGTILAHEIERRTGFETRVSVLGHIQRGGAPTAHDRVLATRYGVHACDMVARGEFGKMAALRGNDIISVDLADATRELKRVPQEFFEVAQVFFG

SEQ ID NO: 19262 - protein, 618 aa, Myxococcus xanthus
YQRLYQRSIQQPEAFWSEMAEQLTWFHKPDAIMDLDAEQVDFSWFGGGKLNAAYNCIDRHATERPGKVAIIWAKNEPGEYESITYRDLQHHVGRVANVLKAHGVRKGDRVCIYLPMVPELAYTMLACARIGAVHSVVFAGFSSEALRERILDSGAKVLITANEGPRGPKFVPTKAIADEAVEGLSLVESILVVRRTGKEVPMLAGRDYWLDAEMAKHRGVCPAEWMDSEDPLFILYTSGSTGKPKGVLHTTGGYLVYAATTFRYVFDIQPEDVYFCAADLGWVTGHSYILYGPLMNGTTTVMFESTPTFPDAGRLWRVVDDLKATILYTAPTALRSLIKEGDAWVKKSSRQSLRLLGSVGEPINPEVWRWYHDVVGEGRCPVVDTWWQTETGGILIAPLPGATPTKPGSATLPFFGVEPVLVDDEGRVIEGNGVSGNLCLARSWPGQARTLYGHHQRFKETYYARFPNLYFTGDGCRRDEDGYYWITGRVDDVLNVSGHRLGTAEVESALVAHEAVAEAAVVGFPHDLKGTGVCAFVTVKPDWQESASEQMVGALKEQVRHVIGPIATPDRVVLVNGLPKTRSGKILRRMLRKIASGEVENLGDASTLADPSVLDELL

SEQ ID NO: 19263 - protein, 1130 aa, Myxococcus xanthus
RGRGARASTPRGQGRGGHPLQPLLAALRSVHGGDFSVRLPGGGADPVMEEIASAFNAVVSLNATLTQEVVRVERVVGREGRMGERVSLGDVRGDWAHSINSINSLIGDLVQPTTEVARVLVAVAQGDLTQKMALEIDGQPVKGEFLRIGTTVNAMLDQLNSFAAEVTRVAREVGSDGKLGGQAEVRGVSGVWKDLTDNVNLMANNLTAQVRNIAEVSTAVANGDLSKKITVDARGEVFELKSTINTMVDQLNGFASEVTRVAREVGTEGKLGGQAAVPGVSGTWKDLTDNVNFMASNLTTQVRGIVKVVTAVANGDLTQKLMVPSQGEIAALGATLNAMTDTLNVFAQQVTSVARTVGVEGKLGAQAQVPGAAGTWKDLTDNVNLMANNLTAQVRNIGEVTTAVAKGDLSKKITVDVRGEVLELKDTINTMVDQLRAFASEVTRVAREVGTDGKLGGQADVKGVGGVWKDLTDNVNYMASNLTTQVRNIALVTTSVANGDLSKKITVDARGEILELKNTINTMVDQLNSFASEVTRVAREVGTHGKLGGQAEVRGVSGTWKDLTDNVNVMAVNLTTQVRGIAKVVTAVANGDLTQRLKMEAKGEVAELADTINAMTQTLSIFAQQVTDVARTVGVEGKLGAQAVVPGVAGTWKDLTNNVNLLANNLTDQVRNIAEVTTAVAKGDLSRKITVDAKGEVLELKSTINTMVDQLNSFAAEVTRVAKEVGTEGKLGGQAEVRGVSGVWKDLTDNVNFMAVNLTTQVRGIVRVVTAVANGDLNQKLTMDAKGEIAALADTINAMTQTLSIFAQQVTDVARTVGVEGKLGAQAEVPGVAGTWKDLTNNVNLLANNLTAQVRNIAEVTTAVANGDLSKKITVDAKGEVLELKSTINTMVDQLRAFAAEVTRVAKEVGTEGKLGGQADVKDLSGVWKDLTDNVNVLAGNLTDQVRNIAKVTTAVANGDLSQKITVSVKGEVLELKNTINTMVDQLRAFASEVTRVAKEVGTEGKLGGQAAVPGVAGTWKDLTDNVNVLAGNLTDQVRNIAKVTTAVANGDLSQKISVEARGEILELKSTINTMVDQLRAFAAEVTRVAKEVGTDGKLGGQAAVPGVAGTWKDLTDNVNSMASNLTAQV

SEQ ID NO: 19264 - protein, 113 aa, Myxococcus xanthus
NGMQPSVCTDVNECTNGTAQCSVNAICTNTPGSYTCTCRPGYWGNGWTCSDIDECSNGTAACNPSQVCVNTPGGYECVGGSCPAPRVQCGAQCVDVSSDVNNCGACGVVCPAA

SEQ ID NO: 19265 - protein, 236 aa, Myxococcus xanthus
  unsure (1)..(236): unsure at all Xaa locations
AVTRAELSRFLSKAVADAVIAGETEDLAQSRLAEVSCLFADIRGFTTISENDSPQEVVDMLNAFFTAMAGVVFRHEGNLDKFIGDCVMAVWGPPLSHPDDAARALRAALEMQDAVHELNRRRVAAGKQPIEVGIGVNTGQAVVGYMGSAERHEFTAIGDTVNTASRLCGMAKSGEVLASESTVRRAGAGFDVEGLPALQVKGKEKAVPTYRVHGLEYTTAASSSRRAXVRRRRPAP

SEQ ID NO: 19266 - protein, 877 aa, Myxococcus xanthus
CSSSASAPVRARGPSPLPTRSAPARPVTQAVTPEKEAPVLTPPGLRLSPAVRPVRQTVTLELDPRRKMFSGTTDIEIELPQATHEVWLHGEELSVKDAASSWRARGSRRPRCPSATCLVFLPREAVGPGTVILRVAYTGRARARESSGVYREQDAGRWYTMTQFQPLAARRAFPCFDEPAFKIPWRLTLRVREEDGAFANSPVEAETHGPDGWKTVRFQTTPPLPSYLVAFAVGPFQAVDAGVAGQHRVPVRMLVPQGRAAEAAWAAQATPPLLEHLETWFGTSYPYAKLDVLALPGTQGGAMEHPGLITFSAPLMLGPVEGDSLWRQRYFALTQAHELAHQWFGNLVTPAWWDDLWLNESFADWLAYKVVTQWKPEWRGDVRRVEARGDALVEDRLVSARSVRQPIEAPGDVHSAFDGITYNKGAAVLAMFESWVGPDAFQQGVRHYLDTHARGTATTADFFEALTQATGKDVAPAFSSFLDQPGAPRVAMTLECPKEGPPRLTLEQRRYLPLGSPGGRGEEQAWQVPVCVRYAAGGTEGRACTVLSESTGTLSLDGAKSCPDWVHPNAEGRGYYHALLRGDAMERLTRQGGRGLSIAERRVLLDDAEALVASGELDVAQALTLATRLLRADDPDLVMGAAALVASVRDDFVPRAAWPNRARFVRGLFGGQARQLGFVPRPGESDDVRMLRPRLVWMVAQSGEDVLLRTEAGKLALRWLDDRRSLSMDAAQGVLGAASASGDAVLHQGMLEALRTTTESRERDVLFTAMGGFQDSALASASRALLLAPDVDTREALPILFRQLEEQPTRAGAFDFLREHFETLRERLPRDIAPWLLGTGGFFCDAEHRARFADFFAPYAPTFEGGERALAQALERV

SEQ ID NO: 19267 - protein, 442 aa, Myxococcus xanthus
  unsure (1)..(442): unsure at all Xaa locations
YPLLTSLGRNLSQAAHEGRLDPVVGRAREVEEVIDILGKRRTNNPCLLGEPGVGKTAVVEGVAQRLLELRGSLSEKVLVELDMATLVAGTQLRGSFSEKLNTLTEEVRRSNGRVVVLIDKVHTLLGAVSTGDSPNYSANQMNTAMARGEFPCLCATTHDEYRKLMTTDPALERXFTPAVVNEPCVPETAEILRGIIGRYEEHHGLRYTPEALEAATSLASRYVTDRFMPDKAISVVDLAGSRCHREGRDVVEPADVARVVAKLAGVPEERLLMNDSSRLLRLEQDLAERVIGHSEAVTRIARVIRRNYAGFASRRPMGSFLFLGPTGVGKTEMARALADVLFGSRDSLVRLDMSEMSEQHGVSRLIGSPAGYVGFGEGGQLTEPVRRRPSSVVVLDEIEKAHREVQMLLLQVLEEGRLTDGKGRHIDFSNTVIVMTTNLGAE

SEQ ID NO: 19268 - protein, 428 aa, Myxococcus xanthus
MPNVVVIGAQWGDEGKGKVVDLLTEHAQVVVRFQGGNNAGHTLVVGGQKTVLHLIPSGILHPGKTCVIGNGVVVDPAVLVGEIDALKVRGFLKDDAQLLISDNAHVIFPWHKLLDSFREKARGGSAIGTTGRGIGPAYEDKVARRGIRVRDLLNADRLRTRIEARLPAALDELKDLCAQAGDPVPQLEVPQILAEFTGLGERLKPFVHDASLYLSGQVRRGARILFEGAQGTLLDVDHGTYPFVTSSNCVAGNAAVGSGLGPTAIDKVMGISKAYTTRVGGGPFPTELHDAIGDQLRKMGDEFGTTTGRPRRCGWLDGVVLRYASRVNGLWGMALTKLDVLSGLKTLQICTAYELDGQKVMELPGDYEDLARVKPIYETLQGWDEQIAGVRTFDELPENAKRYVRRVEEVSGVPVVCVSVGADRGETV

SEQ ID NO: 19269 - protein, 459 aa, Myxococcus xanthus
SRLLLVSNRLPVTVKVEKDTVSVVRSAGGLATGLRRPHERSGGLWIGWPGDVSRLSESQRARVDAQLAELRCVPLTLSASEVSRYYEGYSNRVLWPLCHYMLERIPRQDRDWEVYRKVNERFADLVAKHYEPGDTIWVHDYQLMLVPGMLRQRLPGARIGYFHHIPFPSSEIFSTLPRRRELLKGLLGADLIGFHTVSYVRHFSGALLRHLGLDTDIDRIIWEGRDVRVGAFPMGIDAQAFESIASEPGMQEEVANLRRSSEGQRILLGIDRLDYTKGIPRRLLAVQRVLERTPAWRGRLRFIQVTVPSRTQVEAYANYRELVNELVGRINGLYGTVHNVPVHYLYRSFNEGKLVGLSRGANVMLVTPVRDGMNLVAKEFCTARPDDDGVLVLSEFAGAAAELGGALIVNPYDVDAMADAIEKALGMAEEERRTRMHTLRKQVKSRDVHWWTSSFLDRL

SEQ ID NO: 19270 - protein, 407 aa, Myxococcus xanthus
RVKASSRMSFTTYRDVLPSGLRVVTIETPHLHTALLAVYVRTGSRHETLVSNGVSHYLEHLFFRGSEGWPDTVKMNAAVEEVGGNLNGVTTRDHGYYYTPIHPAHLRVGLDIIGDMLTRPRLTDMEVERQIILEEMLDEVDEKGRDIDLDNLSKHLLFPGHPLALKIAGTRESVTNMTHTQILEHFAQHYVAGNIVVTAAGRVKHSEVLEMTERAFARLPRGPSSVEAPPPLTPPGPRLHFVSHDESQTEFRLNFRGVPEQHEDYPALQIIRRVLDDGLSSRLPFEIVEKRGLAYSVSASLDAYHDAGLLEIEAASAPEKAATVITEAFRVLSTLCENEVGEEELARAKRRHRMLLEFSQDSPGELSGWFGGTELFRTPESFGHRADLVDSQSAARVREVARRYFNR

SEQ ID NO: 19271 - protein, 504 aa, Myxococcus xanthus
YAAPNQPGSKVQFKPRYQNFIGGRWVEPTRGQYFENISPVTGKPFCEVARSTAEDIEKALDAAHAARLSWGRTSPTARANILNKIADRMEQNREMLAVAETWDNGKPVRETLAADIPLAIDHFRYFAGCIRAQEGGVSELDHDTVAYHFHEPLGVVGQIIPWNFPLLMAAWKLAPALAAGNCVVLKPAEQTPSSILLWTELIQDLLPEGVLNVVNGFGVEAGKPLASSPRIAKVAFTGETSTGRLIMQYASENLIPVTLELGGKSPNIFFEDVMAQDDDFFDKSLEGFAMFALNQGEVCTCPSRSLISERIYSQFMEKALDRVRKVKPGNPLDTDTMVGAQASNDQLEKILSYIDIGKKEGAKVLIGGERVALSGDLKDGYYVAPTVFQGHNRMRVFQEEIFGPVVSVATFKDFDDAIRQANDTLYGLGAGVWTRDGNTAYRAGRAIEAGRVWTNCYHIYPAHAAFGGYKQSGIGRENHRKMLDHYQQTKNLLVSYSPKAMGFF

SEQ ID NO: 19272 - protein, 322 aa, Myxococcus xanthus
SKRGLLLVNLGTPDAPQTGPVRRYLREFLNDPRVIDIHPLGRWALLNFIILPMRPAKSAEAYRKIWMKEGSPLLVYSQALAAQVAERLAGEYEVVLAMRYGSPSIPDGIAALKARGVSEFTVLPLYPQEAASSTASSLARTYEVLAQSWDVPFVRAVPAFFEHPGFLDAFTAVARPVIDDARADYVLFSFHGLPERHMRKSDPTGTHCLSTASCCDAMTDANRHCYRAQSYATARGLAQRLGLPAEGWSVSFQSRLGRTPWVKPYTDVVLPELAKKGVKRLAVMCPAFVADCLETLEEIGLRAREQFLEAGGESLTLVPSLN

SEQ ID NO: 19273 - protein, 701 aa, Myxococcus xanthus
PGKPYPLGATFDGQGVNFAVFSEHAKKVEVCLFDPEDPAKETRRFPLLETTHQVWHGYVPGLAAGALYGLRVHGPYEPKKGLRFNPHKLLVDPYARAIHGQVDYQAPIYAYTPGTKEDDLAFDTRDDAAAVPKGVVMGADTFDWEGDTPPGVPWHDTLIYEVHVKGFTQLHPRVPEALRGTYAGLAHPASIEHLKKVGVTAVELLPIQHIVDEPFLIQREKVNYWGYNTLGFFAPDARYSGSGSLGGQVDEFKRMVKQLHRAGIEVLLDVVYNHTCEGNQLGPTLSFKGVDNAAYYRLTEKDPRYYLDVTGCGNSWNATHPYALKLVADSLRYWVEEMHVDGFRFDLATTLGRDRHGYDTRAAFFQIIHQDPVLSRVKLISEPWDVGDFGYQVGNFPVLWSEWNGKYRDTIRRYWKGDDRQAAEIGYRLTGSSDLFSLSGRKPAASVNFVTAHDGFTLHDLVTYNDKHNEANGEENRDGANDNHSWNCGVEGETTDAEINALREQQKRNFLATLFLSQGVPMLVAGDEMGRTQKGNNNAYCQDNELSWVDWELNDTQRALLDFTCALTKLRREQPVLHKRRFFRGAHMWDSELKDLAWFRPDGQEMRKDDWEKPYVRSLGFLLGGDAITAPDDEGNRIVGDTILVLMNAHHEPITFRLPAVEWGADWELVVDTALAGESLRTHTPAGGTVQVVGRSLAVLR

SEQ ID NO: 19274 - protein, 183 aa, Myxococcus xanthus
VEGLEKAYGEVKAVQGLTFEVAPGEVLGLVGPNGAGKTSTLRCLAGILPPSSGRILVAGYDLSRTPVDAKRALAFLPDEPRFFEYLTVWEHLNFTARLYGVEDWEERGRALLEEMELTGKEKSLPGELSRGMKQKLSIACGFLHSPKLILLDEPLAGLDPIGIRRMKASLRRRAEEGTALVLS

SEQ ID NO: 19275 - protein, 1071 aa, Myxococcus xanthus
MPKRTDIRKVLVIGSGPIVIGQAVEFDYSGTQAIKALRDEGVEVVLLNSNPATVMTDPEFAHRTYIEPITVEAAERILASERPDSLLPTMGGQTALNLAKALAEQGILEKYGVRLIGASLDAINKAEDRQLFKAAMQKIGVALPKSGYATTLDQAMSLVEDIGFPAIIRPSFTLGGTGGGIAYNREEFETICRSGLKASPTTTILVEESVLGWKEYELEVVRDTADNVIIVCSIENLDPMGVHTGDSITVAPAQTLTDREYQRMRQASLAIIREIGVETGGSNIQFGINPKDGRMVVIEMNPRVSRSSALASKATGYPIAKIAAKLALGYTLDELRNDITRDTPASFEPTLDYVVVKVPRFNFEKFPHADRTLTTSMRSVGEVMAIGRTFPEAYMKALRSMELGRVGLESPELPAEKEEREKVLREALRIPRPERPWFVAQAFREGMTVEDVHALSAIDPWFLRYIQMLVNEAQSLQEYGRLDQLPDEVLRQAKAHGFSDKYLGRLLGYPAEEVRAHRHARNIRPVYKRVDTCAAEFEAYTPYLYSTYEEEDEAPPTDRQKVLILGSGPIRIGQGIEFDYACVHAAFALREAGYETVMVNCNPETVSTDYDTSDRLYFEPLTIEDVLEVSQREKPVGAIVQFGGQTPLRISVPLEKAGLPILGTSPDAIDRAEDRERFAALIEKLGLKQPENGVARSHAEAFKVAERIGYPVMVRPSYVLGGRAMETVYDVASLERYMREAVSASPEHPVLIDRFLKEAIEVDLDLVADRTGAVMIGGVLEHIQEAGVHSGDAAATLPPHSLSPDLVERMKDQAIALARELGVVGLMNVQFAIQGKTIYILEVNPRASRTVPFISKATGVAMAKIAALCMVGKTLKELGVTQEPEFKHVAVKESVFPFARFAGVDVILGPEMKSTGEVMGLANDYASAFAKSQLAAGVKLPKSGKVFISVKDDDKPAVVDLARRLRSMGFSLVVTSGTHTYLATKGIEAQVVQKVTEGRPNIVDKIVDGEIVLVINTTFGKQEIADSFSIRRESLMHSVPYYTTVQPARMAVGALESLKCTELEVKPLQEY

SEQ ID NO: 19276 - protein, 203 aa, Myxococcus xanthus
DYLSRHGIKDARVLEAIARLNRADFVPEDLREEASADSPLPIGHGQTISQPYVVALMTEALQLQGDERVLEIGTGSGYQTALLSLLCREVYSVEIVPELAQSAREVLGRQGFENVSFREGDGSLGWPDQAPFDAILAAAAPPDVPLQLLSQLKPGGRMIIPVGPRGGTQQLLRIQRALRPGEVPQVESLLSVRFVPMTGQPLS

SEQ ID NO: 19277 - protein, 336 aa, Myxococcus xanthus
  unsure (1)..(336): unsure at all Xaa locations
SVIGSGSFGTALANVLAVNCEEVRLWGRESSVVEAINTQHENPTYLKGIPISERVRATNDLQEALVGSELVVLATPSHATREVVAKAQAYLPRHVPIVTVSKGIENGTLLTMTELLEDCLPEEFHPYLAVLSGPSFAKELARRMPTVVTIASHWDKVALRCQKALQTETFRSYTSTDVVGVQYGGALKNVIAIAAGMADGLGMGHNARAAIITRGLAEITRLAVRKGANPLTLSGLSGMGDLVLTCTGELSRNRHVGMELGKGRKLPDILADMKEVAEGVKTARSAHELELKTGVELPICHQVYLIAHEGKSARTAVVDLMTRHPKSELAGVXAAF

SEQ ID NO: 19278 - protein, 641 aa, Myxococcus xanthus
LSKLNPPQREAVVTLEGPLLVLAGAGSGKTRVITHRIVHLLNERPGLIMARNILAVTFTNKAATEMKERLVHMAGPRAQGVLVCTFHAFGAEMLREDIHRLGWPKKFAIADMGDQLANIRRAMREHKIDDRSFDARKVLNLISKAKNSGKAPEPKPEGIGDDYDLITHMVYPDYQLSLKAQGSVDFDDLLLLPARLLREHPDLYEKYTKRFRYLLVDEFQDTNTAQLELLKLLAGRSRNVCAVGDDDQCIYSWRGAEVRNILDFDRLFPGGKEVRLEQNYRSVQTVLDAANAVIAKNPERKAKQMWTDRTGGTKVKVVTCPNDEEEARFVAHEIQKHMALGISADDIAVLYRTNGQSRPIEETLREKNIGYEVVGGSEFFDRREVKDVIAYFKVIVNKLDEISLLRIVNVPSRGIGDVTMERLNVHARGEGVTLWTVMKKATDYEDLPPGAGARVMDFVDLVERYRAAYEHGQLANVTRKLLEEIGFREATRAHATSATAADKKLKGVDGVLNSLENFEKREGPKASLPTYLNRLSLDTRQEEEEVPGANRRVTLMTVHASKGLEYRLVFFIGMEEDLMPHGGMQGEAQNLEEERRLCYVGITRAKEVLYLTRAATRVKRGKEVPRTPSRFLEDLPPEVIE

SEQ ID NO: 19279 - protein, 654 aa, Myxococcus xanthus
SLLAVLAEKPSVARDIARVLGANERGEGWLRGNGYVVTWAIGHLVGLAQPHEIRADWKKWSRALLPMLPADWPLVVSKETRSQFEVVKQVLNAPEVSSVVCATDAGREGELIFRYIYDAAKCRKPVQRLWVSSLTERAIQDGFRRLADGREYEALAAAAMGRSRADWLVGMNLSRLYTLAHGGHGEMLSVGRVQTPTLAMVVERELAIRDFVPRDYLELVATFAPRAKGVPPDALYKGTWFRSGPDGKPVAPPGFEGVREARRLDANGVEAQAIIDRVRAGRAIIESLESEEKRMAPPLLYDLTELQRHANRLHGFSAQRTLEVAQALYEKHKLLSYPRTASRHLSRTVADTLPEVVNAIRGPYEEDLAVGTGARALGKRYVDDAKVTDHHAIIPTPTAPGGVRLSPDEQRVYDLVCRRLLQAWHEDHVWRVTTVITAVTSAGAPPVVDRFQSTGTQVEQVGWKVLDIGGGQKAPRLKSEGRKGEDAEREPEDEPQTLPSGLARAQPQSVEDVEAVKKRTRPPPRFTDATLLTAMESAGRALDEKELADAMRETGLGTPATRAAIIEVLLDREYLRRRGKVMEATEKGIHLIQVVHPDVKTPAMTGQWEAWLQRIERGEGQLDEFIRGIEAYVIEVVGHGATAPQRPPRNEVLG

SEQ ID NO: 19280 - protein, 315 aa, Myxococcus xanthus
KRALITGITGQDGSYLAELLLSKGYEVHGMVRRSSEEKFERIQHLHGKIQLHQGDLLDQFSLAALLNLTKPDEVYNLAAQSFVPTSWNQPVLTGEFTALGVTKMLEAIRHTRPEARFYQASSSEMFGKVLEVPQTEDTPFYPRSPYGVAKAYGHHITVNYRESFNLFAVSGILFNHESPRRGLEFVTRKVTYNVARIKLGLQEKLPMGNLDAKRDWGFAGDYVDAMWRMLQQPQAEDYVVATNETHTVRELVEIAFARVGLDWEKHVFIDPAFVRPAEVDLLIGDPAKAKTKLGWEPKVRFKELVEMMVDADLER

SEQ ID NO: 19281 - protein, 512 aa, Myxococcus xanthus
ITLVGINDFHGQVEPHRTPLKDGQVVEEGGAATLAAYVARLRAANPGGVVLLDAGDMFQGTLPSNLTEGAVVIDVYNHLGVDAAAIGNHEFDYGPVGPGSMAQRPGDDALGALKARIGQARFPMLSANLRDASTGARPAWTGNDGTYLMKVKGVKVGIIGLSTEDTPKVTNPANVSSLRFLPLAPAALEASRSLRARGAEVVVVVAHAGGKCADLSNPRDTSSCDEGDAEILSMLKRLPPGTVDAIVAGHTHQTMGHFFAQVPIIETTGLARSLGVVELFVDPDSRRILPERSRIQAAIPLCAKVDATQGTCDGRRLRNEPQVRLEPASFMAEPVVPDAQVAPLLAPSAGAGTGGAESPVGARGGHAPGPRLHGEGVLGNLVADVLRASANADVGLMNPGGVRADLAAGPLTFGQVFEVLPFDNTVAVATLTGPELSRLLHLAYGNDMGSVFAVSGLEVTLERCPGPGRLSGVALAGGQPLVVDSRKMYRVALPDFLARGGDGLEPLLSTVP

SEQ ID NO: 19282 - protein, 313 aa, Myxococcus xanthus
RILGTASVLPGPAVTTAELCARVGRNAAEVARKTGILTRHFAPPGTKAADVAAQALRGALDAAGLEARALRRILCVTSMGGDVTTPATANRVAAALGLSGSCDAMDLSNACMGFLSAFDLAARSVATGLGPVGIVSVELLSRTTTPEEPRPYLVLGDAAAAAVMGAGRSGEGVLGVALGNDGTLPTDVVLENPTATGKLERMRFLTPSQEMTRVALDALVRAARAALDEAGVTLHDVEWVLTHQPNGSMLEAILQALEVSPERSVRVVDTVGSVGSASLGTSLDRLLRTRPVKPGHRILLVGVGAGVAHGAVL

SEQ ID NO: 19283 - protein, 253 aa, Myxococcus xanthus
ALILGASSGTGAAIAEAVTRKPGLNVFGVHRGRYAEGAVQLEQRIRDAGGRGVLWQADASSPEAAEAGVAALREVAGPRSVKLFVHSIAGASVGRFLSEGEDRLHARRIRRTFDTMAHSFVFWVQALVNEDMLAPEARLLGLQNPLDETHLGNTGLISASKAALEMYVRYLAMELGPRGHRVNLLKFGTVMTPALKHVYSPGALARLEAAHARMNPAGRMGTVEDVARFVTVLAGEEAGWFNGATIDFTGGMT

SEQ ID NO: 19284 - protein, 444 aa, Myxococcus xanthus
DIGGYAKVKQRLQQEILDVLAHKDTLSDPEAVKRVEALLPRGMIFWGPPGTGKTLFAKAMASSLGAAVQVVSGPELKSRWVGESEENLRQIFVRARQAAPSIIVFDELDSFASARGTYTGSGVEHSMVNQLLTEMDGFRKEELVFVVGTTNFVESLDPALLRPGRFEFQLCIPYPNSADRRAILSIYNQKLGLEMTERALDYAVKRTGDRVEGTGTRFSGDHIQALCRALARRRLREGAQGPTEAVDVERALTEFLDRPELTPMEERVVATHEAGHAVCALFCEHAPAIDRISIRGDLAGSLGHVQYADPAHRYVVTRGQLLDSICMLFGGREAEALLLDDLSLGSAHDLERATEIARELVEDLGMGGDGVPVRRFDAPGRQADRHALSDATRSTLEAAIQEVLAVQRARARDILQREKERVVALRDLLIERKVLDREAFTHLV

SEQ ID NO: 19285 - protein, 689 aa, Myxococcus xanthus
TTLKSESLEPHRMHAVGKVLTTDQGIPISDTDNSLKAGIRGPTLLEDFHFREKMMRFDHERIPERAVHARGAGAHGYFQVYKSLEKYTQARFLTDPSLRTPVFVRFSTVGGSRGSADTVRDVRGFATKFYTEEGNFDLVGNNMPVFFIQDGIKFPDFVHAVKPEPHNEIPQASSAHDSLWDFVSLVPETTHMIMWLMSDRAIPRSFRMMEGFGVHTFRLVNAAGKANLVKFHWKPLLGNHSLVWDEAQKLSGKDPDFHRRDLWESIERGDFPEYELGLQIIPEGDELKYGFDLLDATKLLPEELAPVQRVGKLTLNRNPDNFFAETEQVAFCVANVVPGIDFTNDPLMQARLFSYLDTQLTRLGGPNFAELPINKPVCPVTNHQQDGFGRQTIPTSRANYHPNSLGGGCPVLANPASAFRHTQERVEGHKIRARSGSFSDHFSQATLFYKSLSRPEQEHLVAALEFEVGKVERVEIRERVVNQILVNVDPELAVRVARAVGVTPPKATRPPKPSKAAGKKAAPSVEVSPALSMENSPHDSIRTRKIAALVSDGFAGKELDGVRKVLEERGATLELVGPTLSPVTSQEGREERPLRTFSTASSVMYDAVYVPGGEKSVAALLRVPLAVDFVREAYVHCKALALSADANTLLDAAGVRDLEAPPSKGLDATRGVSAARRWRRRASASSSPS

SEQ ID NO: 19286 - protein, 317 aa, Myxococcus xanthus
RAFVTGGSGFVGRHLLTALKVRGTPARALARSAAARASVTEAGGEPFEGDLSDVEKLKAGMEGCDTVFHCAAVVKGWGARSEFYETNVRGTERVLEAARAAGVKRLVHVSTEAVLADGSPLERVDETMPLPERPIGDYPSTKGEAERRVLSVNAPDFVTVVVRPRFIWGAGDTSLLPQFQEAVRTGRFRWFGGGRYLTSTCHVANCVEGMLLAAEKGRGGEAYFLTDGEPVEFRGFITAMLATQGVDAGERTLPYGVAATVASVGDLLWGTFGLGGRPPLTRTEVLLMGREVTVRDDKARRELGYEGRRSREEGLRE

SEQ ID NO: 19287 - protein, 336 aa, Myxococcus xanthus
LTIGVVGATGVVGREVLAALYAQDVPAEQVRVFGSERSKGMEVEYGEDSLEVEQATPDAFRGVKLVLLATPAEASRTLAPAAQAAGAWVVDASSAFRGDGNVPMVLPGFNTDVLGAGFTFKGRIVCLPGAVTTAAVHVVEPLRKAFGVARAQVTALMAASSAGVRGVAELEKQTADLLSGREPEPHAFPHRVGFNLVPQVGGFMVNSPWTEEEGGWTLEAARLFSSKGDVPVIAGTAVQVPTFYGHGLTLNVQLKKAGPVEQVRAALKTSGALKVLDVPGERVYPMPMLVTSDPAVHVGRVRAFPQAPEWVTLFASVDNASRGAALNLVEAGLRLA

SEQ ID NO: 19288 - protein, 318 aa, Myxococcus xanthus
VRGLRKHYKVHKRPPGLKAALRSLIHRSYTTVKAVDGISFDIRPGERVGFLGPNGAGKTTTLKVLSGLLYPSDGEVTVDGHVPQKREEAFLKKIMLVMGQKQQLLWDLPPAETFELNRAIYDVPQAQYKKTISDLIELLEIGDLIGKPTRQLSLGERMKCELAAALIHQPRVLFLDEPTIGLDVAMQATMRTFIKEYNEKYGATLILTSHYMDDVAALCPRVIVIDKGLLSYDGGLDALVQRVRPEKRVVLRLSEEVDAGRLSPLGRVVTHEPGTAVLQVQQEAVNATITRALSTLPVMDLTVENAPLEEVMSELFAE

SEQ ID NO: 19289 - protein, 426 aa, Myxococcus xanthus
PAPDTVPPSAASALRATGVSNSSVSLSWGASTDNVGVTGYEIFVNGSASASATTSGATSATVTGLAANTTYAFTVKARDAAGNRSAASNSVSATTTGTQPVGNKIIVGYWHNFDNGSTNIRLRDVSAKFNVIQVAFAEPVGGPGSGRMAFTPYNASVADFKADIALLKSQGRKVLISIGGANGTVHLDDATARQDFATTMQALIDTYGFDGLDLDLEGSSLSLNGGDTDFRNPTTPRIVNIIQATRQLLNQNGPGFILTMAPETAYVQGGMAAYGGPWGAYLPVIHALRDRLAYLHVQHYNTGTVMALDGRAYAQSTPDFHVSMAEMMLQGFPVGGNTGVMFPWLRPAQVLIGLPSSPQAAGGGYTTPANVHKALDYLLKGQSFGGTYVLRNPAGYPGFKGLMTWSINWDAFTNFEFSNSHRAYLD

SEQ ID NO: 19290 - protein, 95 aa, Myxococcus xanthus
KRLLDARASVRLLDVREADEYAGGRLPGALHIPRGYLELRIESQVQRDEELVVYCAGGTRSALAAKTLKELGYERVASLAGGYNRWSDAALPVEK

SEQ ID NO: 19291 - protein, 278 aa, Myxococcus xanthus
TLKGHDGPVNGCTVTPSGWVVSASDDKTLRVWELETGKELARMEGHEGWVRSCAVIPDGRVVSASDDKTLRVWELETGKELARMEGHKGPVWGCSVTPDGRLVSASFDEMLRVWELKTGIKLAQLVGHKGAVNGCAVTVDGRVVSASSDGTLRVWELETGKELARMEGHEGPVNGCAVTVDGRVVSASSDGTLRVWELETAKELARMEGHEQPVNGCAAAAHGCVLSACNDKTLRVWELDTGREVAQLEGHEGPVKSCAVTEDGWVVSASDDKTLRVW

SEQ ID NO: 19292 - protein, 473 aa, Myxococcus xanthus
GDYQWGEVEQQWRANRQDENWQGHGWQDLIVYEVHAKGFTADPASGVRFPGTYRGFGEKAAYLAELGITAVELLPIHEKPLDGGYWGYQTINFFAPELSYAAFKEPHQVINEFKWMVEQLHKHGIEVIIDVVYNHTGEGGLWREKLETDDVMPGEPLESLDPAETAGLYSFRGIDNQAYYALNPDLRTYWNNTGVGNQTRPNHRPTRKLIIDSLRFYVEELHVDGFRFDLAPILGERDGDYNRWDDPRNTVLQDVIDDPVLQKYNTRIMAEPWSAGGWYCMPLGEFPNAKTQPGNGWYEWNGRFRDWWRAFMNQDGWKLNSNEGSLCGRPGTVDGGFLMYGSQEWFERNGRRPYHSMNFITVHDGFTMYDLFAYDEKQNRCGPLNPVCCDTPNSPFCDKVSGEEHNRSRNWGPIGDERAESMRRQMIRNAFMSMMISHGTPMILGGDEWMRTQLGNNNAYSTLSDNPFNWYQW

SEQ ID NO: 19293 - protein, 406 aa, Myxococcus xanthus
  unsure (1)..(406): unsure at all Xaa locations
AVYFVMVDRFSNGDPKNDGAVDLEDAQAFHGGDLQGVIDRLDGLQQLGVRTVWLSPVFQMRTDKFHGYGAFHGNWVEGFGRVXPRFVQXALLKTLPWQLCCWDMRVVLYVVLNHVGPWTSLSRELPDWFYAVGPIKDWGDSRQLVMGYVHGLPDLSSGKEDVYAHLLAHSRRWVDVLQPAGFRLDAVKHMPTSFWARYNATCASTRGRTSCCLGEMLDGDPVLLSNTMKEGRFGTMFDFPLAFALVDVFCRDRSPSHLGAILFNDRLYPAPGSLVTMVDNHDLPRVMSECGGDVERVKRALAVQLTARGVPALTYGTEEGLTGAKEPENRGDMRFTNHPLRSWIGGLLALRRGSAALQRGETMILAAREDLFAYARVTADEVVVIAVNTRDSAVDVPLPDGLAGAK

SEQ ID NO: 19294 - protein, 343 aa, Myxococcus xanthus
AGPTPRFEVNDRLLRAARRQPTDTTPVWLMRQAGRYLPEYRAIRGNIAFLDLCKHPDLAAEVTVQPVTRLGVDAAIIFSDILIPVEAMGITLELGDKGPHFPDPVRSAADIDKLGVPDPVEGTGFVAEAIRRTRKALNDSVPVIGFAGAPFTLAAYMVEGGGSKSYILIKRLMFEQPELAHRLFGKLTDTLIPYLKMQVEAGASIVQIFDSWGGALSPWDYERFCIPYLKRMVSELKATGVPVIVFGVGMSSHLSLLKSTGADVVGLDWTLPMDEGRKVLGPDVAVQGNLDPLHLFLPREELDGRVKDILRRAGPEGHIFNLGHGILPPTDPDAAKFLVEAVH

SEQ ID NO: 19295 - protein, 421 aa, Myxococcus xanthus
RVAIVRGLRTPFVKAGSVFSGLTALDLGRLVVQELVQKTDLDPNVIDQVVFGQVIPTLTAPSIAREVVIAAGLPKKIDAFTVSRACATSIQALTTAANAIATGEADVIIAGGTESMSDAPIFTSRPLAHALVAASKGRSLPDKLKPFQRLKAKDLLPVPPAIAEYSTGMTMGESAEKMAKENGISREEQDRIAFNSHRNAAKAWKDGLFDNEVMHVVVPPKFDKTAERDNIVREDSSMEALGQLKPAFDRKYGTITAGNASPLTDGAAALLLMSEEKARALGYEPLGFLRSHAYAATDPGDQLLQGPAYAVPTALKRAGMTLADIDLVEMHEAFAAQVASNIQALASQAFAKKAGWSAPVGEIDRERLNVTGGSIAIGHPFGATGARIVTQAINELKRRNKNTAMCTVCAAGGLGAVVILE

SEQ ID NO: 19296 - protein, 492 aa, Myxococcus xanthus
LGERVLAALREARVTVWMTAQSANGQSLAVVVPRPDAEHARSVLVTELAQELSRREVEPLEVRQPVTLLTLVAETMGHGVNVAGRFFSALGAVGVNVRASAQGASSRSLSCVVDAADTAVAARTTHAAFNLAHQQVSLFVLGRGTVGGQLLAQLRAQQALLRDRHGIALRVVGLADSKRALFDAAGLTLDGVEARLEGVTPEAPQARTLVPLLDALRRLPVPILVDCTAAGGLEALYTEAFQRGIHVVAANKKPLALPWEAREALVDTARRNHVAYHYETTVASSLPVIDTLANLVRTGDTVRLITASLSGSLGFICNELTAGVPLSRAVRTARERGFTEPDPREDLSGTDVARKALILARELGLPLSLSDVALEPFVATDECASVDSFFQVLATQDAAYAERVARCRHAGTVLRYLARIDPSKAGTGSPVIRVGPVGVEAGHPAADLRGSESFVSFTTTRHSDFPLTVRGAGAGGAVTASGVLADILRISQ

SEQ ID NO: 19297 - protein, 357 aa, Myxococcus xanthus
MKLATALVHAGVRRDPTTGAVAVPIYQSATFQHPALGQSTGYDYSRTRNPTRSALEDALAQLEGGSRGLAFSSGMAALHCALQLFGPEDHILLTEDLYGGTYRLVDRILHVPCTFVDTSHPSAVRDALRPNTRAIVVETPTNPMMRTADLSELAAIARKAGVLLIVDNTFLTPWLQRPLELGADIVVHSATKYLAGHNDVVAGALVVKDAALGERLAYLQNGIGAILGPQDAYLVIRGLKTLALRMERHQANAREVAAWLRAHPGVERVFYPGVGGMLSFTVAHAALVPQVLASVQLCLFAESLGGVETLITYPTTQTHADIPAERREALGISDRLLRLSVGIEDSHDIIADLAQAL

SEQ ID NO: 19298 - protein, 358 aa, Myxococcus xanthus
TRLLHTGHEQDPTTGAAAVPIYQVSMFDQPGLETPGEFDYARSGNPTRKALEGVLAALDEGHAAFAFGSGMAAVSSVLMLFSAGDHVVVTDDCYGGTYRVLTRVFSRFGLQATFVDTSDPDAVRAALRPNTRALLVESVSNPFLKRTDIPAMARVAQAHGALLIVDNTFLSPALSRPLTEGADIVIHSATKYLGGHSDVVAGAVVVKTPALAQELGFLQNAVGAVLGPQDCFLLQRGIKTLQVRLERQVRTAGALAKWLTERPEVRRVFYPGTGAVVSFRLAQDTLAAPFVESLQLPLLGVSLGAVESIVTVPARHSHASVPVAERERRGITDGLIRFSVGLEDLEDLQEDFVRAFTQ

SEQ ID NO: 19299 - protein, 618 aa, Myxococcus xanthus
CQQSRVLLRSAAMNRKRPLNSLLRAAAVMVLPAFLGCAQDSQVTREAPTPAESPAAASQPSPAEAKAFAEKVNADLKSLWTKQATAEWIKSTYITDDTEQNAAFVNEEVLAYVNGAIKEARRFEGLTLDADTARMLHLLKVSQALPAPSDAERRSELAATAAKLEGLYGKGKYCGPDGKGKCRDLEVLSDVIAESRNFDELLDAWQGWHSVARPMRPLYERLVSISNEGAKDIGFNDLGTLWRSAYDMSPGEFEVEAQRLWGQVKPLYDDLHCYVRGRLAKQYGADKVPDGKPIPAHLLGNMWAQEWNNIYPLVEPFPGQASLDVDAALKQQKYDAMRMVKLGEKFFTSLGLKELPPSFFERSQFTKPEGRDVVCHASAWDVNFSNDLRIKMCIKPTEEDLVTIHHELGHNYYYTYYYQLPVLYQAGANDGFHEAIGDALTLSITPGYLQQAGLLKAVPKNEKNLINLQMKDALEKIAFLPFGLLVDQWRWEVFSGRVQPADYNKSWWTLREKYQGVAAPVARSEQDFDPGAKYHVPANVPYTRYFLARILQFQFHKALCEASGYKGALHECSIYGNKDAGKRLQAMLELGASKPWPDALQAMTGTRQMDATPLLDYF

SEQ ID NO: 19300 - protein, 280 aa, Myxococcus xanthus
VNAQLIDGKAVAARVRAEVKAEVDRLKLEHGLTPGLAVVRVGEDPASKVYVNGKKKAAEEVGFRSWELHPDEGITQAALLEVIHQLNADPAVHGILVQLPLPRHIDPDVIISAVKPEKDVDGFHPLNAGNLLLGRSTTRACTPYGVMRLLEEIGCDPAGKRAVVVGRSNIVGKPMALMLLQKNATVTICHSKSDLRREVEGADILVVAVGAAELVKGAWIKPGAVVIDVGMNRKPDGKLVGDVEFAAAAERASFITPVPGGVGPMTIAMLMRNTLDAAVR

SEQ ID NO: 19301 - protein, 353 aa, Myxococcus xanthus
MYGLTRSLLFQLSAERAHRLGMAGLHYLGRLTGLVRVPAREGPGGRPARPGRRSGRAALAHPVALAPRLDKDAEAVDGLFACGFSAVEIGTLTPRPQPGNPSPRLFRLPEHRALINRMGFNNHGATQAAARLRMQTWRPGPLGVNIGKNKDTPLEQAVDDYVACVDALAPLGDYVVVNASSPNTPGLRKLQEPEQLGQLLGAVQERLATVAPGKPLFLKIAPDLSPEAVDEVVDVARAQKLAGLIATNTTVARPFEHPLAKEAGGLSGAPVREPANAVIRRAWLRSGGALPIIGVGGVFTAQDVYEKLRAGASVVQVYTGFIYEGPGMVGNILPTLATLLARDGYKQVRDVIG

SEQ ID NO: 19302 - protein, 513 aa, Myxococcus xanthus
PPGSASVDTMPIVHDWLARRAALAPERTALIDADHGERRISFREWNDSASRTAAFLHHALGVGRGDRVAVLAYNCVEFLDLFFACAKLGAVLQPLNWRLSATELGGLLADAEPSVFVFGPEFRTQVEAVRSGASFVRHWLSLAAPGPSERAFSERDTQTDVALPPLELEEDAPWVLCYTGGSTGLPKAAVLTHRSITANAVNTVMGWGLTADDVAILNAPLFHAGGLSVFTAPLAYAGGASVVCRSFHVEGVFDLVRRGVVSLFFGVPTMFIEMQRHPRFDAVDLSRLKLVISGGAPCPAPVFERFFARGVDFKTGYGLTEAGPNNFWLPPEDVRRKPGAVGVPLFHVEARIDGETQPGDVGELLLRGPHLCAGYWRRPGDTARTFADGWLHTGDLATRDAEGCFRIVGRSKDLIISGGENIYPSEVESVLAGHPDVAEVAVIGVADPKWGETPRALVVARPGTSPSAEALLRFCDGRLARYKTPKSIRFVDALPRTSAGKVDRRTLGAAHGA

SEQ ID NO: 19303 - protein, 121 aa, Myxococcus xanthus
  unsure (1)..(121): unsure at all Xaa locations
MKGLVGKQGTATRGGIGQRSLELDPGGSRPSQRRVGDGEFRGEHSHPGPCSRTARPGARDEDARDGMDDEERGTQRLSPQSPSRGVTRSLEFREGRGECPYLQNVGHCLHLGVGHGRPEAX

SEQ ID NO: 19304 - protein, 317 aa, Myxococcus xanthus
VMKFGGTSVGSPTRLRQVVELIGKHARQGPLAVVVSAMGDTTDWLLDAAHLATEGDLEGALAVATRIADLAKANAAALAPGQATALAERVDGLLAPLRQLLHGVSLTRECSAPTRDRVLSFGELVSATLLAELLTAHRTPATFRDARQLLVTDDRFGAARVDLVRTRERLQAARETWGVEVPVLPGFIAATPDGRTTTLGRNGSDYTAALVAQGLGASEVTVWTDVLGLHTADPELVTDAYPVAHLTHGEGLELAAVGARMLHPRTMIPLIESGISLRIRNTMEPEHPGTLIDAIGSRDGQRPACIATREDLALLGI

SEQ ID NO: 19305 - protein, 445 aa, Myxococcus xanthus
  unsure (1)..(445): unsure at all Xaa locations
TFDSLGLKPALVEALSALGYEEPTPIQAAALPPLLAGKDLLGIAATGTGKTAAFALPLLNHVEPGACRPNTTSALVLVPTRELAMQVSEAIHRYGQKLGISVLPLYGGQVIGQQLRVLKRGVDVVVATPGRALDHLRRGTLQLDDVRVVVLDEADEMLDMGFAEDLEAILSGTPEDRQTALFSATLPPRIASIAERHLHEPVRVKIAREKVEQGEIPRVRQTAYVVPRAFKIATLGRLLDVESPTAAIIFCRTRTEVDDLTVSLNGRGWRAHALHGGMTQEQRDRVIKQLKSQGTDLLVATDVAARGLDIPRLSHVVNFDVPNAPEAYVHRIGRTGRAGREGVAITLVEPREHRLLRNIERVTGQRIEVATVPTVADMREKRQEMLRASLRRDAGDRXVRLPPQRGGEPGQRVRRHGHRRRRREAPPXGPGRGPRHGGDGDPRRR

SEQ ID NO: 19306 - protein, 210 aa, Myxococcus xanthus
KRARPMLARLFGGAVGVPAERLVDVAVAAELIHSASLLHDDVVDAGMFRRGRPTVNARWGNIVAVMSGDLILSTGLFQLSQLDARLTRSALSVVSEMTRAAIAEVEARGDLDLPLNRLRFIAEGKTGSLFGWCGNAAATLAEHPEAVERFDGFGRHLGVAFQIADDIRDILGTDVGKPRYADVHSRTPSMPILLAVAKDESLRRKLKDAW

SEQ ID NO: 19307 - protein, 735 aa, Myxococcus xanthus
PSEEAQPDKAQVDAELQRVVELRHPEPHAVLGIHPDGDGVVIRAFRPDAVAIHVLPESGGRVAMTHRPGGVYEARINGKDQTFNYLLEVEYPGKRVFTLRDPYSFLPTLGEMDLYYAGEGRHERLWERMGAHLLHHHGVRGTSFAVWAPTAAGVSVVGDFNGWDGRLHSMRRMGSSGIWELFVPEVGEGTRYKFEIRPGQGGPNVLKADPFAFRTEVPPATASVVHDLARYTWGDAAWLEQRAQRRDVHHQPWSVYEVHLGSWRRVVEDGDRPMTYRELAPALAEYIKFTGFTHIELLPVAEHPYGGSWGYQVGGYYAPTARFGHPDDLRFFIDHMHQEGIGVLVDWVPGHFPRDLHALGQFDGTALYEHADPRKGAQPDWGTLVFNFGRNEVRNFLIANALFWIEEYHIDGLRVDAVASMLYLDYSRKQGEWIPNRWGGRENEEAIHFLRELNETVHRKHPGVVVIAEESTAWPKVSAPVSEGGLGFDYKWNMGWMHDTLSYFSKDPIYRQYHHNQLTFGLLYAFSEQFMLPLSHDEVVHGKGSLYGRMPGDPWQKRANLRALFAWMWAHPGKKLVFMGGEFGQPAEWNHDKSLDWHLTHDPGHHGILQLVSDLNRIYRDMPALHDADGEPMGFQWLQPDSAAYNVFAFVRRARQPGRHVVCIANLSPTVRENYRVGFPFQGRYVELLNTDAEQYGGSNLGNMGQIHTEPTGWDGQPASATLTLPPLSVLWFTP

SEQ ID NO: 19308 - protein, 1108 aa, Myxococcus xanthus
EDKGPVELRVLKPENLDAFIRAQGDLRRAYQTPPTLKNPGRALSRGFNAVRTPGMFLLDTLSPAFRDEVGEVLPRAPQASGSGEPLAKVAEGPEAPGGRAARLHGDAQPVAEPGPGRRRAGLQRPRLQRQWLQRLPGAPVTLAPLPAGTYVLQLVQGRVEGQVVLVVSDLTVQLKQTDGQVLLRVAGRDQKPREGAEVQVYLPKGKGPAGKTNAKGEVTLEVSEPRVIATATAGGDTAIVDTDFYSALAVAPDVFIYSDRPIYKPGHEVKFRGVVRQPDTFLARLFTPKKRQVQVKLVSQEGRALTTRAAVDEFGAFHGTLKVPDDLGTGVLRVEAEVDGHPHQGEARVQDYVKPTFYLEMEPASETVVPGQTLRAKVRARRYAGGTPDATKYEVFLYRSLLDAPAWVDDAGKGGQGSDVTYGSASTTEGKLSVPERLYSSVEARGAYEDPWSSASAFDANGEAEIEVAVPALAAGEERLPYRYSLTVRARDDQETFANATSAFFLSKVEVLGLARYSDAVVAKSGDATLAIRATTLSGKPYGVTQGEVEFVLRKADGSEKSLGKRSFSTAADGTHREKVPTSDVGSVLARVVVKDKNGETWQGEESLLVIGGADEPVARVPNLTLASLSGTLAPGDTAKLVALMPDSWGSGGRDAGPVWVTLSGASLYDTQVVELTGRTLVHSFNVEKRFGSAVYASVAYPTATGRWEERTVAFRVIPRERTLTVELQPRRAEATPLTEQSIDVRVVDHEGRGVVAQLSVGVVDKAVYAIQSEFRPRVLDFFYPPARNNVSNFFSSEFQGYGYGEALARKMAGLPDHAFASIKPPSRQTKDLERDTAHWDPAVVTDRDGRATVRFTLPSNQTLWVVTAVAADTSGRFGEGTSEFATRGGLNLYAALPQFLREGDEAVASVRLSAGEKSPASQLLDVKLASLGALKADQFEHKVELAKGGEQVVPLTLKASSTGAAQLTVNVAGGKDSLRDLKRFDVGPAAVEDVVKVSAWGGGALEVPAPQEATLARVELVLQPSIVDAALSNVRELLTYPYGCLEQLVSTTVPNVAVYQVLQKAGALAKLDTDTQALLAEARSRSVQGTARILDMSVKGGGFTWFG

SEQ ID NO: 19309 - protein, 745 aa, Myxococcus xanthus
LLWFSELSREDVALAGGKGANLGEMTRAGLPVPPGFVITATAFQEAMAPVRARLQALWAQVDPDDPSSLTQVTQQLREHVRSAPVPERLRAAILEAYQQLGADRAVAVRSSATSEDSAATSFAGMHESFTHVLGEDALMDALRACWASAYGERVVAYRKAEGLTEEPAIAVVVQAMVDAARAGVMFTADPSSGDTGRIVIEAAWGLGEVVVGGQVEPDTYSVSKKEPCVREVRVGDKSVRLVRNAEGHTQRETLSPEQAHERVLSDVAVLELARLGLRVEQHYGAPQDIEWAEERGRLFLVQTRPITTLGKSAVPPPEEGHAGKALVQGLGASPGVAAGRVRVLASPAEGRQLQPGEVLVAEMTSPDWVPTMRRAAAIVTDRGGMTCHAAIVSRELRKPCVVGTRTATRTLRDSEAVTVDGSMGEVREGQEAPRPRAVEVPATASTVGTAPVLATRLYVNLALPAQAREAAALPVEGVGLLRAEFMLTEALGGVHPRKLIAEGRRGEFVERMAGALLQTTRAFHPRPVVYRTTDFRTNEFRGLEGGAEFEPEESNPMIGFRGAYRYLREPDVFNLELEVLARVREQTPNLQVMLPFVRTLWELEACLELIARSPLGRQRGLKTWVMAEVPSIVYRLHDYAKCGIDGVSIGSNDLTQLMLGVDRDSESCAELFDEADAAVLAAIGDIIRGCEEAGLTSSLCGQAPSNRPDFAEHLVRAGITSISVDPAAVLATQRVIAAAEQRLLL

SEQ ID NO: 19310 - protein, 351 aa, Myxococcus xanthus
MRANVFQAVNRFGIEEVERPRAGAGEAVIRMTMTTVCGTDLHIVRGEYPVRPGLVIGHEPVGVIEELGPGVTDYRPGQRVLVGAITPCGQCRACLSSHLSQCGHGAGYEALGGWRMGNTQDGAQAEYIRIPAAQANLAPIPDGLTDEQVILLSDIASTGFSGAEAGSVRIGDAVVVFAQGPIGLCASIGARLMGASLVVGVDGDEARMKMAQRMGVDVVLDHRQQDVVAEVKRLTGGGADVAIEALGTQQTFESALRCLRPAGTLSSLGVYSGKLQLPYDAFSAGLGDYRIVTTLCPGGKERMRRLMDLVHHKRVDLSPLITHRFKLADIQEAYALFGERRDGVFKVAIQP

SEQ ID NO: 19311 - protein, 437 aa, Myxococcus xanthus
LQEYGRDWTRVYAPAPAAVALPRTTDEVARLLALCHQHHIAVVPSGGRTGLAGGAVAARGELVLSLQRMTRMGPVDLLGNTVRVQAGAVTEAVHHHCAEHGLTWPVDFASKGSSTVGGNIATNAGGVKVIRYGLTRQWVLGLQVVTAQGEVLELNGALEKNNTGTDLRQLFIGSEGTLGVITEATLKLTQLPGKQDVFLFAVPDVAAVLRLFRDARRQNAFSISAYEFFTDRCMARLGRHRKLRPPFETPSECYVLLEAEAKDAAAVEGWLGSLFERELVTDGVQAQGAAQAAELWALREGISESLSATGLPHKNDISLPVAGLEAFCAELEALFSARYPGWEICLFGHIGDGNLHVNVMKPDAMDKAEFLAHTKQADPTMFALVQKHGGSISAEHGVGLLKKDYLGYSRAPAELALLRTLKRALDPRGILNPGKVV

SEQ ID NO: 19312 - protein, 246 aa, Myxococcus xanthus
SKTVVVTGASRGIGRAVALGFAKAGHDVWALARSTEALESLRQEGGERIRPLAVDVADEAALIAASQRILAEGPPRVLVNNAGITVSAPLAKTRTEDLARVMAVNVTAPFLLCRELMPAMAQAGGGRVINIGSMAAVRGVKYTSAYCASKHALLGLTRALAVEYAKKQVTVNIVNPGWVETDMFAGATSAISASTGRSEEQAREALASMNAMGRIITPEEVAALCLFLASDAAGGITGSAYAIDGG

SEQ ID NO: 19313 - protein, 291 aa, Myxococcus xanthus
PKQVDVYEVGPRDGLQNELRTLPTRDKARLINALVAAGEKRIEVTSFVSPKWIPQLADAEELLRLVGRRDGVVFSALVPNLKGLQRAKKRGLEETAVFISASEAHSKKNINKSIAEAVVGAREVTASALQAGMRVRGYLSTVWGCPYEGDVPVERVVDICRQLVDAGIYQLSLGDTIGIGTPRQTEVILEALLKHIPVEKLALHLHDTRGTALANALVGLSAGVTTFDASIGGLGGCPYAPGAAGNLATEDAVFMLHGMGVDTGINLDRLVEAGEIAQELIGRKLAGKYLQ

SEQ ID NO: 19314 - protein, 377 aa, Myxococcus xanthus
KATGLYPYFRAIEASHGATEVEIEGKRVIMVGSNNYLGLSADPRVKEAAIKATEKFGTTSSGSRLLNGTLALHEELEARLAKFLNRESAIVISTGFQTNLALASILGRHDIVFSDRQNHASLVDGIRLSFATERKFRHNDMDHLEQLLSQADPDAGKIIVTDGVFSMEGDICNLPRIVELAKHYNARVMTDDAHAMGVLGTRGRGTSEYFDLEKETDLVMGTFSKSFASLGGVLAGPFEVINYIRHKARSVIFSASMTPGSIAAALKALEIIEAEPERRARLLDIAEKMHNGFRAMGFDTGVSVTPVVPVHIGDQVKCFRFWRALHEAGVFANPVIPPAVEPGHALIRTSYMATHTDAQLDRVLDTFETIGRKLGVI

SEQ ID NO: 19315 - protein, 582 aa, Myxococcus xanthus
LDLTILHINDHHSHLAGSSLELNVTNAAGDTVAAEVESSGFARVTSAMKELAAGKENVLKLHAGDALTGTLYFNRAGQIGEADAAMMNTVCFDAFTLGNHEFDKGDTELKRFIDRLHAGQCQTPVISANVQFGAGSALHTSRAAGYVEPFTVVERGGQKIGLVGLTIAGKTKESSSPDADTTFEAEVPAAQRAIDALRAQGINKIIVMSHIGYQLDRTIIPQLSGVDAVIGGDSHTLLGPAAMETFNVGTPAGPYAESLRNRDGETVCLGQAWQYSQVVGEMTLRFDAEGVVTSCGGTPHVLIGNQFSIDGTPVSESDNAAMLASVAVSGFLRVTQPDAAAAQVLAPFQGRIDEYSRTVVATADDELCNRRVPGNTEPGRSSVSCNALGEVHSRGGDIQQLVAQAYLEVANADYGGADITLQSAGGVRRPLQGPVTAADVIEVLPFGNMLFRLDVTGTEVKSMIEDGLHATFREGGTTGPYPYTGGLRFDVNAAHARGQRASNLEVLDQTTGQWNELQPTATYRLFVLSFNATGGDGYVTLANVPAERRSDIGVLDADVLQTYIDRQAERKPGTNLPVLHKV

SEQ ID NO: 19316 - protein, 259 aa, Myxococcus xanthus
RTDCGHPLRSHRRIHMSGIEGKVIAITGASSGIGEATARLLAKRGAHVVLGARRTDRLETLVSAIRAEGGSARYRKLDVTKRDDVESFMGFVRAEHGRIDVIINNAGVMPLSKLEALKVEEWDRMIDVNIRGVLHGIAAGLPIMQAQRSGQFINLSSIGGHQVVPTAAVYCATKYAVIAISEGLRQEVGGDIRVTVISPGVTTSELADSISDPVAREGMREYRRVAIPPEAIARSIAFAIEQPDDVDVNEIIVRPTAQS

SEQ ID NO: 19317 - protein, 202 aa, Myxococcus xanthus
MKLFYSPGACSLSPHIILREGGFSFTTEKVDIRAKKTAAGEDFHAINPKGYVPALQLDDGSLLTEGPAIVQFLADQVPDKKLAPANGTLERYRLQEMLNFISTEIHKGFSPLFNPAFPDDVKRLTRERLAQRLGVLEVVVAKQAFLLGDQFTVADAYLFTTLNWAGHTKVDLEPFPALRAYHARVADRPSVQEALKAEGLAK

SEQ ID NO: 19318 - protein, 204 aa, Myxococcus xanthus
  unsure (1)..(204): unsure at all Xaa locations
MASNTGFTLWLTGMSGTGKSTTAAYIAARLRQVGRNVEILDEGELGEALWAGLGDGKEDRITVVKRLGFVANLLTRNGVAALVPCVSPYKPGREENRRSIGRYVEVYVDCPTEKLIERDSTGRYKKALNGEIPNFIGITEPYEPPNSPEVTIHSNVESVEDGARRSSSRFWTSATXAPRSXRSSPARRXRPTRSPRRGRRLRRP

SEQ ID NO: 19319 - protein, 193 aa, Myxococcus xanthus
PEALLRAAEKGDAATVSELLRQGVAVHARDSAGNTSLLLATDGNHVAAARSLIEAGANVNLQNRQLDSAYLLAGARGYLEILRLTLKNGADLKSTNRYGGTALIPACERGHVEVVKTLLQAGVDPNHVNRLGWTGLLEAILLSDGGPRHQAIVRLLIDGGADVNLADGNGVTPLQHARERKQDAIAKMLVAAG

SEQ ID NO: 19320 - protein, 262 aa, Myxococcus xanthus
QEIVGGIEARPHSFPWIVSLQQGTSHFCGGALVRVGAKEESDIVLTAAHCFYDGTSNVTAVAGAHDLYRPTAGQATARVVRAVLHPQYNPDTTMNDIAVLKLDRPIKFDQAVAGACGQSSTMRPNLAAPVRIWRHPRPVCLPASGDRVADNTMATVAGWGLTREGGYDTSSLLLQVGVPTLNHRDVANSYRPHGITINEQAMFGAGYKEGGKDACQGDSGGPLIVPGPQGYVLQGIVSFGVGCARAGLPGIYTRVSNYIPWI

SEQ ID NO: 19321 - protein, 366 aa, Myxococcus xanthus
SGNTSLGVALYQRAIQEKQNLFFSPYSVTQALSTVYAGARGNTEAQMAQALRFSLSQSRHHPTANALERALAKPASPPPASGTPPTFHSLNSAWGQQGMTFHDGFLDTLARHYGAGMRLMDFENDAAGARAEINRWVEVNTRDRIQDLVNEESLPNATRLMLINAVYFKGAWSWPFREQGTRNAAFRALDGTSHQVPTMSGGRGQYMEGDGFEAVTLDYAGGTFRMVLVVPEWERFEEVESRLSPAFFKDVRARLENHQIDIQLPRFQIESELPLIPALQALGMEDAFTEGADFSAISPTKLRIATVNHKAFVAVNELGTEAAAATAVGMVPVSLPKPIHVNRPFIFVIEHVATQNVLFLGRFVKP

SEQ ID NO: 19322 - protein, 354 aa, Myxococcus xanthus
FDSSDDLDSALDGKDYAYARISAPNTTLLEEAVAALEGAEDCVAYASGMAALRSVFEAQGFRAGDKLVMPADGYGVTRALYKSLCATLGVELHAFLMTDPEVPERIRALKPRMVLAESISNPLLRVPDLRVLARACQDVGATFVVDGTFPSPVGQRALALGADYAVQSTSKWLNGHSDALGGTVSASRERMAPLRAARVLAGDVLGPFEAWLTLRGLRTLPVRMKAHVEHAAHVARRLMESPLLERVIYPGLTSHPDHATAQELLLGGGPMVAFEIKGAGRPESMRFLEALKVGRPGPSLGDVCTLVMHAASASARRFTPEEREAAGIRENLIRVSVGLEDPDDIVDDLLAAVA

SEQ ID NO: 19323 - protein, 437 aa, Myxococcus xanthus
  unsure (1)..(437): unsure at all Xaa locations
VDTRDMSKANNPWPRAEFVKRAPGLAWKEFFDAAGLGTQEQVIVWQPSALTVLSKLAQSEPLQAWKDYLAFHAVARADPYLPKAFVDESFAFNGKTLSGTPAQKERWKRGVDATNLSMGEAVGKLYVAKYFPPEVKAEAEAMVRNIITAFEKRIDALTWMSPETRTRAKEKVGTLQASIGHPEKWRDYSGLDIVAGDAYGNAERAVRFEYQRNVAKLGQPVDRKEWYMVPQLVNALNSPQQNSIIFPAAILQPPFFDANADPAVNYGGIGAVIGHEIVHSFDDVGAKFDARGKLENWWTKEDEAKFQAAGKALAXQYNDYRPLPDLSVNGELTLGENIADMAGVAVAYDAYQLSLGGKPAPVIDSYTGDQRFFLGFGQVWRAKYREPYLRRIIMTDGHAPGPYRTATVRNLYAWYGAFDVKPGQTLFLTPEQRVRIW

SEQ ID NO: 19324 - protein, 348 aa, Myxococcus xanthus
LIGATGLAGQQFIAALKNHPSIELTGLAASPRSAGKTYAEALKTASGMTAWFVPEPLPAELAGMKVVAGDALEAKDYDLVFSAVEADVARELEPRLAKDIPVFSAASAFRYEDDVPLLIPPVNAAHAPLIREQQRRRGWKGFIVPIPNCTTTGLAVTLAPLVERFGVKAVLMTSLQAMSGAGRSPGVIGMDILDNVIPYIPKEEHKVEVETKKILGALRPAGDGLTPHDVRVSCTCTRVAVMEGHTESVFVSLDKKATVAEVTQTLREWKGAELARNLPSAAPRWIEVLDDPFRPQPRLDRDTHGGMATTVGRIREDGVLENGFKYVLVSHNTKMGAARGAILVAELL

SEQ ID NO: 19325 - protein, 377 aa, Myxococcus xanthus
LYLEEHDAFRRTVRAVVEKEILPFVKEWEAREAFPRELFTRFGELGFLGLKYPVEYGGSAAGELYEAVLLEELGRCGSGGVSAGLGAQFTISTGPIHQFGTDAQKLRWLAPAIRGEKIGALGITEPDAGSDVAGLRTTARREGDSYVLNGSKTYITNGVRADFVVLAVKTDPSAGHKGLSMVVVEKGTPGFSVGRKLDKLGWRASDTAELFFEDCRVPAENLLGVEGQGFAQIMGNFQWERLSLALGAVGAMEHMLETVLAQVKSRRAFGQSLHQFQVVRHKLAELFTARESARQLTYHALRLHVAGEWAVAQTSMAKKVATETCCRVADECLQLHGGAGYMMEYDIQRHWRDARLGPIGGGTSEVMNEIIAKQLGL

SEQ ID NO: 19326 - protein, 263 aa, Myxococcus xanthus
LRVLRVERPEGTRVRVGPVEVGGPGFVVMAGPCAVEGAEQVQHAASVVAAAGAHVLRGGVFKPRTSPYAFQGMGEPGLHVLAEAGRRHGMPIISEVMESAQIPLMEESTDILQVGARNMQNYSLLRALGKVRKPVLLKRGLSATLQEWLLAAEYILDGGNEQVMLCERGIRTFETELRNTLDLAAVAWAKQRSHLPVIVDPSHATGDPALILPMSLAAAAAGADGLLIEVHPKPEQAMCDGHQALTPERFETLMRRLPAVLDA

SEQ ID NO: 19327 - protein, 334 aa, Myxococcus xanthus
NTFGELFRLTTFGESHGPALGAILDGCPAGVPLTREQIQVALDRRRPGQSTITTARSEPDQVELLSGVFEDKTLGTPIAAIVRNTNQRSGDYEKLKAEDRPGHADAVWRERFKHRDHRGGGRTSGRETLCRVIGGAIAEAYLARDVPSIRTVAYVSQVGNLVAAVPAPGLTREQVDAHATRCPDVAIRDEMSRRILTAKEAGDSLGGAIDVRVEGLPVGLGEPIFGKLKARIAQALGSIGAVTGVVWGPPDLLERIGQPGIQFHAVKDAYGGIQGGLANGEPMQIRTFFKPPATLQEHAKGGRHDPCIMPRAVPVLEAMVSLVIADLVLHFNAR

SEQ ID NO: 19328 - protein, 303 aa, Myxococcus xanthus
LMIQVEGLTKYYGEHAAIRELAFTISQGEVIGFLGLNGAGKSTTLKVLGCVLMPTSGRVVIDGHDVVSNAHEVRQRIGYLPDVPPLYDEMTVGEYLTYVAQLRGVTSRDTASRVGEAEEKTGLRDVHGELISTLSHGYRQRVGVAQALVHKPALLILDEPTSGLDPRQIVEMRDVIRGLKGAHTVLVSSHILPEISQTCDRLLIIHKGMLVAQGTEEELAAKMGGRGTIELEVRGDKARAVEVLQRFGSVEVDRASDGLVALTVRASPDQRPQVAQAVVGAGLELLRLDQGAGQLESIFLRLT

SEQ ID NO: 19329 - protein, 371 aa, Myxococcus xanthus
EQASAPKSQFLANMSHEFRTPLNAILGYTNMLLQGVSGELNPAQKRNLTRIDSNGRHLLEVINEILDITRIEAGRMPLNLSDFGIPELLQEVMAEMDPIIARSKLTVSAHLGPRVPAVYSDRQKVKQIVLNLLSNALKFTHEGSVQVQAEYVAATSTLTISVTDTGIGIDPANQEKIFEDFQQVDSSPTRAYGGTGLGLSICRRLATMLGGRVTLQSTQGEGSTFHPALSQTREARMMNPSETPKPLVLVVDDYQDAREMYAEYLEFSGFRVAEAKNGQEALDKAFELRPDIILMDLSLPIMDGWEATRRLKGDDRTRAIPVVALTGHAMTGQSDEAKGAGCDSFVTKPCLPDALVDEVRRVLAPTEAHRR

SEQ ID NO: 19330 - protein, 475 aa, Myxococcus xanthus
MRRAKIVCTLGPASQSQEMLEALLENGMDVARLNFSHGSHEQHAENIAKLRAASLKVRKAVGILGDLQGPKIRTGRFVKGSTELKEGGTFHITTDETVPGTDEIVSTTYPFLAADVNPGDRILLDDGLLELKVLETDKQKLIRTQVIHGGTLKNNKGINLPGVAVRAEALTPKDREDLVFGIKAGVDYIALSFVRQPSDLDTARQAMAEVGRTVPIIAKLEKPEAIARLDAILDKTDGVMVARGDLGVEIPPEEVPAVQKDIIRRSNLRGLPVIVATQMLNSMIDNPRPTRAEASDVANAVFDGADAVMLSGETASGKFPIESVQMMERIILAAESSARTTQSLMRVLETPVGLPNHFPDVIARVACEAAKASNASLIAAFTLSGVTARLLSHYRPPVPIVAFSPNQEVRRRLSLLWGVVPRVLEPTQDTEAMVKRVEEELLARGLGRKGDRIVIVFGAPVGQPGKINSLRLHTI

SEQ ID NO: 19331 - protein, 417 aa, Myxococcus xanthus
FPADFTFGVATAAYQVEGGIENDWAEWERAGKLKEPDARCGPAVDHWNRYEEDYALARAVGATAFRISLEWARIEPERGRFDEAALESYRERLLKMKAHGLRPVVTLHHFTHPTWFHRETPWHQPASVDVFRRYAKRCAALLEGLDALVISFNEPMVLLLGGYLQGAIPPGLADGPTTMRAMENLVRSHVAAREELLSRLGRVELGISQNMLAFAPDRWWHPLDRALVRLGAQAYNHAFHEALATGKLRVTMPGVASTRVDIPGARDSVEFIGVNYYTRAHLRFVPRPPFIEFKYRDIHGRGLTDIGWEDWPEGFLQTLRDVKRYGKPVWITENGIDDRVGVRRPHYLHSHLAQVLAARAQGVDVRGYLYWSLLDNFEWLEGWGPRFGLYHVNFDTLRRSPTPACDYFRAVATGRKL

SEQ ID NO: 19332 - protein, 256 aa, Myxococcus xanthus
RLNWLSSIPFFAVHLMCLFVFAVGAKPVDVAVCVGLYVVRMWGITAGFHRYFSHRAFKTGRVFQFILAFVGSMSAQKGVLWWAEHHRHHHRYSDQAEDIHSPLQKGFWWSHAGWILSDKYNDTRMEGIKDFARFPELVWLNRFHLVPSVLLAVALYFIGGFSMLVWGFFVSTTLLWHGTFTINSLSHIFGKRRYKTTDTSRNNWLLALLTLGEGWHNNHHFHQNTANQGWFWWEVDLSYYSLKVLSWFKVVEGLRL

SEQ ID NO: 19333 - protein, 441 aa, Myxococcus xanthus
VEKQRARFETRATLPLAWRREQLQVLERAARKYEAEILAALQSDLSKSPEEAYLTEVGSIYGELKDALKNVKAWMAPRKGAAPLAIQPARVWQYSDPLGVTLIISPWNYPYQLAIAPLIGALAAGCTAVLKPSELSPATSAVLARMLKEAFPEDVVAVVEGGAEESRALLDERWDLIFFTGGPQVGRVVAEAAAKHLTPTVLELGGKSPCIIDKSADLEVTARRIAWGKYLNAGQTCIAPDYVLIPPELKGRFTELVQKAVTDFYGANTRESRDYGRIISSRHFERVSKLAQDGTVAFGGERDADSRFFAPTVIIDAPLSSPLMQEEIFGPLLPVVDCPSIDEAIRFVRARPKPLALYTFSKDAAVNERVLTETSSGGAVANDVCVHFAAKDLSFGGVPQSGSGGYHGQPSFDAFSHRKGVVKRPFLLDLKLRYPPYTGKL

SEQ ID NO: 19334 - protein, 403 aa, Myxococcus xanthus
VSQEAFIFDAVRTPRGKGRKGALHGTKPITLLTGLVDALKKRHPNLDPQRIDDVVLGVVSPVGEQGADIARTLVLAAGLPETVGGVQLNRFCASGLTAVNMAAQQVRSGWEHLVIAGGVESMSRVPMGSDGGAWAMDPATNFDTYFVPQGISADLIATIEGFTREDVDRYAARSQQLAAQAWAGGYFKNSVVPVVDQNGLTVLDHDELMRPDSTVASLGKLNPSFSVMGEAGGFDAVALQKYHFVERIEHVHTPGNSSGIVDGAALVLIGSEQVGKSLGLTPRARIAAVATSGSDPTIMLTGPIPATQKLLEIAGLSVKDIDLFELNEAFASVVLKYQKDLGIPDEKLNVNGGAIAMGHPLGATGAMILGTMVDELERRKARRAVITLCVGGGMGVATLIERV

SEQ ID NO: 19335 - protein, 558 aa, Myxococcus xanthus
RDLTALAREGKLPAAHGVDAAVTEVLGLLTRGGKHPLLAGEPGVGKSALVQEVARRIAEGRVDAELANARVVEVSVANILARSTQRQAAESFEELLAYLSRHPRPIVYIRDLPAALGGPLAPVAVRGLRTGGLRFIFETEPKRVQELLRSDEALAERLHLLPLHEPPTEKARWVLGRVAEELERELRLPIDPAACDLALRLSSKFLLAQRMPRKAIELLKETAAEAASAAKDHVGPEDVLTRFCAATRLPRFVVDDAMPLDLDETERFFGERLLGQTDAVGAVLRSVALLKAGLNDPRRPLGVFLFAGPTGVGKTQLAKLLAEYLFGSADRLVRLNMADYPNDGDESVPFGATWAPALETRRGELSALLDGKVFTVLLLDEFEKAARSVHDRFLQLFDEGTFVNGAGETVSCNNTLIVATSNVGAEVYRESGMGFTGARRAEEMVPEVDRRIGEAFRPEFLNRFDAICHFRPLSKVDIRKIAQREVGRVLEREGIRARALDVEVTPAVVDLLVERGYSPQFGARYLQREIEKTLTAALAVEIARRPLPPGTPVRVEAR

SEQ ID NO: 19336 - protein, 235 aa, Myxococcus xanthus
ALELQGLSKRYGEFTALHTVDLAIRPGEIFALLGPNGAGKTTMIGSVCGLVKKSSGSIRVFGKDLDQDPVGPRYDIGLVPQEINFDPFFTVAESLRIQLGFYGRPADEARIDEVLTALNLHAKKDAYTRALSGGMKRRLLIAKALVHKPRLVFLDEPTAGVDVELRRDLWTYVRKLASEGTTIVLTTHYLEEAEELADRVGIINEGRLLMVEDKATLLRRFGERRVIITFEQPQP

SEQ ID NO: 19337 - protein, 459 aa, Myxococcus xanthus
FSALALSPPLLQVLEELDFKTATPIQAQSIPVLLQGRDLVGQAQTGSGKTAAFALPLLQKVQLQHRKVQALVLCPTRELCAQVAGEIRRLGRRLPGLQVLVLAGGQPIRPQLEALEKGAHLAVGTPGRVMDVLDREALETRQLSTVVLDEADRMLDMGFREDMERILGAMPPRRQTVLFSATFPPDIEALSRDFQRQPVRVTVEAATAGPDIQQVRYDCEPGDKQALLLRILRHYQPASAIVFCNLKATVVELKKSLSASGVSVDGLQGDLEQFERDRVMAKFRNQSTRVLIATDVAGRGIDVEALDAVINFDLPMQAEPYVHRIGRTGRAGRAGLAVSIVTPRDGRKVDDIQLATGVKLERGDVESLPSADPRNAVSLESTWDTLYISAGRKDKMRPGDILGALTGEAGGLEATDVGKIEIQDHVAYVAVARRVSRVAFQRLSEGRIKGRRYKIERVK

SEQ ID NO: 19338 - protein, 202 aa, Myxococcus xanthus
MKVYGLPMSTATRSVLTTLAEKGQEAELVVVDLTKGEQKSPAYMEHHPFGVIPAFEDDDGFKLYESRAIIRYLDRKLPGPSLTPSDVHAYARMEQFISVEQCYFSPSAMKVIWERLFKKVMGGGTPDEARISEGLQGVERVFGIIEPVLGKQQYLAGDGFSLAEVTWMPYMDFFVAAGGAELVGKYPNVAAWWERVRSRPSW

SEQ ID NO: 19339 - protein, 288 aa, Myxococcus xanthus
IRKCVIPAAGLGTRFLPATKAVPKEMLPIVDTPTLQYIVEEAVSAGIEDVVLINGRGKGAIEDHFDIGFELETTLRARGKDSEADKLRAIADLVRVVSIRQKEPKGLGHAVLCAKSVIGDEPFGVLLGDDMIDAEEPGIRQLARVYRQYNQAVIALMEVPESETHMYGIAAGTDLGDGVMRIDRIVEKPKKGTAPSNLAVIGRYVLPPDIFPILENQTPGVGGEIQLTDGLATLQQSKGLLGYRFKGQRYDAGDKVGYLKANIAYALKRPDLRAGLLEYMREVVKTEK

SEQ ID NO: 19340 - protein, 581 aa, Myxococcus xanthus
LRELLKASRPYHRMLLLAMAATVVSRAMQVGYVALVGVLTDSLLSPHRVMLFGRRLPIGRLGLGKVAAGLVALIAGCSFFEYVSRILWMRAAHRITHDLRLRLYEHVQSLELKAFADTSRGNYLTLLNEDLNRIELLFSSTWGVWNEVAYATCSTVGFFLVSPGFAGLAAVPMPALLLLAQSLEKRIRPRYAALRQQAGVLQGVLNNNIDGIPTIRAFGAERMAARWVDEASVGFRGEQDAATQIHSSYNPVVLAAANTLRMVTALAAGFHASRGHLTPGTYVSLVILSTSLSLPMLSVARDFPHILSTLASLSRVFKAFELPRERRDEGAALDAGAVRGAIRVEDVRFGYHPGLPVLDGFSVDIPAGKMTAFVGETGSGKSTLAKLLLRFHDADAGHILLDEQDIAGLRRGDVRRAIAYVGQDIFLFNGSIRDNIAFGMPDVGLEAIQEAAQRAGAHEFIMQLPQGYASHTGELGQKLSGGQRQRIGIARALLLRRPILILDEVTSSLDAVTEAQLLRAWSEVLAGRTVIVVAHRLSAVRDAHRIHVLERGRIAESGSHEELLGRGGRYARYWDLQVNQK

SEQ ID NO: 19341 - protein, 475 aa, Myxococcus xanthus
ANTQPTADTERIRAVFEAQRAHRWTMSRTTAAERIARLKRLREAIIARRAELADAIHADFRKPAMEVDLTELHPTLEELNHTVRHLKSWMKPMRVGTPMLLAGSSSHVRYEARGTVLLLSPWNYPFNLLVSPLVAAIAAGNTVICKPSEKTPHTSRFLAQLVKDVFPENEVALFEGGAETAEALLELPFDHIFFTGNTRIGRKVMEAAAKHLASVTLELGGKSPVIVDETADVAAAAERLCWGKFVNGGQTCVAPDYVFVHASKERAFLDALKASITRFYGGTEQERQASPDLTRLVDPVAWRRVKDLLKRSVAAGAKVEVGGETDEPSRYIAPTVLSGVTAENPVMEGEIFGPVLPVLTFQSREEVYAHIRAGGKPLALYVFSQDKRAVEDIFQNTTSGGAVVNNVLVHLANPNLPFGGVGTSGLGNYHGHFGFKTFSHERAVMVQWMKSLASVFFPPYRGKAQELASRATRLM

SEQ ID NO: 19342 - protein, 447 aa, Myxococcus xanthus
ARRGMKERLARLEQFKTLLVARREALAEALHADFRKPRAEVEATEVLPVLMELASIQKHLKTWMKPRKVSTPLLLTGTSSLVQYEPRGVVLVMAPWNYPFHLLVSPLVAAVAAGNAVLCKPSEKTPNTARFIAELVKDVFPPEEVAVVEGGPEVGEALLRLPFDHIFFTGGARVGRRVMEAAAKHLASVTLELGGKSPVIVDETADVAAAAERVVWGKFLNGGQTCIAPDHVWVHASKEEALLEAMKEALERFYGRTEEARRASLDLCRMVDDSAFTRVRQLMDRTVQAGARVVVGGGVGAESRYIAPTVLADVTPDTPIMAEEIFGPVLPVLRFESLDEVVSHVREDGKPLALYVFSNDEATVERLLRETRAGGTCINTVVLHNVNPNLPFGGVGASGVGAYHGETGFRTFSHERAVLRQGRTSLVHLFFPPFTGKAQKLARLAGR

SEQ ID NO: 19343 - protein, 560 aa, Myxococcus xanthus
MIRLDNISKQNGQQILFIEASAALHKGEKVGLVGPNGAGKTTLFRMITSQEHPDEGQVAVDRGVTIGYFSQDVGEMEGRSAAAEVMDGAGPVSTVAAELKELEAAMADPDQADNMDKLVERYGLVQGRFEELGGYALEGRAREILAGLGFTQEMMDGDVGALSGGWKMRVALARILLMRPDAMLLDEPSNHLDIESLIWLEEFLKNYDGALLMTSHDREFMNRIVNKVVEIDGGSLSTYTGNYEFYEQQRAMNEKQQQAQFERQQAMLAKELKFIERFKARASHAAQVQSRVKKLEKIERVEPPKRRQTVLFEFQPAPRSGDDVVSLKGVHKAYGSRTIYEGLDFLVRRTERWAVMGVNGAGKSTLLKLVTGSTQPDTGNVALGGSVKMGYFAQHAMDLLDGERTVFQALEDAFPRAGQGSLRALAGCFGFSGDEVEKKCRVLSGGEKARLVMAKMLFDPPNFLVLDEPTNHLDMATKEMLITALSRYEGTMLFVSHDRHFLAALSNRVLELTPEGIHQYGGGYTEYVARTGQEAPGLRSEAPQGARRPPGTSRFTAAQR

SEQ ID NO: 19344 - protein, 559 aa, Myxococcus xanthus
  unsure (1)..(559): unsure at all Xaa locations
KKLVNAPRAVVREMLEGLVSLAPGQVLLDGESVVLRADTPSDVRARKVAVISGGGSGHEPAHAGYVGAGMLDAAVAGDVFTSPSTDAVLAAIRAVAGPAGALLVVKNYTGDRLNFGLAAELARAEGIPVETVVVADDVSLHDTVEPARRRGIAGTVLVHKVAGAAAEAGAALQDVLREATAAAEVLGTMGVALGPCTVPAAGKPGFTLEEDEIELGLGIHGEQGVRRVPMQTADSLVDTLLTTIVEDRRITSGDRVVLVVNGLGGTPPMELAIVARRALAALRQGGIRVERAWSGTFLSALEMPGCSLTLLKVDDARLARLDAAVDAPAWPGAGRLPKEPGVYRPSSTASPASLPAEAPQPGMDRFRKAALRVADAFEQSEPRLTALDSAAGDGDLGLSLVRGAEAIRALPEDAWTSPARALTAIGNALRRSIGGSSGPFYATALLRAARRLAEGPVDAAAWAEAFDLAVTAVSELGGARPGDRTMLDALRPAADAFAKAVRCGQGAREAWASAVHAXEAEEEATSRMQPRLGRASYLGARAVGVPDAGAAAVVVWMKA

SEQ ID NO: 19345 - protein, 272 aa, Myxococcus xanthus
RIFKYQGLGNDFVVLDRRGSGEDIDAATSRWMCDRRLGIGGDGVLALLPSERGIARMVVHNADGSIAEMCGNGLRCAVKFLVDDSGQTPGHINVETGAGVLTCYPSYGEGGVVAVDISMGPARLVAPNLPSGATGQPFLDALVPGHPPLRAYAVSMGNPHMVLLDQPLEDASRLGPLLEHHPSFPDRTNVEFVRVDSDGLTVVVWERGCGLTQACGTGACASAVAAVLAKRLPADAWLRVTLPGGDLSIRVPADLSDIRLRGPVAFVFEGVV

SEQ ID NO: 19346 - protein, 257 aa, Myxococcus xanthus
VSMLLQGKKLLITGVLTPQSLAYGIAEHALAQGAEVLLTGFGRAKSLTERSAKRLKPGMEVLELDVTNSAHFPALTDALRQRWDRVDGVLHSIAFAPEDALGGNFLNTPWESVQTAFRISTFSLKELSVACLPLMTQGGSIVTLDFDNRVAWPIYDWMGVCKAALESTVRYLARDLGPKGIRVNALAAGPLSTIAAKGIPGFKALERGWGQQAPLGWSAKDSHDMVARTACALLSDWLPSTTGEMIHVDGGYHAIGA

SEQ ID NO: 19347 - protein, 946 aa, Myxococcus xanthus
LSGANIDFIEGLYARYLEDPASVDASWREVFDRSNGAGRPIFSTRLLEPVAAPAAAKGGGKGAAPKAQVAPAPQPAPVAAPGQSVQDISLQARVDHVIFAFRLRGHLRAKLDPLGRPRPALAHVADVALVDDSHFTDAEAQQLVETNGVFGEQRVRLTELLARLRRTYTDTIGVEYMHMLDSERRRWLMHRMESNENRTDFSPDECRHILTKLSYAEGFEHFLHTKYVGAKRFSLDGGEALIPMLDALGEVATGMGLREIVIGMAHRGRLNVLTNILGKQPDQIFSEFDGPRNPQDYLGRGDVKYHMGFSSDHTTRQGRKLHLSLAFNPSHLEAVDPVVEGRVRAKQDRGGDTERTSVMPLLIHGDAAFIGQGVVAETLNLSGLKGYTTGGTVHVVINNQVGFTTDPHDSRSSLYSTAIAQMLDIPVFHVNGDDPEACVHIAKLVAEYRQTFKSDVVIDLVCYRRYGHNEGDEPSFTQPAMYDIIRKHPTVRTLYAAKLAEQNKIPAEESEAIKQRCQQEFDAALTRARQESQFKEPSALEGLWKPYQGGALKSAPDVSTAVDKQVLCDALRKLSTLPEGFNVHRDVERTVIKKRLGMLDSGELQWSEGESLAYATLLSEGYNIRITGQDCERGTFSHRHAVVHDVKTGEKFVPLRQFISGTGRNGFHIYNSPLSEMGVLGFEYGYSLDVPDGLTAAQAQFGDFRNGAQIIIDQFIAAGESKWRRLSGLTLLLPHGYEGQGPEHSSARLERFLDLCAEDNIQVCYPTTPAQIFHLLRRQVLRPVRKPLVIMSPKSLLRRPEATSKVEELATGTFQEVILDRVDPAGVTRLLLCSGKVYYDLVKARDERKDESIAIVRLEQLYPFASDVLAGLIAKMPKLAELLWVQEEPRNAGAWHFMFPRLHDLASTQSKQQVKIGYIGRAEAASPATGFPKTHEYEQQLIIEEA

SEQ ID NO: 19348 - protein, 398 aa, Myxococcus xanthus
MAVEIKVPPLGESITEAVVGKWNKKPGDAVTADEPLVVLETDKVTIDVPAPSAGSLSSIAFKEGDKVRVGEVLGLLEAGAGAPAARPAAAPAPAAAPAPAAEVPAASDARSTPTARKVAEENRLDISQVKGSGAGGRVHKDDVLGQLNRPATPAAPAQPAGPRPNAAREERVRMTPLRKRVAERLIQAQSTAAMLTTFNEVDMGEVMALRKKYNDKFQQKHGVKLGFMSFFIRASVEALKAFPQINAEIDGEDVIFKHYYDIGVAVSGSRGLVVPVVRNADKQGLAELEKSVGELGTKARNDKLALADLQGGTFTITNGGIFGSMLSTPILNPPQTGILGMHNIVERPVARDGQVVIRPIMYIALTYDHRLVDGREAVQFLVRVKECIEDPERLLLDV

SEQ ID NO: 19349 - protein, 657 aa, Myxococcus xanthus
RISPDEKSILFLRTQPTSNVQTLYAFDVESGQTQELLTPEAILKGAEETLTPEEKDRRERMRVSARGFTSYQVSEDGNRLLVPLSGRLYVVDRASGKVTELKTGPGTLDPRFSPDGKQVSYVREHDVYRIDVAANREQRVTKGGTEAKSHGVAEFVAQEEMGRFTGYWWSPDAKSIAYTEADTTEVEKLTIVDVMHPERGGEDFAYPRPGKANAKVRLGITPVTGGKTVWAQWDAAKYPYLATVTWPKGGPLTALVQNREQTEQKLLAVDPRTGKSRELLTEQDAAWLNLEQVFPLWLEDGSGFLWYTERNGGPEVELRKADGALVRTLVKPDAGFRSLARYIQKDDTLYFNGGPNPTQSHLWRVKAGGAPEKVTTGLDIESGSVSKSGGLMVMNGQGLKSMPKVQVVRGDGTTVGELPSVAKEPPYTPNVEQRQVGPERFWTSLVRPRDFKPGKKLPVIVEVYGGPTTTVVHKSMAAHLMSQWVADQGFLVVKIDGRGTPLRGAKWEREVKGDFSGVTLEDQVAALQALAKEVPELDLSRVGISGWSFGGYMSALAVLKRPDVFKAGVAGAPVVDWLDYDTHYTERYLGVPQQSPEAYEKSSLLTYAKQDKPMGKLLLIHGTADDNVYFFHTLKLSDALFRAGKPHDLLPLSGLTH

SEQ ID NO: 19350 - protein, 294 aa, Myxococcus xanthus
VRGRFAPSPTGRMHLGNIRSALLGWLQARAAHGRFLLRIEDLDRARCKPQYVDDLLRDMEWLGLDWDEQPVFQSQRDGLYRDAQARLEQAGRVYPCFCTRAEIARAASAPHGLSDEGPRYPGTCAHLTREQISERARTRPPAYRFRAVPGEVRFVDGLQGSYSQDVDAVVGDFVVRRNDGVASYQLAVVVDDAATDITHVLRGDDLLSSTPRQLQLYAALSLRAPDFLHVPLVLGEDGKRLAKREGAFALAELRERGVAPERVLGLLASWSGWGDGGPLTLAELVHSFRPERLP

SEQ ID NO: 19351 - protein, 498 aa, Myxococcus xanthus
  unsure (1)..(498): unsure at all Xaa locations
MPKAKYVLALDQGTTGTHVSILDTKLQVVGRSYKEFTQHFPKPSWVEHDLDEIWASSEWCIARALKSAGLRGKDIAAIGITNQRETTGLWMRGSGQPLSHAIVWQDRRTAEQCRRLKEQGVEPRVREVTGLVVDPYFSGTKLTWMFDHLKGARAKAEKGDVCFGTIDTWLVYKLTGGAAHVTDVSNASRTLLMDLTTLQWSDEMRAMLSVPAACLPQIRGSAEVYGTTRGMRSLPDGIPVAGMAGDQQAALFGQACFEPGESKCTYGTGAFLLMNTGSEPVRSSAGLLTTVAWRLGGTGTTTYALEGSSFIAGAAVQWMRDGLKVIKRAPDIEALAASVKDSGDVVFVPALAGLGAPHWRPEARGLFAGIDRSTTVAHMARAVLEGIALQIHDLAEAMRRDSGRDIPVFKADGGAAANNLLMQFQADVLGVPLVRPRNLETTSLGAAFLGGLGAGIWDSPEAIRRAWKAEKTFKPKMKPDARERHLAKWKRAVERAXD

SEQ ID NO: 19352 - protein, 247 aa, Myxococcus xanthus
ALITGGSRGLGRNMALKLAARGTGIILTYRTGADEAAAVVKQIEAAGGKAVALPLDVGDTRGFGAFVEAVRTELGRHFGRERLDFLVNNAGMGIQVSFAETTEAQFDALMNVHLKGTFFLTQRLLPVLADGGRILNISSGLARFTFPGHAAYATMKAGVEALTRYLAKELGARRISVNVLAPGATATDFGGGVVRDNPELNKTLAAQVALGRVGQPDDIGDAVAMLLSPESAWVTGQRIEASGGMML

SEQ ID NO: 19353 - protein, 245 aa, Myxococcus xanthus
VEEQAESVAPATIEQDIVGGTTTTINENPWQVSLRYGGHWCGGSILNKDWILTAAHCVDGYAVTSIVAGSTSSTSTSTGQTRNVAQTIIHEDYGASGNDVALLRLATSLDLNGTTVAAIPRISAADAASGATDPAVVARVTGWGATSSGGSGSATLRTVDVNVISNTEAQQSYPNEYIGPDQIGAKAPGKDSCQGDSGGPLTVNHNGTRKLAGVVSWGYGCADARYPGMYARVSYFESWIDSKLS

SEQ ID NO: 19354 - protein, 165 aa, Myxococcus xanthus
LRLLMDRAPTPIGSMLVVCDEAGSLRALDWEEYEPRMLRLLRLHYGVNGYVLEPASDPFGRTTAMQTYLRGDVSVIDSLPVATAGTPFQREVWRALRDIPAGATTSYGQLAQRIGRPKAVRAVGMANGANPIGVVVPCHRVVGANASLTGYGGGLERKQWLLDHE

SEQ ID NO: 19355 - protein, 442 aa, Myxococcus xanthus
FKKVLIANRGEIALRVIRACRELGIATVAVHSTADANALHVRFADEAVCIGPPASKESYLNVPQLLSASEITRADAIHPGYGFLSENAEFAEVCENCKIRFIGPRPEMLRLMGNKVRARQAAREAGLPLLPGSPGTVKDPREAEAFAREIGFPVILKAAAGGGGKGMKIVREPGALAQAFSTAQAEAVASFSNGDLYIERYVEKPRHIEIQIVADEHGNIVHLNERECSVQRRHQKLIEESPSPALTPELRKRMGEVSVNAMRRLAYNNVGTIEYLLDERGEFYFMEMNTRIQVEHPVTELVTGVDLVSEQIRLAYGEPLRFTQEDVQIRGHAIECRVNAEDPITFAPWPGKITGYSVPGGYGVRVDSGAYENYTVLPYYDSLLSKLIVHAEDRATAIRRMQRALGEYVVEGIRTNIPFHRAALAEESFQEGNYDTRFVERL

SEQ ID NO: 19356 - protein, 165 aa, Myxococcus xanthus
VLISEDKLQARVRELAAEITRDYAGKDLTLICVLKGSAFFAIDLAKYIDLPVKLEFLGVSSYQGGTESTGEVRITTDVSKPMAGKHLLIIEDIIDTGLTMQFLLENLRARHPASLKVCTLLEKPSRARTKVDIDYKGFVIDDLFVVGYGLDFGEVYRNIPFIGVM

SEQ ID NO: 19357 - protein, 311 aa, Myxococcus xanthus
DFKVFAGNSNPGLAHRICEYLKRPLGKAEVGRFSDGEIHVEIGENVRGHDVFILQSTCPPANDHLMELLIMCDALKRASAGSITAVIPYYGYARQDRKVAPRTPITAKLIADLLESAGAGRVVSMDMHAGQIQGFFNIPSDHLYGSPVFLEDLRKRFPESQELVIVSPDAGGVERARAYSKRLNTGLAIIDKRRPRPNASEVMNLIGDVSGKDAVLVDDMVDTAGTLAQAAAALKAKGARRVVAYAVHPILSGPAIQRIQDSVLEEVVFTDTVPLSPAAQACSKIRLLTTERLFGEAIARIHRADSLSSLF

SEQ ID NO: 19358 - protein, 548 aa, Myxococcus xanthus
CRRSPPMLLASAREEAPWSPTLLHCLRHRASTQPDAIAYTFVGDDASDETRISYRELDRRARAIAASLQRMDAAGERAILLYPPGLDYVAAFLGCLYANVIAVPAYPPDISRLNRSLPRLQAILTDARASIVLTTEMILSLVDSLEEQASQLRDRRWLATDLLEAGCEDGWREPEVTGQTLAFLQYTSGSTGTPKGVMLTHGNLVHNSHLIGLGMELREGSVAVNWLPPYHDMGLIGGILQPLYNGFHGVLLSPITFLQRPLSWLQAIERHRGTCAGGPNFAFDLCVRKTRPEEREQLDLRTWQVAFCGAEPIRPETLARFARAFEPAGFRPEFFYPCYGLAEATLIAAGGVKAEPVRTGHFDARALQHGQGAPRDEGTGQDTVTLVSSGTQLPTQSLVVVDPQARTLQADGEVGEIWMSGPSVAQGYWGRPEETERVFQARLARGEGPFLRTGDLGFLRDGQLFVTGRAKDLIIIRGRNHYPQDLEQTTEQSHPAIRPGCSAAFSVDVDGEEHLAVAFEVSARQEVSPDDVATSVQQAIAEHHQLGV

SEQ ID NO: 19359 - protein, 623 aa, Myxococcus xanthus
  unsure (1)..(623): unsure at all Xaa locations
AMPSPSRSVQTLTDLLRWRASNQTEARAYTFLQDGEGQETTWTYGDLDRQARAIAAALQEHKGAGERALLLYPPGLEYIAAFFGSLYAGVAAVPAYPPAQLQAVTRILSILQDAKPRFALTTHEILESVNALAEAYPVLKDIRWIATDALEDGLEDGWKRPAITGDTLAFLQYTSGSTSTPKGVMVLHRNLMSNEEMIRQGFSHDDPPTICGWLPLYHDMGLIGTVLQPMYLGSHSIVMSPWSFLQRPIRWLNTITKYRATTSGGPNFAYALCTRKVKPEKLASLDLSSWRVAFNGAEPVRAETLVEFADTFAPAGFRREAFYPCYGLAEATLFVSGGITSELPRHLTVDSAALEQNRAVAAQPGPSARTLVSSGRSWGDSLIRIVNPETLVACAPGEVGEIWTAGPHVTHGYWGREETNAETFQARIQGSEEGPFLRTGDLGFMIDGDLYVTGRIKDLIIVDGRNHYPQDLELTAESQHPALRPGCSVAFSVDHPEGERLVVLVEVSARFAPSEQGDGAQSLNGSALQKTIRQAVAAAHSVDVHEVVLLQQGEVLKTSSGKVQRRACRAKYVEGSLQRWAAXSVPRGMLSRPSLPARSEHDDRHPQDGDERAHEVPRRGSLP

SEQ ID NO: 19360 - protein, 315 aa, Myxococcus xanthus
  unsure (1)..(315): unsure at all Xaa locations
MDADITHVLLVGGTGRFGGRLASALLARPGIHLHVLVRPGTRSDALVRLAEHGVTLVSGTLDDMRSLDSALEGVDAVVSAVSGPPEVQVAGQLRLLDSARRHGVIRFIPSDYSLDYTDADAGDAFMDAHRRVADAVVKSGVPHSFVLCGAFMETALSPQAQVFDFERGVVSYWGTGDEPFDVTAMADAARWVAEVVVDPHAAGRRLEFVGDVATVNDVAALYEALTGQRLRRLCRGSVEDLRRQLVRARPEGVSVQVSSAELSLLSQLAGKGRLREPANAEYPRLRPMTLRDFLEARWMVSTSARATLPLASQPX

SEQ ID NO: 19361 - protein, 392 aa, Myxococcus xanthus
RIVGYFTAWGIYARNYHVSNVQPSKLTHINYAFSNISGDGRCILGDPFADIDKSGGWQGEWDPGQLRGNFRAFKEMKRQNPHLKLLISVGGWSWSTHFSTVASSPASRAAFVKSCVDLYIRGQYPGVDPVNGEGVFDGIDIDWEYPVGGGLPGNSNSPADKQNYTLLMQEFRSQLNAVTTQTGKPYLLTIATGASPDLLENKQETKKLSDVLDWINVMSYDYHGAFESTVNFHSALHRVTGDPGAATGFYTDGSVSKMLALGVPPAKIVVGVPFYGRGWGSVPNVNNGLFQSGVPTRGTWDDGSSGLTGVFDFKDIKANYERPGSGYTKFFHPEAKEAYVYNPATGIWIGYDDVQSINAKADYILNKNLGGAMFWELSGDDGSLLDALARKL

SEQ ID NO: 19362 - protein, 256 aa, Myxococcus xanthus
VRVVSWNVNGLRSVHRKGFLPWLAGCRAQVVGLQEVRARADQLPDDVRSPSRWKTHFVAAERPGYSGVGLYSRLEPDEVVTVLGVGELDVEGRLQIARFGKLTVVNGYFPNGNGKDRDLSRIPYKLTFYRRLFERLEKPLRDGGRVLVMGDFNTAHQEIDLARPKENRETSGFRPEEREEFDRWIRAGWVDTFRHFNKGGGNYSWWSQRAGVREKNIGWRIDYVLASPAAMAYVRKAGIHPDVLGSDHCPVSVDLD

SEQ ID NO: 19363 - protein, 307 aa, Myxococcus xanthus
PMAYPQFFEMYRNAIKNTWTVEEVDFSTDLVDLRSKMTDAERHLIHRLVAFFATGDSIVGNNLVLNLYKHLNAPEARMYLSRQLYEEALHVQFYLTLLDTYVPDPAERAMAFAAVDNIPSIQRKAQFCMKWMDSIQGLDTLQTKAHRRQFLLNLICFAGCIEGLFFFAAFAYVYFLRSKGLLNGLAAGTNWVFRDESAHMAFAFESIQVARKEEPDLFDAQMERDVVAMLREAVECETQFAQDLLSGGVMGLSVQDMRGYLEYVADQRLQMLGMTPVFGTKNPLHFMDLQDVQELTNFFERRVSSYQ

SEQ ID NO: 19364 - protein, 784 aa, Myxococcus xanthus
MRVRKRNGGTETVDLNKIVRAVGRSCVGLPRVDAMRVATKTISGLYDGATTRELDSLSIQTAAALIVEEPEYGRLSARLLATFIQKEVSNQDIHSFSQSVAAGHKHGLIADRLLQFVQANARKLNAAIDPSRNDLFEYFGLRTVYDRYLLKNPQTREVLETPQEFFLRVASALSGDNVNEAIELYRLFSSLEYLPSSPTLFNSGTRHEQLSSCFLLDSPADELDAIYKKYSDIAMLSKFSGGIGVAYHRVRARGSLIKSTNGHSNGIVPWLKTLDASVAAVNQGGKRKGACCVYLETWHADIEDFLELRENTGDDARRTHNLNLANWVPDLFMKRVEADGDWSLFDPKSVPHFTDLYGDAFEQAYAKAEADGLAMRKVKARDLYARMMKSLAQTGNGWMTFKDISNRKSNQTGKAGNVIHLSNLCTEILEVTSQGETAVCNLGSLNLSRMLVDGKFDFERLRANAQLAMRQLDRVIDLNYYPIPTAASSNKRWRPVGLGLMGLQDVFFQLKLAFDSAEARALSKKISEEIYFAALTTSCELAEQYGAHESFAETRAAKGELQFDHWGVVPEDTARWDALRQRIMKHGLRNSLMIAIAPTATIASIVGCYECIEPQVSNLFKRETLSGDFLQVNRYLVRDLQALGLWNENIRNRIKMAEGSVQDITELPENLRAVYRTAWELPMRSLLDMGADRGAFIDQSQSLNLFVETPNIGKLSSMYFYAWQKGLKTTYYLRSRPATRIAKATVGAGGGASVAQAAPAPVAKATEAEAVACSLENPEACEAC

SEQ ID NO: 19365 - protein, 431 aa, Myxococcus xanthus
MRIAIIGTGYVGLVAGTCFADSGNDVTCVDIDERKIRMLQAGEVPIYEPGLEELIKKNVREKRLFFTRDLTEAVTNAQVVFIAVGTPEGESGDTDLQYVLAAAEQIGKAMKQYTVVVDKSTVPVGTADKVREAIRKVTDIEFDVVSNPEFLKEGAALDDFLKPDRVVIGVDSERARKVMADLYSPFVRTENPVLFMDTRSAELTKYAANAMLATRISFMNDIAALCEKVGADVDFVRKGLGSDKRIGYPFLFPGVGYGGSCFPKDVKALVATARDYGLELDLLRAVERTNERQKKLLVTKAAKHYGSLEGRKFGVWGLAFKPKTDDMREAPSIEVIEGLIGKGAQVIAHDPVSPHTAKRVFGDRIRYASVPYEALEGVDGLFVVTEWNEFRHPDFERMKTLMKSPVVFDGRNVYDPARMRELGFTYYGIGR

SEQ ID NO: 19366 - protein, 218 aa, Myxococcus xanthus
GMFFNPTKKLRIPTPEEALPGRSDVMPVPEKHEVLGTPIKGPVPEGLEEVYFGLGCFWGAERKFYQTPGVYSTAVGYAGGPTPNPTYREVCSGLTGHNEVVRVVFDPKKVSFEQLLRVFWESHDPTQGMRQGNDVGTQYRSGIYFTSEAQQRAAVASRDAYQKALAARGFDAITTELLPAPPFYFAEDYHQQYLEKNPGGYCGLGGTGVSCPVGVGVN

SEQ ID NO: 19367 - protein, 244 aa, Myxococcus xanthus
VFAGLCAVDNPENVDTMMAALARLGIRTTRMGAYKPRTNPYEFQGLGAACLPWVFESAGKHGIKVIAMEVTHPRHIDEIRDALERSGNATGVMLQVGTRNAQNFELLKSIGQQRVFPVLFKRGMGITLEESLNACEYVASEGNPKIIFCLRGVKTHLGDPHRNMVDFAHVPVVRRLTRLPVCVDPSHAIGQAAPPPDGLPDIFHAIGQGLIAGASMVLVDFHPHPEAALCDGPQALRMEQLPAL

SEQ ID NO: 19368 - protein, 334 aa, Myxococcus xanthus
REFRGRPAWRHSAVASPYSKELLLDMYRKMYLIRRFEERAGQQYTLGKIAGFCHLYIGQEAVAVGPVEALRPDDYMLSAYRDHGQPLARGSDAGMVMAELMGRDTGYSKGKGGSMHIFDIEHHFYGGYGIVGGQIPLAAGMAFASRYRNEDRVTVCYFGDAAASQGALHETFNMASKWKLPVIYICENNRYGMGTAISRIAAVPEIYKRASAYDMRGEPVDGMDVLAMYEAVKDAAEYCRAGKGPVLLEANTYRFRGHSMADPATYRTKQEVEDERKGDPIPKLRAYILKQGLAQDDVFESIEAEVNAQVDQAVKFADESPEPSLDELWRDTIV

SEQ ID NO: 19369 - protein, 322 aa, Myxococcus xanthus
ELMYREALNQALAEEMERDANVYLIGEEVGRYNGAFKVSQGLLDKFGSARIIDAPIAELGFTGLSVGAAMVGLRPVVEMMTWNFAILAMDQIVNNAAKLRHMSGGQLRCPIVFRGPGGAGGRLSSQHSQALEANYAHFPGLKVIAPATPADAKGMLKAAIRDENPVLMFEGERLYAIKGEVPEGEHVVPLGKADVKREGSDVTIITWSRMYYFCMQAAEELAKEGISVEVLDLRTLRPLDEEAILASVRKTNRAVIVEEGWALAGVGASVVDIIQSKAFDDLDAPVERVTGLDVNMSYAANLENATQPDAPKIIAAVKKVLY

SEQ ID NO: 19370 - protein, 523 aa, Myxococcus xanthus
IQMPSLSPTMTEGKIVKWLKKQGDKVSSGDAVAEVETDKSNLEIEAYDDGYLLQVLVGEGEMAKVGAPIAYIGAKGEKVGAGKQVAPAAAPPEQKPQPAPAAPAPQAAAKPASSGGGDNRIAIQMPSLSPTMTEGKIVKWLKKQGDKVSSGDAVAEVETDKSNLEIEAYDNGTLAEIVVGENQMAKVGAPIAYLTAKGAKAAPAAPAAQPKPPAPAPEKPAAAKPAAAPAQAGGRRLRASPVAKRIAREKGLDLTQVSGSGPSGRVVKRDIEEALARGPAAVPAAKKAPAAQPAPGVRPEPTVLPLSSMRKVIAQRMTEVKPGVPHFYLTIEVDMEAASKVREEAKAMDLKVSVNDLIVKAVAMAVRRYPKINVSLQGDKVVQFHSVDVGIAVALEEGLITPILRDADQKGLQAIASGVRELAERARKRALKPEEYTGGSITVSNLGMYGIDQFVAVINPPQASILAVGAVSEKAVVRDGQLAVRKMMTATLSCDHRVIDGAIGAEFLRELRGLLEHPTRLLF

SEQ ID NO: 19371 - protein, 472 aa, Myxococcus xanthus
LRVRFAPSPTGYLHIGGARTALMNFLQARRQGGTFVLRMEDTDQGRSTPESVQAILDGLNWLGIDWDEGPGKEGPYAPYFQMQRLDTYRKHADQLIAEGKAYRCYCTKEDLDAQRQVAEKAGGAFKYPGTCRERTEPPAGRNAADAVIRFKMPAGDGSVSFTDKALGTITKTHSDLDDWVMMRADGIPVYNFGCVIDDHLMDITLVARGQEHVNSTFPQLMLYQALGWTPPDFAHLPLILGPDREKLSKRKHPEADVMVHKRNGVMPEALLNFVIRLGWSHGNDEVISREQMLEWFDFSDVGTTSGVWNPEKLLWLNQQWMKQLPVETVVERLLPFLEAKGIQAKGDPRLETLVRTLRERSNTLEDIATTAANVYFRSGITLDEKAATKHLSGESLNLLRKVRETLTALPEWSVEALDGVVKQVSEASSVGMGKVAQPIRVALTGNTTSPGIGETLVLVGRDESLLRIDAAL

SEQ ID NO: 19372 - protein, 794 aa, Myxococcus xanthus
VGSFLLAAGIKHGDRVLLVSENRPEWGISYFGILRAGATVVPVDPGLSEAELVNIARRADARACLVSEDAARDFPGLFAALGDGVTVASLAEAMTGDPAHPDRIGPVRRSAAADDLASIIFTSGTTGTPKGVMLTHRNFAALVAKLAGTFDIGVGDGVLSVLPLHHTFEFAAGFLTPFWRGAEITYIDELTSDRLGEVFETGRITAMVGVPALWQLLHRKITQEFASRPQFIEQALKALMATHGELRNRNNINLGKLLFWPVHRKFGGRIKVIVSGGSALPDDVHKAFHELGFNITEGYGLTEAAPVLAVTKPGNKRQPGTVGRALPGIELRILNPDNDGLGEVLAKGPNVMPGYFGDREATEAVLKDGWLHTGDLGRLDAEGHLYLVGRAKDVIIDHNGKNIYPDELEELYQDHTHIKELSIVGLPDDAGGEKVACLCVPDYADRPREEVRRELEEHFRKVSAGMPFYRRVKVLRLWDGELPRTAKRSVKRKQVVEELKRQERMAASASKAREKAANPTTGGIADWLFPLIADVSHRPVSDVRPDALLSGDLGFDSLMLTELSSALEAAGVPLPAVEDLTQVQTVEDLRKVVASSGKRPTVETRAKEISKENERAEKVEIPGPDVVADVGRQLLSFGQKVLYGGVFDVKVTGKSFIPQNRNFLVIANHSSHLDAGLVRVALGDQGERLVSLAARDYFFNTPLKRAWFENFTNLIPIERQGSLRESLRMAGEALRQGFNVLIFPEGTRSTTGELMEFKSTLGYLALTFNMDVLPLYIGGAFDALPKGSVLPKTK

SEQ ID NO: 19373 - protein, 203 aa, Myxococcus xanthus
VLAMILAGGAGTRLEPLTRERAKPAVPFGGRYRIIDFVLSNFANSGVYRMKVLTQYKSDSLNNHLSRAWRMTAFLGHYVEAVPAQMRTGLDWYKGSADAIYQNLNIITDEEPDYIFVFGADHVYRMDTRQMLDFHCTKKAACTVAAIPVPIEQGREFGIIDVGPDGRMRQFLEKPKDPPPMPGNPKMCLASMGNYLFSTDVLV

SEQ ID NO: 19374 - protein, 647 aa, Myxococcus xanthus
GVELKHLDRDVRPQDDFYAFVNGNWLKTTSIPADRARYGTFIELADKAELAMRAIIEESAAAKERHPGSTAQKVGDLYNSFMDTQHIESLGLKPVSDELERVKAVKRSDALPELFATLLREGVPVPFGIFVGQDQKQATRYTVYATQLGLGLPDRDYYTKQEPRFVEVRAAYVAYIEKLLTLAGEKNAKKAAQDVMAFETALAAKQWDRARNRDREKTYNPKTVAELDALTPGFSWGRFLKASGAEATPSVIVRQPDYLESLGGLLKSTPLPVIKQYLALKVLDTRAPLLSSAFEQAHFEFRGKTLQGLEENRPRWKRGVAQVNEVVGEAVGQLYVERHFSPDSKKRMQELVANLREAFRKGIDGLDWMSPATKAQAQAKLEKFGVKIGYPDKWRDYSSLDIVAGDLVGNVRRGELFDHQRAVGKLGKPIDREEWGMTPQTVNAYYSSTMNEIVFPAAILQPPFFNPEADDATNYGAIGGVIGHEFSHGFDDQGSRSDGDGNLRDWWTPEDKSGFEQRTNMLVNQYNGFSPLDAMNVNGKLTLGENIGDLSGLTVAYQAYKLSTQGKMPPVIDGFSGDQRFFLGWGQIWRGVYRDDAMRQMLLTDPHSPPQYRVNGVVRNMPEFYEAFGVKQGDANWLPPEQRVKIW

SEQ ID NO: 19375 - protein, 848 aa, Myxococcus xanthus
IPMAHPTEDKNFRLPTSIRPRRYAATLTLDLDAKSFSGQQTIDLDVAAPSNEIILHGIALALSDVTFRAGGQQRKPASIQPAQASETVVLRFDEALPTGAASLDVAWTGRFTEGLRGLYQAGKVAATQFEAADARRLFPCFDEPAFKARWALTVRVPTGLTVLGNGPVVKDTQEGNLRAVTFQETEVLSSYLIALVVGPLVGTDAQDVQGVPVRTWALPEKAHLTRFGQDVALAVLPRLQDYFGLPYAFTKLDQVGIPDFEAGAMENAGLITYREVALLLDPATAPLSVKKRVAEVVTHELAHQWFGNWVTMVWWDDLWLNEAFATWMAFKIVDQWRPEWRMWLDFDAHRASALHLDALKSTHPIHGEVRNAGEAGESFDAITYEKGGAVLRMIEGFLGEGPFREGIRQYMRKHARANAVKEDLWNALGDAAKQPVEELATAWVGQSGFPLVTATLDGRGLSLSQRRYYSEPGVQSAEVWPVPVVLRYEDSTGVREQRVLLRDAQATVKLEGEGAVKWLTANAGSTGFYRVAYDKPGLEKLATNLKSLAPSERTALLADQWALVRAGQASVADLLDLAGRFGDEEDDSVLDELVGRLAYIEGRLADGEDQVRFRAWVEKLLGPGLKKLGWQSAPNEADRVKLRRASLVRAVGGLARSQDALAEARPRVERMLQGQRDALEPNLLDAAVGMVARAGDAALFDTFLQKIPSEPDPATQRRYLMALTAFEAPELTARARGLLYTDTVKTQDVASFVAGLLGNRVGRDAWWAQMRTQWKDVVARTGGAPMLLRRIVEAMGMLRTREHLEQMQALLKAQPIPEAQQATAQTLERLSQDVALRERCMPEVSAWL

SEQ ID NO: 19376 - protein, 317 aa, Myxococcus xanthus
VVCFGETLVDFLPAAPGHRVRDVPAWHPCPGGSPANVAVGLARLGLRPAMLGVVGADEFGHFLRERLAAEGVDVSHLRQTAEARTGLVFISLDGKGERSFTFFRTRSAEFLLGQADVDAAFLSGAKAVHCGSNSLQWPEAQEAAVRMLGLARDAGLIVSCDPNLRLHAWEDTSLLKGLLARMLPLCTVVKLSEEEIGFVTGTEVPHEALTRLAAMGVPLPVVTLGERGALLQWKGECIHVAAPQARVVDTTGAGDGFVAGLLQGLVRWYGGAGGLRDATGEELVTLATFACEVGARVVEKLGAVDGLPRAEVLAHVM

SEQ ID NO: 19377 - protein, 234 aa, Myxococcus xanthus
RAIRLLFSIVFWAFLMLSSAVLFVGAVLVWLVTLPFDRDGRVLHLYSCFWAQLYFYVNPLWHLEVDGREHLPWRGPAVLVSNHESLGDILVLFGLYRPFKWVSKASNFKLPLIGWNMRLNRYVPLVRGDRASITKMLADCEYWLSRGVPILMFPEGTRSSDGVVKPFKDGAFALALKQRCPVIPVVLTGTARTLPKHGLVLETTARCHVQVMPPVDPSAFTDVASLREHVRNLI

SEQ ID NO: 19378 - protein, 587 aa, Myxococcus xanthus
TVSDYLLHRLSQWGVRRIYGYPGDGINGILGALGRTLEFRFEHTRHEYMSAFMACAHAKFTGEPGVCLAISGPGAIHLLNGLYDAKLDHQPVVAIVGQQTRSALGGHFQQEVDLMSLFKDVPSEYLTMVTSPSAIRHAVDRAMRVAIYERTVTCVIIPNDVQEEAYHKPPHAHGTVHSSVGYSVPRVLPRERDLRRAADVLNAGKKVAMLVGAGAQAAADEVMHVAELLGAGVAKALLGKAVLPDDVPYVTGSIGLLGTKASWDLMSDCDTLLMVGTSFPYSEFLPKEGQARGVQIDLDGRMLAIRYPMEVALVGDSQETLKALIPMLEHKKDRSWRDSVVKNVRQWEKTAEALAMDRANPVNPRRVFFELSSRLPDGVILTADSGSGTSWYAQHLKMRKGMMASLSGNLASMGCGVPYAIGAKFAFPHRPVIALVGDGAMQMNGNAELITVAKYWKEWKDPRFIVMVLNNRDLNMVTWEQRVLAGDPKLPASQDLPDFPYAAYAESLGFLGIRVDRPESLGRAWDEALSATRPVVFKAYVDPDVPLLPPHITFEQAKHYAQALAKGDVDTGGILKQSLKGMVETLL

SEQ ID NO: 19379 - protein, 311 aa, Myxococcus xanthus
IGLGGVAIGNGFASTSDAQAQATLEAAWAAGVRYFDTSPWYGLGLSERRFGRFLHTRDANEYVLSTKVGRILTAADAPPPKLLWSDASPFNYQYDYSAAGVRRSVEDSLQRLGVSRIDIVFIHDLSPDNQDMGDKWTEYFDQAIKGAIPELTKMREEGLIKAWGFGVNRAEPALRALEVSDPDIFLLATQYSLTNHEEALSKTFPALEKRGISVVVGSPLDAGYLAGRNRYLYDGTIPPGVQEKRARMSAIAAKHGIDLRTAALQFAAAPSVVSSVIPGARTPEQVKANVQSMTVAIPDAFWEALKKEGLI

SEQ ID NO: 19380 - protein, 551 aa, Myxococcus xanthus
ETQGLNFLQEIIEEDQRTGKYAGRVHTRFPPEPNGYLHIGHAKSICLNFGLAQQYGGKCNLRFDDTNPVTEDTDYVEAIQRDVKWLGFEWEDRKFFASDYFPKLYDFAVQLIKQGKAYVCSLSPEEIREYRGDFTTPGRNSPYRERSVEENLDLFHRMRAGEFSDGQHTLRAKIDMASPNPVLRDPPIYRIRHAHHHRTGDAWPIYPLYDFAHCLSDAIEGITHSICTLEFENRRVLYDWIVDNLVSGDRPYQYEFNRLNLNYTVMSKRKLLKLVTEGFVAGWDDPRMMTITGLRRRGFTPASIRDFATRVGVGKAQQLIDMSLLELCIREDLNETAPRAMAVMRPLKVVLENYPEGQTELLEVQNHPQKPEMGTRQVPFMRELYIEADDFMEDPPKGFFRLAPGKEVRLRSAYFIKCEQVIKDAAGNVVELRCSYDPATRGGNAPDGRKVKGTLHWVPGNAPVAEVRLYDRLFSVEAPDADDSKDFTTFLNPTSLQTLRDARVEPMLVDAAVESRYQFERTGYFYVDPKDSKPGKPVFNRTVTLKDSWTK

SEQ ID NO: 19381 - protein, 419 aa, Myxococcus xanthus
LSLEGVPLAQLVERWGSPLHVVHMAALRRNAERFLAVPPGRTGGCEVYYSYKTNPVPGVLSFLHGLGVGAEVISAYEMWLALKLGVPPERIVYNGPVKSEASVREAISRGIQLLAANHAEEIAVFARLAAELDRRPRVAVRVTTNSGWSAQFGTPIAGGAALRAYQQARGSKHLDVVGLHAHRGETIRTEGDFTAFVESVLDFTDTLHQELGLDLEVLDLGGSLNTPTVEHIAERDWRLNLTFFRDVPAPDPAASLSIDRYVALAVEMVETHYARRGRQRPRIFLEPGRAMTGDTQLLLGRVHALKAGEDRTWAVLDAGINHAECVRNEYHQLFHVNRPDAPADKVYTVVGPICTPGDTLYHAKRLPDLRVGDTLAIMDAGAYFVPFATSFSYPQPAIVALEDGKERLLRRAETFDDLV

SEQ ID NO: 19382 - protein, 821 aa, Myxococcus xanthus
RPFSLPGATEHYAAERPVRAEHVRIEVDLDFDTHRITGLCTTRVSAVRPVHTLTFDAVDLDVSDVQVDGRAARFSNSGAHVRVELSAPLAAGQACEVAIRYTARPRRGLYFWAPDAAYPHRPHQAWTQGQDIDARAWFPCLDTPAQKATSEVIATFPEAMTSLSNGTLESDRVHDGRRTQHYRMAQPHAPYLVTLVVGEFEEATDTAGTVPLRYLFPKGRKEDALRCVRRTPEMVRVFQEVTGEPYPWSSYAQVFVTEFILGGMENTSATSLTDTVLHDARAQPDYNAEPLISHELAHQWFGDLLTCRDWPHGWLNEGFATWLEMLWKERADGQDEADQHRLVDLEAYLGEARERYARPIVARRFHAPMDVFDRHLYEKGGLVLHELRRRLGDDLFFKGLRHYVARHRHGSVETVDLARAFEDATGHNLDAFFDQYIFAPGHPELKVDVRYDAEEARLRLQVRQTQSTADGVPLFRLPLDVALTVDGRDTVHRLEVTDAEHAFHLPCPSAPSQVRVDPRRGVLGTLTVDKSAGLWMDELRAAPEMRARTEAAVALGRDGSPRAVDALGTALADARLFWGTRAACAKSLGRIRTPDSRARLLDALSTEHPRVRRAVVASLGEFRRDAEVTARLRALVNGGDTSYFVEAEAARSYGRVRAPDALGVLEAASTRPSYQDVIAVGAVDGLAESQDPAAFSVVLARTAYGHAAPLRRAATLAVAKLAEVAGRKREAVDLLAELLRDPLFRVRMGVFEAARTLGDSRLVPALEQTPLLDAVARRAARETVRFLREGEPQVREVASLREEVDRLKEETRALRERLEGL

SEQ ID NO: 19383 - protein, 540 aa, Myxococcus xanthus
PLAGKPPPEDFLIDPEKLRAAYFSGRPDVDVPEQRVAFGTSGHRGSSARNSFNEGHILAVTQAICEYRQQQGIDGPLFLGMDTHALSSPAQQTALEVLAANGVQVRFTDGATPTPVISHAILTYNRGRTAGFADGIVITPSHNPPEDGGIKYNPPNGGPADTNVTSVIEKRANALLGAGNEGVQRIPHERARTAPTVKPYDFITPYVEDLGTVIDMEALRGAKLRIGADPLGGSNVAYWEPIATRYGLNLHVVNPTVDPTFRFMPLDHDGKIRMDCSSPHAMANLVRLKDAYDIAFGNDADSDRHGIVTRSLGLMNPNHYLAVAIDYLYRNRPGWKPGTAVGKTLVSSSLIDRVAKDLGRRVVEVPVGFKWFVDGLLDGSLGFGGEESAGASFLRRDGTVWTTDKDGIILDLLSVEILARTGKDPGEHYQSLAAKFGAPHYTRIDQPATAAQKAALKKLSPEAVKATTLAGEPILQRLTRAPGNNADIGGLKVVAENGWFAARPSGTEDVYKIYAESFRDEAHLQDILQEARAIVGEAFA

SEQ ID NO: 19384 - protein, 99 aa, Myxococcus xanthus
  unsure (1)..(99): unsure at all Xaa locations
MKIRPLQDRLIVKRVAEENKTKGGLFIPDTAKEKPLEGKVIAVGNGKVQEDGKVRPLDIKAGDTILFSKYAGTEIKLDGEEHLILREEDVLGVIEKXSG

SEQ ID NO: 19385 - protein, 1188 aa, Myxococcus xanthus
MRIKRLDITGFKSFMERSVFTFDEGVTGIVGPNGCGKSNVVDAIRWVMGEQSAKNLRGRGMEDVIFNGSENKPPLSMAEVSLTFIVDDTDQLAPQYQGFSEVTVTRRLFRNGDSEYLINKTLCRLLDITELFLGTGVGTKAYSIIEQGRVGLIVSSKPEDRRHLLEEAAGVTKYKARRKAAERKMEATDANLLRVTDITNELEKRLDALSRQAKKAEKYKKLKARMRDIDLHAATHRQLELMAEKKMLQSRLENLGSEERESLDRVKELEETITRRRTELEAETAALQALAAEVHTLESSLQRDTQEMTYGKRDLEETRARVAAAQVELDGLLARKAEMSEAMAAREAELSGIAGSWKEDEVAMQVAQEELRRVSQLQTEVALRLEQERAGLVAVATRLANHESNLVNLARQRGDLGARRAKLQGELETLRAQEQTLENVRGDVAKRVEDTRHLAAELAERKGQEEDALTRTRAAFTENEIEVIALREELSDKRSRLSTLEDIQKNYDGFDRGVRAVMTRAGVQAREQGIFGLVADVINVTPRYERAVEAALGERLQHVIVESRDKGVELVDYLKGHAEGRGSFLPVPALDTLPAPLEPDFSQPGVLAHALREVTCEEALTPLVQLLLGDVVIVQDVATARAWTESGGPACTLVTVEGEVFRPDGTIVGGESEGAAVGALQKKREIAELATEVARVEERYNEILTRHYTLQKQMGHAEGVLKGLAKNQHAEELNLASQEKDLHKAGEDLARVRERVRALEVEEGQLTQSHQALEHEEEASRGEVAHGQADREGREERVKQLVSEQESLRLRAETANGELTGLRIKVAAGSERGESARKELDSLVSQRQDMETRITRLQATVVEGGARVEELARRTTDTEGGLSQRAEEHRLAAEGLEAHRAAHTTASAEVREQDATFRELRGRVDKLMQGLSQISLREREIPLELEHLAGGIHERHQVELANELHKYHMLAALAPETEADLKDLRAQVEKMGEINLTAIDEHAELSKRYDFLTAQKKDLQSSIEQLKEAIQRIDATSRERFKQTFDVVNEKFQAIFPRLFGGGRASLILTNEGPGGEPGVEIVAQPPGKKLQSVNLLSGGEKALTAVGLIFGIFLIKPTPFCLLDEVDAPLDEGNVGRYNDMVKEMSKQSQFILITHNKRTMEVSNTLYGVTMEEPGISKLVSVRMRE

SEQ ID NO: 19386 - protein, 738 aa, Myxococcus xanthus
ERMDLAVSGMTCAACARRVERTLSEVEGVQECSVNFATRRASVLFDARATSVSALADAVADAGYRAEVPQASTAEETDAAEERGLRRRLAVAVLFGLPVVVLAMSHGALDFTGSIWVQLGLTVPVMAYSGGPIFRAAWAALRHRSADMNVLVALGTGAAFIFSVVATVWPTFMVTGDHGGHGGHGAAPPIYFEAAAAVIAFVLLGRFLESRARTRAGDAIRRLQALAPSIATVLENGVEREVPLAEVRVGDRVVVRPGQSIPVDGSVVDGASSVDESMLTGESLPVEKAAGAEVFAGTMNGTGRLVFRAAKVGSDTALQQIVQVVERAQGTKAPIARLADVVSGVFTPVVLLIAIATFAAWFVLAPEETRLTMALLNAVAVLVIACPCALGLATPAALMVGMGRGAQLGVLVKSAASLEGASRIDTVVLDKTGTLTQGRPAVVRVLTASGMTEEEVLTLAAAAESASEHPLARAVVSEASNRGLKVGTPESFTATPGHGVEAEVGGRKVLVGSRRMLDGRGVSGSEDAERVLTTDGQTPVLIAVDGRWVGAIGIADPEREEAATVVQSLRSMGLHVVMLTGDHDGPAARVARALGIDRVFAGVLPSGKAHVVRTLQTEGRRVAMVGDGINDAPALAEADLAVAMGTGTDVARDAAGVALLRSDLRGLPAALGVARPTIRVIRQNLLWAFLYNVLGIPVTAGLLYGLTGWLLSPMLASVPMSLSSVSVLLNSVCLRRLR

SEQ ID NO: 19387 - protein, 422 aa, Myxococcus xanthus
QEQQAGVEVVKRGESAPSPSLRVLDVMALTVGIVLGAGIFKAPSLVAAQSGSGEAMLLTWLLGGVASLVGALCYAELASAWPHPGGDYHYLYRALGKGPAFLFAWARLTVIPTGSIALLAFVFGDYATQLFPLGLYSSPVYAAMLVVGLTAVNIAGLRQGTRTQNLLTALEVLGVGAVVIVGLLFTPALVPAAAPPAPAASSGTAWGLAMVFVLLTYGGWNEVAYLSSEVRGSRRTIAWSLLASIGLVTALYLLVNVAYLRGLGLEGMARSEAVAADLMQRAVGSGGALVLSVIIAISALTSANATVLTGARTHYAFGRDSVLFNGLGQWHAKSNGPSRALLVQGAISLALVGLGTLTRQGFETMVEYTAPVFWLFFLLTGVSLMVLRVREPDAPRPFRVPLYPLTPLLFIGIAPTSSIPAW

SEQ ID NO: 19388 - protein, 188 aa, Myxococcus xanthus
QGAVMLTVGDKIPNFKVKATVSLEKGKEFQDITNETFKGKWLVLFAWPKDFTFICPTEIAEFGKKNKDFTDRDAQVLGLSTDSEFVHHAWRTHHPDLKNLPFPMLADIKHELCNALGILHKEEGVALRATFIADPEGIIRHVTVNDLSVGRNVSETIRTLDALQTDELCPCNWTKGEETLDPEAVEGG

SEQ ID NO: 19389 - protein, 233 aa, Myxococcus xanthus
NTPDGSTPDAGDDCGDGQRQSGEACDDGNRVDGDGCNATCTTVEGGFICEVPGAPCVHLVNCGNGRVEDGEECDDRNLVSGDGCNGSCRVERGWACPAQGGRCRAKECGDNIIAGDEECEDGNTTPGDGCSDVCRLEEGWKCPPGQPCSRTTCGDGITEGTEQCDDGNTVMGDGCSPLCTKEPRCSDGNCEETCGDGLILPNSAVEECDDGNTRANDGCSPDCKLEDGFACVL

SEQ ID NO: 19390 - protein, 377 aa, Myxococcus xanthus
LFTSESVTEGHPDKIADQISDGVLDAIIAKDPQARVAVETLVKTGLAIVAGEVTTNCYVDIPKLVRSTICRIGYTDSSMGYDGNTCGVMVAIEGQSQDIARGVDNKKDQGAGDQGMMFGFACDETPELMPAPIHYAHAITRRLADVRRKQHPWIRPDGKSQVTVEYRDGRPARIDAVVVSTQHSDEVSNKKIQEAIREDVIANALPKKLIDNKTKFFINPTGRLVAGGPMGDSGLTGRKIIVDTYGGMGRHGGGAFSGKDPSKVDRSAAYMGRHIAKTVVAAGLARRCEVQVSYAIGVAEPVSVMVETFGTATVPEERIALAVRKTFGLRPREITEYLNLLRPIYQKTAAYGHFGRTEKEFTWERVEEKKDALRDAA

SEQ ID NO: 19391 - protein, 466 aa, Myxococcus xanthus
DYAIADLSLADWGRKEIRIAESEMPALMAIREEYAKTQPLKGARVTGSLHMTIQTAVLVETLQALGAEVRWASCNIFSTQDHAAAALVQAGTPVFAHKGESLKEYWDFTHRIFDFGPAGSDHEGPNMILDDGGDATLLMHLGKRAEKDASVLANPQSEEERELYAAIKAKLAEDATWYTRKSAKILGVTEETTTGVHRLQEMSAKGTLLFRAINVNDSVTKSKFDNLYGCRESLVDGIKRATDVMVAGKIAVVAGYGDVGKGSAQALRALSAQVWVTEIDPICALQAAMEGYRVVTMDYAADKADIFVTATGNKGVITHDHMAKMKDQAIVCNIGHFDNEIEVASLEKYKWEEIKPQVDHIIFPDNKRIILLAKGRLVNLGCGTGHPSYVMSSSFANQTIAQIELYSHSANYEVGKVYVLPKHLDEKVARLQLKKLNAQLTELSQEQADYIGVKTSGPYKPDTYRY

SEQ ID NO: 19392 - protein, 263 aa, Myxococcus xanthus
VLPKSALSTVVGMATRLPVPAPVHQAAMRAFAKAYNVDMEEAEHSFEHYPTFAQFFTRGLKPGLRPVDAGEKVVVSPVDGRVSQVGYSDYGRCLQAKGIEYTVDELLGDSEAAKPFYGGAWTTIYLSPRDYHRIHAPLGGTITGYAYIPGEFWPVNPASVKNKQSLFCVNERLVTYLDTVAGKCAVVKVGATCVSRIKAAYDEVTTHTGQPGKVHRYGSAMPVEKGGELGRFEMGSTVILLFEPKRVTWDDSLQEEAVVRLGK

SEQ ID NO: 19393 - protein, 249 aa, Myxococcus xanthus
HVAVVHGYGDHFGRYGFVTDALLADGFAVHGFDYRGHGKADGRRAYCEKWPDYLEDLEVFWERVRAVSEGKKAFVLAHSHGGLMSATWASSRRVEGLTGLVLSAPYLKLAITPPASKLMAARAVGKLVPWLSISSGLKVEDLTHDTDVQRATREDPLHQAIATPRWFVESTRAQGEAVLLAPKIQVPLFVLCGAEDGVAAPAAAREYFERAGSPDKKFKEYPGMRHEPLNEVGRAEVFRDISGWISAHL

SEQ ID NO: 19394 - protein, 527 aa, Myxococcus xanthus
LTMPHRFDFLVLGGGVAGLSFALQAARHGTVAILTKRDRFESNTAYAQGGIASVLAPPDTFESHIEDTLVAGAGLCHRDAVEVTVKEGPSRVQELADLGAEFNRRITGEFDLTREGGHSARRIIHSGDITGREVQRALLAACDEAPNITFFPQTAAIDLIQDRRVPSPGVSRCLGVYALLEDGVIERFLAKVTVLATGGAGKVYLYTSNPDVATGDGVAMAYRAGAKVANMEFYQFHPTCLYHPEAKSFLISEALRGEGGKLKLKSGASFMERYHPMGALAPRDVVARAIDAEMKRTGDDCVYLDMTHLGRAFLAERFPNIYATCKAFNIDMAVQPIPVVPAAHYMCGGVVTDLEGRTNVPSLYAIGEVTCTGLHGANRLASNSLLEGLVFGHRAVQVAAEEVRAQPSPSEDPPPWDSGSAVESDESVVVTHNWDEIRRLMWNYVGIVRTDKRLMRARRRLELLREEIRDYYWRFKVTRDVIELRNIADVAYLIVDCASRRKESRGLHYTLDYPHPDDHRWLRDTVV

SEQ ID NO: 19395 - protein, 202 aa, Myxococcus xanthus
ALRGINLTIPKGKTVGIIGRNGSGKSTLLKLITGIYTPTSGDLQINGRISALLDLGAGFHPDFSGRENILINGIILGMTRAEVRARMDEIIAFSELGEFIDEPVRTYSSGMYMRLAFAVATHVDPDILIIDEILAVGDEHFSKKSLAKMMDFKRQGKTIVLVTHELGTVERWCDLAAWIDGGYVRRVGKPSEVTAEYREAIS

SEQ ID NO: 19396 - protein, 474 aa, Myxococcus xanthus
VSCRNLVGGSWQVPPGAAHLDVRSPYTGTVIGRVPLTPASGVAQAVEAAKAAAAAWKNTSLRERTQYLYRFRQFLERDLDALAQLAASEAGKTVAEARAGLLKGMEVCDFALSLQNLDTGAHLEVSRGISCEYRREPLGVVAGITPFNFPAMVPMWMFPIAVTLGNAFILKPSEKVPLTACALGELMCEAGYPAGVFSVVHGGKEAVDALVAHPDVQAVGFVGSSAVARHLYAEGCKRGKRVLALGSAKNHLIVVPDADPELTPQAVVDSFTGCAGQRCMAASVLLAVGNVESLLQEVVRRAAKLELGPGMGALIDRGSLDRLETAIARAEAEGARVLLDGRGHKPQGEPWSGGNWLGPTLLDGVRPEMEAARRELFGPVLSIVRVPTLSAALAVENASPYGNAASIFTTNGGVAQTVVEGVRAGMVGVNVGVPVPREPFSFGGTGDSRFGHGDITGPSSLDFWTQVKKVTRKW

SEQ ID NO: 19397 - protein, 320 aa, Myxococcus xanthus
MHFRKLGRSGLVVSEISYGNWITHGSQVEEEAALACVRAALDVGITTFDTADVYAATRAEEVLGRALKGERRAGYELFTKVYWPTGPGKNDRGLSRKHILESIDGSLRRLQTDYVDLYQAHRFDVETPLEETMLAFADIVRQGKALYIGVSEWTADQIRQGAALARELRVPFISNQPQYSMLYRVIEPQVIPASDEAGLGQIVWSPIAQGVLTGKYLPGQAPPAGSRATEANAVRYGITRFMTDDVLTRVQQLVPLAKDVGLSMAQLAVAWVLQNPSVSSAIVGASRPEQVHDNVKAAGVKLEPELLRRIDAVLGPAIER

SEQ ID NO: 19398 - protein, 483 aa, Myxococcus xanthus
  unsure (1)..(483): unsure at all Xaa locations
ASQRDRGHGPPPRYAAGTRXRHMAEAFDVVVIGAGPAGEVAGARAAEAGLSVALVEHELLGGECSYWACIPSKALLRPSEARWLAEHAAGVREKLQEGIDARAVLAHRDSMVNNYQDDSQVKWAENAKLKVVRGTGKLTGPRKVRVEDKDGAVRELEARKAVVLATGSHPRIPDIPGLKDAQPWDNRQGTAARQVPKRLVVLGGGAVGVELAQAWRSLGSEVTLVQRGKRLLSRAEPFAGEQVAQALRDAGARVLLGMNATRVQRPGGKGEVTVTLSNGEQVVADEILVAMGRVPRTEGIGLETVGLVGGKPVEVDDQLRAKGVDGGWLYACGDTNGRNLLTHMGKYQARMVGDVIAGKQARAWADAKATPQVVFTHPQVASVGLTEAKAREAGLPVRTVEQQLQDVSGTSLVGKGLTGTVKWVVDEKRRVLVGATFTGPEVGEMLHAATIAVAGEVPLDTLWHAVPSFPTMSEVWLKLLEAY

SEQ ID NO: 19399 - protein, 881 aa, Myxococcus xanthus
  unsure (1)..(881): unsure at all Xaa locations
SAHAAIFEHSRDGVLVLDAGQRIVEVNRAAERIFGPRTRLVGQPVGLLLPGWRPPEPRAPADAALRETELAGHRPGGSGPAHYLRVVTLPLPGEGDGGWVLQLHDMTARLEVEASLRQQKEFFEAVVINSPVAIITITRQFRVLSWNPEATRLFGYSPAEALGKHIFELVATEPTVLPEAEQASREVVQRGRLRSVTRRVRKDGSVVDVELRALPVSVGGRQLGFIAIYHDITDLERARKAAEAANQAKSLFLATMSHEIRTPMNAIIGMTGLLLDRALTEEQRDFVATIRQSSEALLTLLNDVLDFSKIEAGRFEAELRPFDLRQCVESVLDLMAVRASEKGLDLGCDLAPPLPQMLVGDASRLRQVLLNLVGNALKFTEHXGAVVSVQGLALGGTEGAADWELTFSVQDTGLGIPDDRRTGLFQPFNQLDASVSRRFGGTGLGLAISKRLVEAMAGTIWVESEGVPGQGTTFRFTLRAQAAPQAYAVQPRQEQGLLQGRRVLVVDDNALFRRLLGRQLQAWGLVPVESASGMDALAQLEAGASFDAVLIDHHMPGLDGTALAERIRQREETRALPLVLVSTPGRRGNPPEGLFAGVLSRPLKDSQLYDALVSCFSQHLPQLPEPRQTRPSRAGPFPGERPGDTVPLDILLVEDNATNQKLALLVLERLGYRADVALNGRQALQALSQKRYDAVLMDLQMPEMDGLEATRRIRQELPPKAQPWVIAMTANAMDSDRTQCFSAGMDDFLGKPIRVEALMAALMRCQPRRSXVAPERRVSSGAVELTPQHSVMRVVLDVARIPGLESAALARLWAELGAQAAQILPELIDTALHSMPALLEDAYSALGRGHADDLGRAAHTLKSNAAWFGASALESQARDIE

SEQ ID NO: 19400 - protein, 326 aa, Myxococcus xanthus
GLDKLVQVERPDPTPGPMQVRVRVKATSLNSRDLMMVEGRYNPRQKLPLIPNSDAAGVVDAVGPGVTRVKPGDRVMSLFSQAWSAGEPTRAAQVSTLGGPLDGALADTVLLHEDGAVPTPAYLSDEEAATLPCAAVTAWSALVTHGALKAGDTVLLQGTGGVSIFALQIARLLGARIIITSSSDAKLARARTLGAHEGINYGTTPDWDKAARALTGGVGVDHVVEVGGAGTFEKSLRAVRPGGTVSVIGVLSGGAGTVPLTPILMQNLRVQGIFVGHRQSFDALNRAFALHTVRPVVDRVFEFSEARAAFEHLKRGAHFGKVVVRV

SEQ ID NO: 19401 - protein, 450 aa, Myxococcus xanthus
QASQKLFGTDGVRGKANVYPMTAEVAMQLGRALAFLIRNGPHRHRVIVGKDTRLSGYMLEQALASGLTSMGVDVELVGPLPTPGISNITTSMRADAGAVISASHNPYEDNGIKFFWRDGFKLPDETEGKIEELVSSGSIDSIRPTATKIGRAFRMEDARGRYIVFLKATFPRELTLEGMTIVVDCANGAAYKTAPAVLEELGAKVIALGVSPDGKNINHKCGALYPENLAKTVVKHGAHLGIALDGDADRLIVVDEKGKVVDGDAIMAICTGELVARKQLKKKMLVSTVMSNIGLERAVARWGVKVARTRVGDRYVVDEMRRNGYNLGGEQSGHLIFLDHTTTGDGTLAALQLLAVMCRAGKPLSELASIFEPVPQTLVNVVVKQKKELGELPTVMKVIKSVEQRLGNTGRVLVRFSGTEPKARVLIEGEDAARNQAYAKEIADALSKAL

SEQ ID NO: 19402 - protein, 626 aa, Myxococcus xanthus
KTIGLWVILIVLFVAFYNFFSQGNDQVQEPSFTQLLTKVEEKKVQEVAVKGNTYSGKFTDTSEKFRTTGPAPDAAMLNQLRSNGVDVKYEREEQNSLWLTILGQWMPVVFLFLFFIFFMRQLQGGSGKAMTFGKSKAKLLSESHNKVTFADVAGADECKEELEEIVAFLKDPKKFTKLGGRIPKGVLMMGSPGTGKTLLARAVAGEAGVPFFSISGSDFVEMFVGVGASRVRDLFEQGKKNAPCIIFIDEIDAVGRHRGAGLGGGHDEREQTLNQLLVEMDGFESNDGVILIAATNRPDVLDPALQRPGRFDRRIVVPRPDVKGRLGVLKVHTRRVPLAPEVDLEVIARGTPGMTGADLENLVNESALMAARQNKERVDLSDFEAAKDKVFMGPERRSMIMTEKEKKNTAVHEAGHALLAKLLPGCDPLHKVTIIPRGQALGVTWSLPTEDKVNGYKKQMLDQISMAMGGRIAEELMFNEMSSGAANDIERATETARAMVCRWGMSEKMGPLAFGKSDGEVFLGRDFNSSKDYSEDSARQIDAEVRNIVVGCYERGKNLLTENIEALRRVSDALVEYETLDAEDVNILLQGGQLTRERPPPRVNAPPKATEKKDKRKILDALEGLP

SEQ ID NO: 19403 - protein, 812 aa, Myxococcus xanthus
LLRKIGADVKLFPARLGEALQKLPRMQGGESAMLGQRLLKTFDKAEDEAKSLKDEFISSEHLLLALTHDKGAVGEVMKSSGVTRERVLSGLKEVRGSGRVTSQDAEATYQALEKYGRDLTEAARSGKLDPVIGRDEEIRRCVQVLSRRTKNNPVLIGEPGVGKTAIAEGLARRIVDGDVPEGLKNKRLVSLDLGAMVAGAKYRGEFEERLKAVLKEIADAAGEVILFIDELHTLVGAGKAEGAMDAGNMLKPALARGELHCIGATTLDEYRKHIEKDAALERRFQPVLVGEPSVHDTISILRGLKERYEVHHGVRIQDNALVAAATLSHRYIADRFLPDKAIDLVDEASSRLRIEIDSMPTELDDVRRKMTQLQIEREGLRKETDPHSQERLGQIEKELANLSEKFNALKVHWDAEKTAIGAIRSLKEKQEKAKNDQAAAERQGDLNRAAELKFGVIPSLDKELKAQNEKLAELQKNQKFLKEEVDAEDIAQVVAKWTGIPVSRLMEGEVQKLVHMEDRLANRVIGQRSAIEAVSNAVRRARSGLQDPNRPIGSFIFLGPTGVGKTETAKALAEFLFDDDSAMVRIDMSEYMEKHSVARLVGAPPGYVGYEEGGQLTEAVRRRPYTVVLFDEIEKAHHDVFNVLLQILDEGRLTDSQGRTVDFKNTVLILTSNIGSQDIQAGMAGKEELDERTRNEVMDALRAHFRPEFLNRVDEIVIFEPLRKKDIYRIVDLQLARLSKLLADKRLTLELTEKARELLAERGYDPTYGARPLKRAVQKNLLDPLALKVLGGEFVPGDHIQADAGPDGLTFA

SEQ ID NO: 19404 - protein, 328 aa, Myxococcus xanthus
KHVTHIKDLGPEGVEAVLAQAAAWKQKGPEHALFANTLLGMVFFNPSLRTRTSFEAVMLRGGGNAIILDVGSGVWKLEHREGAVMNADRAEHLKEAAPVLSRFVDMLGVRTFSQGGGDEEDELDPVINAFRKWSTVPVVSMESAREHPCQGLADMLTLRETFGNTKKLPVTLTWAPHIKPLPKAVPNSFLLSAAAAGCEIRVAHPPGFDLHPAVRAEAEAYAKATGGSVTYTHDQDEALAGSRAVYAKSWGPTAAAAFSPNDVSALLASYSGWMPTRLTMSRAQKDAAFLHCLPVRRNVEVADEVLDHPSSRVVDEAGNRYHVQRALL

SEQ ID NO: 19405 - protein, 285 aa, Myxococcus xanthus
LRHAAKYVQQFRRKTFVVKLGGAMLSDPRLRRAACEQIALLWTFSIRPVVVHGGGPELDTLCDALHLPVEKVAGRRVTSAPVLDAAKMVLAGKLHTDLLADLQAAGVPAVGLSGVDAGLIKARKRPPVMVTEAGATEGKLVDYGLVGDIEQVDTRVVEHLRSADYVPVIAPLSGGTDGAVYNTNADTVAAALAVALSAEKLFFLVQVPGLLKNVSDPSSLVTLANLTDLATMESTGAIAGGMKPKAHAIRHALVGGVGSVHLVSGVQPNALLEEVFTNEGSGTMV

SEQ ID NO: 19406 - protein, 350 aa, Myxococcus xanthus
AHARMLARVGLLKDAEAKSLVTALKALHDEARAGTFVIRPEQEDGHTALEAALVERVGDPGKRIHLGRSRNDQVQLALRLLLREEVLTLGARAAELAGAFLDFAQAHKDVALPGYTHLRRAMPSTFGLWGMAFAEGLLEELEALRGVWARLDRCPLGAAAGFGVPLPIDREYVAALLGFSRVQRSPIDVQNGRGRHESAVLGWACSVAGTLEKWLWDVQLYSMDEFGFLGLPDAYTTGSSIMPQKKNPDVVELARGRCRELRGLAHQVEAVAGGLPSSYHRDFQLLKSPTLTALGSTRELLDVLTRLVPALQVKADAAARASDDTLYAAHHAYALVAQGQAFRDAYKQVG

SEQ ID NO: 19407 - protein, 243 aa, Myxococcus xanthus
KKNVVLAFSGGLDTAFCAVYLREQGYDVTTVTVDTGGFPPEQLERIAALSKQLGAVEHVTVDARETLFQGYLRYLIAGNVLRGQVYPLSVSAERACQAAEVVRVAREKGTQALAHGSTGAGNDQVRFDVAFRSLAPELELLTPIRTLSLSRQQELTYLAERGVHMPPKLGSYSVNEGMWGTSVGGAETLDSWKALPEAAFPGGELSQDLKPRPLTVSFEKGVPVALDGEKLGPVKLVEALNAL

SEQ ID NO: 19408 - protein, 323 aa, Myxococcus xanthus
AAGIGAALGLRRILRSRFQFKDSTVLITGGSRGLGLVLARQLLKEEARVAICGRDEQTLERAREELERTGGEVYAIPCDVRDPVQVEAMVSAIHERWGTVDVLINNAGVIQVGPLESMTLEDFQEAIDTHLWAPLYTTLAVLPEMKRRGKGRIVNIASVGGKVSIPHLVPYSASKFALVGLSDGLRAELRQDGIVVTTVCPGLMRTGSPRNAYFKGNHEAEYAWFATGDSLPLTSLSAEQAARKILDACRRGDAEALLGAPAKLAAVGRTLAPNLTATLTSWANRFMPQDSSQDRYSGSQSETPLTQSWLTELTRRAAERNNE

SEQ ID NO: 19409 - protein, 379 aa, Myxococcus xanthus
MDFSWTHEQVELYDRALAFARAQLPEAAKPSKEALPRDLWQRCGEFGFLGLPVPAAHGGLGLDTLTTARVMEALGRGCVDTGLVFSVGAHLFACVMPILESGDDAQKSRYLPRLCSGEWVGANAISEPEAGSDVFALKTRAVRDGDSYVLDGGKSYVTNGPSADVFLVYAATQPAHGYMGLSAFLVEKDTPGLSVGRAFEKMGLSTSPIAPIYLEGCRVPESARLGAEGQGAAMFKRSMQWERACLFAAYVGVMERVLEQTADFARTRKQFKKALGKNQAISHKLADMKQRLEASRLLLYQACWKMDRGQDAVMEVSLAKLAISEAAIQSGLDAIQIHGGMGYVAETGIERVLRDAIPSAIFSGTSEIQRDIIANQLGL

SEQ ID NO: 19410 - protein, 528 aa, Myxococcus xanthus
PSLIDSGPRSMPAGAPRTLVELLQQAVAHAPGHVITFIDVQGQRETLTFAALWDEALRLWGGLRARGAKTGDRVMLAMERPGDFVRGFWACTLGGVVPVPLALPASLERSQPGVARLISVSERLGTPWLLTEARATAPLSEAGLRALSLQSLSGAEPGPLAAVDPEAPAILSFTSGSTGRPKGVVLKHANLMAMGEGMVAGGWYLPGDVGVSWMPLDHVAGTSYPHLLALRTRTPHVLVARDYVLADVLRWLDLLSEFGGTMSWAPNFAYGLVADRLEREERRAWRLEQVRVLASGGESVLPATLRRFSEPLRDSGLREDAVCPAWGMAETSSFFSMTRGVRTHPVEAATELGPPPVGAALRVVDDTDAVVPEGQVGHLQARGEQVLSGYLDDAELNARSFTADGWFRTGDMAVIQDGQMSIAGRQKEVLILHGNNVYPQDIEEVVESVPGVLPSYTVACPTRSGAAQTDELAVCFVPTPDAPPLAELLRSIREKVGRVLGFHVAHLLPLAREQVPRTELGKRGRTEL

SEQ ID NO: 19411 - protein, 300 aa, Myxococcus xanthus
ELAIEVKGLVKRFGDVTAVDGIDLDIRRGECVGLLGPNGAGKTTTVEILEGLQTATSGEVRLLGLRWETDAPVLRERIGMTLQETRLVDQLTVEEMVRLFTSFYPRPLEVEALIGLVQLGEKRHARVGKLSGGQKQRLALALGLAGDPDVLFLDEPTTGLDPQSRRALWDVVAQLKARGRTVVLTTHYMDEAEVLCDRLVIIDRGRVIARGTPRDIITSLGAEQVIELEAEPSPDLERLRPLPSVVAAQRHAGRITLRVRELHLALPEVLREVAAGGGQLLHLSTRRPTLDDVFIDMTGR

SEQ ID NO: 19412 - protein, 194 aa, Myxococcus xanthus
MFVLPNLFTVTSIFCGFYAITLCTGDAEPVQLYQAALAIFFAMFFDGFDGRVARLTKTQSDFGVQLDSLADVISFGAAPSLLVYKWALEPLGFMGLFIAFSFAACGALRLARFNVLAARNPHGGGGSFFVGLPIPVAAGMLVSVIISHHAATQGQPLAESAVVPMAVAVAGLALLMVSTVRYSHLQGHAAQPEE

SEQ ID NO: 19413 - protein, 436 aa, Myxococcus xanthus
  unsure (1)..(436): unsure at all Xaa locations
ISYEKYALPNGLEVILSVDRKLPVVAVNVWYHVGAYHEQPGRTGFAHLFEHMMFQGSRNVADDVHISRLEQLGATDLNGTTSFDRTNYFETVPSNHLETALWLESDRMGFLLDAITPEKLETQREVVKNERRESIETAPYGAAREKAWHALFPLPHPYHGDVIGSMKDLNAANVDDVKDFFRKWYAPSNATLAIVGDFDVAKTKALVEKYFGTLPSHARPQRPEVAPVNLTAPVVLREEERVARLPLLSIQWLTPAYLEEGDATADVLATALSTGKASRLYRRLVLDKELAQSVSATQQSQGAQSVFSVDVVARPGVSTDTLLHEVDAVLDEVRQQGITPAEIARARTRYDTRTLAGLQSVGGFGGKADVLQSYNHFVGEPNYVAQDLARYESVTPEAVKQFAQDTLRPGARVILHAVPPARRQAPLDSKERHXCA

SEQ ID NO: 19414 - protein, 495 aa, Myxococcus xanthus
PHIKEGPGPRKPWSERPDARTTSGTVSPRPAAIRGPQGGTSMAISTIDPATGKTLRTFTPLSAEELEAKLQTAADTFRTYRETTFADRVTWLRRAADLLEAEADRYGRIMTQEMGKPIDAAKAEAKKCATACRYYVDKGESLLRDRLVDMGTGRAFVRYQPLGPVLAIMPWNFPFWQVVRFAAPALMAGNVGLLKHAHNVPQCALALEELFLQAGFPRGAFQTLLIETADVHRVIEDRRVRAVTLTGSEGAGRAVGAAAGKAIKKVVLELGGSDPFIVMPSADMEKAVETAVSARLINNGQSCIAAKRFIVADAIYPEFERRFVERMKRVTVGDPMDAKTDLGPLATRGILDGLHAQVEASVKAGARLLLGGKALEGPGNFYPATVLAEPPPQAPAFHDELFGPVATLLRARDVDHALELANATPFGLGASVWTQDEAEQRRFIDGIDAGMVFVNALVASDARLPFGGVKHSGHGRELADVGIHEFVNIKSVRIA

SEQ ID NO: 19415 - protein, 336 aa, Myxococcus xanthus
  unsure (1)..(336): unsure at all Xaa locations
RGLVPGQTVAQRYRVERWLGAGGSSTVYEATDLHQDMRVALKVLAVPHADAAMVARFRQEVEHARALEHVNILRVFDAGVDGERHFLTVELLDGVDLRQRLLERRATLAEALRWLTHATVALEHAHGRGVLHRDVKPANLFITRTGVLKLMDFGLAKSTHVMGTTAQGAVLGTPEYMAPEQVTGNPAVSPATDLYALGVVAYELFTGQLPFRHPEPVPLMFLHVQERPVPPRTLRPALPEPFERVVLRLLEKRPDDRYRSAAELRTALAKLWPHALNGDASVAARAPAPPLARARAPGPGGGTGXEKRAAVTPPMPLAPSCPEPTAPTRAPRRPXV

SEQ ID NO: 19416 - protein, 523 aa, Myxococcus xanthus
LLGETIGQNLRRTVERHGDREALVVASQGFRATYQQLWALTSQVARGLMALGVQKGDRVGLWSPNRFEWVAVQYATARIGAILVNINPAYRSSEVEYALNQSGTKVLLHARGFRQTDYRGMVKEVRPRCAGLAAALVLEDDWQRLLDGAEDVSEDALAAREASLQFDDAINIQYTSGTTGFPKGATLSHHNVLNNGFFIGEALRYGPEDRVCIPVPFYHCFGMVIGNLACTSHGATMVIPAEAFDPLTVLQTVQAERCTSLYGVPTMFIAELDHPRFGEFDLSTLRTGVMAGSPCPVEVMKQVQSRMHMREVTICYGMTETSPVSTQSALDEPLDKRVSTVGRVHPHLEVKVIDAGSGEVVPRGSPGELCTRGYSVMLGYWANPEATAAAVDAAGWMHTGDLAVMDDEGYVKVVGRIKDTIIRGGENISPREVEEFLHAHPGVSETQVIGVPSKRYGEEVMAWVRVKPGATLTAEELTRFCAGRIASFKIPRYFKFVDAFPMTVTGKVQKFKMREASVVELGL

SEQ ID NO: 19417 - protein, 347 aa, Myxococcus xanthus
MHAVAVFPGTREVRLVDPPEPRPVTGSQVLLKVLEVGICGTDREIGAFEYGTPPPDSDHLILGHEALAEVVETGPDVTLVREGDLVVPTVRRPCPHARCRPCRAERQDFCVTGDFRERGIKAAHGFLQEWVVEEEGHLVVVPRKLSDVAVLVEPLSVAAKAAEQVQAIQRRLPWERARVRALALGAGPVGLLGAMSMVVNHFDTFVYSLEPAASERANLIRSFGATYVSGQDVLLGELGKKVGTFDIIYEAVGMSKVAFAALDALGPNGLFIFTGIPAHGGPNPVDTDTLMRNIVLRNQLLLGTVNASRSAYELALRELEQAMFLFPQSVRALITHRVPIQEAPALL

SEQ ID NO: 19418 - protein, 250 aa, Myxococcus xanthus
RFANQKLIVVGGTSGMGKAVARILLEEGGRAVVIGHRDDKLQAAVAELAASGPVEGLRADIASGTERQALVAQLQKDHADATLLVNAAGVFLPKAFLEHEERDYDLYLDINKALFFITQAVARSMVALRKGGAIVNIGSMVGQAGHPGHSISAYSMAKAGLHSLTQHLAMELAGHGIRVNAVSPAVVETPIYEGFIPKEQVHGALQGFNGFHPLGRVGRAEDVAQTIVHLLSDETSWVTGAIWDVDGGVM

SEQ ID NO: 19419 - protein, 466 aa, Myxococcus xanthus
VSTKNVRTEKDTFGPIDVPADRLWGAQTQRSLQNFAISTERMPLALIRALVLVKKAAARVNVENGSLAKEKGEAIIRAADEVLAGQHDAEFPLSVWQTGSGTQTNMNTNEVLANRASELLGGERGERRKVHPNDDVNKGQSSNDVFPTAMSVAAVAAITEHVLPELKALRDVLAQKARAFHDVVKVGRTHLQDATPLTLGQEVGGFVAQLDHAKGHLERTLPHLLELALGGTAVGTGLNAPKGYAERVAQELAQLTGHPFVTAPNKFEALAANDALVQAHGALKGLAAVLFKVANDVRWLSSGPRSGLAEITIPENEPGSSIMPGKVNPTQSEALTMLCAQVMGNDVAVTVGGASGNFQLNVFKPLIAHNLLQSCRLLADGMRSFRLHCAVGIEPNRPRIQENLERSLMLVTALNPHIGYDNAAKIAKTAHRDGTTLKETAVALGLVTPEQFDQWVRPEDMTGHKG

SEQ ID NO: 19420 - protein, 698 aa, Myxococcus xanthus
RTALLRPSGKETREDPFPALVAMARQSDKPVYLVPELFVWEKRPARLKPNWVDVVFGSPEAPGFLHSMLAFFRNYKRAQFRVGEPIDLQRFVAENPRDSDELLARKARSSLHVHLARETRAVFGPPVKPASRVIEETLRDRSLRKVVEECAAESGRKPESVLREARRNLEAIAAKPSPTALAFTSPVLEWVFNRIYDGMHVDEAGLHRALKAASHAPIVLCPSHKSHVDYLVMSWVLWNRGYAVPLVAAGANLSFWPLGTFFRRCGAFFLRRSFKGDKVYAASFKAYVRKLVHDGIHQEFFPEGGRSRTGKLLLPKLGMFTWQVESVLEGARDDLIFVPVAIDYEKVVESSSYSKELAGGEKKPEDLKALLSTPKVLAARYGRIHLGFDEPISLRAFMQARGINPDEPVSDEQKKGLVRALGNRVMYGISKVSTVTPHALVSTALLSHRRRGLTQREMADRINILRRIAVEEGSPQSVEMRNAPSNPETMGPIQDAMRTFISDEMVRTQEARGEVIYQVEEARRPELSFYKNTLMNLVASRSLVANAMLASGSPAPYDTVKERALFLSRLFKVEFIYRVGTTFDSIFAETVERLERMGLVLEENETLRVAPEAHARPDLEFLADMLRDYLEAYLLAALTLQDVATGAAEDRKSFVKMALETGRAEYHAGRITASESLAKVTLENAVAFLLDQKLLIEA

SEQ ID NO: 19421 - protein, 368 aa, Myxococcus xanthus
DYYQTLGVDRSASAEDVKKAYRKLARKYHPDVNPGNKAAEEKFKQVSAAFEVLSDTRKRKLYDEFGPDAEKIGFDEKKAEAYRAYKASAGSAGAGGIPYGAEGFDLGDLFGDLFGGRGGGAAGGAPGGFDIGEMFGRRGRNAGPERGEDLTVRVQLTLAEAVSGTERPLAFNRPGRCSTCSGRGTSGPVSTCNVCNGTGRARRSGSLFGGAGACPNCHGTGKAAPPCPQCGGAGVKEELARLTVKIPAGVHTGSKVRLSGQGAAGTRGGPPGDLYIETEVAEHPLVRREGDDLHLDLPVTVSEALLGADVRVPTFQGEVTVKVLPHSQSGRRMRLKGRGVPSLKGGAQGDLYLHLQVKVPEETTAEAR

SEQ ID NO: 19422 - protein, 138 aa, Myxococcus xanthus
MDIGEILNLLPHRYPFLLVDRVVEIIPGQKLTAYKNVTINEPFFNGHFPGHPVMPGVLILEALAQATAILAYKSENMDPSRKLTYLMGVDGARFRKPVLPGDRLQLEIEVVRHKGAVWKTKGLATVDGARVAEGEFLA

SEQ ID NO: 19423 - protein, 350 aa, Myxococcus xanthus
VLHFGSYNYSGLNGHPRVVAAAEAALRRYGTTVSGVRLLNGTCELHLELERALAEFLGFEDCVTYSSGYAANLSVLSALCAEGDVVLSDMLNHQSIIDGLKLSGADIRTYRHKSLRSIESTLKKLPYEQRKFIITDGVFSMDGDVADLPGIVALAESYNAFILVDDAHATAAMGPNGRGTPAYFGLQSQVDVLTGSLSKGLPGIGGFAAGSKATIDLLRFGSNGYIFSASLPPPIAAGLLEGIRILQEQPELQERLHHNENYLRAGIRSMGLDCMNSESPIIPILMPAYEKTFELTRLLHLEGIYVNPVGYPAVSKNRTRLRINVSANLTQADLDRFLDALDRCSRKLNL

SEQ ID NO: 19424 - protein, 581 aa, Myxococcus xanthus
  unsure (1)..(581): unsure at all Xaa locations
GGAFLFEEVGSARILTPETFTEEQRLFFKTALQFSREQVLPLSERIEAKDNALLRQLLRQAGELGLLSVDIPEAYGGTGLDKTTSLLLAEAMSLNGSWSVTFGAHTGIGTLPIVWFGNAEQKAKYLPKLATGEWVAAYALTEQGSGSDALGAKTKAVLSPDGKHWILNGSKLYITNAAFADVFVVFAKVDGDKFTGFIVEKDTPGLTVGPEEHKMGIRGSSTCPLYFEDARVPVENQLGEVGKGHKIAFNILNYGRLKLGAGVLGGMKLQLQNALRFTQERKQFNAPIVQFPLSREKLARMAALVYAVESMTYRTAGLVDARLGQGDKDAPDYEARLLEAVEEYAIESSIMKVHGSESFGHLVDDAVQLHGGAGYIEEYPVERSYRDARINRIFEGTNEINRMLITGMLLKRAVRGDLPLFAMAGNVAEELSRGERPRARVQDALAPQEVAAEAAKHLALHGLRVAAETFGPELEQHQEVLAALSDVVMDAFALDSMVTRTRQAATSGALDPVRVAMTQLYALDAIPRAYDRTRRALCATLKGGALDQELERLGTLDVFTPYDXAALRETVVAALESAGGY

SEQ ID NO: 19425 - protein, 281 aa, Myxococcus xanthus
KGIILAGGSGTRLYPLTRVVSKQLLPVHDKPMIYYPLSTLMLAGIRDVLVISTPQDLPRFQELLGSGDQWGMRFSYAEQPKPDGLAQAFVIGRDFVGADSVSLVLGDNIFYGHGLSELVKRAASRTSGATVFGYYVKDPERYGVVELDAKNRAVSLEEKPLKPKSNYAVTGLYFYDNQVLDIAAGLKPSKRGELEITDVNAEYLRRGQLDVELMGRGYAWLDTGTHESLMQASNFIEIIERRQGLKVSCPEEIAFRMGYIGAQQLLTLAEPMLKNDYGQYL

SEQ ID NO: 19426 - protein, 427 aa, Myxococcus xanthus
MELICIGLSHRTAPLTVRERLALPESRQVDVLQRLAQAPVEALWVSTCNRVEVYLFAPDAAMARQRALMELQVLGGVEALEHLYEHQGEAALVHLFRVACSLDSMVLGEAQILGQVKEAFERGQGAGAVRGELMRACAAAFSCAKRVRTETAIGRAATSMAAAAVQLASKVFDGLAGKTVLVVGAGEMGELAARHLKQAGASKLYVTNRTLSRAEALAAEVGGQARPFEELLGLVAAADVVVCSTGVAGAALHAGQRGRPGARTPGAPLFMVDLAVPRDIDPAVGTLDWVHAYDVDDIQKFVADNAAARAEEAQKAGVLVAQEVARFVKERALREGTPVLARLRQRAEAIARSEVERTLGALGDGLNEKQRKSIEAMGRAIVNKLLHEPTARLRAVGPEGEGNRLAGAAAELFGLLEEEVGTAAAAP

SEQ ID NO: 19427 - protein, 298 aa, Myxococcus xanthus
VRIATRQSPLALWQARHVGALLTSRHPGLEVTLVEMTTEGDRFLSAPLSAVGGKGLFVKEIEQALLDGRADIAVHSLKDMTSVFPEGLILAAVPEREDPRDVFCGLGGLTLDTLPQGARVGTSSLRRSCILRSRRPDVDIVSVRGNVQTRLARTREQGLAGALLAYAGLKRLGLEDVITQVLPPEVSLPAVGQGVLAIQCRTDDARVRALLVPLEHATTRIAVTAERALLAKLEGGCTVPLAGYATVSGDTVFLRGLVGRPDGTHVVRGEVRGPVSQAHALGESLADDLLSRGAADIL

SEQ ID NO: 19428 - protein, 249 aa, Myxococcus xanthus
LEGKRVLVTRPRERAEELCFLLEDEGAEVLSVPLLELHPPEDPRPLASAAEHIQRYTWVVFASPTGVDALMEALREAGTQDRIQRVKVATVGPRTTRAAEGYGLVVVAEPSEGTGAALLNLIKDALQPGDEVLLPAAEEGRRELEDGLREYGLLVTRVTAYRATPAPLPPESLALLDASPPDVVLFASPRTAEAFVEEAGRERLATARVVAIGPTTASALERLGVPAAAVAERPTPESLVDAAVLAVTS

SEQ ID NO: 19429 - protein, 463 aa, Myxococcus xanthus
MADFDLVVIGSGPAGEWGAVQAALAGKRVAVVEREPVLGGTAANTGTLPSKTLRETALHLSGFRARGLYSVETTLRHEATVSDFLFRERRVKDIERERIARNLQRHKVEIIQGTGALVDANTVVVRRQDAPERRLTGGTILVATGSSPYRPPLYPFEDPRIHDSDEVLELERLPRSLVVVGAGVIGCEYACMFAAMDIPVTLVEARAELLPFLDDEFSALLGQRMEALGIQLRFGQVVEQVDVPRDADTPIRMMLSSGAVLETDQVLVASGRTANTAGLGLEALGVQVGPRGQVEVGPTYQTALPHIYAVGDVIGFPALASTSMDQARIAVEHAFDLGGVRTMAPVLPYGIYTIPEVSMAGETEEALRTLNVPYVAGRAAFATNPRGQILGDTHGLLKLLFHRESLKLLGVHVMGPQASELVHVGLTALLTGSTARLFVETCFNYPTLSEAYKAATFDALDQL

SEQ ID NO: 19430 - protein, 686 aa, Myxococcus xanthus
APEAPPAAPVATAPEWPEPQPPALRLPDSVRPTRYALDLKLLPAEPTFSGSVSIDVDVSEPVRQVWLHGQDMEVSQARIEAGGRTLEARPVTASEGRLGLLLPETLAPGKARIHIAFTGKVDRERSQGLYAVEEGGEPYLYTFFEPVDARRAFPCFDEPGFKVPWTLRITAKEDHVALANHPIVSREKLPDGLARVTFAESKPMPSYLVAFVVGPFDVVDAGTAGRNAAPLRFIVPRGRGAETAYAASVTPRIVTLIEDYFDMPYPYEKLDVAVVPRYWGTMEHPGLVALGQPLTLIRPGEETLARRKWYVNIANHELGHYWFGNIVTCQWWDDIWLNESLTSWLDRKTVDPFDTSWGFGLEQSTQSTLFALDTDALAATPPVRKPANTHDEVLGSFDNGTTYAKGSAIIDMFEAWLGEERMRDLLRGHIKKHEWGVATSEDFAATLSAAAGPDVARAFRSFIDQPGAPRIAAELQCQPGAPAKLTFTQERYVPAGSTASKDQTWSVPVCVRAGSGKTSERTCTMLTGATGELALPGKSCPSWFVLNAGGTGYYRSGYTREQLTRVLAAPTEALTVRERLTLLADMEAGVRRGDLPLSDVLRYVPTTAKGDHRLIMQRGARLLTFVHVDRLSNDESARYRNWVAAMYGPRARALGWEPKPGDDDAVKSLRPNLLGLAALRGEDPAL

SEQ ID NO: 19431 - protein, 235 aa, Myxococcus xanthus
IGVGAEQSLTRLHRAHLEAVPFENLDIHLKRPIRLDMNALFEKVVVQRRGGFCYELNGLFARLLTALGHRVTLLSAGVATAPDGSAYGPEFDHLALQVEDEQGRWLADVGFGECFTEPLRLDTHDVQVRSGRAYRLSPEGNNLILWSEKPSGWEAEYRLSLVPRQLADFEGMCRYHQTSPDSIFTQRRLCTRATPEGRITAKEGTLVLTRSGVRTEQPLPVEDALRRALVEHFGV

SEQ ID NO: 19432 - protein, 827 aa, Myxococcus xanthus
MSDEKKKGSAASAMPTAMAPPGLINKEDIPQVLPILPLRNSVFFPGGVLPLAVGRQKTIALIKDAVRDDQVIGVVTQRRAEEEDPGAADLYTMGTVARIVKLLKMGEDNYSLVVQGLARFRVVELVQEAPYLKARVDAVEDKTSSENVEVEALGINLKKLAREVIELMPELPAAATELVESITHPGHLADLIAANVDVPIEEKQAVLETVDLKARMKLVLELLNRKREILKLSNKIDSAVKGEMSKTQREYYLRQQLKAIKEELGEMGEEEEELDELQERLKKAGLPPDVEKVANKELNRLKTIPAASSEYTVARTYLDWIADLPWAKISEDNLDIENARQQLDKDHFGIKKVKKRILEYLAVRKLKNDMRGPILCLVGPPGVGKTSLGQSVAKATGRKFVRLSLGGVRDEAEIRGHRRTYVGALPGRFIQSMKKAGTKNPVMMLDEIDKLGADFRGDPSAALLEVLDPEQNNTFSDHYLDVPFDLSKVMFVATANQLDPIPGPLRDRMEIIELTGYTFEEKQSIARIHLVPKQLKEHGLSPDHIDITDEALLTLTTAYTREAGVRNLERRIADICRAVAVEVAGGKTEKQTINADRVKEILGPEMFYSEVAERTEVPGVATGLAWTAAGGDLLFIEATKMAGKGGMTLTGQLGDVMKESATAALSYLRSKAEQLGISPNFLEKTDLHLHFPAGSIPKDGPSAGVTILTALTSLLTGIRVRHDTAMTGEATLRGLVLPVGGIKEKVLAAHRAGIKRVILPERCRKDLIDVPDQARNELEFIFVTHMDDVLKAALETPPVGVAGTPGGEPGKEAPLPKPAESAPEVRA

SEQ ID NO: 19433 - protein, 378 aa, Myxococcus xanthus
GESQRFKAYRVQHNQARGPYKGGLRYHREVSLDLFKALAAEMTWKTAIAEVPFGGGKGGIQIDPREYGREEIEAITLRFMYRLKSMIGPDIDIPAPDVGTNPGIMALLYRQYSDGERERHNLRGIVTGKDVRIGGSEGRHKATGQGVAFCIEDYYADRGESVKGKTFIIQGFGNVGSHAANILSQMGARLLAVNDADGTIFNGDGIDVTALSAYVQDPKNLKRSVLGFPGAQRIEKKDLWDVQADILVPAALGGEITADVAERLRVKLVAEGANGPTTPEADRILEKRGIELIPDIIANAGGVTVSYYEWIQNKRMERWSEAEVDQRLERAMKRNYRIIRDISRNQPRKTEMHDSRQYCIGETVDTRCAAMILALKRI

SEQ ID NO: 19434 - protein, 605 aa, Myxococcus xanthus
YILLLVLGFLLFRNVFQDAGVRRVSYSQFRDGVEAGNFSRVQISNEWVKGFLKDTAQPPPPPADGERTLRGEPSALPWMAYRVAGDEGLVPLLEQKGIQFEAVPQSGLGEALWIWLLPLGLFFLFWSFMMRRVAGGMGQGPQSVMSFGKTRAKVQAEADTGVGFKDVAGVDEAVDELREIVEFLKTPEKFRRLGGRIPKGVLLVGPPGTGKTLLARAVAGEAGVPFFSLSGSEFVEMFVGVGAARVRDLFAQATSKAPCIIFIDELDAIGKSRNSGVAGGHDEREQTLNQLLAEMDGFDSRAGLIILAATNRPEILDSALMRPGRFDRQVLVDRPDKRGRERVLEIHAKGVKLGPDVDLKAIASRTPGFAGADLANVVNEAALLAARRNRDAVMRADFEEAIERVVAGLEKKNRRMNEREKEIVAHHEAGHAVVGWMLPHAERVTKVSIIPRGLAALGYTMSLPLEDRYLMSLDELRDKMAGMMGGRAAEEIFIGEISTGASNDIRQATEMARMMVRDYGMSTLGPVALSADHGPGFLRSAGVPETRSYSEQTARMIDEEVRKLVSEALDRARQVLTTHKDRAQALAARLLAVEVVEEDTMVTIL

SEQ ID NO: 19435 - protein, 532 aa, Myxococcus xanthus
MRWCVTCVAWCPSGGRMAMDCDWLIIGSGFGGSVSALRLTEKGYRVMVLEKGRRFRAPDFPKTNWALKRWLWMPTLGWRGLFEMSFFRHVTVLSGVGVGGGSLVYANTLPIPRDDFFQASTWGHLAAWKEELAPHYTTARRMLGATPNPLRTVPDQVLQDVGTDLGRTDFQPTTVAVYFGEPGVTVKDPYFNGEGPDRTGCTACGGCMLGCRFDAKNTLDKNYLHLAERRGLALHADTEVTWVRPLPDGGYEVEALQGARRFFRKKVRFTAKHVVFAGGVLGTLDLLLKLKASPDGLPRLSDRLGDGVRTNSEALVGVVNGRKGQDLSRGIAIGSILHTDAQSHLEPVRYSAGSGFFRLLMAPQVSGATMLQRFVRLVGLLVRHPLRFLKAWFVPDFARRTMILLYMRTLEGHLRMTRSRRLGLSTALQEGPAPSANMPEAFDLARRVADKLDGYPMTIVSETLLGIPTTAHILGGCCMGDSAETGVIDSRHRVFGHEGLYVVDGSAISANPGVNPSLTITALAERAMTFIP

SEQ ID NO: 19436 - protein, 591 aa, Myxococcus xanthus
IWTSLRAMGLIQNPPLSHASLRRVLALARPEWRLLLLGTCFLFIGSAGGLLFPQAIRVILDEALTTATLDMVNDTTLWMLGVCFIQSVAIGLRFAFFNIAGERIVSDLRERLYRSLLEQEIAFFDQHRTGGLTSRLSTDTALIQGAVSTHIAIMLRNATTLIGGLALLLYTSPRLTLVMLAVVPPVTLGALFYGRKARQLARDAQAAVAEANEVAAESLYGIQTVQAFVAEDAERRSYGRAIGKALALARTRIVSSGFFMGGTGFTGLASTLLVFWYGTHMVVSGDITVGGLTSFLMYTLMVVMAVGALSELWAEFMKAGGATERVFELIDRTPAISVSGGERPANMEGNLRFRDVNFSYPTRRDVPVLQGLDMDVAPGEVVALVGHSGAGKSTVASMLMRFYDPDRGAILVDETDLRTLDVRWLRQNIGIVSQEPTLFSGSIADNIRYGRTDATDAEVEAAARVANAHDFVSRFPEGYRTRVGERGIQLSGGQKQRVAIARAVLKDPRLLILDEATSALDSESEHLVKEALDRLMVGRTTLIIAHRLSTVAGVDRIFVLDQGRVVQHGNHEALITQDGLYKRLVERQFIA

SEQ ID NO: 19437 - protein, 255 aa, Myxococcus xanthus
MKIATWNVNSVRARQERLLAWLKKAQPDVLCLQELKCVDDDFPMEAVRELGYHAAVHGQKTYNGVAILAKEEPKDVVKGLSDGVDDSHARLIAATVGGIRVVSAYAPNGQSVDSPQYQYKLEWYGRLRRYLDTRDKPDEPLVLGGDWNVAPEDIDTYDPKLWEGQTLFTLKERDALQRLGAFGLSDAFRRLHPGVQKFTWWDYRMLGFPKNLGLRIDHLYVTAPVAERLTVVDVDREERKGKQPSDHAPVWLELR

SEQ ID NO: 19438 - protein, 337 aa, Myxococcus xanthus
ERNLIARTRPFAAQDTRRSWWEVGTTFAALLGAIALAALPSWWPLRIVGSVVQALALIRSFILVHDYLHGSLLSGSRIAKALFHTHAVLLLTPPRVWTESHNHHHANTARLAASASGTFTTWTAQQWREATALERLAYVVERHPLVMIFAYPLAFLGGLCIVPFVKHPLRYWSAGFAVLLHVTISAAVFHFGGLGVYLTAMVLPLSLGYALGAYLFFSQHNFPDVALREDPDWTHASAALEASSYLACGPVMAWFTGNIGYHHVHHLNPRIPFYRLPEAMAAIPELQNPRTTTLHPRDVLACLRLNVWDGKRGRMVRFRDVSRVTLRAPGRAPRERK

SEQ ID NO: 19439 - protein, 291 aa, Myxococcus xanthus
RHLLGIEGWRRDELESLLDRAKAHLPGGPDTTHLLRGKVVANLFFEDSTRTRTSFHMAAKGLGASVLNWTHTGSSVSKGETLLDTARNIEATGPVAIVMRHRSSGAPHLVAKHVKCAVINAGDGTHEHPSQALLDAFTLRQRWGSLDGRTVLIVGDVLHSRVARSNLHCLKALGAQVVMCGPPTLLPPGLESLGAEVTHNLDAALPRADAVMCLRVQLERQEQAFLPSTREYARLFGLNAAREERMKAGAVVMHPGPINRGVELAPAVADGARSVILEQVSNGVAVRRAIL

SEQ ID NO: 19440 - protein, 372 aa, Myxococcus xanthus
MTKRAVLALADGTTFEGRAFGAVGETVGEVVFNTTMYGYQEVLTDPSYVGQIVTMSYPEIGNVGANPEDEEGSRVHAVGMVVRALSEQPSNWRAKESLDAYLKRNGVAGIEGIDTRRLVRHLRTHGAQMGVISSEGLSPLALVERARSARGMEGLDLATGVSTKEAYTFTQPSPDVFTGLGEVRVPAEPRFDVVAYDYGLKKSMLHFLVDVGCRVTVVPANTSAEEVLARKPNGVFLANGPGDPAAVKGADRTVAALLGKVPVFGICLGHQIMALALGGRTYKMKFGHRGGNQPVKDLTTGKVEITAQNHGFAVDDASLKGLAVVTHINLNDGTVEGLAVPDARAFSVQYHPEASPGPHDARYLFDRFAKLM

SEQ ID NO: 19441 - protein, 465 aa, Myxococcus xanthus
RKAKIICTLGPASDTPEVIEGLIRAGMNMARLNFSHGTHEEHRRRVETIRKVAKRLGTPVAILQDIQGPKIRLGRFDGGQLLVKQGQSVTVTTRNVLGQDGVIPTPIKSLVKDVAKGHEILLDDGRVRLRVLRVHGQDVQCRVEVGGVLKNHKGLNLPGSPMSVPTITRKDAVDLAFGQEVGVDYVALSFVRTPEDIKKARAHVAKLKTPLIAKIEKPQAVERVEEIAAVADGIMVARGDLGVEMPLERLPAIQKHMVSAVNRMGGLVIVATEMLESMVANARPTRAEVSDVANAILDGADAVMLSGETAAGKYPVEAASTMACIVEETERGVVKHQHHSPFERSEDLGTGVAAAAVAAATQLGIGTIVAYTESGHTARLISEFRPHARIIALTPSETAVNRMALYWGVTGMQVARVSTTDAMLTQVRQLCRKEKLCAPGTPVVVVAGVPLNVPGNTNLMSIHRI

SEQ ID NO: 19442 - protein, 620 aa, Myxococcus xanthus
RLRVTMAKQSGLLRRLGNVALNEVSERFGSTSPTPSSGDTRFTPPTPAASKDEESLEGWGFADTRFVVKPDGSTVLTGTRYNISNVALPDLMQWFAGKLASPLGYDNRNEPHYPPEIPAAKKNDKLVAALREFLKEEQLTDDPKQRLRRGHGHTGGEIWAIRYGKLDRVPDLVVFPRGHDEVVRLVEVATQHGACVIPFGGGTNVTEALRIPLSEERLVIAVDMRQMNRILWVDPVNRMACIEAGATGRHLMEELAKFGFTMGHEPDSLEFSTLGGWIATNASGMKKNRYGNIEDLVLDMQVVTPQGIVERPRQAPRESVGVNPRQYMFGSEGNFGIVTTAVVKLFPLPEVQRYGSVIFPDLETGLSFLYALQQSGAVPASVRVMDNTQFHFGQALKPAKHGLAAKVKSEVEKAVVTKLKGFDPYKLAVATLVFEGSREEVAFQEKTVYRIASEHGGMKGGGANGERGYQLTFGIAYIRDLTFEHWAIAESFETSVPWSRAMDLYERVQRRVEKEHAALGLPGKVFFTGRFTQVYQTGVAIYFYLGFYARGVSDPVGAYAALEHAAREEILAAGGSLSHHHGVGKIRRDFLPEVYSEAALALNRKVKAAIDPDNVFGASN

SEQ ID NO: 19443 - protein, 732 aa, Myxococcus xanthus
MRFPFVPLGLMLTALTGAPGLALDDAPPPLAPSGTTPDAQVQAKLDLADRFVRRAELLRDSLVPPRWLREGDRLVFWSREGKDGGTWVLAHAKTGELKPLLSGEQLRQQLSTLLGKPITAPRFFDVALAPDERGIVFRLEGKTFGLGLSGGHVTLLSPEDRAALTLSPQHFLAPKGGALAVQRQGGFAVLNAEGATVVERTGEANLDWRIPERPWSPDGRFLVVWRDDLRAVHQVPVVDYSSALEKVTTVPYTKSGTPLPRAELHVVEVATGRVTRVPPVEGETYDWFAGWNPEGTEALCLHLSRDAKRLDLSVVEPASGQRRHVLREERPETFVTGLDFAVGGWAKQVTALPGGRGYLWMSERDGWRHVYAYDRSGKRVRQLTRGAFPVHEVVGVAPTGDALYVLASADSGAPYEHLFYRGSLKGGALKRLSSASGMHRITPSPSGQYYVDTWSSRTQPRLRELVSVEGGKRVRLTTSDASEFESLGDTRPEALLVKAADGVTPLHGVLYKPRDFDASKRYPVLASIYAGPFTTVVPWSFLGTSDSLTASGLAQLGFIVVLLDPRGGPGRSKSFQDANYGRVGQTEIPDYVAGLKQAASTRPWMDLERVGIHGGSWGGYFTLRGMLTAPDFFKAGYAGAPGALEEEAIINEPYLNLPSVNPQGYAAGDNLAIADRLRGHLKLMHGTSDVNATLSVTMRMADALIRAGKRFELLIMPGQPHSPRGAASRYYR

SEQ ID NO: 19444 - protein, 398 aa, Myxococcus xanthus
RVVITGMGAVSPYGAGVPPLLDALAEGRSAIRPIDDFDVSGCGCKHGARVPRGSLSALTGSNNLRRAPRGTQYTMLATEEALQMAGHGPSTWNPERVGVFLGTYRAMAEVSQDIWHRIITSEPRFVQPLLFQETVTNAVASALSIRWGWRGTNYAISAGNACGFQVLALAAQALRSGRADALIAGTFDLFTTATHFDMDDIGVLSDANVSRPFDTRRDGYIMGEGAAVVVLETLASARARGATPLAEIAGLGVAHDGHAFGIHHPEGRGLASAMSQALRDAEASPEAVDYIAAASNSTQSLDRAEVAALKTVMGAAASTVPLSSVKGLMGEAESASDMFNLLACVGAVRGGGLPVQAGIEQPEFELNLVRQPRPHRPVRTALAHSYSFGGNAGAALVR

SEQ ID NO: 19445 - protein, 405 aa, Myxococcus xanthus
KVVVTGIGVLTPIGNNLAEFSEGLRSGRDGIAPVTHFDASKHRCQSAGELKNIDFSAHFSPDELPYLSRGAQMIRVAAAQGLAASGMDLDVEDRSRIGVVLGTNLGGMPARKEGYAALHYPYRRGRAGPKEPWRALVLDSFICAMSDHVASQYQLGGLSLVMSTACSAGLHALGVAMDVIRSGRSEVMFAGGVDPLSEMPQAGFGVLRSLASDKLRPFSKDRDGTLLGESASLWVLESEAHAKRRGANILAELAGYGGSTDAYHMTRPDETGRGPARAMQAALASAGMKPEQIGYIKAHGTGTPANDVIETRAIKHVFGEQTRVPVSSIKAMVGHSLGSSGAMEAAAAVVALNDGFLPPTLHLDTPDPECDLDYVPHHSRPTKLEAVLSNAFGFGGNNAAMVFRR

SEQ ID NO: 19446 - protein, 247 aa, Myxococcus xanthus
FQQQTVIITGGSRGIGKAIALAFAAEGADIVLNYGSNAEAARQAAAEVEAQGRRCVLVPGSVASPDVPGQLREAALSHFGRIDVLVNNAGISRDGHLMMLQAAAWRETVDVNLYGALACCQAVIPTMMQQGRGAIINMSSSAGIRGRAGQVPYAATKGALIGLTQALAGELGPHGIRVNCVAPGFVETEMVAGLMNRPGVREGFIQATPIRRLGTVEDVANATLFLASPESAYVVGDVLRVNGGLVL

SEQ ID NO: 19447 - protein, 232 aa, Myxococcus xanthus
QVVLVTGAGQPIANAIARRHGKAGARLALVFLPEHEAEATALARELSAELALACESSDAQAVGAVVRRVATELGRIDLLINASLSRATGRLSDLSAEQWKAVLDRQLSGTAWFCKEVIRPMMRKRSGRIVNLLDAASGGASRVAAEGITAMTRALANEVARQGISVNTLAVQLLEEETAHLTPAQRERLDGELGPLGRLGSAEEVAEAVLFLGSSAANLTTGQRLSATGGLW

SEQ ID NO: 19448 - protein, 318 aa, Myxococcus xanthus
GTMSRRIVISGLGAVCPQATGPTALWERFSQGDAGPPSSLAERIPDAAFAKQSAQLRHMDRLGRIALTATTLAIEDAGPGNPLQTGIAFGSSYGCLPTNAEYLEAILERGGRYGNPVVFQNTVTNAATGYISMVHDLRGPTATLCSGHAAGLEALRFGCQQIEEGQAERMVVVGADTLSPMLLAGIALPEGMRVSEAACALVLEEHTHALTRGAHRHAEVLGTGHRGGSLTNQAHTLARAVRDAMHLARIEPEQLSAVFSCASGRGDFDGWEQRGLHEALGAHAAKVPVSCPKDVLGETFSTAGMLAVVLATRALDKG

SEQ ID NO: 19449 - protein, 397 aa, Myxococcus xanthus
MSPHRVVITGLGVTAANALSADKLAQALLNRRSGIRRAAPFDIEGRTYSAGVVDLPGETPDNGLDRVSKLALHAAEQALRDSGLEAQGNWREVAGVMLGTSRGPALSLEQVIRSGGDEDARRRHFGEVPFSSIARNVADRFGLGGILSTVTMACVSSSLAMGRALDEIRQGRASVMLAGGADALTLLSFSGFSVLRAMTPTVCRPFDHRRNGMVLGEGAGILVLEELNHARQRGARIHAELCGWGTAGDAHHPTSPHPEGRGLQQAMTLALRQAGLTTEQIDFVNLHGTGTPANDPAECQALRGVFGARAAALPVNSLKPYFGHTLGASGALELIGSVLGMARDFLPPTLNCEELDPKCDVDVVRGEGRAQRIDTLMSTKSAFGGANVALVTRRFPE

SEQ ID NO: 19450 - protein, 154 aa, Myxococcus xanthus
QAATPAGLGIQELLRLLPHRYPMLMVDRIDSLEPGVFAEGIKCVTANEPFFQGHFPEHPIMPGVLIVESMAQVAGVMLRTRSRPDLAPVEPATQKPARPGVMANIHRMRFRRPVVPGDQLRVRATHLKSLGTIHHVKVEARVGEELVADGELML

SEQ ID NO: 19451 - protein, 449 aa, Myxococcus xanthus
QFPNDFLWGVATSAFQIEGATSADGRGESIWDRFAATPGKISDGSDGKVACDHYHRWREDVALMRWLGVKSYRFSVAWPRVLPTGRGAVNAAGLDFYSRLVDGLLDAGIEPFVTLYHWDLPQALQDLGGWPSRDTASAFVEYADVMSRKLGDRVKRWITHNEPWCISVLGYGNGEHAPGHKNWGEVLATAHHTLLSHGQAVPVIRANVKNAEVGITLNLSPAEPASPSPEDAEACRRHDGSFNRWFLDPLYGRGYPKDVVEDYVKDGRLASSALPFVRDGDMAAIAVPTDFLGINYYSRAIMRSDRIPESQNAPRTVHPEPERTDMDWEVYAPALTRMLVHLHTDYQPGPLYITENGCAYATGPSEDGKVHDDKRVAYLRSHLEASLEAIRQGVPLAGYFAWSLMDNFEWAFGYQKRFGMVYVDYDSQRRIPKDSAHLYKALVEKNGLD

SEQ ID NO: 19452 - protein, 678 aa, Myxococcus xanthus
NPLIAKWTGAHGGVPPFDQVKVELFKPALEAAMERTRGELAAIANDTSAPTFENTIVALESAGKTQGEVETLYGIWSSSMSGPEFQALEREMAPKLAAFDDEIFQNEALFRRIEAVYQSPDKAKLTPEQQRLTWLHYTRFVRSGAKLDAAAKQKLAAINQRLASLYTSFSQNVLADEEGYTVVLESEADLAGLPDSVRAGAAAAAESRGQKGKWLITNTRSSMEPFLTYSSRRDLREKVWRNYVNRGDNGDARDNNVIIAEVLKLRAERATLLGYKTHAHWRLENAMARTPERAMELMEAVWKPAVARVHEEVADMQRVANKEGAKLKIEPWDYRYYAEKVRKAKYDLDQNEVKPYLQLEKLREGMFWVAGELFGFSFTQVNDVPVFHPDVRVWEVKDQASGRHVGLWYFDPYARKGKRSGAWMNAYRSQERFRGEVTTIVSNNSNFVKASPGEPVLISWEDASTLFHEFGHALHGLSSNVTYPSLAGTAVARDYVEFPSQLLEHWLSTPEVLNTYALHYQTGKPIPQALVDRIEKAATFNQGFGTVEYLSSALVDMKLHLAGATPIDADAFERDTLNALGMPKEIVMRHRTPQFGHVFAGDGYSAGYYSYLWSDTLTADAYERFTEGKGAYDKDVAALLRKHVFSVGNTLDPADAYRAFRGREAGIQALMRKRGFPV

SEQ ID NO: 19453 - protein, 818 aa, Myxococcus xanthus
MRVMKFGGTSVGNAERMRGVADLAAAARKQTRVMMVASAVSGITNLLLEAARAAQEGQPVESLHGRFEDVHRGIIRELAPELGEARQRSLEEGLSTLASELRGLLQGVGLLRECSPSVLAHLSGLGERAACLILGALMHARGLEPHAVEPRDVILCAGDPLQATPLQEETRARFTPLREAGGPGLMLMPGFFGGDTRGKTMCLGRGGSDYSAALAAAALDAELLEIWTDVDGIFSADPRLVPEAFPLPEVSFEEAMELAYFGAKVLHPKTIAPARERGIPVRVCNSFRPDHPGTRVTDDAAPPEHPVRGLSFLPGIALVNLGGAGLKGVPGTAARVFESMALANISVVLITQGSSECSISFCVQQADAERAVQALEVAFEMERAAGKVDTIEQQRGLAVLSIVGDGMRHRVGVAGTFFSALADVGCSIAAIAQGSSERSISAVIAETDGPRALAHVHGRCFGTTEVVELLLAGVGSVGGELLKQVHQQAPKLRAHGVDLRVCVIANSKRVATASEGIPLEDWKQRLAGQQRRRAPGRLPRLGRAKRPGRPVFVDCTSSEDIALAYPSLMEAGLHVVTANKKANAGQWSHYRKLRETASRHQRRFLYETNVGAALPVIDTLKNMLRTGDRVLRVEGILSGSLSFILGLTEEGVPLSQAVGTAMEKRFTEPDPRDDLHGTDVARKVLILARELGRQVELEQVTLDSLLPSDFDATGPLDDFLARLPQVDAAFQRRVETLRAEGKVLRYVGSVTEDGCFVGLVPVPLTHPLAAVKGGENALSFTSERYSPTPLVIRGYGAGAAVTAAGVLADVLRLVDGPL

SEQ ID NO: 19454 - protein, 291 aa, Myxococcus xanthus
IGTGPLGTVFKGRVTALGLDICLKELKDIFGYFSFLQRGEVLKRLKKELCAQAQVRHPGVVQVVDQNVDAARPYFVLELMQGSLRERLDAGGGNGVPVPFALRAFLQMAYGLRAAHAGGLTHHNIKPENVLFDVYGNAKLADFRLGRVVEVDATKGMPQVFVGTGGMAYMAPELMNRGGKEPGASADVYALGILLYEMLTGQIPGRRSPLPSEVNPEAPSGLDQLFDKATQDKREQRYPDVDAMLEGLLQGVPGQGVPRQGRPRHLLGHAEGVTDERPGPGALGARRARWG

SEQ ID NO: 19455 - protein, 591 aa, Myxococcus xanthus
  unsure (1)..(591): unsure at all Xaa locations
STHTQASGAQVGSSRXSPPVSSPANDSKSSASPGVTVRRLLKLARPELLPLAAGTLFLLISSGATLAYPRAIGDLVDQALTARDRYVVDRLAMLMLAVFTVQGIAMALRIYLFTNAGERVVSRLRKDLFRALLSQEVGFFDSRRTGELTSRLSSDTTVLQTTVTANVSMMLRYVVTALGGVGLLLYTSVQLTLVMLAVIPPVAIGGVFYGRRVRVISRQAQDALAASGEVAEEDLSGIRTVRSFAAERHEVERYSVAVERSFTLAKKRALQTSVFMGVASIAGYGSIAAVLWYGGRLVVEGGLSVGELTSFLIYTMLVAFSFSGIAELWADFMRASGAAERVFELLDRKPAIGAGGEQLTDLRGHVQFRGVHFAYPSRPDVPVLQGLDLELRPGEVVAVVGPSGAGKSTLASLLSRFYDPQNGEVLLDGHPLTALEPEWLRRNIGMVAQEPQLFSCSIADNIRYGRPGATDAQVEEAARAANAHAYIERFPEGYGTQVGERGVQLSGGQKQRVAIARAVLKDPRLLILDEATSALDAESEHLVKDALERLMKGRTTLIIAHRLSTVANADRVLVLDGGVVIQSGTHASLMS

SEQ ID NO: 19456 - protein, 275 aa, Myxococcus xanthus
STRVSVPVLGQGTWQMEEDDRAGAIRALRAGLDLGMTHVDTAELYGYGKVEESIVSEAIAGRRGDVFLVSKVMPSNASYAGTLAACERSLKRLRTDHLDCYLLHWPGSHPLEETVRAFEKLVVDGKIRAWGVSNFGVEDLEEALALAGPGRIACNQVLYHLEERAIEHAVLPWCEAHGVAVVGYSPFGNGRFPRPDSRGGKVLGGIARAHGVTPYQVALRFLVRGPSLFAIPKASREAHARDNAAAASLTLTADELAHLDAAFPLGPEPASLPVI

SEQ ID NO: 19457 - protein, 631 aa, Myxococcus xanthus
  unsure (1)..(631): unsure at all Xaa locations
LNEEQLRAVEAGEGPVLVIAGAGSGKTRTLTFRVARMLERGVPPAGILLLTFTNKAAREMTRRVEELAGAFVDVRRILGGTFHHAAHVLLRQYAGVLGFSTNFTVLDREDARDLMVTCIAERRLKSDKRFPRPDLVLDLVSLAANLQQPVSHVLMDRRPQMLPLAPEVLAAAARFQQRKAQMHLMDFDDLLVHLKRLLTHHPDVKAQLTERFRCVLVDEYQDTNRLQGDLVDLFAGERKDLTVVGDDCQSIYSFRGADFTNIIGFPERYPGCSVHALTRNYRSTPEILRLANTSIALNTNQFPKVLTAARSPGVKPLIVPARDAGEQAAYVAQRIGELRDQGLSLEAMAVLYRAHNHSLELQLELTRRGIPFRVRSGVRFFEQSHIKDVLAHLRLVNNPGDELAFKRVIRRVPGVGPATAEHLWTALRASPEGTPLAEGLAHADVRAHLPRKAQKGFQAFSDLMGRLTQPEASPSPGRLIEDVLAGGYADFLRAEFSEEEHREDDVRQLAEFAGRFEDVARFLSEIALVSEFPAGQALRQQGPEACLTLSTVHQAKGLEWRAVFVLWLADGRFPLSLATRLPEXEEEERRLFYVALTRARDTLALVYPQSVLPRDGERILLRPSRFLQELP

SEQ ID NO: 19458 - protein, 586 aa, Myxococcus xanthus
RIIGIDLGTTNTLVASVRNRIPKIVPTDRGNLTLPSVVALSARGDLLVGGVAKDQMVTNPKNTLWGTKRLIGRKYNSKTVEDLRGYFPYDIVEGANGDAAVMMGGKLYSLPHVSSFVLGQVKTIAEQFLGGPIEGAVISVPAYYNDNQRNAVKEAGRLAGFDVKRIVNEPTAAALAYGFNRGLDQKVLVYDLGGGTFDVSVLHLAGNVFEVLATGGDTFLGGADFDNRIMEYALERFREETKVDLNTENPIALQRIKNAAEAAKIDLTLIPNVVIDLPYIDERKGKPMDMRIPLTREFLNSLTGDLVDRTFEICDRVLAEKGISRAEIDEIILVGGQSRMPLVQQKIQAHFGKAPRKGVHPDECVALGAALLGDSLGSIDAVTLLDALSMPIGYAMPNGRVKRIIEKNSLIPMVKSFRLPPPKEPGSPFIELDIYQGDSDLLVDNEYLGRFACPRPPPAGRSTPPHRGVSAPGDGGGSERHAQGGPRHPRHAGAAQAGAPGGRVASLTAGAQLQQQRERRPGALLQYQEHLPEGLGVQMAKFPSKEWVDEAVRLTNEDPECAMAGKGWKGDFGAVVEAEPGKLAKA

SEQ ID NO: 19459 - protein, 169 aa, Myxococcus xanthus
AGFILWLTGLSGAGKSTLSRALRAHLASSMPVEVLDGDEVRTWLSRGLGFTREDREENVRRIGHVARLLAKHGVGVIAAAISPYASSRAEVRRLAEEAGIPFVEIYVQAPLDVLIARDVKGLYKKALAGELAHFTGVSDPYEAPDAPDVTVHSDVDTVEAGLWRVLETL

SEQ ID NO: 19460 - protein, 505 aa, Myxococcus xanthus
VLGIDLGTSHARVAVVQDGTPKLIPLPGTTTTDLPALIAVNGTGDLVVGATAQTEGQRAPRRAISGLKRLLGLKPRSPQLRWLAPLLPFPVTTDTNGDSAVEVRGRVISPILFTAMLLRELKHAAATHLGRKATRAVICAPTHFTDRQCAALREAATLAGLDAQRILIAPAAAALAYAHGRGLARKRVLVVDLGGGGLQVCVVQVTGDDLEVITTGGDATLGGMDFDARIAEAIASDLSEQGVPKPDHPFDWAPLRTAAESTKVALSSQEQVDVTLPSGTVPPINRERVEALTADLAQRVTTVVRDVLESNALSPQGLDAVLLVGGQSAAPLVRRRLEESLGVSVRDDVDTRGSVALGAALLGQGLLLAAAGKPAATVSEVLSSPLAVAERGGTLRRVLERNTRLPATKTLVLPAVPGPLELALFQGAVTQASDAEYLGRLTLNVERAGEVELHLALSVDGALSLETTLPGMKRHAVSLATEHLDDATFDALIARSPLAAEPERR

SEQ ID NO: 19461 - protein, 213 aa, Myxococcus xanthus
LLRAVIFDLDGTLVDSLGDIADATNHALAHHGLPTHPESAYLRFVGSGVRELIRRAVPSGQDALIEPVLASYKAYYDDHLFDRTAHYPGIPEMLTALAAQGTKLAVLSNKSDDFVKRLVARLLPQASFAAVYGERPELPRKPDPTAALALASELGVPPAACGFVGDTSIDMDTARAAGMYGVGVAWGFREVDELKAHGARAVAATAAELLAAL

SEQ ID NO: 19462 - protein, 246 aa, Myxococcus xanthus
RALWQIEQMASFCARSGDAARITTTGAMLEDNLAQGRLSAVLGVEGGHAIEGQVARLSELHQRGVRFMGLTHLSNNDLGGSSFPMMGNRGLTPLGRDVMEEMARLGMSVDVAHASESTLKDLFTHPSVRFFCSHTGVRAAGGGWRNLSDESLRFIADRGGVVGIIFAPVYLGGDTVDDVVRHIEHAVDVMGEGGVGLGSDYDGMVPLPRGMKDVTGLPLLTEALLRRHPPSWVERVMGGNFRRFFQ

SEQ ID NO: 19463 - protein, 192 aa, Myxococcus xanthus
VSSVNLMAREVAAKIVFYGPGLSGKTTSLRKIYETVRPAHRGEMMSIATEGDRTLFFDFLPVKVERVGDCSVRLALYTVPGQVFYNATRKLVLQGADGVVFVADSQPEAMDANRESLANLEENLFEHGIRLDRFPLVMQWNKRDLDGVLPVEVLRKELNPRGVPELETSAANGRGVLDTLKAITRLVIKDLR

SEQ ID NO: 19464 - protein, 179 aa, Myxococcus xanthus
VVFDMDGTLVDNMQFHNEAWVSFAQKLGLPLTANDFQSRFAGRKNEEIIPELLGRPVAPDEVERIAEEKENHYRTLYRPHLKLHRGAEAFIQRLKEAHVPAAIATAAPQGNRELVLDGLGIRPLFASIVGAEQVTRGKPAPDIFLAAAKALGVAPTECLAFEDAVLGIISAREAGMTVV

SEQ ID NO: 19465 - protein, 543 aa, Myxococcus xanthus
GTTYKQSGVDIEAGDAFVERIKPHAARTMRPEVMGGVGGFGGLFALPPGKYQQPVLVAGTDGVGTKLKVAFAAGRHGTVGIDLVAMSVNDILTCGAEPLFFLDYFATGRLEVDDAAEVVKGIALGCEQAGCALLGGETAEMPGFYARGEYDLAGFCVGVVERAAIIDGKSVKPGDALIGLPSSGLHSNGYSLARKVLLDDGKLALDATPEGLDRPLVDALLEPTRIYVKDVLALLQAVKVKGLAHITGSGIPGNLPRCLPDGTRAVLSEQTWPKPPIFDLIAKLGSVARDEMFNTFNMGLGLILVVAKEDVAQALERAERPGRAGLRGRPRGSGPGRGHGGHRPMSGQRVRLGVLVSGSGSNLQALLDACAREDFPAEVACVVSNVSTAFALERARKAGRTAKVVDHKAHATKEGFEKALLDTLRAANVEWVCLAGFMRLLSADFLGHYAGRVLNIHPSLLPAFPGLHAQRQALERGVKVAGCTVHFVDAGTDTGPIIAQVAVPVLPDDDEKALSSRILAEEHRLYPLAVRLAVTGKVTLDAA

SEQ ID NO: 19466 - protein, 404 aa, Myxococcus xanthus
GIKLGLERVQEALAALGHPERRYPALHVAGTNGKGSTCAMTAASLHAAGHRVGLYTSPHLVRVNERIRVDSEDISDADFGLRILEVLERYPSAVSSPMTYFEFGTVVALWHFAQVRVDVAVLETGLGGRLDATTAASPVVTAITPVSFDHMEYLGDTLAAIAGEKAGILKPGVPCVVARQAPEALEAILRKAEQVGAPVRLEGRDFTGERQPDGGLSYRGATWSLDGLSVALRGPHQRQNAAVALACLEALQERGVTAPPEAARAGLASACWPGRLEEVGQQPILLLDGAHNPAGVEVLLASLKDLYPGRRLHLVFGVVGDKDRGPMMRALLPECASVQLTPLETPRSLAPEAYLAEARALCADVTAWPDADAALAAARKRAAANDLVLCTGSLFLVGMMKARM

SEQ ID NO: 19467 - protein, 676 aa, Myxococcus xanthus
RTLRAAESLGKDLGRGLARMDPADMKRLGAHVGDIVTLSGKRRSAAKVMPSYPDARGRGILQIDGVTRANTGVQLDEPVKLTLAPARHAEKVVLAPLEFTPAQRDLAYIGTLLDGLPVVKGDRVRALLFGSRTADFRVVETTPVGAVVIHPNTLLEVAKAPEKEKVTHERARAVSYEDVGGLKRELGRIREIVELPLRYPEVFERLGIDAPKGVLLYGPPGCGKTLIARAVAHETAAAFFTITGPEIMHKFYGESEAHLRQIFDEAQRRAPAIIFVDEIDAIAPRRENVQGEVEKRVVAQLLSLMDGLAQRRHVIVLAATNIPNVLDPALRRPGRFDREIAISIPDRTARKGILRHPPAGGMPLAEDVDLDHLAAVTHGFVGADLQALCREAAMLCLRRLIPHIDFASAEIPYDELIQVQVTMADFQAALHEVGPSAIREVFVETPDVGWKDVGGLGQLKQRLIEAVEWPLRYPEEFARAKVRPPKGVLLSGPPGCGKTLMAKAAAHESQVNFISVKGPALLSKFVGESERGVRETFQKARQAAPCIIFFDEIDSLVPTRSAGGMDERVTERVVSQFLAEMDGIEELTGVLVLAATNRADLLDPALLRPGRFDLLVDVPLPDREARRDIFQVHLRDKPVEKDLDLGGLAARSESFSGADIQAVCNQAAWEAVRHVI

SEQ ID NO: 19468 - protein, 559 aa, Myxococcus xanthus
QRFLLAMVKTHFDAQGQPDRVVGALQDVTEQRSAERERERLATIVEQSPDFIGVGDPSGRAVWVNDAGRRLLGLGLDEDITRYHLRDFFLAEDQTYVDEHIAAAILQGGRREGAFRFRHFPTGEPIAAQYHTFALVEHDTQRQMGIATVGRDIRAQKRLEAERERLLARERVAREEAEEANRLKDEFLATVSHELRTPLTAVLGWVQMLRTGTLPPEKRERALATVERNARAQGQLVEDLLDVSRIMTGKLKLDVSSVDVSQVVEAVLESLRPAAEAKGIRIQAALDSGGTIMGDVSRLQQVVWNLLSNAVKFTPKGGRVQVLVERRNSSVEITVADTGQGISPQFLPHVFERFRQADGSTTRKAGGLGLGLAIVRHLVELHGGTVMATSEGEGRGATFIVSLPQAVALRREVLVPPTLRGPLQEQDIPCPPQLASLRVLVVDDEEDTRELLRSIIEACGGIVTTASSSEDALAELREASFDVLVSDVGMPEEDGYRFIARVRALPEEQGGGIPAVALTAYTRMEDRTRALLAGFTTHVPKPIEPVELMAVIASMSNRG

SEQ ID NO: 19469 - protein, 346 aa, Myxococcus xanthus
NPLGLNGFEFVEFTSPQPEVMEHLFERLGFTAYSKHPSKELVRYKQGGINLLINREASGQAAEFRAEHGPSASGMAFRVANARTAYEMALERGAKAADPERGSLGEGSYVLEGIGGSLLYLVDRHGEKGTLYDSWQEIPGAEAAEAKNSVGLETLDHLTHNVRRGQMRTWSSFYNRIFGFTEQKYFDIKGQATGLFSQAMIAPDKAIRIPLNESQDDKSQIEEFIRQYKGEGIQHLALTTPDIYDTVERLRARGVVLQDTLETYYDLVDKRVPKHGEDLARMRKNRILIDGSEEEGLLLQIFTENLFGPIFFEIIQRKGNEGFGNGNFQALFESIELDQIRRGVIK

SEQ ID NO: 19470 - protein, 434 aa, Myxococcus xanthus
GSVLKTAPGAYLSGFGNEFATEAVPGALPEGQNSPQRAPFGLYAEQLSGSAFTAPRRENRRSWLYRLRPSANHPAFQPLAQGLLRSGPFDEVPASPNRLRWSPQPPPAQPTDFVDGLVTYAGNGDAASGAGISIHLYAANRSMVDRVFFDADGELLIVPQAGRLRLVTELGVLDVAPGEIAVVPRGVRFRAELPEGQAAGYVCENHGAFFRLPDLGPIGANGLANPRDFLTPVAAFEDVDRPTEVVQKFLGNLWSARYSYSPLDVVAWHGNLVPYKYDLARFNTINTVSFDHPDPSIFTVLTSPSEVPGTANCDFVIFPPRWMVAEHTFRPPWFHRNVMSEFMGLVHGVYDAKAGGFAPGGGSLHNCMSGHGPDRTSYEQAIQADLKPHKIKDTLAFMFESRWVIRPTRFAMETPALQQDYDACWAGFQKAKLP

SEQ ID NO: 19471 - protein, 441 aa, Myxococcus xanthus
  unsure (1)..(441): unsure at all Xaa locations
MTFASLGLSDALTRAVAGLGYDEPTPVQRATIPVVLRGGDVWASAKTGSGKTAAFLLPILEALRARPGGSVRPVRAFILVPTRELAAQIVDSIQRYGQHLKKPLKTCLAVGGVSANPQMLALRGGADIVVXTPARALDLVHQNALRLDQVETLVLDEADRLFSLGFADELNSLLALLPTRRQNLLFSATFPPAVRKFAEQLLHEPTRIDVDDGELPSTEFILQRALQVDVPRRTMLLRHLLETHAWSHVLTFVASRYTADHVALKLNRAGIVATSLHGELSQGARTRALADFKAKRVRVLVATDVAARGLDIAQLPAVVNYDLPRSTADYVHRIGRTGRAGDKGVAISFVSAGTEAHFRLIEKRHQLDLPREQVPGFEPTEEVSTTTPPRDPNGGVKGRRKSKKDKLREAAAAAATRPPKQGPXRLLLPRVQQGHVRFRGR

SEQ ID NO: 19472 - protein, 604 aa, Myxococcus xanthus
KYTLLVVGSGLAGASAAATLAELGYRVHCFSFHDSPRRAHSIAAQGGINAAKNYRNDGDSVWRLFYDTLKGGDFRSREANVYRLAQVSNRIIDQCVAQGVPFAREYGGLLATRSFGGALVSRTFYARGQTGQQLLLGAYQALERQISAGQVRMHPRTEMLDLVMVDGRARGIIARDLRTGELRAFAGDAVILATGGYGNIYHLSTNARGSNATAIWRAYRRGAGFANPCFTQIHPTCIPVSGPHQSKLTLMSESLRNDGRVWVPKLKGDQRTPRDIPESERDYFLERRYPTYGNLAPRDIASRSAKEICDQGRGVGPGGRGVYLDLGDAIERLGAGTIRERYGNVLEMYERITGEHPYRAPMRIYPAVHYTMGGLWVDYDLRSTLPGLYVLGEANFSDHGANRLGASALMQGLADGYFIVPNTIAAELARFGPGSVDLDHPAFRDAERIVQAKLERLLASRGTRTVEDHFRALGSLLWEQCGMARSERGLSSALESIQALQGDFERDLRLPDTGIELNDSLERAGRLADYYELAELMCRDALERRESCGAHFREEFQTAEGEARRDDEHFCHVSVWEYRGQDRPPALHKEPLSFESVAAETRSY

SEQ ID NO: 19473 - protein, 607 aa, Myxococcus xanthus
  unsure (1)..(607): unsure at all Xaa locations
GPVIGIDLGTTNSCVALLSNGRPLVLRSREGYNTIPSVISLNAQNKLLVSHRAKNQLVLRPQHTIYGAKRLVGRPYDSAVVNQVRERFHYDIVPDSAGRAAVRLADTALSLEEVQALILRECKEMAEAHLNQKVERAVVTVPAYYSEPQREAVRKSGILAGLKVERILNEPTSAALAYGLNRELNKKVLVYDLGGGTFDATILKIEKNVFEVLGTGGDVFLGGIDFDNLIVDYLLARFQEKEGIAFTGDGIALSRVSDAAERAKMGLSERSTFEVHIPMLMMDDSGRPRDLRVVLSRQELEKICEPLLSRTIDVVRDVLLDAKLKAAEVDDIILVGGMSRMPLVRDKLKGLFGKGAQASVNADEAVALGAALYSGSVDKVSSVVLIDVLPMTVGVAMPGGAFKRVIERNSPLPAQRSFAINTTKDNEVFLELSIFQGEDSHISANEYLGTVRIEGLPKGPKGSVRVAVTLKLDSECVLHVEAREYSTRKEVKATLATRYSPEELQKQLQVSKESVKAAEERRGADLKERAGGFWSFVKKALGRKXRVAHDGHRTPVHDALQVPRGCLRGHLLRGARRPRQRAALAAPEASGGGHAGRGAGGDLHPAG

SEQ ID NO: 19474 - protein, 320 aa, Myxococcus xanthus
YPIHRPRRLRRNAVLRDMVRETRLDPGDFIYPLFVVEGRDVRRPIVSMPGIFNLSLEHVVAEARHARKLGVPAVLLFGIPNHKDARGTQAYADDGIVQRAIQEIKAAEPDLQVIVDVCLCEFTDHGHCGVLEGGHVVNDATLALLAKMSVSCAKAGADIIAPSDMMDGRVAAIRAALDETGFGELPIMAYSAKFASGYYGPFREAAQNTPTSGDRRGYQMDPGNVREALKEVALDVEEGADMIMVKPALAYLDVIRAVRERWELPVVSYNVSGEYSMLKAAGQNGWIDYERVMLETLTSMKRAGSDLIITYHALEAAKLL

SEQ ID NO: 19475 - protein, 661 aa, Myxococcus xanthus
MGTSFTPDEQTLFFLRNPEGSRALALHAFDVATGQTREHLTAERLLQRARENLAVEPKARQEPARVSSRGLSSYALSEDGEKLLVGLSGKQYIVTRASGKVTELKTGPGAMDVRFSPDATQVAYVRGHDVYRLDLATNIEHQVTKGGTEEKSHGLAEFIATSEMMRFSGYWWSPDGKALAYTESDTSGVEKLAIADALHPENDARRLAFPRAGKANARVRLGIIPITGGKTTWVRWDVEKYPYLATVRWPAKGPLTVLVQNRLQTEELLLAVDPRTGSTRTLLVERDDAWLTLHQTFPHWLEDGSGFLWYTERNGAGEVELRDASGKFVRSLVPPGAGFYDMAGYVEKDGTVYFTGGPTSDERYVWRLSPGGRPTRVTSESPALELARMSKRGGLLAITSEGPRRMRHTTVMKADGTRVGELPSVAMEPPFQPRVEVRYVGKERYPTSLVRPRDAKPGVKLPVIVDIYAGPGIPMVYQSMQQHLTNQWLADEGFIVVKLDGRGVSPTADAKLRKPKYDWPRLLLDEQVAALRALAAEVPEMDLSRVGITGASNGGYMSALAVLTRPDVFKAAVAVSSVTDWRDYDSHLTERFFGLPDEHPQAYEQASLLTHVKADQPMGKLLFIHGTADDNVLFFHALKLSDALFRAGQPHEFLPLSGMPH

SEQ ID NO: 19476 - protein, 769 aa, Myxococcus xanthus
LLEDLNAPQREAVLHGDGPLLVLSGAGSGKTRVITRRVAYLVKVHNVYPWRILAVTFTNKAAREMRERLVQLLGAQANELVVSTFHSAAAQILRREAEHVGLTRSFVIYDDSDQLNVVKRAMREAGIESMQPREILHRIDQEKNAARLPEHMQVAPGDERGQLVRKVYAAYQERLRAANAVDFGDLLLLLVTLFRTRPDVLENYRRRFHHVLVDEFQDTNPVQYALLKQLAPPPSANLVVVGDDDQSIYRWRGADVDNILGFPRQYPGAKVVKLEQNYRSDQNILDAAHEVIRKNTRRMEKKLWSERQRGQTLNLMLNRDERAEGQEVARQILALQREGFIKLSSMAVFYRANAQSRVLEEALRLARVPYTLVSGRSFYDRAEVRDASAYLRLMVNPRSDADLLRIINIPARGIGDTTVERVTDFANARGVSLYEVLSQPEQIPALNGAAVKRLKGFRNLLESLTAFAQTNEEAAGAVDQMLRETKLVETLQAEGSDESQTRAENLREFLGAAQEFDLNRAAAAVAAAANPPSDVPPEVDAAPLTADVPALQAFLEQISLVGEADAEVGDGRVALMTLHAAKGLEFDAVFLTGMEENVFPHSRAVKSESTFLNEVASADGEPSEEMAEERRLCYVGFTRARKRLFVSLAQCRSLFGELRYNAPSRFLRDVPPALFGISEQEVPEAPRPMVPSTQRRRTWDEDDGPRIDRSYSQASSDMDGVGGDVRGMRVRHEQFGVGRVVSADGNGPNAKVTVEFGGGVGLKRIIARF

SEQ ID NO: 19477 - protein, 254 aa, Myxococcus xanthus
DLELGGKVVLVTGGSEGLGAAVARRLVREGAKVALCARGAERLEATAAALRAEGGDVLTVQADVSRAWEVEHFVDAAHARFGRIDGLVNNAGTAAGRPFASVSDAEWEADLQLKVFAAIRASRQALPFLKESGSGAIVNVLAIAAKTPGANSTPSSVSRAAGLALTKALSKELGPHAIRVNAVLVGIIESGQWARRAKEVGKPMESFLQEMARHAGIPLGRVGKAEEFADTVAFLLSPRGGYISGAAINVDGGL

SEQ ID NO: 19478 - protein, 323 aa, Myxococcus xanthus
TIINGDGIGPEVMAATVRVLEALKVPLDFEYKDAGTEVVAKYGTNLPHETVEAVLRSGIALKGPTGTVVGGGLPSANVGLRKRLDLYSSLRPVKSVPNVKTRYEGVDLVVVRENTESLYAGLEHIIVPGVVESLKIITEKASTRIARFAFEYARKHGRKKVTAVHKANIMKLSDGLFLDCCRKVGREFPDVTYEEVIIDNLAMQLVKDPTRFDVLVAENFYGDVLSDLCAGLVGGLGVVPGANIGERTAVFEAVHGTAPDIAGKGIANPTALMMSAVMMLDHLELGEAARRMENAIWKVYGSGEVRTGDLGGKATTREFTDAI

SEQ ID NO: 19479 - protein, 191 aa, Myxococcus xanthus
IDKSILITGASRGLGLALMNGLARRGARVVGVARHAAEMGAVAEALRWEGLEAHALACDVGDKEAIYPMVGAATALVGPLDVLVHNASTLGPTPLPLLLDTACEDLQRVLEVNVVGPFRLTKAVAGNMSVRGKGLVMHITSDAAVSAYPRWGAYGVSKAALEHLGRVWAAELEGTGVRFVSVDPGEMDTRM

SEQ ID NO: 19480 - protein, 355 aa, Myxococcus xanthus
  unsure (1)..(355): unsure at all Xaa locations
GAYRVLGELGRGGMALVYRGLHEMLQREVAIKELLPDGQRDRETLSRFRREALALAAFRHQNIVTLYDMVEKGESLFMVMELVDGPTLHTLIKEGPLPADVTGVIAARIASALDHAHFRHIIHRDLKPANVMLTKSGEVKLMDFGIAKDVGMEALTQQGMAVGTPSYMSPEQVTGVPVDGRTDIFSLGVLLYEALSGARPFHGKTAGEVFAKIRDGKYTPLSKVAPNVPAPLVRIIQRAMEVKPEDRFPDAAAMRRELDVFLAQEVQVSHAALLVAFLRHRQKLTETEAQQLMRPHELDAAVEGVRHGALPPGREAAVGPGRPPSRXXRRRAPGSTSPRPSGRRWWSSSPAEAGG

SEQ ID NO: 19481 - protein, 394 aa, Myxococcus xanthus
  unsure (1)..(394): unsure at all Xaa locations
STDALVQKAKRHLLQNYKQPPFVLARGQGARVWDMDGREYLDLIGGIATCALGHCHPEVVAAAKAQLDSLWHVSNVFYSQPQIDLAAQLTEWSGLSRAFFCNSGAEANEALLKLTRKVMKDRGTPERFEVISFDSSFHGRTLATVTATGQAKYQKGFEPLPAGFTHVPYGDLEAVRKAVGPATAAILVEPIQGEGGVRMAPLGFLVGLRALCDEHGLLLLVDEVQTGMGRTGKPFGFMHEGIVPDGISVAKALGNGLPIGAMLCKEELGASLTPGTHGSTFGGNPVAAAAANAVVRILRRPGFLDEVQEKGAYLLARARELQGRLPAGRIQAVRGQGLLVGVQLDHKVAPVIAQVHEEGLLVNPAGDRTMLFAPPFIVTVRELDXGLSILERVL

SEQ ID NO: 19482 - protein, 662 aa, Myxococcus xanthus
SSRAIPVIVRCSRESTPSTPGSLETPMPVNAPPHRWTLADAHELYGIRNWGNPYFGINEKGHVIVHPDGPQAPNMDLKELVDEVRRRGIGLPLLIRFTDVLRHRVVHLNEAFRKAMSDQGFKGGYRGVYPIKVNQHRYVVETLIEAGKGYNYGLEAGSKPELLAVMALLENENALVICNGYKDEEYIETALFYSRLGRNVILVVEKPSELPLIAEVARRTGIAPRLGIRVKLSTRGAGKWEASGGDRSKFGLTSSELMNCIGFMKDAGLLNSFELLHFHLGSQISNIRNVKNALREVGCFYVEVARQGAPLKYLDVGGGLGVDYDGSQTNFASSMNYTTEEYANDVVFGVMEACDRAGVPHPTLVSESGRAVVAHHAVLVVDVLGTSEFGPAPVPDKVDEKAPSVVRNLWSTYREVTNKNLLEAWHDAQDAKEESLTLFSLGHLSLEQRVAAENIYWATCHKIMRIAREQGEIPEELDSLEKALNDTYFCNFSVFQSLPDSWAIDQLFPMMPIHRLAEKPTRRATLADITCDSDGKIEHFIDKREVKDALELHALNDDDYYLGIFMVGAYQEILGDLHNLFGDTHAVQVSLGPNGGYLIDNVVAGDTVTEVLNYVSYTKDDLVAKLRKFTEAALRQGRITLDESRNLLRMYEDGLSGYTYLE

SEQ ID NO: 19483 - protein, 285 aa, Myxococcus xanthus
ARTLDGTEISRVMRAEMAQDVAALQAAGVTPGLSVVLVGNNPASQAYVASKTRACESLGMRGQTLTLPEDVSKEALFAVIDRLNADPSVHGILVQLPLPAHLPYKAVLEHIHPAKDVDGFHPVNAGLAFVGDPRAFVPCTPAGIMEMLRREDIPTRGKHVVIVGRSLIVSKPLASLLMAPGPDATVTITHRHTPDLASFTRQADILIVAVGKQNLITADMVKPGVVVIDVGQNRVSDASSPRGYRMVGDVDFDAIQPIASAITPVPGGVGPMTITMLLANTLQAA

SEQ ID NO: 19484 - protein, 220 aa, Myxococcus xanthus
WTFDRIDGGGGNPGTGLAAILSESTFNAMFPNRNPFYTYSSLIAAASTFPAFANTGSLETRKREVAAFFANTAHETGNYVYVEEINRGDYCGSWGPPGCYCVAGKKYYGRGPIQLSWNGNYCAAGAALGLPLHTNPDLLAQDANASWRSAFWFWTTQAGAGTMSAHRAMVDGHGFGETIRTINGSLECNGRNPGQVQSRINNYQHFTNMLGVSPGGNLGC

SEQ ID NO: 19485 - protein, 1340 aa, Myxococcus xanthus
TYRRLDSRARSLGARLRALGAQGERALLLYPPGLEFVAGFMGCLYGGVIAVPCYPPDPTRLERTLPRLRAIARDCGARYVLTTSTIQEMAEFLTPQAPELGELQWIASDAVPEAEAADWKRPDLTSESLAFLQYTSGSTGNPKGVKVSHANILHNESLITRDFGLQAERSVGVGWLPMFHDMGLIGKVLQPLYLGFPCVLMSPIAFLQRPLRWLEAVSHFKGTVSGGPNFAYDLCARKARAEDVARLDLSHWDLAFNGAEPVRRETMERFAETFAPAGFRREAFYPCYGLAEATLIVSGGVKGTPCVQERYDTGSLELGRAKPASDAAEGPTARTLVSSGQGAPDQRLLIVDPETRVPRASNEVGEVWVAGPSVAGGYWDRPEETAHAFGARLANGEGPFLRTGDLAFLSPEGELFITGRLKDLLIVRGRNLYPQDLEMTAERAHRAVRPGCSAAFSVDVEGEERLVVVSEVDVREGFDGAAVVGALRRALADEHQVHAHTVVLLQARSIPKTSSGKIQRRACRDGFLAGSLEVVEVSGEEAAPVPEAVPSTPSAPLRERLALASEEARPALLVDFLRVEAARVLRAAPASLAPETSLASLGLDSLMALELHGRLEEELGVSLPVAFLWQHPTLGTAAAHLVDAWKGSAAPAAPPLKAGSLEGELPLSPGQQRLWFLDRLVPESALYNVHFQLRLSGALDVPALERALQGLLSRHAVLRAAFPEVEGQPRQLLPPLRPLDVAREDLRALSPAERDARLNQLARAQGEAPFNLSEGLLVRAALVALEDQEHVLLMTQHHIVTDGWSIGVLARELAALYRAEVAGAAASLGAPALQYVDYARWQRGLGGALDGQRAYWARKLENLPRLELPTDFPRPREPGFRGALHRFALPAELVDSLKAVGRSEGCTFFVTLAAAWAALLHRYSGQDDFGLGTIFAQRDRAELRDVVGFFASTLVLRADVSGAPRFRELLGRMRHTFHEALAHADLPFEEVVGASRAVRGGDNPLFQANLVLESLPPVDMDVPGMQWRPVLPVPDGAVEGTAKFDLQLAVVETPRGLEGALEYRSDLFSAETMARLAGHLEALLRGIVAAPDARVEDLPLLDEAERRSLLERWNDFTAPLSQDASHCIHAQFREQAARTPDAVAVVAEDGTLTYAELARRASALALHLRGLGVGPEVRVGLCAERSVEMVAGMLGILEAGGAYVPLDPDYPRERLTYMLEDSGARVLVTQSHLAGTLPVAGLHTVLLDTAEPYAAMPASPLALGTTPDNAAYVIYTSGSTGRPKGVVVPHGGVANFFAAMDVRVGHSPAGAWLAVTSISFDISVLELLWTLTRGFKVVVL

SEQ ID NO: 19486 - protein, 361 aa, Myxococcus xanthus
RVINFNAGPAGLPLPALERARDELIDFQGSGMSVMEHSHRGREYEGVHDEAISLLTRLLGIPDTHQVLFLTGGASQQFAQVPMNFLRPGASADYLMTGVWSEKAFDEAKYYGTPRVAVSTARPDKRYTRVPRQDELRLESSAAYVHLTSNNTIFGTQWHTFPDVGNVPLVADMSSDFLWKGFDVSRFGLIYAGAQKNLGPSGVTLVVADKAFIARGRTDIPKIFRYTTHAENNSLYNTPPTLAIYLVRNVLAWIQSVGGLAQLEQWNREKAALLYGAVDRHPEFYRAPVERESRSVMNVVFQLPTEALDASFVADAKQQGMVGLKGHRTAGGIRVSMYNAVSVENVRTLAAFMDHFVKTRG

SEQ ID NO: 19487 - protein, 594 aa, Myxococcus xanthus
  unsure (1)..(594): unsure at all Xaa locations
FDAIIVGSGFGGSVMAYRLAEAGLRVCVLERGKAYPPGTFPRSPYDMRNNFWDPSKGLHGMFNLWSFRGLGGVVSSGLGGGSLIYANVMLRKDEKTFVHEHPQTGGYEYWPVTRDDLEEHYDAVERMMHVQRFPLAHPPYDATAKTLAMKLAAERLGRAADWQLPPLAITFANAGAAPALGEPIREAAPNLFGRMRTTCRLCGECDIGCNYGSKNTLDFTYLSAAHRAGADLRTRAEVKEFWPADGGGYVVQYVDHAEAREGERREVASDQLQRVTLTADRLVLGAGTFGTTYLLLKNRAHFPRLSARLGTRFCGNGDLLGFLLRSVDSSSGTRLPRVLDGGRGPVITSALHFRGKEEGGTGRGYYIEDAGYPEFINWLYEGSQQAPLLRRGMAPGLAPRQGLDRPDARHGCQRGDCEALGDCLGSATSLPLLAMGRDIPNGNMRLTRDGKLDIDWRMHGSREYFGRVRKSMEDIADALEAKMVHNPLSYLSRVITVHPLGGCPMGQTPAEGVVNAHGEAFHYPGLYVADGSVMPGPTGPNPSLTIAALADRFSDHLIAHWPRTTALRKHPTTEERIXRYELPAGEPPSAPGDA

SEQ ID NO: 19488 - protein, 231 aa, Myxococcus xanthus
MDTELQGRGVLVTGGAGGIGTALVHTFAEEGAKVAVHHHSSTEKAQALARDVGGAALRADLTVEADVDALVPAAVAALGRLDVLVCNAGVWPAPDEPVWEMSLARWRRTLAENLDSVFLCCRAFLRHVATTKTGNIVIISSTAGLFGEAGHADYAAAKGALASGFLKSLKNELGRIAPLGRVNVVCPGWTAVDRSRDKLAQPGFVERVTRTMPLRKVAQPVDVERAVVSLA

SEQ ID NO: 19489 - protein, 503 aa, Myxococcus xanthus
LLLTAILFGGSAAVAATPPPLTTDTGSPVGTNQNSKTAGPRGGVLLEDFHLIEKLARFDRERIPERVVHARGTGAYGTFESYGDFSKLTRASLFSAKGKKTPMFVRFSTVIHPTGSPETLRDPRGFALKFYTDEGNWDLVGNNLPIFFIRDAIKFPDMVHSLKPSPITNKQDPNRSFDFFSHLPESTHMLTQVYSDIGIPANYRQMNGHGVHSFKFVNAKGEYKYVKFNWSSQQGVKSLTAEDAARVISEDHQHATTDLYATIGAGKFPSWELSVQVLDPKELDKFSFDPLDATKIWPEAQVPSIKLGKFTLNKMPDNFFEETEQAAFSPGVQPPGIEPSEDRLLQGRLFSYADTQRYRIGANYQSLPINRSRATVSNNNQAGSMNFANTKSDVNYEPSVSRETQDAPQYLFSNAPLRGTTQQGGIEKTDNFAQAGAFYLALDAGGKDRLIKNLAADLNQVRDAKVKARMVGHFFMANPDYGTRLAKAVNVKLDDAKAAVATL

SEQ ID NO: 19490 - protein, 291 aa, Myxococcus xanthus
LLRGIVAYPITPFTSTGRVDEVLLGKIVDDMVKAGVHAIAPLGSTGVLPYLSDDEREQVAEIVIKRVAGRVPTLVGVSSLTTERTVHHAKHAEKLGASAVMIIPMSYWKLSDAEIITHYETVAKRIAIPIAVYNNPATGGLDLSPDVISRLLKIPNVTMVKGSTGDVNRMHRLVQLCGEDVAFYNGSNPLALAAFVAGARGWCTAAPHIIPKLNIELYDAIQRGDVAAARQSFYRQLPFLQFIVAHGLPRAISAALELQGTSVGPLRAPLQALPAERVEELRRILVGLEVI

SEQ ID NO: 19491 - protein, 430 aa, Myxococcus xanthus
MTEISQILAREVLDSRGNPTVEAEVQLAGGARGRAAVPSGASTGEHEAIELRDGDKHRYLGKGVQKAVKNVVDVLAPALVGMDAADQFAVDQRMLELDGTATKGKLGANAILAVSMAAARAAADAHGLPLYRYVGGVQARTLPVPLMNILNGGAHADTRVDVQEFMVVPAGASSFAEGLRWGAEVFHALKKILKGRKLATGVGDEGGYAPDLPANEEALKLIMEAIDQAGFKAGEQLFLALDVAASEFFDKGSKKYKLKGEGKEYDSTGLLEYYRGLSERYPIISIEDGMAEDDWEGWKKLTDALGSRMQLVGDDLFVTNVERLGRGIETGTANSILVKVNQIGTLTETFDAVRMAHRAGYTSVMSHRSGETEDTTIADLAVALDCGQIKTGSASRSDRVAKYNQLLRIEGELGAAARYAGKSVFRALNQ

SEQ ID NO: 19492 - protein, 264 aa, Myxococcus xanthus
GRMSLEVRGIEVWRGRGRTLGPMDLTLEPGEVLAVVGPNGAGKSTLLSAMSGELRCSTGEVLLDGTPLLQWKPRERAMRLGVLPQESSLGFGFTALEVALLGRSPHSSRAEGSADLAAAVAALDATDTRHLASRSYLTLSGGERQRVQLSRVLAQLSEPLASGHRYLLLDEPTASLDLAHQHLVLEAAARFAQAGGAVLAVLHDLNLAARYAHRMAVLAEGRVVELGAPAQVLSQELVARVFGLRVQVVEWPGSPGPLVIPEGR

SEQ ID NO: 19493 - protein, 575 aa, Myxococcus xanthus
RPARSEAARHPTVPVALPALKGAEQARSATSDRRHCPHSPLPGGCSEGVRCLPDRTRREAANGRASGPAHRDPSPRGDPLVRARRPDPCALVLFGATGDLAQRKLFPALFELARAHLLPKNFAVVAFSRSEGDSEAFREHVKASLLKFARTQPLDEAVWNDFAPRLELISGGYDDPKSFVRLREELDRVAQKFGTQGNQFYYLATPASTFPQILQGLSESGLLKRQEQADPRPWQRLIIEKPFGHDLESARALNRELAAVLDERQIFRIDHYLGKETVQNILVFRFANAIFEPLWNRQHIDHVEITAAETLGVEGRGGFYDETGVIRDMVQNHLLQVLALCAMEPPVSFGAEDIRDEKTKVFRALRPLEGREVSRAVVAGQYEGYLQEKGVKAGSRTPTYVAMKMNIDNWRWAGVPFYLRAGKKLKRRVTEVSIHFKSVPISLFSGEGATCQRLQPNVLTLRIQPQEGIALSFESKVPGEDVNIAGVTMDFNYQETFQRPVPEAYERLLLDCMRGNATLYARQDSVEQAWTFVTPILQALESGEGGPAHGYPGGSAGPDAAAALLARDGRRWTGL

SEQ ID NO: 19494 - protein, 468 aa, Myxococcus xanthus
AGAQFGVAGMGVMGASLALNIADHGFRVAVWDRHAERIDEMHRKHGHPEVWGTESLEAFVQRLERPRKVLLMVTAGAAVDSMLERLLPLMAEGDVIMDAGNSWFLDTRRREEQCKAKGIHFLGVGVSGGEEGARNGPSIMPGGAPSAYELVRPVFEAIAANTDMGPCVTYVGADGAGHFVKMVHNGIEYADMQLLAETYDVLRRGLGLDADALADLLSQWDHGIAGSFLLETTIKVLRQKDPETGKPLVDLVLDKAGQKGTGKWTVQVALDLGVPIPSIAASLDARILSSMKDERVAAAPKLNGPVGQLSKEERAQLAAWTHDALYAARVVTYAQGMRLIQAASQEYQWNISLAELARIWRGGCIIRAKLLTPLREAFQQQPTLPNLMVSDAFAPVLERMAPAWRQVVGVATRVGIPVPVFSSSLAYLDSYRTAELPQNLTQAQRDAFGAHTYQRKDRPEAGFVHTEW

SEQ ID NO: 19495 - protein, 536 aa, Myxococcus xanthus
PRNMKDYEATRRDFRWERPEHFNFAADVIDRHAAERPEALALLWSDEAGQARRFTWEDLRRRSLHAARFLTEQGLRRGDRVFIMMPRVPEWWFLVLGCIRVGIVFMPGTPMLTPKDIRYRLEVAEAQAVIADVSCLERFDGLVGTAGKVRTWVSVGEGAPSPWGRYVSGVAEANAGAAFEPTRADAPLLIYFTSGTTGMPKMVLHTQASYGQGHVITGRYWLDLTPEDRHLTLSDTGWAKCAWGKLFGPWSQGACNVVYDFRGRFEPAKLLKVLETQKVTTFCAPPTAWRALVLQDLKAFDLSSLRHTVSAGEPLNPEVIDTWKDATGLHIHEGYGQTETVMIVGMFPSMAPRVGSMGKPSPGFTVSVIDDQGQEVADGQEGDIAVRVAPERPVGLFQGYLGDDAANAACRRGDWYVTGDRAVRDADGYFWFVGRADDVIKTSGYRVGPFEVESALLEHDAVAESAVIGVPDEKIGQRVKAFVVLAPGHTASPVLAQALQEHVKRTTAPYKYPREIEFVTELPKTVSGKIRRAELR

SEQ ID NO: 19496 - protein, 306 aa, Myxococcus xanthus
MTHKRLKRIGMVGGGAMGCGIALELAIAGRQVVLYNTRADSSERARAKLERDASLLVETGLLAPEQAPAAIGRIRRTTVLAEAAVEQDLVIESIPEDLALKQQLFRELDQLAAPDTLLATNTTALSVTAIARDCTRPERVLSAHYYLPAHLIPLVDIIPGEKTSPDAVETVRRFIEELGKSPVVFSRDVPGSVGPRLQQALIGEAIRLVHEGVATPEMVDRVLTQGVGRRLGASGVFDRLDLVGLDFMTALLRGTGRPVPPVLAQKVERGELGQKTGQGFYSWTPESTAAYEERMARHLATQLRED

SEQ ID NO: 19497 - protein, 329 aa, Myxococcus xanthus
KYHLLGQTGLRVSPLALGTMNFGTDWGWGITSEDAHRLLTRYLEAGGNFIDTADAYTSGSSERIIGDYFAKHGGRERAVIATKFSANLSPGDPNAGGNSRKHIYAALEGSLRRLKMSYVDVYWLHVWDGLTPVEEVMGTLTGLVREGKVRYIGFSDVPAWYFARAQTLAERNHWEKVAALQLEYSLAERNVEREHLPAALAMGAALTPWSPLAGGLLTGRYTRDGNQPKGDGRAHALLASGNPVADKFLQERPWAIVEELVAVAKEVERSPAQVALNWVATRPAVVSTIIGASRLEQLEDNLHALDFKLPHELSARLDAASRPELFNPY

SEQ ID NO: 19498 - protein, 662 aa, Myxococcus xanthus
ADTMERFKKVLIANRGEIAVRVIRTCHRLGYSTGAGFSEADRGAPHVLAADEAVAIGPSPAKESYLVIGKILEAAKTSGAEAIHPGYGFLSENADFARACRDAGLVFIGPEAEAITLMGNKRQAKLRMIAAGVPCIPGYEASDLDDEALAVEGERIGFPLMVKAAAGGGGRGMRLVHEASQLRAALRAARSEATNAFGSGELILEKAVIDARHVEVQVFADTHGNVVHLGERDCSVQRRHQKIVEESPSPAVSPALRARMGEVAVAAARAIGYRGAGTIEFLLAPSGDFYFMEMNTRLQVEHPVTELITGLDLVEWQLRVAAGETLPRTQEAISASGHAIEVRLCAEDPAKGYAPQAGRLLAWRLPLREGVRIDHGVREGQEIPPFYDSMQAKVIAHGPDRETARRRLVEALRELTVFGVTTNKNLLLYVLEHAAFRSGEYDTAFIARHAAASEVEGLYQADAKARALAAALLFHDEGLKLADTAGLDVSLLNWNTSHRHPVRMKLVSRGAEASVTVQPVSGEGYEVDVGDSSFDVSVLGLSAGVLDFSSAGTRGRARYLRDGDTLWLDLGSGAHAVTDVTFRPPSKSDGVGSGRLAAPMDGRILRVDTQVGAAVKPGDVLVVLEAMKMEFQVVADVRGTVAELNVSVGSQVKAKQLLVSLA

SEQ ID NO: 19499 - protein, 264 aa, Myxococcus xanthus
RSLFAPGCFSNRTIVVTGGGSGIGRCTAHELAALGANVVLVGRKPDKLEAVAREIQEDGGKVSFEVLDIRDEEGVKATVARIIAAHGPIHGLVNNAGGQFPSPLSAISKKGFDAVVSTNLTGGFLMAREVYLQSMSSHGGSIVNMLADSWGGMPGMGHSGAARMGMLNLTQTAAVEWAASGVRVNAVAPGWVASSGMDSYKDEGVRAMIPLLKKEVPLQRLATESEVSAAIVFLLTDAAAFITGDVIKIDGGASCNTKIFPLEE

SEQ ID NO: 19500 - protein, 1002 aa, Myxococcus xanthus
  unsure (1)..(1002): unsure at all Xaa locations
WRMALASLVMAPLAVMAMAVAMREVGKAHQQWNALQSRMNRSLLEYLRGIHVIKTFGLSARRFSDLSSSIEEGLSWMEGFMRTNGRGYGAFGALIGSSLVVLVPMGGWLYTRGTLSLESLVLFLVLGPQLLMSMMRLMFAWGNADRIQAGNARIQAILAAPDLETPTSAARPSHDGVAFRGVSFRYEDGGPEVLRDVSFEAPAGKVTALVGPSGAGKTTLVRLVPRLWEATNGAVELGGVDVRALPLDQLLSHLSMVFQDVFLFHGTVRENLRLARPDATDAQVDAACRAARAYDFIQALPGKYDTLLGERGARLSGGEKQRLSIARALLKDAPVLLLDEATAFADPENEARIQEALSALCAGRTVLVVAHRLSTIATADHIVVLDGGRVNDQGTHDELLARCALYQQLWRSHTEALDWSLGDPGTPDVQKEVVXCSGNSSCSASGSRAERTHGSGAAFSSPLPRHSRAPRPTHWSSSSFVKRSSTGSRCTXRGGSPAAIALSVLLRLAFSIRAMSNIFVAAHALMGQARIRTADHLRRLPMGFFTQRRSGELAGVLTTDVALVEDVWSHTIGIFTASFALPMLVGLGLCFLDWRLGLVILAALPVALLVLAATTPLFVREFEAVLEASADVNARVVEYVQGIAVLRAFGRHGEVYQRFVKAMERLRDALIRADVLPSPLLAVFGFVVEMSFVAVAYAGSTLALRGSIQPGVLLVFLIVTVGVVRQVADLGVALLMLRASQRALGRVDRLLAEKPLPEPSVRAASIQKFDVEVDTVSFAYEDATVLDGVSVTFPERSLTALVGASGSGKSTLVHLVARLWDIPRQGAIRIGGVDIRDIPFEELHQHLAMVFQDVVLFSGTILDNLRVGRPDASLEEVQRAARAARAHDFITALPNGYDTLLGEGGGTLSGGERQRLSIARAILKDAPIVLLDEATASVDASAEAEIQRAIDELVRKKTVVVIAHRLRTVRRAHRIIVLDKGRVAESGTHVELLAKRGVYAAL

SEQ ID NO: 19501 - protein, 247 aa, Myxococcus xanthus
PFAGKVAFVTGSGKGIGKVIAARLAGSGATVVVNSFHSRDEGERTVQEIVDAGGKAFHAWGSVAQEEHLDRMFASIEAQFGGLDFLVCNASNGLIGPFDRITPRDWDKAFRTCITGTYECAMRARPLMARRGGGSIVTMSTSMSQRYMHDLGCQGVVKAGVESLTRYLAAELAPDGIRTNCVSAGPVHGELLRMFPDAASRVARWESATPGGEICTAEDVADVTELLLGPKTRRVNGAIWVVDAGLS

SEQ ID NO: 19502 - protein, 521 aa, Myxococcus xanthus
AILAIDLGTSAVKVAAVTLRGRILGGDVEPLELALLPDGGAEQQPEAWWRAIVLATRRLLASGAVRAEDVIGVNCSSQWSGTVAVDASGTPVCPALIWMDSRGAPDVKRAVGGFLSVEGYDVRRLMTWIRLSGGVPSLSGKDPVGHILYLRRERPDVYRRTYKFLEPKDWLNLKLSGRCAASYDSITLHWVTDNRALGRIAYDDRLLKMAGLEREKLPDLVPASTVLGPLQAQAASELGLREDVQVVTGAPDILAAAVGSGAVGDFEPHLCVGTSSWLCCHVPYKKTDLFHQMASVPSALPGRYLLANEQESAGICLTFLKDNILYGRDAGAGTDGDAPDLYRVMEAQAGNVPAGSDQLIFLPWLNGERSPVDDKSLRGGFFNQSLKTTRAHMVRAVMEGVAYNSRWLFTYVEQFVGRRLDSLRIIGGGARSALWCQIHADVLGRAVQQVDEPVLANARGAAFQAAVALGRLTVEEIPSLVPVARTFHPDSKNAALYDELFREFVNIYKHNKAIFARLNRA

SEQ ID NO: 19503 - protein, 378 aa, Myxococcus xanthus
FEFATATRVVFGPGRLAEAPEIIRGLGGSRVLLVTGANPSRARPLHDALERLGLGVTVFSVDGEPTVERAREGTARVAEAGCDVVVALGGGSALDAGKAIAALAANGGDPLDYLEVIGRGQPLTRPSLPFMAIPTTAGTGSEVTRNAVLGSKDAKAKASLRSPHMLPRVALVDPDLLTGAPAAVLASSGMDALSQLIEPYLSARANPLTDALAREGLRRSARSLRRAVLDGPDAPAREDLALASLFGGLCLANAGLGAVHGFAAPLGGMFDAPHGAVCAALLPAVLDVNLRALRARAPTHPSLPRVQELAALLTGRVDARAEDAVTWVDELRAALGVPGLGRYGLTEAQVPALVAKAKEASSMKANPLVLTDAELAEI

SEQ ID NO: 19504 - protein, 355 aa, Myxococcus xanthus
MKAVAVFPQKREVRVITDAPEPRIQSPTQVKVRTREIGVCGTDKEIIEFVYGSPPPGSDHLILGHECLGEVVEVGEAVRGLSRGDWVVPRVRRPCPHATCPPCRGGHPDFCITGDYTERGIKGAHGFGAESFVEDVAYLHRVPAELREVAVLTEPLTIAEKALRQLERFQDRLPWRAGPGRAVVLGAGPVGLLGAMALARRGYATTVYSRSPKPNVKAEASEAMGVPYISSKEVRPEELVRRVGAADVIYEAAGVAKAALETLKALGPNGVCILTGVPSKEEPFDVSPVLKDVVLGNQVLVGTVNAADVDFDMALEDLRHFQARWPGGLERLICARHSPEDFCDVVTGKKSGGIK

SEQ ID NO: 19505 - protein, 600 aa, Myxococcus xanthus
NHYVPNLRDIEFNLFEFLDIGQASLGHAPFGDLDETAARQMLQMFAQLSTNELAQSFEEPEHNPPKLENGEVTLPPGLKKAMNAFFDAGMHLLEQPPHLGGLGAPPSLGWAAFELLVGANASLAFYTLGNLLARIIDRLGTDAQKQRFLPHMLDRRWGGSMVLTEPDAGSDVGAARTKARRVSDDVWEIEGVKRFITNGDSDMSENIIHMVLARPEGAAPGTKGLSLFVVPKYWVNEDGSLGEANGVVCTKLEKKMGLKGSVTCEMTFGDGKPCRGLLLGEVHDGIRQMFYIIEQARMAVGVKSMATLSAGYGRALAFSKDRLQGADLMQARDKTAPRVPIFRHPDVRRMLMAQKAHAEGMRALCLYTAFIQDGVERKGGHRATEAGELDTLNDMLLPLVKGYCSEKAYELLALSLQVHGGSGYLQDYPVEQYIRDQKIDTLYEGTTHIQALDLLMRKVARDGGATLQGLLSQIRETAERTGEGKELEAERAALGRALGDLETMLGTLMGKLGESIYHVGLQGNRVLAAVAEVVIGWLLVRHAEVALERMKSNPGDRAFYVGKLASARWFCHEVLPGVAHAARMVEHGNLDLMEVPEESF

SEQ ID NO: 19506 - protein, 397 aa, Myxococcus xanthus
LKLDRSNQLLAEARRLVPGVTQSMMKRPEMFALGAFPVFLAKGKGALVEDVDGQEYIDFIGGLGANMLGHNDPAVVNAIREHLEEGVLHSLPTPVEVSAAQTLVDLIPGAEMARFFKTGADATSAAVRLARHITGKQKIITVGYNGWHDHFMFDTPGVPAALAALTLRMPLFTPPDEPALLASIEKNASELALVLLSVPYNRPLTPAFLQQVRATCTANNVLFALDEVVTGFRLAVGGAQEFFDVRADFVTLSKSIAGGMPLSAIAGPAKHLSRLSELQVSTTFGGELLSLYVCDAVLKGYRDGAYIQHLAHLGRKLREGVNAQAEAAGSSLRVIGYDAIPFFLFAKDPTEHAKQMQPFQAGMARRGILLRRDVTFLSTAHTEEQIDYAIEMTGEVL

SEQ ID NO: 19507 - protein, 344 aa, Myxococcus xanthus
GYAAQDAKSPLAPFQFERREPGPSDVQIEILYCGVCHSDLHQVRDEWGGSRFPMVPGHEIIGRVVRVGDQVKKVKVGDMAGVGCMVDSCRTCPSCQEGLEQYCEKGNVQTYNGKEKDGQTATQGGYSEAIVVDEAFTLKIPENLDPAAAAPLLCAGITTYSPLRHWKVQPGQRVGVVGLGGLGHMGVKLAKAMGAHVTVFSHTDSKKQDATRLGADAVVVSSNKEEMAAQTGGFDFILDTVSAQHDINAYLRLLRRDGHLVLVGAPEKPLDVRPFSLIPTRRSFSGSMIGGIQETQEMLDFCGKHNIVSDIELISIQQVNDAYERLLKGDVKYRFVIDLASLRK

SEQ ID NO: 19508 - protein, 188 aa, Myxococcus xanthus
LNHAQRELTLKIVYYGPGLSGKTTNLRHLHAKASPEVRGRLLTVETHDDRTLFFDLLPVFFSTSSGFKVKVKLFTVPGQVIHNATRRIVLQGADAVVFIADSRRSATADNNAYWRNLQENMKENNLDPSQVPVVIQFNKKDLPDARTDAEIEESRRRGGEAVVGAVALRGEGVLETFHAVAQAAYRRL

SEQ ID NO: 19509 - protein, 435 aa, Myxococcus xanthus
SQVRLPPGPQGHFIAGNLVEFSEDPLGFLTRCAREYGDVVRLGKRNFLLNHPDLIERVLVNGDGNFVKLAGVGQGKRHKGGFPEAMMNSEGEDWLRKRRLVQPAFHRKHVAACGDTVVALTETMLQTWRPGDARDVHADVSALALDIVSRFLFHTPIDDEARHVADAVDAVMRHTDSPLRPPIWVPTPTNLRLRRALGRLNTLLATLVRRYREQPESRTDLLALLLSAPVPLSENQLRDELATMIMSGHETTADALVWAWYLLAQHPEAEARLVAELETVLGGRLPGAEDLPRLRYTEAVVKEAMRLYSPAWITSREALRDCELGGFHVPAGTMLAVSQWVTHRDARYFDAPESFRPDRWLSEDAQRMHRYVYFPFGGGPRFCIGSALAMMETVLITACVARRFRLELAPGCVVRPRPALALQPLGVWLIPRHRS

SEQ ID NO: 19510 - protein, 275 aa, Myxococcus xanthus
IVGGVEARPGSHPWIVSLQQYNDHFCGGSLIRVGNKEESDIVVTAAHCVYDGTSGLTVVAGAHDFNRPSSSQQAVVARKTVYHPEYNPDTTANDVAVVVLDKPIKFTSTVQPVCLPEDSFSVSGASCGKSSVVMRPNLVAKSPLAETSLSPVGLSSVGADVPDGTMMVTAGWGLIREGGYDTSSILMQVWVPTVNSETLKTAYKKEGITIDPNVMLGAGYMSGGKDSCQGDSGGPLVAQVGGRYVLYGITSFGVGCARPGFPGVYARVSEFRSWI

SEQ ID NO: 19511 - protein, 500 aa, Myxococcus xanthus
PLLTFEQERFTYGQFATHVTAFARGLKQRGLQPGERVALFLENSARFAITYLGVQAAGGVVVLVNTAYRQVELAHILSDAEVCGCVTGAAGAAELVPLRAQLPSLQWFITGERPTTALPESLTEVPFDTLLAEGTSATAPLVMPRPEDLAVLGYTSGTTGRSKGAMLLHRNLLANVRAVTEAWRWTEQDRLLLTLPLFHTHGLMVGLHGTLFTGASADLRRRFNAAESLTALRDDASLTMFFGVPTMYSRLLEEARASRVKPRALRLWVSGSAPLSPQLFADIEAELGARILERYGMTETIMNTTNPYEGERRSGTVGFPYPGQEARVVDVRTRQPQPCGETGEIEVRGPHVFAGYWRRQDATAESFDADGWFRTGDLGDVDADGYLRITGRARELIISGGFNVYPREVEEVLAMHPGVAEVAVLGLPDADLGEQVVAVVVPHPGATPPESQSLVDWCKDRLASFKKPRQVVFTDALPRNALGKVQKHLLRAALVPPGTR

SEQ ID NO: 19512 - protein, 511 aa, Myxococcus xanthus
MAPTYDALVIGTGFGGAVAACRLAQAGLTVRVLERGLRYQKGSFPRDWSNPLNGWLWRYDQGLFDVKLLPGMSIVQAAGYGGGSLIYANVHLRPPAETFDADWPEGYSRAALDPYYDLVAYMLDLQPITASARGLPTKAKRMREVARKLGREQQFFYPDLAVRFAPAGEPMPNKFGVAQEGCNYCGECDIGCNVRAKNTLDLNYLAVAEQQGAEMTTQAEATRIEPLSPMGYRVTYTDHAAGGAERTVEARRVFLCAGTVNTTELLLRCRDQWGTLPRISDRLGCRYSANGDFLAFAFETREVWDPSEGPTITTSLVVDQGQGADKTWFLFQEGGHPGKAAGLLQVLDMGRDFRVPADLLQKQLVRALRRRSQPETVMGKERGRFQAVFLAMGRDRANGRLALRPLTRDMEVRWDVPSNLPLYRTQEQICQDIARALGARAVFNPLWDRLHIPVSVHNLGGCTMAEEPAYGVLNPDGEVHGHPGLYVLDGAALPASTGVNPSSTIAAVAER

SEQ ID NO: 19513 - protein, 502 aa, Myxococcus xanthus
YDVVVVGSGFGGSISALRLAQAGKSVLVLERGKRYRPGDFPRDVTRTDEVLWRHATRRKAQGLYDVRFLSGIGTVTASGVGGGSLIYANVHVRPDAEVFEDPRWPRTYRRDSLEPYFDKVARELRLNPVPPSIPLRKRDLFQRAARGMGRETFDPPVAVAFSEPPGPGRRVCQLCAECEFGCQHGAKNTMDLTYLARAEALGALVLARTLVSHVEPVRDGYRVHCQDLVSGARHTVESSRVVLAAGTLGTVEILLRSRDVARTLPRVSRRLGMAIRATGTSWRDAGRARGHPALGGPRRVHRDALHRPAAALHAGDGHVQPARHGGPSRAWGSRTSDGSRAWGRRCGPAWAQPFTAALKKGLMSRPLRADVDAARTSNLFGIGQDNANGRMHLDDGQLDVSWDFAGENAELVRRMTDAMRDLAAQYGASFAPLITWQLFKRPFTVHSLGGAHLAEAPERGVVSTEGEVFHYPGLHVADGSVIPTAIGFHPVMTISAVAERIA

SEQ ID NO: 19514 - protein, 317 aa, Myxococcus xanthus
PLHETRLPIPRPGPEELLLRVRACAVCRTDLHVVDGELPKPKLPLVPGHEIVATVEAAGERATAIPVGTRVGVPWLGWSCGHCRFCLAGQENLCEQARFTGYQLDGGYAEFTVAHQRFCFPLPPEYTDVHAAPLMCAGLIGFRSLRMAGRERRLLGFYGFGAAAHLLIQVARHQGRRVFAFTRPGDVEGQRFARELGAEWAGDSDTVPPERLDAAILFAPVGALVPAALRAVDKAGVVVCGGIHMSDIPAFPYALLWEERVVRSVANLTRADALDFLALAPKVPVRTLVQTFPLSAANDALTALRRGQVHGAAVLEV

SEQ ID NO: 19515 - protein, 449 aa, Myxococcus xanthus
RSALTRRREQLAKALGSAAALLASSRPRARNYAADQFPFRASSHFLYLFRLATPDGVGLYDGQGWTLYLPEPGPDDALWDGAVPGFAEIAERTGCTVRSRAELPAALKGRDVAALPTPDLETCLDVAALLGREVRPGHLAAVDVPLADAMIALRLRHDDAAQAQLRQAAEVTVLAHMAGMRATRPGILEAAVRAAMEAEFVSRDVRPAYQPIVTVHGEVLHNLRYDHTLREGDLLLADVGGESPAGFACDVTRTWPVTGRFSTTQRELYDVVLRMQKASIDAVQPGTRYRDVHLAAHREMARGLVALGILRGDPEELVVDGVTALFFPHGVGHLLGLDVHDMEDLGDRAGYAPGRTRSPEFGHRSLRLDRDLEPGMAVTIEPGMYQVPAILSDARLMARAKDRLQRDVLARYADVRGIRIEDDVLVTSDGNEVLTAAIPKEASNIEAVM

SEQ ID NO: 19516 - protein, 602 aa, Myxococcus xanthus
MGKVIGIDLGTTNSCVAVMEGGEPVVIPNSEGSRTTPSMVGFTDSGERLVGQIAKRQAITNPENTVFAAKRLIGRKFDSPEGKKAIGVSPFKVASSPNGDAWVEIRGKGYSPPEVSAIVLMKMKQTAEDYLGEQVSEAVITVPAYFNDSQRQATKDAGRIAGLSVLRIINEPTAAALAYGLDKVQDGGTERIAVYDLGGGTFDISILELNAGVFEVKSTNGDTFLGGEDFDQRLIDYLAKRFAESNNGLDLRKDRMALQRLKEAAERAKHELSSAPETEVNLPFITADASGPKHLTETVDRATFEALVTDLIDRTIEPCRIALKDAGIPAQQINQVLLVGGMTRMPRVQQKVKEFFGREPHKGINPDEVVAVGAAIQGGVLKGEVKDVLLLDVTPLSLGVETAGGVFTKIIDKNTTIPCKKSQVFSTAVDNQPLVSVHVLQGEREMAADNKTLARFELVGIPPAPRGVPQIEVSFDIDANGIVHVSAKDLGTGKVQQVRVVSNSGLSEAEIQAMISDAQSHASDDKKKKELAELRNNADGLIYTTEKSLEEYASLLSEKDREEIKADLERLKEVLNTSDAAVLKESFQRLEGSAYRIADAIY

SEQ ID NO: 19517 - protein, 506 aa, Myxococcus xanthus
VLLCILDGWGIRQERDNNAIVLAGTPHLDKLASPYPFTELQTAGLAVGLPEGQMGNSEVGHTNIGAGRIVYQDLVRINRAAESGELAQNPVLRAALDGVKADGKALHLLGLVSPGGVHSSMDHLFALLKAAKERNVAHVYVHAFLDGRDTPPQSALGYVEELERFLHETHTGRIATVTGRFYAMDRDKRWDRVHQAYEALVFGRGPKAPDALSAIRASYAEKVTDEFVKPTVLAAGDGTPVGRIQDGDAVIFFNFRADRARELTQALAFPEFKEFDRGGLRLGRYVCMTQYDETFKLPALFEPDQPQDIFPELLSRQGLRQFRTAETEKYAHVTFFFNGGREVVYAGEDRHLVPSPRDVKTYDLKPEMSAYEVTAELVKRLDSGKYDFALVNFANPDMVGHSGRLDAAMKAVKAVDECLGALGKACERNGWVLAISADHGNCEQMVDLETGEPHTAHTLNPVPFHLIHPDFRGQKLRPGILADIAPTLCKVMGLPQSKEMNRQGLL

SEQ ID NO: 19518 - protein, 485 aa, Myxococcus xanthus
MKRTRVAVVGGGIGGLTAAGLLAKDGHEVTLFERGASLGGKAQAVIVNGITLDTGPTLLTLPHLVRGTFQQLGAEDLLPRFTELEPQCAYRFEDGCDFTAYKDVERMAESAAGVRPGERDGIRGFYTEAAAIWRAAGEPYLEAPFEGMAGFMTRVAKRGVGAVMAGMKMGTLHELAARHFKTDHLRQYVGRFATYTGASPYEASAAFALIPHIEHAYGVHHVRGGIGALVDALGQAVRRLGMRIHLDTRVRFERTREGYQVGPQEGTERFDSVVVNADPLERLARAEEPLALSGFVLLLEVEGRMALPHHTVLFGGDYRREFDELFGGQLASDPTVYFCNPSATDESMVPPGRTGLFVMVNAPALPVDARGAEQATRDWEAGAERVKAQMLERLCRHYPALKGRVRVIGQRSPVDLAAQGAPGGSIYGFLPHGKFGPFRRPRIRGNTPGLFFAGGGTHPGGGVPLVMLSGRFAAELASQHLRRDA

SEQ ID NO: 19519 - protein, 517 aa, Myxococcus xanthus
MSASTQGRRIVVVGAGVGGLAAAARLAHQGFDVQVFEKTQGPGGRCNRLQVDGFTWDLGPTIVLMPEVFEETFRAVGRRIEDYLTLLRCDPNYRVHFRDGSDVTFTSELCAMGRELERVEPGSYARYLAFLAQGRVQYRTSLDHLVGRNYAGLRDYLSPRVLARIFQVRAHRRMYADVSRFFQDERLRAAMTFQTMYLGVSPYASPAVYGLLPFTELGVGIWFPKGGLYAIPQALERLAREEGVRFHYGAPVERILTDGGRTRGVRLEGGEVVEADAVLCNADLPYAYEKLLDPKATTLKRKEKLRYTSSGYMLYLGMKRRYPELLHHNVVFGRDYKGSFDDIFERFRVPEDPSFYVNAPTRTDASLAPEGKDALYVLVPVPHQHPDLDWKVEGPKVRAKFFARMAELGFPSLESDIEVERVFTPDDWAGTFNLARGSAFGLSQNFTQIGPFRPSNQDARVKNLFFVGASTQPGTGLPTVLISARLVTERLMTWAHAQGVSLSPRTAAATPLEGVAA

SEQ ID NO: 19520 - protein, 361 aa, Myxococcus xanthus
MALTLPDAQPPTGLLPLEQAWLQLVQTEVETSLAELFELPDEAGLDVRWTQALTQARAYTLRPAKRLRPALVMAGHCLARGSAVVPSGLWRFAAGLELLHTFLLIHDDVADQAELRRGAAPLHRMLAPGRAGEDLAVVVGDHLFARALEVMLGSGLTCVAGVVQYYLGVCRHTAAGQYLDLDLGRAPLAEVTLFQTLRVAHLKTARYGFCAPLVCGAMLGGASSGLVEELERVGRHVGLAYQLRDDLLGLFGDSNVAGKAADGDFLQGKRTFPVLAAFARATEAERTELEALWALPVEQKDAAALARARALVESCGGRAACERMVVRASRAARRSLQSLPNPNGVRELLDALIARLAHRAA

SEQ ID NO: 19521 - protein, 374 aa, Myxococcus xanthus
FDYMNLTKPIRLALAERGYTNPTPVQARAFRPAIEGKDLIVRSKTGTGKTAAFGLPLLEKIPADERRVRALILCPTRELALQVADELKMLAKHKGLKIAAIYGGASMKQQEDALEEGTPIIVGTPGRVFDHINRGNLKLDACDHAVLDEADEMLNQGFYEEVTRILDRLPKTRQVLLFSATVPTDIQNLIARYTTNAETLLLSGDVFTVEHIHHIRYDVSDAFPKPRNLIYVLEKEEPQNAIIFCNTRDDTALVTAVLNRNGFDAELLNGDLPQKERERVMGKVKRGEVAFMVATDIAARGIDISGLEYVINYSLPEDPAVYLHRVGRTGRIGNKGTAINLFSGRELATYTSLEKKYGIKFDKREMPAPEEAMR

SEQ ID NO: 19522 - protein, 408 aa, Myxococcus xanthus
MSAVEGTNYYFRKAARIMDVGTPIETLLATPLREVKVQVSIEMDSGEIRTFLGYRIQHDNSRGPMKGGLRYHPMLDQDECASLASLMTWKTAVVNVPYGGAKGGIACDPSQLSIKELERLTRKYVDQVQDVIGPTRDIPAPDVNTNPQVMAWIMDQYSRYHGHSPAVVTGKPLELYGSKGREAATGRGLLYVAREILRDLGLPVKGTRFALQGFGNVGGHTAQLLWEDGGVVVAVADALGGVRNPQGLDIPSLFEHVKRTGTVTGFSGGASCSNDDVLGADCEVLIPAALGHVLTRENAHAVRAKLIIEGANGPTQPEADEIFEKRGIFVVPDVLASAGGVTVSYFEWVQNLQHLSWEEDRVNAELEKSMKEAYERVAQVARSRKVSMRTAAYILAIGRVGKATVLRG

SEQ ID NO: 19523 - protein, 388 aa, Myxococcus xanthus
IYFLSGKRTPFGTYGGSLKDLSATDLAVESAKAALAQAKVSPEDVQHVVYGNVVQTSADAIYLPRHVGLRTGVPVPVPALGVNRLCGSGFQAFITAAELMLTEQAAVVLAGGTESMSQAPHVIRGARWGLPLGKGSLEDMLWTALTDSYTGQPMALTAEQLAVDYSLTQDQVDEYAVLTQKRFAAAQEAGRFQDEIAPVTLKTKKGETVVSRDEHNRPETSVESLRKLPKVFKKDGVVHAGAASGICDGAGSMVMATGSFVKKHGLQPIGRLVNWGVSGCDPKIMGIGPAPAIRQLLERAQCQLSDIDLFEVNEAFAPQYLAVEKELGLPRERTNVNGGAIAVGHPLGASGARITTTLVYELKRRGARYGIGSACIGGGQGIAVLVEA

SEQ ID NO: 19524 - protein, 544 aa, Myxococcus xanthus
INAHTRVPPPKNEPVLSYAPGTTERREVQAELKRMAGEQIDIPVIIGGKHIRTGKTDTVRMPHNHQHVLATLHEADASHAEQAIQAALAVKDDWARMPFQSRAAIFLRAAELLASRYRPILNAATMLGQGKTAHQAEIDAACEAIDFIRFNVHFAEQILGWQPEAAYQTWNMTDYRPLDGFVFAVAPFNFTAIALNLATAPAIMGNVVLFKPSSTAALSAWYIMELLREAGLPDGVINMLPGDGPTVGNPVLASPHLGGIHFTGSTPTFNAMWRTVGENISRYKQYPRIVGETGGKDFIVAHPSAADDLEALAVAIVRGGFEYQGQKCSAASRVFIPESLWPKLKPRLQALISEIRMGDVSDFRNFMGAVIDEKSFKKVSSYIDLAKSDSGASIVAGGDVDRKQGWFVKPTLVQLDSPTHRILREEIFAPLVGLHVYPDAKYEETLREVDQAASYALTGAVFARDRKAIDTALRELRHAAGNFYINDKPTGAVVGQQPFGGGRASGTNDKAGSGLNLVRWTSPRTIKETFVPPVKVPYPFMDND

SEQ ID NO: 19525 - protein, 1859 aa, Myxococcus xanthus
  unsure (1)..(1859): unsure at all Xaa locations
MSSDKQPSTVDDQSASFADVTADIQQNAQPVFEEAQPEALSVAEDDFSEVGSDTPAVAASAEPETSLEASFADLSMEVESAPDAPVAPTGDALASTEVEVPSSEVELLDGTADSEPVLAHEQSPAPIDDAWASAPLAVETEHMDVADAGDIIDVAAMAEPEAASQAADSEIALDSSEMVEASAADSADTTDAWDAGATTDVTADAMATADHGATDFIAASAGDTYEAQPAEIALDTADEASAEAEPTEIALDAAHVSDAAVEHASEMAFDASAGSEPGANYSPAEIALDASDVAVPEAYPETALTASDASDAATAEAYPAADFATAEAYPTTEFATAEAYPEADFATADVSDASTAEAYPEVALTASEASDTTAAAPELALSASDVIETSAPEPELAAADASSEVVAEASPYGSAAASFEEPFAETAFSEGDATAAGETYAEAVLDAAEVSDTAVSEHAFATSETSESATAEAYPEVALDTADVSDAATMELDSVETAAEATSDTALASSAWGSTDAAEEFATTEYAASDVSELAAIETAPETAHSTYDHSSEAFDGKEVVLDATEMSEPEIALDTSDVAESPSAQSPSEITLDATDVAESAPIEPAAEISLEASDVAEPQSAEIALDGSEVSEESPAQQGSVPTLELNAAEVSSDEPSLDVIDVESAPGHAGDEASFQAADGGSEQPTLEVIEVGTEATASEVDFPPEAAPFASSDVPSLEIRPVQVGPDLHAETIEVAGDPPQSSARTPSAEEMFDLSGNPEEAVPLAAANEFLAHGHFAPTDERSVAMAEGDAGAIELQPEWASTSEQPAAEAAQTEWATSGEQAAASDAYAGWEDPVSETVELQAEWAEPVTASEWTTSEQTAAATGHAEWAASDTGIASEAGQAEWADSTTELQPEWVAAEGAAAPEAQPEWATSAEQAHTEAQAQWTETAAQAALGSEQTEWAANTPEAAQADWASSSTETAPGEIQAEWAEPIAEDGQAQWATAEAPPSDGWNTASTEAAPVEVQAEWAESSEASPTEVQADGSTPTLDAAPVEVQAEWDDPAQQDGATLTAEPAATEAQAEWAAPEIADATTDAQAGWTTPGADTAQSEWTASSENGWATAEEVQTEWTAPATETAAQPEWATTPAAEAARTDWAAPGTENAGQPEWATPATEAVPGEGAQPEWASPATEEVQAEWATPAAEAAASSEWASPAAEGAQAEWATPATETAASSEWASPATEEVQAEWATPAAETAASSEWASPAVEEVQGEWATPATEAAASSQWASPAAEGAQSEWATPATEAAQAGWAAAPVEAAQPEWASPAAEEAQGEWASPATEEAQGEWANPAAEEAQAEWVTPAEGAAPAPEWASPATEEVQAEWATPEEGTAPAPEWASPATEDVQAEWATDAAAPASEWASPATEEVQAEWATPATETAAQPEWASPATEAAQPVWAAPTEGAQAEWAAPEAEEVQEEWAAAPAEGAQQGWATPTEAPHAEWSTPATEEVQAEWADPIEEAAPAAEWASTSAPAASQWDTPADNAPAAAEWSATSHDTSATWDAPATTEWSSEQTANWNEASAEEVSLADTATPASAEWNDASVDVEPVMEEAEPIEAASAWEAEPILDSAPVTSQWAAASTDSPFGAQAQDFTEAMPIEEEEVSMELEQEVAEIDVEEEAVVPPPAPMAAIPVVASAPVHFAQAASLATAAQAQHTAVVMPAAPANHVAVEREPLFDDTAIVGGTALTSFVEGEHRVIIHTVEGQVKRGTIRDADLLDEVISLEQQSGFAAEQIPGKRVKAIFFMLAAGARQPQVEGQKIRVTFNDGRQVAGFSQDFQGSTPGFFVIPADQRTNTARIFIYRSSVQAVAEGX

SEQ ID NO: 19526 - protein, 424 aa, Myxococcus xanthus
AHSQALFARAQARIPGGVNSPVRAFRGVGGDPVFFREGAGAWLTDVDGNRYVDLVGSWGPLILGHAYPPILDAIIDAARRGSSYGAPHADEVEFAELICATMPAVEMVRLVSSGTEATVAAIRVARGFTGREHILKFEGCFHGAGDPFLVKAGSGVETLGLPDSPGVPSALAKLTLTAPFNDLAAVERIFAENGQDIACAIIEPVVGNMGVLVPKPGYLEGLQALCQKHGVLLVLDEVMTGFRLSRGGAQELYGLKPDLTTMAKVIGGGMPMGAYGGPRDIMEKVAPAGPVCQSGTLSGNPVAVAAGLACLKALAAPGTYARLEEVSRMLEVGLLAEAKAADVPVTVNRVGSMLTVFFTGEPVYDYTSAKKADTARFGKFFHAMLNESVYLPPSQFEAAFVSLAIGEPEVAHVLAAARKAFRSL

SEQ ID NO: 19527 - protein, 339 aa, Myxococcus xanthus
AAMRATVLHKPGDVRFEERAEPKILAPTDAIIRLSATCVCGSDLWPYRGVQAVTEPTPMGHEYCGIVEEVGSAVASVKPGQFVIGSFFASDNTCPHCKAGYQTSCQHREPVSGAQAPRMRVPLADGTLVVTAEVPPDALVPSLLAVSDVFGTGWFAADAANVNPGSTVVVVGDGAVGLLAVLSAKQMGAERIIAMSRHETRQALAREFGATDIVSVRGDEGVARIKELTRGIGADSVLECVGTQESMLQAIGAARPGGFVSYVGVPHGVSLDGEKLFFSHVHLHGGPAPVRRFMPQLIDLVWSRKVNPGKVFDLTLPLEKVAEGYRAMDERRAIKALLR

SEQ ID NO: 19528 - protein, 249 aa, Myxococcus xanthus
DFKGQVALVTGASSGMGLATAKAFAAAGASVVLADVNTAALTSAVDALTSAGHSALGVTCDVSDEAQVAALVRRAVEAYGRLDMAFNNAGIQAPPTDAADEPSDLFDRVNGINLRGVWACMKHELKQMRQQGSGAIVNCSSLGGLVGLPGRAAYHASKHGVIGLTRSAALEYAPRGIRINAICPGTISTPMVTDMLAKGELDLAGAIANQPIGRLGEAEEIAASVLWLCSPGASFVTGVALPVDGGYTA

SEQ ID NO: 19529 - protein, 671 aa, Myxococcus xanthus
YKLTIRTGTKLGAGTDADISIVLVGTRGESAPRVLDKHFHNDFEAGAEDVYALSSEDLGDLVLLRFSNAGGVAADWLLDWAIVTAGEKQWHFPFYRWVLSGATVDVLEGTAKLARQASSERESTARRELLEARQRMYPWRAPEMTEGLPGALDLREGRPLPKDELYRGLTEGSYEVVIAKTLAAIKLNLPMLTRAWNGLVDIFDFFKHLEVPQLAQRWKDDLEFARQAVQGIAPLHITLVPSLPQGMPLTDDDVRGLLSPGTTLARALDAKRIFLIDFEILDDIRMYRKVGEDGVEERRWAPAARCLLYLDDQRQLRPLAIQLGRDAQKDPVFTPNDDAYDWLAAKIYLRCSEGNSHQMVSHALRTHFVAEPFVMATMRNLPDPHPVYKLLRRHFRYTLAINEGARKGLLDAGGVFDDFIATGGPDKGHLQLGKKGFQRWTLADNKPRADLERRGVLDPAVLPNYPYRDDALPLWDAFEEYVGGVLRHFYRTDADLEADTEMQQWWKDLTEHGLPVDKLPCRELRRVDDLVDILTTVLFTVSVQHAAVNYLQYEHYAFVPNAPLSMRREPPRQKGTLRAEDIPEMIPTKSQMLWQVAIGRALSSFGDDEEYLLHEGGWREEYFHEPELVAIRQRFQERLRAQREAVEARNAGAEVPYTILRPDRIPCGITV

SEQ ID NO: 19530 - protein, 363 aa, Myxococcus xanthus
VVGAGAFVPSRVVSNERIARAIPGWPAERIEEKVGIRERRFLWDIDEATGRAIPPPENDGHIYPASNTNMCEVALQKALAQVGVDAKELDALFVVTCTPNRRTSTTDAMELHRRLELREDAFGLVVDDGCGGTPYVLDMVKKMMEGGRFRTVAVVASAFTSPLVNREVYTDELPPGPGRSKTLQGYLSMYVFGDGAGAVVLQSKPGESGAEGILASFSGNAYGDLVIRKGGGLLKLPYQPGRMRPADMAFVVDGFRVARSYPEYMQKCLDAVLGPRPELRSKVERYYFHQPNKRVMDAFVERAGLPREAVACNVDRYGNTSAAGMLILLAEDLEAGRVRLGSGDLVVVAAVGANVHYGAQLVR

SEQ ID NO: 19531 - protein, 392 aa, Myxococcus xanthus
TRDFIDLEERYGAHNYHPLDLVIERGEGCWVHDVEGRKYLDCLSAYSAVNQGHCHPRILETLREQAAKVTLTSRAFRNDQLPHLYKALRELSGLSRALPMNSGAEACETAIKLARKWGYTVKGIPEDKAEVIVFANNFHGRTISLISFSTVRSYRQGFGPFTPGFTVVPYDDVEAVRRAITPNTCAILMEPIQAEAGVLIPRDGYLKQVAELCKQHRVLFMVDEIQTGLGRTGKTFAFQHEDVRPDVIVVGKALSGGFYPVSAVMADDEVMGVLRPGEHGSTYGGNPLGCAVARTALDVLRDERLVERSAEMGTSFLAMLKTLKNRHIVEVRGRGLMIGVALDISARPACEALMKEGVLCKETHDSVIRLTPPLIVTQAELDWAFERIKKVI

SEQ ID NO: 19532 - protein, 397 aa, Myxococcus xanthus
LKNLYVQVLLAIAVGVILGWLRPDLGESMKPLGDGFIKLVKMIIAPVIFLTIVAGIAKMGDLKHVGRIGLKALIYFEVLTTLALVVGMVVVNTLKPGAGMNIDPAQIDTSGITQYRASASQQGTIPFLLDIIPHDFLSAFTEGKLLQVLLVAVLTGVALTRLGPMGQRVLDLSDDLAQVFFGIVGMIMKLAPLGAFGAMAFTVGKFGVESLSSLGRLLIAVYVTCALFVFLVLGLVARLSGFSLWKLLRYMRSELLLVLGTSSSESALPRLLKRLETLGCDRGAVGLVLPTGYSFNLDGTCIYLTMAAIFIAQAVNVDLSLGEELTLLGVLLLTSKGAAGVTGSGFITLMATLAALNGKVPVEGVALLLGVDRFMSEARAITNVIGNTVATLVVSKW

SEQ ID NO: 19533 - protein, 371 aa, Myxococcus xanthus
FTEEHEAFRNTVRSFVEKEMTPHGLEWDRAGIFPKELFRKAGDLGFLGINHDPKYGGSGLDYWYVTVFAEELSRSLNAGVNMALLVQSQMATPIINEIGTDEQKREFLEPALKGEKIAALGVSEPGCGSDVASIKTTARRDGDDYVINGSKMWITNGTRADFITLAVRTGEAGYGGISLVTFPTDVKGFGVSKKLDKVGNLSSDTAVLYFEDCRIPARYVLGEENEGFYHIMTNFQGERLVGAITTVAGMERMVEDSIRYGNEREAFGRPLMKFQVWRHKFVEHLTAIEAAKRLTYHAVDLFDRKENPVKEVSMAKLFAGDLAQRVAYDCQQFYGGMGYVEETSIARMWRDVRLITIGGGTSEVMKEIISK

SEQ ID NO: 19534 - protein, 605 aa, Myxococcus xanthus
FPLPRGGDATLVQLLIQRAKNASTVGVSHKKDGRWQDVTFAQFLDEVKALSAGLVAQGVKPGDRVAIFANTSLQWLICDVAISAAQAITVPIYASNTPDECRYILNHSETTLVFVDNDEKDARQAGRLTRLRQKLAECPALRRIVAFEGPVAGGTELSLADVIAQGRTEHAARPDDFEARVAGVSMEDTASIIYTSGTTGDPKGVILTHRNWAFEAKAAQSVGMMVPSDSVMLFLPLAHVFAQVVKAAWLSMGYRLVVAESVDKLLANLVETRPSVLPSVPRVFEKVYNNVVANGSAAPGLKGRLFRWAFKLFDEYVEARSQGREYATLGFALAKKLVFSKVHAAISEKLGGNMRVFISGGAPLSPKIGYFFDLLGLKVLEGYGLTETCAGTTVNREHKIKIGSVGAPVPGMEVMIASDGEILIRGPAVMKGYYKNPEATAEAIDAENWFHTGDIGELDADNYLRITDRKKDLIVTAGGKNVAPQNLENALKTHAIISQAMVYGDKRPYLVVLITVSEEGARRLLLDQGAPVGTYADNARRPEVQAAVKAAVDQVNTQQPPYATLKRFTVLENDFSQETEELTPKLSVKRKVCTQKYRAQLDRMY

SEQ ID NO: 19535 - protein, 839 aa, Myxococcus xanthus
SATPPSPKLRLPTEVRPTGYKVALTLDPKVSSFKGAMDITLDVTKPTSVVWLHAKSLNVTGAVFIQNGSAFIGTPVKGEEDFLGFSVAKPLAAGRARLVINYEGVASEKETDGAFRVNEGGDWYIYTQFEPVDARRVFPSFDEPGFKVPWQLTFHVPAGVVAVTNTPQESEEVRPDGGRTYRFARTQPLPSYLIAFGVGPFDFLPAADAGQKKVKTRIITPRGRTAEGAYAAQVTPEILAALEDYFGIPYPYEKLDVLAVPLLRGAMEHPGLVTFNSRLILAKPEEDSLGRQRAFSDTQVHELAHQWFGNLVTMQWWDDLWLNEAFASWMTPRIVESWRPAWDAPVERVHDRARALDADSLLSARRIRQPIESANDIHNAFDGITYGKGSAVLSMTEEWLGRDVFQRGIQRYFRKHAGGNATANDFLDAVSAESGKDVTGMLGSFLDQSGAPLVTASLACGADGAKVVLTQQRYLRLGAASPGPQTWKVPVCVEYAAGGKEARTCTLLEGERAEVALSEAKTCPDWVFPNAEGAGYFRVQLDGDAAAKLAKSGMKRLSRTERVTFLTDVRALALAGTIPAAEALALTSRLANEPDRVVTLASLDLLELVSSRLLPDEKLKDRARFLRETYGPRARQLGFAPRKGESEDTRLLRPRLVRLAGRDGRDPKLLAEARALANKWLKDNRAVAPEMVDVVLALAATENDAAFREQLVVAVRSEKERRTRQHLIGALSSFTDPVLVKQNLALVFEKGLDPRETMWMAFAASQGLRTQDVAFDFVKENYDRLVGDSPEALLSLDAAGRMAYIGSNFCDAGKRQQVEEFFSERTAKAPGGPRVLAQV

SEQ ID NO: 19536 - protein, 292 aa, Myxococcus xanthus
LLVGTASPHLGRALGQALGVAPADCHFERFPDGEMHVEVPEQVRGRTVILVQSTTPPAGEHLLELLLMADACWRMGAARLEAVVPYLGYARQDRRARPGEPLGGRLVADLLSQGRFARVLVVDLHSPALEGCFGAPLEHLTSLPLLAEALREHVTDTSVVVAPDLGAVKRAEALARLLNRPWAVIHKVRLSGDEVHASGLMGEVRGRRPILVDDMVSTGGTLAAAAGTLRDAGCTEDFTVATTHALLVGPAVERLRTLPLTRLVSTDSVEPVLGLPFQHQVVTLAPLVARAL

SEQ ID NO: 19537 - protein, 606 aa, Myxococcus xanthus
IAQLKALRPPYVTREVLEIYDEATAALDDAGARASVARHAHPDAAMREAAEAAEQALETLSNDIRMDRGVYDVLAALDLSGEDAATRKWMEKVRREFRRAGVDRDDATRARVKALQEELVRIGQEFSRNIRQDTRTEALSPSALEGLPDDYVRAHPPGPDGKVRITTDYPDIVPFMTYSRDAQAREQMWRVFRQRGHPANADVLQRMVSRRNELATLLGYRNWAAYATEDKMTRTQQVAADFIDRLGMATEARAKQEYAQLLARKQKDVKGAKVLEPWDQDFYEDRLRAERFSFDSQAVRPYFEYGRVKAGVMDITSRIWGITYKPVKDARVWQQEVETYDVFDGDTLLGRIYLDMHPRDDKYKHAAQFDLVAGQAGKRYPEASLVCNFARPGELMTHDEVETFFHEFGHLLHAIFGGHLKWAGIAGTRVEWDFVETPSMLLQQWAGNPEVLKEFAKHHETNQPIPAEMVEKLRASKEFGQGLWARRQLFLSAVSLDYYSRAPGFDTTEALVALQTRLSPFKHEHRDGTHFEVAFGHLDGYSAAYYTYLWSSVIAKDLETEFQKKGFLDRETAMKYRRTVLEPGGSKPAAELVKDFLGREYGFDAY

SEQ ID NO: 19538 - protein, 253 aa, Myxococcus xanthus
FRDGLLAGKVAFISGGSSGINLGIAESFVKAGAKVAINGRNVEKLEAAVKGLQAHGTAMGVAADVRDYAAVEKALQTVREAYGELDVVVCGAAGNFPAPALGMSSNGFKTVMDIDVLGTFNISRAAFEHLRKPGASLINISAPQAYLPMAMQAHVCAAKAGVDMLTRVLAIEWGGSGVRVNAITPGPIDDTEGMRRLAPSDEGRDKLAQALPLQRFGKKQDIAQLALFLASEGSSYITGSIMVCDGGQSLLGG

SEQ ID NO: 19539 - protein, 411 aa, Myxococcus xanthus
MSTSPVQELVVSGFGVTSAIGQGAASFTSALLEGAARFRVMERPGRQHQANGQTTAHLGAEIASLAVPEGVTPQLWRSATFSGQAALVTVHEAWNAVRLQAVPGHRIGLVVGGTNVQQRDLVLMQDAYRERVPFLRAAYGSTFMDTDLVGLGTQHFDIHGMSFTVGGASASGLLAVIQAAEAVLSRRVDVCIAVGALMDVSYWECQGLRAMGAMGTDRFAREPERACRPFDRESDGFIFGEACGAVVVESAEHARRRGVTPRGILSGWAMQLDASRGPLSSIEGESQVIGAALRHADLAPERVDYVNPHGSGSRQGDAIELGALKACGLTHARVNTTKSITGHGLSSAGAVGLIATLVQLEQGRLHPSLNLVDPIDSSFRWVGATAEAQSLQNALVLAYGFGGINTAVAVR

SEQ ID NO: 19540 - protein, 279 aa, Myxococcus xanthus
LFPGQGSQERGMGAALFDEFPDLTDIADAILGYSIKRLCLEDPGKELAQTQFTQPALYVVNALSYLKRLREGAEQPAFVAGHSLGEYNALLVAGAFDFETGLRLVKRRGELMSGASGGTMAAVVGCDAVAVEQVLRDRQLTSLDIANINSPDQIVVSGPAQDIERARQCFVDRGARYVPLNVRAPFHSRYMQPAASEFERFLSQFQYAPLRCVVISNVTGRPYAHDNVVQGLALQLRSPVQWTATVRYLLEQGVEDFEELGPGRVLTRLITANKRGAPA

SEQ ID NO: 19541 - protein, 374 aa, Myxococcus xanthus
MMQERGVALPFEDPVTNAVNAARPILDAMSPEARERIELLVTSSESGVDFSKSISSYAHEHLGLSRHCRFLEVKQACYAATGALQLALGYIASGVSPGAKALVIATDVTLVDESGLYSEPAMGTGGVAVLLGDEPRVMKMDLGAFGNYSYDVFDTARPSPEIDIGDVDRSLFTYLDCLKHSFAAYGRRVDGVDFVSTFDYLAMHTPFAGLVKAGHRKMMRELTPCDVDEIEADFGRRVKPSLQYPSLVGNLCSGSVYLSLCSIIDTIKPERSARVGMFSYGSGCSSEFFSGVIGPESVSALAGLDIGGHLRGRRQLTFDQYVELLKENLRCLVPTKNRDVDVERYLPLVTRTASRPRMLALRRVVDYHRQYEWV

SEQ ID NO: 19542 - protein, 420 aa, Myxococcus xanthus
MGPVGIEAMNAYCGIARLDVLQLATHRGLDTSRFANLLMEEKTVPLPYEDPVTYGVNAARPILDQLTAAERDSIELLVACTESSFDFGKAMSTYLHQHLGLSRNCRLIELKSACYSGVAGLQMAVNFILSGVSPGAKALVVASDLSRFSIAEGGDASTEDWSFAEPSSGAGAVAMLVSDTPRVFRVDVGANGYYGYEVMDTCRPVADSEAGDADLSLLSYLDCCENAFREYTRRVPAANYAESFGYLAFHTPFGGMVKGAHRTMMRKFSGKNRGDIEADFQRRVAPGLTYCQRVGNIMGATMALSLLGTIDHGDFATAKRIGCFSYGSGCSSEFFSGVVTEEGQQRQRALGLGEALGRRQQLSMPDYDALLKGNGLVRFGTRNAELDFGVVGSIRPGGWGRPLLFLSAIRDFHRDYQWIS

SEQ ID NO: 19543 - protein, 419 aa, Myxococcus xanthus
LREDRFLDVLRRLIALTPKLQNNPGAGLVPEERLAAQVVLDTLAPHIESGFIQAESVAGPGQASRPCLVLTVPGEGEGAIGFVGAHFDVVPADQKTEGWERSPFELWEGPGGVLYGRGVTDCLGHVAVLTDLLAQLAERKVRPSRTLKVVLISNEESSELPGLGLNYVAEQGMLKPLDGQPVYWLDSANFGPTLGTAGVSLWELKVTGVGGHSGMPQNCVNALELGMAASLELARFFHERFPPTEDEKRWGFLSSSSLKATVVEAPNTKETKVPADVVLRGDIRLTPFYDLAEVQKTVTDFMAELDARLERDDAPAHFPRTRTAGGKRGELAFRFQGEGTEGIACRLDSEGLRALKEAMQVVRGVSATPFSLTGSLPLVRDLQRQGCDVQITGFGDMQYYHAPNEQARLEDFRQGFAIL

SEQ ID NO: 19544 - protein, 627 aa, Myxococcus xanthus
APQRETHAFQAEINQLLSLVINSLYSHKEIFLRELVSNASDALDKLRFRAITEPELLADEPALELRLIPDEAKGTLTIEDTGIGMSHDELVKNLGTIAHSGSREFIEALAQKGQQKDMQLIGQFGVGFYSAYLVADRVEVVSRAAGQGQSAWRWTSEAKGSFTVEPAERAARGTSITLHLKEDQKEFLGEWRLRSLITQYSDYVGHPIKLQVSKTTGTGDEAKTETSLEVVNKASALWQRSKSEITDEQYQEFYKHLTHDWEAPLAWTHFKADGNTQFTGLLFVPKQPPFDLDAQQQRGVRLFVKRVFIMDRCEELVPQWLRFVRGVIDSDDLPLNVSRELLQDSQVVRAIRKHVVKKSVDLLEKLAKDKPDDYLTFWKAFGTVLKEGLATEAEQKDKLGGLLRYESSREEGLTSLADYVGRMKEGQEAIYYVYGESRKAVADSPHLEALKQRGFEVLYMTDPVDEWAAQGLREFQGKPLVSALQADLKLQSTDEQKKEQEQHAEGLKTLTSKMKDVLQESVREVRVSDRLTDSPVCLVVPEGGSPAYLERLLQQRGRGAGMPRVKRILEVNPKHPVIEHLKAVHDRDPAAAQVAEWIELLHDQALLTEGSTIADPNRFARRMTGLL

SEQ ID NO: 19545 - protein, 337 aa, Myxococcus xanthus
MLIVMRPDATAQDIERVNDEIRRRGWQPHAIPGGTRTAVGITGNPGAVEPEPFRVLPGVADAVAISQPFKLVSREVKPDDTQLRIGDLTIGGSAFHVIAGPCSVESREQILSTAHAVKKAGATMLRGGAFKPRTSPYEFQGLKGDGLALLAEARQETGLLVTTEVKDTATLQAVADTTDILQIGARNMQNFSLLEAVGDLRKPVMLKRGMSATIKELLMAAEYIVARGNTQVILCERGIRTFETMTRNTLDLNAVPMLKALSHLPVFVDPSHGIGVRKAVPAMMRAATAVGADGIIVEVHPDPPRAKSDGAQSLDFSEFEKSMNEVRAIAQAMGREV

SEQ ID NO: 19546 - protein, 182 aa, Myxococcus xanthus
LVRHGETEWSRAGRHTGRTDIPLLDSGREMGRLLGAPLKAWRFDTVYTSPLSRAADTCALAGYGDYAQLREDLMEWDYGDYEGRTGAEIRAERPDWTIWKNGVPNGETAAQVATRVDSVISDALRTDGDVLIFAHGHLLRVLAARWLGLPPWEGRLFLLSTASISVLGHDGDRRRPAIVSWN

SEQ ID NO: 19547 - protein, 404 aa, Myxococcus xanthus
KAASALRQWMEDGREKYGIAYQKFICTSADNLGYYAPWRLAPTLRFKPWQTLYRQLDGFFHDDRVTYALAYPSKYLGLHPTTCSSVFSVIPFLELAFGVWHVEGGFRELSRGMMRCARDLGATFRMGTPVEKVRVDAGRAVGVKLVGGEVLDADAVVVNADLAYAARSLIPAEAREGSRLTDAALERAKYSCSTFMAYYGLDTVYADLPHHLIYLSESARRTDRDALEDRHVDLEDPPFYVCNPGVTDPSGAPAGHSTLYVLVPTPNTGRPVDWVKTEQALRERIPAMLEKVGLKGVREHIREERYFTAETWRDDFNVFRGAVFNLSHTWLQLGPLRPKVKNRDIEGLYFVGGGTHPGSGLLTIMESANIAADYLTREAGKGPLPGWPYVPPLEPESPVQARAG

SEQ ID NO: 19548 - protein, 191 aa, Myxococcus xanthus
VLALVALGADLKARDSSKHSVLHLAAMVDDAALVKELLRLGVAADVVDSNKSTPLHVAAEHGSVSCIAALAKGGVPVDALDTSGRTALFEARQADVAQALIDAGANPNAGKGWTPLHQHARFKERGPVIEVLLKAGADVSLKNGSGQTPAQEALEHKNASLAQLMGAKASSGKAGALDVQPLLDALARQRK

SEQ ID NO: 19549 - protein, 294 aa, Myxococcus xanthus
MASLRDIRKRIRSVKNTRQITKAMKMVSAAKLRKAQDGILAARPYATMLDQIIADLSARAGDESLSHPLLTARPVKRVELVLLTSDRGLAGGFNSNVIRRANRFLYENTNLESIRLSTVGRKGNDFFRNRGQNIRKDFGGLYQRLNYRAAADVAEELVASYLNGEVDAVHIVYNEFVTAISQTVKVAQLLPLQTLGTPDQASTAGSTSLVDFKYEPDRQSVLDRLVPQAVNIKLYRALLESVASEHGARMSAMENATSNATDMIGNLTLTYNRTRQAVITKELMEIVSGAEALK

SEQ ID NO: 19550 - protein, 489 aa, Myxococcus xanthus
  unsure (1)..(489): unsure at all Xaa locations
ADDSMSAQVPTAGRIIQVLGPVVDVEFPPGGLPEVYTALKVTNANLSAAADNLTLEVAQHLGENTVRTIAMDSTEGLGRGMAVTNTGAPIQVPVGKATLGRILNVTGEPVDEMGPVKAQEYWSIHRAPPPFTEQDVRVQMFETGIKVIDLLAPYTRGGKIGLFGGAGVGKTVLLQELIRNVAVERGGFSVFAGVGERTREGNDLYHEMQDTKVIQTDNLEASQAVLVYGQMNEPPGARARVALSALTMAEYFRDVEGRDVLLFVDNIFRFTQAGSEVSALLGRIPSAVGYQPTLATEMGGLQERITSTTKGSITSVQAIYVPADDLTDPAPATAFAHLDATTVLNRSIAELAIFPAVDPLDSTSRILDPAVIGAEHYGVARKVQGILQRYKELQDIIAILGMDELSEDDKLVVARARKIQRFLSQPFFVAKVFTGKDGRYVKLQDTIQGFKEIAEGKHDDIPEGAFYMTGSIDEVVENARKLAASXAGR

SEQ ID NO: 19551 - protein, 249 aa, Myxococcus xanthus
LELRGKTALITGSSRGIGRAIASVLAREGVRVCLSARGAEALEATAAQLRAGGADVATVVTDVATQAGAVEAVEAAVRAFGRLDILVNNVGGSGGAGAFHSATAEQWTSVLDRNLLSAVWCSQRAVEAMRQQGGGCIVHINSIFGREYATSAPYTTAKAGITALTKEMAVDLAQYRIRVNGVAPGSILFPGGSWDKRQKADPEKVARLVRDELPWGRFGAPEEVADVVAFLCSERARWVTGATLPVDGG

SEQ ID NO: 19552 - protein, 514 aa, Myxococcus xanthus
MTERELWERYQRYLCVVPALDFTLDVSRMRFPADYLERMRPRLEEAFGAMEALEKGAVANPDEKRKVGHYWLRAPELAPEPALQKEITDTVAAIHAFAKNVHEGRVKPQKAQRFTHMLIVGIGGSALGPQLVADALGTAKDPMQVSFFDNTDPDGFDRVLAQLGERLSETLTLVISKSGGTKETRNGMLEAERGYSARGLDFSKHAVAVTGAGSELDNHAKKQGWLRAFPMWDWVGGRTSVTSAVGLLPARLQGLDIDALLKGARDMDAATRERDALKNPAALLALMWHYAGDGRGHKDMVILPYKDRLLLMSRYLQQLVMESLGKETDLDGQVVNQGIAVYGNKGSTDQHAYVQQLREGVLNFFATFIEVLKDRDGGSQEVEPGVTSGDYLLGFLLGTRRALYEKDRESLTLTVPDVSARTLGALIALYERAVGFYATLVHINAYHQPGVEAGKKAAGVVLELQRKLTTRLREARAEARTAEQLAADIGMPDEVETVFKVLQHLAANPDRGVT

SEQ ID NO: 19553 - protein, 201 aa, Myxococcus xanthus
CSPCATNDSCAGNSCNCCPNGTQCLALTPGATPTCVECTTSSQCAAGQQCDTANGRCVDSVPSCNTADSCGPGCVKCPGERPYCLDGEVCVQCRNDLECGDGQFCLSGECASCTTDKHCGPRCGACDGDTPFCLSNGTAQGSTCVGCTDDGDCGSGVCNPTTRTCENSGACAVTCEPGTVCDGTSCVECFADAHCPCGGTC

SEQ ID NO: 19554 - protein, 233 aa, Myxococcus xanthus
AFITGAGIRIGSAVARALGRSGYDLALHANRSLEPLEALADELRGLGRRVTLHAADLSRPEAVDSLAAQVREAWPALDVVVHNAGLFERTDFAAISRDQYRTMMAVNLDAPFFLTQALLPALRAGKDPLVVHLTDVGGERPVSHYAHYSVSKAGLIMLTRALAVELAPHIRVNAVSPGTVAFPEDFDAEARDAVLRRIPMGREGNVEDIARTVVFLAREAPYITGQVIAVDGG

SEQ ID NO: 19555 - protein, 254 aa, Myxococcus xanthus
MSEVGTRKVLVTGGGTGIGRAVAEALLRAGGQVVVSGRRVEVLESLTTAWPGQAFALPCDLASLEAREGLLRRAAGLLGGLDGFVHSAGQVVHQPPGHIGEDALRAQLEVNLIAPLRLGEQALEVLEPGGAQVFIASTLATRPVVTSAVYSAAKAGLLQVMKVLALVGAARGVRASAVLPGVVETDMVREVRLAPGAGPLSEPEYARRQEAQLAGLRALHPLGRLGRPEDVAEAVRYLLGASWISGSELVLDGG

SEQ ID NO: 19556 - protein, 248 aa, Myxococcus xanthus
MNVLITGATAGFGLAIARRFIQDGARVIASGRRTERLEALRAELGERVLPLTLDITDREAVERAIRSLPAEFAEVDVLVNNAGLALGLDLAQSARVEDWDTMVDTNVKGLLYCTHAVLPGMVARNRGHVVNMGSVAAEWPYPGGNVYGATKAFVHQFSLNLRADLHGTAVRVTDIEPGLVGGTEFSNVRFKGDDTRAASVYANTQALTPEDIADAVHWVATRPAHVNINVMSLMPVSQSFGPLPVKRQ

SEQ ID NO: 19557 - protein, 116 aa, Myxococcus xanthus
IFKEFTFEAAHRLPNVPPGHKCSRLHGHSYRVEIHVRGPVGSQSGWVMDFSDIKEAFEPLRLKLDHYYLNEVEGLENPTSENLSRWIWKRLRPGLPLLSRVVVRETCTSGCIYQGE

SEQ ID NO: 19558 - protein, 140 aa, Myxococcus xanthus
ASIGLSATAIAPGKFATAEHMNFTTVLFETIGTVTTVEEEQLHAVTGLSGSGPAYVYYLVEAMEKAAEKQGLDTSVSNELILQTLIGAAEMLKQSPKTPAVLRKEVMSPGGTTEAGIEQLISHNFQEAMMQCIEQATIRS

SEQ ID NO: 19559 - protein, 36 aa, Myxococcus xanthus
MSNPKVVLAYSGGLDTSVAIKWLQEKGYDVVACCLD

SEQ ID NO: 19560 - protein, 281 aa, Myxococcus xanthus
MESSLKEVRFDSITAEHFKQVKEHGFTDAYLASVWNVPELDVRAKRKALHITPSYKMVDTCAAEFESSTAYFYSSYYGESEIEPSTNKKVAIIGSGPIRIGQGVEFDYSSVHGVLALEKEGYETILINNNPETVSTDFEVADRLYFEPVTVEDVLNVLDAENVTDVIVQYGGQTAISLVKGLEEAGVNLLGITNDVIDALEDRDLFYKLLDDCDIPHIPGEMAKDEQELVQKAKAMGFPLLIRPSYVIGGKGMLTIQNETELQACLPAIKASHFPMLIDAY

SEQ ID NO: 19561 - protein, 103 aa, Myxococcus xanthus
  unsure (1)..(103): unsure at all Xaa locations
VGYALGIGFAPVRKEGKLPREVIEVHYGLKYGKDVLTIHKDAIKPGQRVLITDDLLGTGGTIEATIKLVEELCXIVVGAAFLIELSYLDGRDKLHGYDVFTLM

SEQ ID NO: 19562 - protein, 229 aa, Myxococcus xanthus
LVVSDPGVVRAGLVSPIVTALEASGYRVLVFDSIEQNPRDTNCLEGAKLFRDFSAEAVVAIGGGSAMDTGKAIALCGPNGGEPSDYADGRLLYSNIAPVICIPTTSGTGSEVTRSAVITEASTHRKMTLKHSTLRPVLAILDAELTLSLPPSVTAATGIDALVHAIEGYTCKVTNPISQALGAQAMRTIVSALPIVFRDGKNEAARQDMLEGSLLAGLCFGSADVGSAQ

SEQ ID NO: 19563 - protein, 72 aa, Nitrosomonas europaea
LAIGYTLNELGNDIAGGIIPASFEPTIDYVVTKVPRFAFEKFPQANDRLTTQMKSVGEVMAIGRTFQESLQK

SEQ ID NO: 19564 - protein, 89 aa, Nitrosomonas europaea
LDLADKAHTNVRALSGGMKRRLLIAQALVHKPPVIILDEPTAGVDVDLRQSLWQFIRQLNLEGHTVVLTTHYLEEAEALCNRVAVLKQG

SEQ ID NO: 19565 - protein, 268 aa, Nitrosomonas europaea
FRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKKGQS

SEQ ID NO: 19566 - protein, 256 aa, Nitrosomonas europaea
MGFLAGRQILITGLLSNRSIAYGIAKAMQREGAKLAFTYQSDDLRERISKLAAEFNSDLLFRCDVSQDEEISRCFSELADHWDGLDGIVHSIAFAPRTALAGDYLESVDRQAFHIAHDISSYSFAALAKAGLPLMQGRPAALLTLSYLGAVRVMPSYNVMGLAKASLEANVRFMASSLGKQGIRVNAISAGPIKTLAAAGIGNFGKLLGYSEKVSPLKRNVTTEEVGNVAAFLCSDLASGITGEITYVDAGFNTVA

SEQ ID NO: 19567 - protein, 327 aa, Nitrosomonas europaea
TLTQFIIEEQRHIAGASGDFTALLNDIVTAIKTISNAVNKGALIGVMGALDTENVQGETQKKLDVITNEIMIRNNEWAGHLSGMASEEMDDVYSIPSPYPLGKYLLVFDPLDGSSNVDLNISVGTIFSILRSPVPSRAASMEDFLQPGVKQVCAGYALYGSSTMLVLTTGHGVNGFTLDRDIGEFVLTHPNMRIPADTREFAINASNQRFWEAPVQRYVAECLAGSTGPRGRDFNMRWVASMVAEVHRILTRGGIFMYPRDTKDPSKPGRLRLMYEANPMSFIVEQAGGLSTTGYERILDVVPQDLHQRVPVILGSKNEVEVVLEYH

SEQ ID NO: 19568 - protein, 420 aa, Nitrosomonas europaea
ANSHEYLLDNGLKLVVKEDHRSPVVIQQVWYKAGSMDEVNGTTGVAHALEHMMFKGTDSVLAGEFSRKIAAIGGKENAFTSRDYTAYYQQLHQRHLPMAMELESDRMHNLQLTEEAFAKEIQVVMEERRLRTDDQAHSLLYEKMMATAFQTHPYRRPVIGWMNDLENMQVNDARDWYQRWYAPNNAVLVVVGDVDPENVFVLAKKYYGRFSAARVPALSERKPQIEPPQTGIKRLVVKASAQLPYLIMGYKVPVLKDPKNEWEPYALTILAEVLDGNASARLNKTLVRETRVAISADASYNAIERGPGTFFIDGAPSEDKTVDDLEQSIRTEIGKIIQSGVTQEELARVKAQVVANHIYQLDSTFAQAMQIGRLESVGLSHRDADIILEGLQAVTAEQIRKVAEKYLIDDSLTIAVLDPQ

SEQ ID NO: 19569 - protein, 450 aa, Nitrosomonas europaea
FIQNRSKENFALHDKYLNSQMVKVLKTIDFDRHYVRAEGAYLFDEQDNRYLDLLSGFGVFALGRNHAEIVEALKSTLEADLPNLVQLDVSLLAGLLAERLVKLTPDGLKRVFFANSGTETVEAAIKFSRYATGKSKIIFCHGCYHGLSLGSLSATGDDHYKKGFGPMVPDFIEIPFNDLEALEQVLAQGDVAAFITEPIQGHGVWIPDDNYLPEAARLTRKYGALFITDEIQTGLGRTGKWWAVEHWSVEPDILCMSKTLSGGFIPVGALVCKEWIFDRVFNRMDRAVVHGSTFGKNNLAMAAGLATLEVLESGNLIEHSARTGAAIMDALTPLTEKYECFKEVRGKGMMIALEFTEPKSPMLKLSWKMLESANKGLFSQLITVPLFRQHRVLSQVAGHGMNIVKFIPPLILTESDVQWIVTAVSDVVANAHRGPSAVWDFGKTLAFSAL

SEQ ID NO: 19570 - protein, 253 aa, Nitrosomonas europaea
INVFPVRAFRDNYIWIVHNQQFALIIDPGDATPVLTWLRQQKLQPIAILCTHHHHDHTGGISLLVQKFEIPVYGPASEKIPGMTHPLAEGDTLVFPELSLELSILDVPGHTAGHIACHGQNRLFCGDTLFACGCGRIFEGNAQQMFDSLQKLTDLPDETQVYCAHEYTLDNIRFARAIDPDNPELIELESNVEEKREQNMPTLPSSLAAEKATNPFLRCNQPAIIQSASRYAGRQLTDPVSVFAAIRDWKNNF

SEQ ID NO: 19571 - protein, 789 aa, Nitrosomonas europaea
SSPTTIELPIEGMTCAACAARIEKNLNKLPGVHAAVNFANEKALIKFDHDSTHPEELVQSIEKAGFQVPEQTVQLQISGMTCAACANRIETVLNEIPGVRAILNPAAEIAYISFNPAITSVEQLVSAVEKAGYGANQISDDNYVKEQSRNQAAYRKELRIFWISAALTVPFMLEMIMMLTGNHNNLLPYWLQWLLATLIQFWPGRRFYISAWRTLRGGGANMDVLIALGTSMAYLFSTAVIILQLDQHVYFEASAMIITLVLLGKLMETRAKRKTSAAIETLIKLQPKTARVERDGEIIEIDINSLKNEDIFLVRSGESLPADGIVIEGSSSINEAMLTGESQPVTKQVGAKVYAATQNQHGLLKCRVTGVGKNTQLAAIIRLVEIAQGSKAPIQRMADTVSGIFVPIVIGISILTLGLTWWLTGHFVIALINAVAVLVIACPCALGLATPTAIMVGTGRGAQEGILVKNATALELAEKIQMLVVDKTGTLTEGHPSVTDIIVADEVNEHDLLQIAASLEQGSEHPLAKAVSQYASSSKIRLLAITNFASVTGSGIKADIDNASYILGSPKFLAEKGAVLDQQRITALQTEGKTVVGVAIQINESVRVIGYLAIADSLRETSIKAIQRIQNLGIDVMMLTGDNPTTAAAIAKQAGIKIFHAEVSPQNKAAEIEKIKANGQFVGMVGDGINDAPALAAANVSFAIGAGSDIAIEAADITLMRNDLMSVADAISLSRSTLHKIRQNLFFAFFYNILGIPLAAAGMLSPVIAGAAMAMSSVSVITNSLLLKR

SEQ ID NO: 19572 - protein, 219 aa, Nitrosomonas europaea
LSAVLFDVDGTLADTERDGHRIAFNQAFNEFQLDWEWDVDLYGVLLQITGGKERIRFYIENYAPSLLSKNNLDEWIAQIHKTKTNYFLNLLKEGKIPLRPGIKRLLDELRKNNIKIAIATTTTYENVSTLLQCTLGDSALEWFDVIGAGDIVSKKKPAPDIYEWVLNQLNLPAEACIAIEDSENGLKSATAAGIKTIITISEYTREQNFSYAALVLEDL

SEQ ID NO: 19573 - protein, 211 aa, Nitrosomonas europaea
MTSLRTRVRMVERLREQGIKDEVVLAAMGFIPRHLFVEAALASRAYEDVALPINYGQTISSPWIVGRMTELLRNGGSNSLRKILEIGTGCGYQTAVLAKIASEVYSIERIGPLLTRTRIRLRELGILNIHLKHADGMRGLPEAGLFDGIMMTAVIPEIPETLLEQLAMGGRMVFPKGNRKQYLCVIDHTTEGFVETILDEVMFVPILPGTI

SEQ ID NO: 19574 - protein, 549 aa, Nitrosomonas europaea
WEQFVQAAGRVGARLTDFGVRKGDHVGIMAATSLDWEYAQMGALFAGAVVAGIDPEYPADQLNHVIENLGLSVLFVQNRSVFAKIPLELRQQISVFIFFEGESQQKNEFSMINLLVEQETDTSICLPDVLPQDEAVIVFSSGTTGMPKAIIFTHEQVIMAVEAIMRVFNDLSSQTILLCWLPLSNLFQRIVNFCAIKIGASSYILSDPRDLMRYVKQVNPDVLIGVPKVLERVHSGVVDHIEGRVWPLRMLARWAIRIGYKRAAARSDRGDSFGLMNKLLWKQAENMFLRRLRMVFGSRVRYLVSGSAAMPVWLLRWFDAIGLPVYEVYGISENVIPVAVNSSGSRKLGAVGKPLLPNEIKLTMDGEILVRGPGVFKGYQDRKEESNLRFSPDGYWHTGDLGELDTAGFLSIVGRKSDVFKTSAGKWIAPVRIEERLGRIAYVEQSVVFQYESGKIVAVIVVDLEKCAQKTSAVRYSEVSLHMENMAKNKLHQILETDINAELEDLPLYQRPVYVAVTDKFFTVSGGELTVNMKVRRSIVAQRFSAYFE

SEQ ID NO: 19575 - protein, 1356 aa, Nitrosomonas europaea
MSYSFAEKKRIRKSFAKRASILPFPFLLATQIQSYTDFLQAEIAPGKRKNQGLQAAFNSVFPIESHSNNARLDFISYMLGSPVFDVKECQQRGLTYAAPLRARVRLTILDKEASKPTVKEVKEQEVYMGEIPLMTDTGSFVVNGTERVIVSQLHRSPGVFFEHDRGKTHSSGKLLFSARIIPYRGSWLDFEFDPKDYVYFRIDRRRKMPVTTLLKAMGYSPAQILADFFEFDHFILVDNKIFFNLIPERLRGELAGFDIVSEDGKVFVQKDKRITAKHVRDLQQANLTKIPVPEEFLLGKILAADLVDKETGEIIALANSEISETLLGRIRQTQSSEISTLFVNDLNYGPYISQTLRIDETTDQMSAQVAIYRMMRPGEPPTEEAVLALFNGLFYSPERYDLSVVGRMKFNRRVGREELTGSTTLSNDDIIDVIKILVELRNGRGEIDDIDHLGNRRVRSVGELAENQFRAGLARVEKAVKERLSQAESENLMPHDFINAKPVSSAIREFFGSSQLSQFMDQTNPLSEVTHKRRISALGPGGLTRERAGFEVRDVHPTHYGRVCPIETPEGPNIGLINSLALYARTNEYGFIETPYRMVRNGRVTEEVVYLSAIEESQYVIAQANANFDQNGVFTDEVVSCRHKNEFTLASRDQIEYVDIAPAQIVSVAASLIPFLEHDDANRALMGSNMQRQAVPCLRAEKPLVGTGIERVVAVHSGTAVRTIRGGVVDYVDASRIVIRVHDAEARAGEVGVDIYNLTKYTRSNQNTNINQRPIVRMGDVLSRDDVIADGASTDLGELALGQNMLIAFMPWNGLNFEDSILISERVVSDDRFTSIHIEELAAVSRDTKLGTEEITADIPNLSERQRARLDESGIVYIGAEVEAGDVLVGKVTPKSETQLTPEEKLLRAIFGEKASDVKDTSLHVPAGISGTVIDVQIFTREGVDRDKRSKQIIADELGRFKKDLADQMRIVEADAFQRAERLLTGKVAAGGPKKLAKNSTITRDYLENVEKHHWFDIRLVDENTSLQLEQIKDSLVQKRKLFDLAFEEKHRKLSQGDELPPGVQKMVKVYIAVKRRLQSGDKMAGRHGNKGVISKIVPIEDMPYMADGTPVDVVLNPLGVPSRMNIGQVLEVHLGWAAKELGKRVNEMLASQRNVSDIRDFLNKIYNNSGKQEDLTSLEDDEVLALARNLSSGVPFATPVFDGAHESEIKQMLKLAGLPESGQTTLYDGRTGEAFDRPVTVGYMHVLKLHHLVDDKMHARSTGPYSLVTQQPLGGKAQFGGQRFGEMEVWALEAYGASYTLQEMLTVKSDDVNGRTKVYESIVKGDHKIDAGMPESFNVLVKEIRSLGLDIDLEE

SEQ ID NO: 19576 - protein, 366 aa, Nitrosomonas europaea
IRAAVVYQKGGPFQIEDLRLEAPRTDEVLVRIVATGMCHTDMVARDQLYDVPLPVVLGHEGSGIVEQIGDGVRKVAVGNHVVLTYMWCGHCKPCLRGDLTYCEHFYALNFGGVREDGSTSTCLANDTRRPIHDHFFGQSSFGTFALVHERNVIKVPETAPLELLGPLGCGIQTGAGAVINTLKVSPGSSFVAFGGGAVGLSAVMAAHAAGATTIISVDVVPSRLALAMELGATHTINSRETDPVEAVHKIINGGADFTLESSGRPAVLRQAIDALAIRGTCGIVGAPALGTEASFDVNGVMTTGKRIIGIVEGDSKPDLFIPALVELYQQGKFPFDRLVKFYSLDQINQAAEDSEKGITIKPIIRL

SEQ ID NO: 19577 - protein, 636 aa, Nitrosomonas europaea
MPLLTLDNACLAFGHHALLDHAALQLDPGERIGLIGRNGAGKSSLLRVLAGEIKLDDGQLWVAPGMNVAYIPQEPTLDESASVFAEVARGLGTLAQTLLDYHEVSHALGEEGADTKALLDRMQHLQGVLEAQNGWSLHHKVETVINRLELPEDAIAGTLSGGARKRVALARALVVSPNVLLLDEPTNHLDFSSIEWLEETLQNFPGSVIFITHDRRFLDNVATRIIELDRGELKSFAGNFSAYQQKKAELMEVESVHNRKFDKVLDQEEVWIRKGIQARRTRNEGRVRRLEALRLERAARRERIGNVNFRVDAGQHSGQLVAELEHVTKSFGDKTIIQDFSCRIMRGDRIGLLGPNGAGKSTLLKLILGELQPDSGMVRLGTRLSVAYFDQLREQLNEDMTLVDSISQGSEFIEIDGKRRHVISYLEDFLFPPQRARSPVKSLSGGERNRLLLARLFTRPANVLILDEPTNDLDIETLELLETLLQDYTGTLFLVSHDRAFIDNVVTQAIVFEGNGHLREYAGGYQEWLQSRSATKAIRKENSDSPVPVAGLGQIRKDKSSLPAGLSYQETNELAALPGKIDVLEQEQIVVTRKLSDPALYKNNHNEAMELQARAAALEKELSLYYTRWEALEHKQ

SEQ ID NO: 19578 - protein, 285 aa, Nitrosomonas europaea
NQRYLPRQPLPDSIHLVSALSEALERAELVFVVVPVAGLRTTLQQMVALNPSLPLILACKGFETGSAKLPCQVVEEVYPASITCGVLSGPSFAREVAQGLPAALTLASHDEIFARSVAGEIRTASLRVYSGNDVIGVEVGGALKNVIAIAAGISDGIAFGNNARAALITRGLAEITRLGMALGGCRETFTGLTGIGDLILTCTGNLSRNRRVGMMLAAGRQLAEILPEIGHVTEGVYTVREAYGLGQRLQIDMPVTQAVYSILYEQVPVEIAIQDMLDREPGAET

SEQ ID NO: 19579 - protein, 409 aa, Nitrosomonas europaea
MPVNIPPLLPEQLLPIPGLSLGTAEASIKRPGRKDILVITLAENTRVAGVFTRNRFCAAPVTVARSHLTGSLPIRALVINTGNANAGTGQSGIDHAHATCASLARLIGCQTQQVLPFSTGVIMEPLPVEKIITHLPQALANLAPDNWFAAAQAIMTTDIVPKGVSRQIQINGTTVTITGIAKGSGMIHPNMATMLGYIATDAAVTQPLLDDLVRYATDRSFNCVTVDGDTSTNDALILMATGQAGNTPITVSTDPAFISLQAAITEVAALLAQMIVRDGEGATKFITVQVESGKTREECTKVAYAIAHSPLIKTACFASDPNLGRILAAIGYAGIEDLDVNLVQLYLGNILVAEHGGRAASYREEDGQRIMQAPEITIQVKLNRGNASTTVWTCDLSYDYVKINADYRS

SEQ ID NO: 19580 - protein, 332 aa, Nitrosomonas europaea
MMYNLLRPLLFLLDPETAHTVTLDTLNLLKRTGLLPDRTIDCTPVRVMELDFPNPVGLAAGLDKNGTCISALASLGFGFIEVGTITPRPQVGNPRPRLFRIPQAEAIINRMGFNNVGVDKLIENVQQSGYRGILGINIGKNADTPLQNAIDDYLICLRKVYLHASYVTVNISSPNTQQLRQLQNETELEHLLGALKAEQTRLSDLHGRYTPLAIKIAPDLESEQITVIASLLMKHRMDAVIATNTTTAREGVEHLPRGNEKGGLSGAPLTERSTTVIRQLANHLQHAIPIIGAGGIMSARDAQLKIEAGASLVQIYSGLIYRGPDLVTKTVS

SEQ ID NO: 19581 - protein, 653 aa, Nitrosomonas europaea
MATIESILHENRIFPPASEFVRNANLSGREAYETLRQEAEHDYTGFWAKLAQQYIAWHKPFTRVLNDANPPFYKWFDDGELNISWNCLDRHLATQADKTAIIFESDAGEVNHCSYRELHRQVCHFANGLKSLGIRQGDRVVIYMPMRIEAVVAMQACARIGAIHSVVFGGFSAKSVYERIIDAGASAVITADEQIRGGRYHPLKATVDEALAMGDTATVHSVIVFRHTGTGITWQPERDHWWHDLIAGQPDECEPAWINAEHPLFTLYTSGSTGKPKGVQHSSAGYLLGAVTSMQWVFDYHADDVFWCTADVGWVTGHSYVAYGPLAIGATQVIFEGTPTHPHAGRFWEIIQKHRITTFYTAPTAIRSLIKLGSDLPAKYDLSSLRLLGSVGEPINPEAWMWYYTVVGQSRCPVVDTWWQTETGCHMIAPAPGAISTKPGSCTLPLPGIDAAVVDETGHPVEQGKGGFLVIKRPFPSMLRTLWNDPERFRKTYFPTDIAGGRYYLAGDSAHRDQDGYFWIMGRVDDVLNVSGHRLGTMEIESALVAHPLVAEAAVVGKPHEIKGEVVVAFVTLREKLPDDQRAAEIAATLREWVASEIGAIARPEEIRFGENLPKTRSGKIMRRLLRALARGETITQDVSTLENPVILEQLSQ

SEQ ID NO: 19582 - protein, 362 aa, Nitrosomonas europaea
DHHSERAATFPAGCTGVAVASDLALEARQAGLYGLFYPLSHGGKIASLEDYLLVAEQEGRTEFSQAIFASHTALDAHMLSRFGNAIIRQQFLQPMANGEALPCYGMTEPGQSGSIPGLITTTAHLSNGRWHVNGRKWFISNADRATFMTVLARTAGKETALDHALSMIIVPADTPGFRVERQLMMMGHACGQGEVSLADVQVPEHYLIGVCGGGLELMNKRLGLGRLLRAMNWIGLARRCMDLMGGRVHSTRGKLGLLVEKQLVRQHFFNTYQAIAGARELVRIAARGVDAQCPDEIAINVAKMAASRALCIASDSAMQLYGAEGLSDLTPLYGIHRIARTSRILDGNDESLISSVGRRLIS

SEQ ID NO: 19583 - protein, 537 aa, Nitrosomonas europaea
MNHAGIIDLVPAEVRQQWTNDGIYPDKSLFDLFCEHARKNPEKPAVVTLDHTLTYRQLLHKVTRLANSLRHLGVVAGDVIAYQLANSAHHCAIDLAAAALGAIVAPFPPGRGRLDIQSLLQRCDARVIVVEPLFLQQDLCELIESLRPALLSLRILVVDGVARTGWHTLNDLFQSRPIATEELPDVDPDSPARFLISSGTEADPKWIAYSHNALAGGRGRFLQHIHTRDKDFRALYLVPLGTAFGSSATFGVLSWMGGTLIMLPRFDVVATIRAIGQLRPTHVFGVPTMFQRIAADPDLAKIDISSLVAIVSGGAKIDETSILRCCGAFGCSFINLYGSADGVNCHTMLDDNMTTVLHTTGRPNPEVCSIRIVDDRKNELAQGQTGEIAARGPITPMQYVNNPELDALYRDAEGWVYTGDLGFIDEQGNLVLTGRKKEIIIRGGINISPAQIEDIAASHPAVVSAACIPVEDEDLGHRVCLCLVMSEGAERPSLAQFARFLLDRGLEQNKLPEYLRYLRQLPLSPAGKVDKKQLIAE

SEQ ID NO: 19584 - protein, 428 aa, Nitrosomonas europaea [sequence omitted]

SEQ ID NO: 19585 - protein, 589 aa, Nitrosomonas europaea
ADVKVKQRKFDVVIVGAGGAGMRAALQLSEAGFKVAVLSKVFPTRSHTVAAQGGIAASLGNVTEDDWRWHMYDTVKGSDYLGDQDAIEFMCRHAAEVVYELEHFGMPFDRLENGKIYQRPFGGQSLNFGGEQASRSCAVADRTGHAMLHTLYQRNVSANTQFFVEWLGLDLIRDHEGEVLGITALEMETGEIMILQARATLLATGGAGRIFEASTNAFINTGDGLGMVARAGIPLEDMEFWQFHPTGVYGAGILISEAVRGEGGYLVNAEGERFMERYAPHARDLASRDVVSRALITEIRQGRGCGPKEDHLLLKLDHLSAETITSKLPGIREIALKFAHVDPLVDPIPVVPTAHYMMGGIPANYHGQVVAPYKTSPDEVVPGLYAVGECACVSVHGANRLGTNSLLDIVVFGRAAGNQIIKDLTRNNHHKPLPPDAAEQTLTRLDRLETQKDGENVAATSEALRKTMQTHCGVFRFPDVLKEGVEKIGEVAERVRHTEICDKSRVFNTARVEALELDNLIEVAIATMIAAEARHESRGAHTRDDFPERDDQKWLRHSLFFSKDQRLDYKPVRLKPLTVESFPPKARTY

SEQ ID NO: 19586 - protein, 171 aa, Nitrosomonas europaea
IKSRIRTIPHYPHEGIMFRDITTLLKDPAGLRSTIDGIVQRYQTEKIDKVVGIESRGFIIAAPVAYALSAGFVPVRKQGKLPAETIGCDYQLEYGYDKVEIHVDAIDKGDRVLLIDDLIATGGTMEAAIKLVQEAGGEVIECCFVIDLPDIGGSRRLRQQGHRLFSLCSFE

SEQ ID NO: 19587 - protein, 228 aa, Nitrosomonas europaea
  unsure (1)..(228): unsure at all Xaa locations
RLVLLRHGQSIWNQDRHFTGWGDIVLSPQGEQEALRAGHLLKQAGFTFDACFCSELQRASDTLAIVQSVMGLNHLSTYRTWRLNERHYGALEGMRPWAAIRKFGIWSTMKSQIRFDAAPPLLMPDDPRAPVNQPRYAAVDRTQLPLAESMQQTLERVRPLWQETILPEIRQGKRLLIVSHQNLLKTLVMQLEGLTGAQIMRLSITTGHPLCYELDHSLVPVKRYYLXD

SEQ ID NO: 19588 - protein, 441 aa, Nitrosomonas europaea
VTFAQLGLSSEILHAVNDEGYVNPTPIQAQVIPSILAGKDVMASAQTGTGKTAGFTLPLLYRLQAYANTSVSPARHPVRALIMAPTRELAMQIDESVRKYGKYLALRTAVVFGGINIEPQIAALQAGVEILVATPGRLLDLVEQKAVNFSKTEILVLDEADRMLDMGFLPDIKRVMALLSPQRQSLMFSATFSGEIRKLADSLLKQPVRIEAAVQNTVNESISHVIHWVKPDSKFALLLHLIRQQNLKQALIFVKTKHGASHLAQMLSRHEISAVAIHGDRNQQQRTQALAEFKHGDVQILVATDVAARGIDIEKLSHVINYELPGNPEDYVHRIGRTGRAGSKGKAISLVSEHEKELLANIEKLLNAKLETEQIAGFDAEQFARSLPDRKNRMSAGNSRYGNKPMENGSEKSRSEKHRKLPSSQKYSGSRRGGTQKYSDP

SEQ ID NO: 19589 - protein, 425 aa, Nitrosomonas europaea
AVQTNDNPRFVSTLTRNTLALILAGGRGTRLKNLTDWRAKPAVPFGGKFRIIDFTLSNCVNSGVRRIGVVTQYKAQSLIRHIQRGWSFLDGRFQEFIELLPAQQRTEEGTWYQGTADAVFQNLDILRTHNPGYVLILGGDHIYKMDYGRILAEHVERQADLTIACLEVPVEDASAFGVMAVDDSWRTTSFAEKPEHPAPIPGKPGHALISMGIYVFNAKFLYEQLIQDHDMDQSSHDFGKDVIPRLVASNARVYAHRFQNSCVNMASGVPYWRDVGTVDAYWKANIDLTTITPDLNLYDEDWPIWTHQEQLPPAKFVFDDDDRRGQALDSMVSGGCIISGATVRRSLLFSNVQIRGYSTIEDSVILPNVSIDRHAYLKRVVVEKECQIPEGLKVGFNPDEDRKHFYVTDDGITLITPEMLGQGIH

SEQ ID NO: 19590 - protein, 726 aa, Nitrosomonas europaea
PGSSEDSAQSLLLTARLYDPCSFLGMHAAPNGRLIRVFQPYMSRVWLHTLSGYQPMRSVHQDGIFEWEGEGVMHPYLLRMENTATGVIEERHDPYAFPMQISGHDLYLFNEGRLLQAYHMLGAHRVRNHGVTGTRFAVWAPNAERVSVVGDFNRWDGRVYPMMVHGHSGVWELFIPDLPEGAIYKYEIRNRISGEILLKTDPYATTYELRPNNAALTPIEQKYDWKDDDWIARRKGWDWLHAPLNIYELHVGSWKRHPDGRFYSYHELADHLIPYLQDMGYSHVELLPISEHPLDESWGYQATGYFAVTSRYGSPEAFMSFVDRCHQAGIGVILDWVPAHFPQDSFSLARFDGTALYEHEDPRLGYHHDWGTYIFNYGRNEVKSFLLSSAHYWLSAFHIDGLRVDAVASMLYLNYSRKEGEWLPNRYGGHENLEAIEFLRALNTMVHGEFPGALTFAEESTSWPAVSRPAYLGGLGFSMKWNMGWMNDTLSYMQHDPVHRRYHHNELTFNQLYAYTENFVLPLSHDEVVHGKKSMLDKMPGDGWQKFANLRLLFTYQMTCPGKKINFMGNELGQGHEWRVGHELDWYLLERDPHRGIQALTRDLNHLYLNTPALHELDFFAEGFSWIDCHDVEQSVISYQRHARDGSFVLVVLNFTPILRTGYRVGIPGSSAYQEVFNSDSIYYDGSNAGNAGKISPTGQPWSGQPDSIIITLPPLAGVILKAADG

SEQ ID NO: 19591 - protein, 730 aa, Nitrosomonas europaea
LHMAFVESRQKRHEFITVEHLLLALLDNPSAAKVLVACTVDIEDLRKSLQDHIARHTPVVEGSEDVDTQPTLGFQRVIQRAILHVQSSGKKEVTGANVLVAIFGEKDSHAVYFLQQRGVTRLDVVNYISHKIGKAAQSSESEKNEENADGEQQDSGSTLENYTVNLNSQAIANRIDPLIGREKEVERVIQTLCRRRKNNPLLVGEAGVGKTAIAEGLARRITENRVPDVLANHQVYALDMGALLAGTKYRGDFEQRLKVVLKQLTDNPKAILFIDEIHTLIGAGAASGGTLDASNLLKPALSSGRLKCIGATTYNEYRGVFEKDHALSRRFQKIDVSEPDIGETVEILRGLKSRYEKHHNVKYTEVALTAAAELSARFINDRHLPDKAIDVIDEAGAAQRILPKSRQRKIIGRQEIEQVIAGIARIPPQNVSSDDRNKLKTLDRDLKAIVFGQDAAIDALTSAIKMARSGLGNTCKPIGSFLFSGPTGVGKTEVARQLAYTLGIPLHRFDMSEYMERHAVSRLIGAPPGYVGFDQGGLLTETIIKQPHAVLLFDEIEKAHPDIFNVMLQIMDYGTLTDNSGRKADFRNVIIVMTTNAGADVLTRTSIGFTEHTKSGDEMVEIKRLFTPEFRNRLDAIISFTSLTEDIILRVVDKFLIELETQLQEKKVDVTFTDNLRKYLARHGFDPLMGARPMARLIQDIIRRALADELLFGHLANGGKVTVDIDEDGK

SEQ ID NO: 19592 - protein, 597 aa, Nitrosomonas europaea
IKLLPDGLISQIAAGEVIERPASVLKELLENAIDAGTTDISVNIAQGGLKLIRVTDNGGGISGEELPLALTRHATSKIASQEDLYRITSLGFRGEGLASIASVSNLLLISHQPGGKHAWQIRSEGIRVMQPEPSSHAAGTTVEVRDLFFNLPARRKFLKTEATEFAHCEEIIRRMALSHAGIAFTLRHNGNLRGHWQSAEAAVRIKTVLGEEFTRSAAWIDERSAGIGLQGMLALPAYSRAARDMQYFFVNGRFVRDKLITHALREAYRDVLHLDRHAAFVLYLDIDPEQVDVNVHPTKTEIRFREARAIHQFIYHGVSKALSLPRSGTELSQSSSQLMADDIVPPAEKRVPAAPMLNYPRQTGLPSEMIAQPFNFYQVLSGSESDSTATQNPFRQTGAGESNEHPALPPLGFALGQLHGVYILAQNWKGLVIVDMHAAHERIVYEQLKLQMDEQTLSAQRLLIPVTFHADSLDIATAEENQSLLQQLGFEVTVLTATTLAVRAVPAILQDADTEKLVCNVLDEIRNGDPGQLLAARRNELLATMACHGAVRANRPLTLIEMNELLRKMEVTERSDQCNHGRPTWFEISLAELDKMF

SEQ ID NO: 19593 - protein, 291 aa, Nitrosomonas europaea
MAILIDRHTRVMTQGITGKTGQFHTRQCREYAYGRDCFVAGVNPKKAGEELESIPVFATVEEAKQKTGATVSVIYVPPAYASAAIDEAVEAGLDLVVCITEGIPVRDMLRTRARMRGKKTLLIGPNCPGIITPGELKIGIMPGAIHQQGRIGVVSRSGTLTYEAVAQLSELGLGQSTCIGIGGDPINGLKHIDVLKLFNEDSETDAVLMVGEIGGTDEEECARWVKEHMKKPVVGFIAGVTAPPGKRMGHAGAIIAGGKGTAQEKIEVMEACGIRVTRNPAEMGKLLKSVI

SEQ ID NO: 19594 - protein, 382 aa, Nitrosomonas europaea
MKIHEYQAKAILSRYGVSVPAGVACFSVEEAVLAAEKLGGNKWVVKAQIYAGGRGKGGGVKLAKSIAEVRQFAEAMLFAPLVTHQTGPQGRIVHRLYIEQGVDIRHEYYLALVVDRTSQCVSLIASDAGGMDIEQVAAGSPEKIHKIQIDPLAGLNLRDAERIVREIDLPESCQSAAITMLDALYRAFDENDASLLEINPLIVTPDNRLIALDAKMNFDDNALFRHPEIVALRDLDEDDPLEAEASQHGLSYIPLDGDIACLVNGAGLAMATMDIIKLYGGNPANFLDVGGGATVEKVTEAFKLMLRNPGLQAILVNIFGGIMRCDVIAEGVVSAAREVKLTVPLIVRLEGTNVELGKKILADSGLTIISAGNMADAARKAV

SEQ ID NO: 19595 - protein, 171 aa, Nitrosomonas europaea
RFNMVEQQIRTWNVLNQDILDLLYQVKREEFVPAAYRFMAFVDMEIPLEHGAVMLTPKMEARILQELHIRKTDKILEVGTGTGYMTALLSKLGTHVFSVEIVPELHTMAHINLQTHDITNVTLELGDAARGWPGHGPYDVIVLTASTPVLPEAFQQNLAPGGRLFAIIGEE

SEQ ID NO: 19596 - protein, 769 aa, Nitrosomonas europaea
SSELDLPLLPLRDVVVFPHMVIPLFVGRPKSIKALEVATEAGTNILLVAQKSAAKDDPAPQDLYRVCCVSSILQMLKLPDGTVKVLVEGNYRAKIESFSDSETSFSGKTIQVRIEETDTPEIEALRRALLSQFDQYVKLNKKIPSEILASLTGIDEAGRLADTIAAYLPLRLEQKQEILEIFDVQPRLERLLGLLEAELDILQVEKRIRGRVKRQMEKSQRDYYLNEQVKAIQKELGEGEDGADLEEIERKIKTASLPKEALAKAESELKKLRLMSPMSAEATVVRNYIDTLVALPWKQKTKISKELKQAESILDEDHYGLERVKERIVEYLAVQQRVAKSKAPILCLVGPPGVGKTSLGRSIAHATNRKFIRMSLGGMRDEAEIRGHRRTYIGSMPGKILQSMTKVGVKNPLFLLDEVDKMGMDFRGDPSSALLEVLDPEQNSTFVDHYIEVEYDLSDVMFVATANTLNIPPALLDRMEVIRLSGYTEDEKLNIAKRYLLPKQMKDHGLNEDELSISESALRDIVRYYTREAGVRSMEREVSKICRKVVKTLLVKKSKEKIIINSRNLSKYLGVRRYTYGMADEKNQVGQVTGLAWTEVGGELLRIEAVVLPGKGKTITTGKLGEVMQESIQAALSVVRSRSRILGISDDFYLKNDIHIHLPEGATPKDGPSAGIGICLAMVSALAGIPVRASVAMTGEITLRGEILPIGGLKEKLLAAHRGGISTVLIPEDNMKDLSEIPGNIKSKLNIKPVKWIDQVLEIALEYKP

SEQ ID NO: 19597 - protein, 239 aa, Nitrosomonas europaea
RNMLADRVILVTGAGQGIGRAAALAYAEQGATVILHGRKTEKLEQVYDEIEALGRASAIILPFDYEQATEAGITELVEAIASQLGRLDGILHNAAWTYGPMPLAFHTSAHWQTIIQVNLLIPAMLTRACFPLLNASPDASVIMTGDTHGQTPAAYWGAFAVAKAGVEVLVKIQAEEWEIYPNLRINTLIPGAVDTPQRTKTHPGSNNRILPKPTDLMETYLFLMGPNSAGITGKTFDCQ

SEQ ID NO: 19598 - protein, 615 aa, Nitrosomonas europaea
MCGIVGAIAKNDVVPFLLEGLSRLEYRGYDSAGIVVADGMLHRLRTTGRVSELSKLVDSGKTSGLTGIAHTRWATHGVPSERNAHPHFSGDQKKIAVVHNGIIENHETLRQRLQQDGFEFLSDTDTEVIAHLISSYLCKTNDLLEAVCRSLDELQGAYAIAVMEESRQDRIIVARNGAPLLLGIDDDGIYAASDASALVQVTQRIVYLEEGDVAELSSDGYRILNCLDSVNGYEVTRKITESSLTRDAVELGPYSHFMQKEIFEQPVAVANTLEMVLNAQSVSPQLFGSEAQSILAQTQGVLILACGTSYHAGLVAKYWLETIARLPCNVEIASEYRYRDPIADPTTLVVGISQSGETADTLAALSYAKSLGHRYSLAICNVPESALIRQTDLRFLTRAGPEIGVASTKAFTTQLAALLLFTAVLTKIRDQLSTGDEQKMIAALRHLPVAIQHALQCEPEIRKWAGDFSQKHHALFLGRGVHYPIALEGALKLKEISYIHAEAYAAGELKHGPLALVDSGMPVVAIAPNDALLEKLKSNLHEVRARGGELYVFADADSRIEESEGVHIIRLAEHSGVLSPILHTIPLQLLAYHVALQKGTDVDKPRNLAKSVTVE

SEQ ID NO: 19599 - protein, 294 aa, Nitrosomonas europaea
MPSSREIRNKIKSVKNTQKITRAMEMVAASKMRKAQDRMKKARPYGEKIRNVAAHMSNASVEYRHPFLISRDSVKRVGIIVVTSDKGLCGGLNTNVLRRALNEIRTWETEGNHVDACCIGNKGLGFMSRLGTQVISQVTGLGDAPNMERLIGAVKVVLDAYTEGQLDRVYIFYNRFINTMKQMPVMEQLLPLTDDRISSEDGEARPTRAPWDYIYEPEAKPVIDDIMVRYIEALVYQAVAENMASEQSARMVAMKAASDNAGNLIDELTLIYNKSRQAAITKELSEIVGGAAAV

SEQ ID NO: 19600 - protein, 512 aa, Nitrosomonas europaea
QLNPSEISELIKSKIEGLSVTSEFRTQGTIVSLTDGIVRVHGLSDVMQGEMLEFPGGTFGLALNLERDSVGAVILGAYEHLKEGDIVKCTSRILEVPVGEALLGRVVNALGQPIDGKGPIAAEGTEPIEKIAPGVVWRKSVDQPVQTGLKSIDSMVPVGRGQRELIIGDRQTGKTAVAIDAIINQKGEDVICIYVAIGQKASSIANVVRKLEEVGAMAYTIVVVASASESAAMQYIAPYSGCTMGEYFRDKGQDALIVYDDLTKQAWAYRQISLLLRRPPGREAYPGDVFYLHSRLLERAARVNADYVEKATGGKVKGKTGSLTALPIIETQAGDVTAFVPTNVISITDGQIFLESDLFNAGIRPAINAGISVSRVGGAAQTKVIKKLGGGIRLALAQYRELAAFAQFASDLDEATRKQLERGKMATELMKQSQYATLKVSEMALTLFALNKGYFDDVDIKRALAFESALKSHIRSHHGAILDKIEASKELDAETEKALEAAIQEFKQNGTY

SEQ ID NO: 19601 - protein, 177 aa, Nitrosomonas europaea
MAEAITIARPYAEAVFKLARESGSLFSWSETLDAVNSIVRESQIRELISNPLISSVKLREIIFSVCGKKLNEDGKRLVSLLIDNQRLLVMPQIHELFEQLKAQHESILEAEVVSAFPLDSGQLEKLVSILEAKFQRKVKAEVSVDSELIGGVRIKIGDQVVDSSVHGKLEAMATALK

SEQ ID NO: 19602 - protein, 378 aa, Nitrosomonas europaea
VSHVMNTYARLPVTFVKGEGVWLWDDQGNRYLDALSGIAVCGVGHCHPVLVKALCEQVSTLIHTSNVYHIQHQERLADRLTSLSGLEKAFFCNSGAEANEAAIKLARLYGHNQGINLPTIIVMERSFHGRTMATLTATGNRKTQAGFEPLLTGFVRVPYDDLEAVNKVAANNREIVAILLETYQGEGGVNFPQANYLQGLRRICDQNGWLLMLDEVQCGLGRTGKWFAFQHSEVMPDAMTLAKGLGSGVPIGACLAGGKAAEVFKPGNHASTFGGNPLACRAALTTLDIIEQEGLMDNAVTIGNFMWEEFGRRLQAWQDVLKIRGQGMMIGIELPVPCSELVPEALKRRVLVNVTSEKVVRLLPALNMQKAEAEQVVT

SEQ ID NO: 19603 - protein, 300 aa, Nitrosomonas europaea
MQIRHFLQFKDFDRQEYEYLFDRTRWIKNEFKQYRRYWPLTDRTLAMIFEKHSTRTRLSFEAGMHQLGGSAIYLSTRDTQLGRGEPVEDAARVISRMVDIITLRTHEHGVIERFAENSRVPVINGLTDEYHPCQILADIFTFMEHRGSIAGKTVAWIGDSNNVCNTWLQAAEVFDFNVHVSTPPGYEVEPERAGLYGTDHYEQFVSPHDAVKDADLVTTDVWTSMGFEDEADTRKNDFADFRVDAEMMACAKEEALFMHCLPAHRGEEVDAEVIDGPQSVVWDEAENRLHTQKALMEYLL

SEQ ID NO: 19604 - protein, 395 aa, Nitrosomonas europaea
KKAVLAFSGGLDTSVILKWLQDTYQCEVVTFTADIGQGEEIEPARAKAVQFGIREIFIEDLREEFVRDYVFPMFRANTIYEGEYLLGTSIARPLIAKRQVEIAQQTGADAVSHGATGKGNDQVRFELGYYALQPDIRVIAPWREWDLTSREKLLTYAEKQGIPIEMKQKAGSPYSMDANLLHISYEGRALEDPAAEPEESMWRWTVSPETAPSEPEYLDLEYERGDIVALNGERLSPAAILTRLNQLGGKHGIGRLDLVENRYVGMKSRGCYETPGGTIMLRAHRAIESITLDREVAHLKDDLMPRYAALIYNGYWWSPERKLLQVLIDESQVNVNGRVRVKLYKGNVMVVGRDSRTDSLFDPDIATFEEDGGAYHQADAAGFIKLNALRMRIAK

SEQ ID NO: 19605 - protein, 754 aa, Nitrosomonas europaea
TLTHNLGFPRIGAQRELKKALETYWKGQNDVDQLLATARAIRTGNWLLQQKAGIDLIPVGDFSLYDHILDMTTLLGAIPHRFGNTGDKISPDLYFAMARGTADQPAMEMTKWFNTNYHYIVPEFDDTTQFRLASDRLFQEIEDAKALGITAKAVLIGPLTYLYLGKEVTPGFQRLDLLPRLLPVYREILQKIASLGVEWVQIDEPILSLDLEQPWRDSFAEAYHTLHDGSCRLLLTTYFGTVDHHLTLLKNLPVDGLHIDVSSAPEQLESFLTEDFSGKTLSLGCIDGRNIWRADLSQKLETLSQAASRFAGELWIAPSCSLLHCPVDLALETKLEPEIKNWLAFSAQKLEEMTTLGRGLNQGRESVEAILTASDEARRSRTESSRIHNPIVHQRVDNLTERDSQRNHPFATRKHLQQQRFNLPLLPTTTIGSFPQTATIRQARAAFRKNELSHLEYLSAMRAEIREMIRKQEEIGLDVLVHGEPERNDMVEYFGEQLWGYAFTENGWVQSYGSRCVKPPILYGDVYRPEAMTVEWIKYAQSQTGKPVKGMLTGPVTMLMWSFVRDDQPRSTTALQLALAIRDEVADLENAGIGMIQIDEPAFREGLPLRKQDWKSYLDWAVKAFRVASSGVKDETQIHTHMCYSEFHDILPAIAELDADVITIETSRSRMELLDAFVKFSYPNEIGPGVYDIHSPRVPDASEMFELLKKASRYIDPTLLWVNPDCGLKTRNWPETQTALQKMVDCAKTLRSAL

SEQ ID NO: 19606 - protein, 419 aa, Nitrosomonas europaea
NQQLFERSRQYIPGGVNSPVRAFKSVGGTPVFFQRGQGAYFWDVEGKSYIDYVGSWGPLILGHAHPDVVRAVQIAAGHGTSFGAPTAAELEIAELLCRLLPSLEMVRLVSSGTEAGMSAIRLARGYTGRNRIIKFEGCYHGHDDALLVKAGSGALTFGHPSSAGVPAETAGHTLVLNYNDVAGVEETFSKMGTEIAAVIVEPVAGNMNLIKATSQFLETLRTLCTKHGSLLILDEVMTGFRVGLECAQGLYGIKPDLTILGKVIGGGLPMAAFGGRRDVMECLAPLGSVYQAGTLSGNPVAVAAGLETLHQIQVPGFFDKLSTMTRKLTEGLTAVAAKHSVAFCAQAVGGMFGLYFRKSPPESFAEVMESDREAFNHFFHAMLKEGVYFAPSAFEAGFVSAAHSNEEIDKTLAVADRIF

SEQ ID NO: 19607 - protein, 420 aa, Nitrosomonas europaea; identical to SEQ ID NO: 19568

SEQ ID NO: 19608 - protein, 289 aa, Nitrosomonas europaea
ALLEVTDLRVLLHTGRQPVRAVDGLSLAIHPGETFALLGESGSGKSITALSIMRLLPDAGEIVHGSVRLNGDELLTLPESAMRKVRGNRIGMIFQEPMLSLNPVMTTGAQIGEVLLQHSGLRGAALQIRILELMRQVGIPDPARRMAEYPFQFSGGMKQRVMIAMALAGKPELLIADEPTTALDVTIQAQVLDLMRGLQQQENMAVLLITHDLGVVAEMAHRVAVMYAGQIIETADRERFFQSPAHPYSHKLFAALPTRKKRDQGLIVIPGNVPALSKVFTGCRFADRC

SEQ ID NO: 19609 - protein, 398 aa, Nitrosomonas europaea
MNPSLENLQLYPFQKLTKLFEDLVPRDSLPTPIGLHIGEPRHSTPEFIRQELINSLEGLAHYPTVLGTDRLRASIATWLTQRYHLSSIDPDTEVIPVNGSREALFSFAQAVIDTDHKAIQPAVVCQNPFYQIYEGAALLAGATPYFLNQLPENNFSADTAQLPDTVWERTQLVYICSPNNPTGKVLTLDEWKHLFDLSDRYGFVIAADECYSEIYFDEGHPPLGALEAAEKLGRSGFPRLVVFSSLSKRSNVPGMRSGFVAGDATILRKFLLYRTYHGSAMNPAVQAASTVAWSDEQHVAENRKLYYEKFTGAMHILGDTLPVSMPDAGFYLWLRTPVSGIEFSRRLYREGNVTVLPGSYLAREAHGMDPGEDFVRIALVAPVVECMEAMERIRDIAR

SEQ ID NO: 19610 - protein, 326 aa, Nitrosomonas europaea
FPQKRMRRNRRDDFSRRLVRENHLRPDDLIYPVFVLDGSNREEKVASMPGVVRQSIDLLLLQAEKCLRLGIPALAIFPVIDASLKNLTADEAYNPDGLVPRTVKELKKRFPELGVITDVALDPYTSHGQDGLIDANGYVLNDETVSVLERQALSHAQAGADVVAPSDMMDGRVAAIRAVLDRDQFIHTRILAYSAKYASSFYGPFRDAVGSSATLGAGNKYTYQMDPANSDEAIWEAGLDIQEGADMIMVKPGMPYLDIVRRVKDELGVPTFVYQVSGEYAMLKAAAMNGWLDEKACVTEALLACKRAGADAILTYFAVEVAGWLQ

SEQ ID NO: 19611 - protein, 510 aa, Nitrosomonas europaea
LYLLLNLGEVIFSRAGASCRIVIAPRLRAQVTSELYAYLQHHSHRFLSNNFAGALASRISETSTSVNMTLWTLVFDFLPIVVTLTVSIILLWYASIPLSLFTLVWALLYLSISYWLARRCRPLAHKSAEARSITVGKVVDAVTNLASVRLFAMLGFERGYLESFLNNEIAASRRWLWSNEKILWFQFLLALTLKVGTLLFALWLWQQNQISVADFVMSVSLSLLIIGEVRNISRRFIDLFEYIGNIANGVGIIVREHEIVDRPGAQPLHITRGCIELRGVTFGYSPDNPVFENLDLRIEGGQRVGLVGYSGSGKSTLLNLILRLYDPQQGSILIDGQDIRDVTQQSLHEQISLIPQDPGLFHRTLLENIRYGRPGATREEIELAARGADAHEFIERMPNQYESLVGERGVKLSGGQRQRISIARVIAKNAPILIMDEATSSLDSITEQAIQNSLAALMKNKTVIVVAHRLSTIAHLDRILVFNRGRIIEDGSHAQLLAVNGAYTQLWSRQ

SEQ ID NO: 19612 - protein, 371 aa, Nitrosomonas europaea
IALPGVIFLEMLKMVVIPLIICSIALGILTSGSPHQLKRMGAFIVPYFIITSFVAVGIGLAITLIIQPGHTVGTSIDTLAAAMTADGGIKTFDDLTVPQRIVNLIPSNFVEAAMQTDMLKVVIGAIFLGVAALTIPREIAKPFEDLCLFGQVAAMKIISWAMALAPYAVFGLMVDAMVRLGFDILTAIGWYMGCVLLGLVIILGLYLFGAAVFGHRPPFEFLRAIRDVQLLAFSTSSSAAVMPLSIRAAEENLGVSEDISRFVIPVGTTINMDGTGLYQAVAAVFLCQIFKVDLSFTEMILLLCTTVGASIGTPATPGVGIAVLATILSGIGVPPAGIGIIFGVDRILDMCRTTINVTGDLTAVVIMDKWM

SEQ ID NO: 19613 - protein, 404 aa, Nitrosomonas europaea
VAFLVQKYGGTSVGSTERIKQVAHRVAEFRAQGHELVVVVSAMSGETNRLISLAKEIQPNPDPRELDVILSTGEQVTIGLLAMALRELGIKAKSYTGPQVSITTDSAHTKARILKIDEDPIRADLAAGYVIIVAGFQGVDETGDITTLGRGGSDTTAVALAAALKADECQIYTDVNGIYTTDPRVVPEARKLDTITFEEMLEMASLGSKVLQIRSVEFAGKYKVKLRVLSSFEEGEGTLITFEEDNKMEQPIISGIAFNRDESKITVVGVPDHPGIAYQILGPVADANIDVDMIIQNVGHDDTTDFSFTVHRNEYARTMDVLKQQVLPHIGAREVIGGDKIAKVSVIGVGMRSYAGIASKMFRVLAEEGINIRMIATSEIKISVVVDEKYMELAVRVLHKAFDL

SEQ ID NO: 19614 - protein, 477 aa, Nitrosomonas europaea
ILAIDQGTTSTRTILFSAELKILAVQQKELKLHYPRKGWVEQNPETIWQDTLEVCRAILERTAGRAEAVAAIGITNQRETTILWDRKTGKPVYPAIVWQDRRTGTVCERLRAQGFEPMVTARTGLLFDPYFSATKIAWILDNVEGVRARAVRGELAFGTIDCYLLWHLTGGRVHATDVTNAARTLLFNIVEQQWDADLLALFDIPAAILPEVRDNAAGFGVTDPALFDREIPVGGMAGDQHAALIGQRCFRPGMVKSTYGTGFCLMNIGPDFRLSRHRLLTTPAYRLNGKMVYAVEGSIFVAGAAIQWLRDGLEFFQDAAASEALARSVPDSNEVYFVPAFTGLGAPYWRPDVRGMISGLSRDTTRAHIIRAALEAQGYQTLDLMAAIEEDGGHQADVVRVDGGLVANGFMCQFLADMLNRPVEVPKVTEATALGAAILAGLAVGLFARLEATEHYWQRDIIYTPVMTEAERKRLYA

SEQ ID NO: 19615 - protein, 184 aa, Nitrosomonas europaea
MNLPNFLTWLRIMAIPLFVGIFYLPTDWMSPATQNLVATIVFAGAALTDWLDGYLARVLNQTSAFGAFLDPVADKLMVAAALIVLVYLDRLDAPVALIIIGREITISALREWMAQIGKSKSVAVSFLGKIKTAAQMVAIPLLLYHDRINDAFDSQTAGTWLIYIAAILTLWSMIYYLRAAIPHV

SEQ ID NO: 19616 - protein, 356 aa, Nitrosomonas europaea
RLKQGYQKPFLLIDSNIIRNKARRFKTSMPRVRPHYAAKANPDPRVLKTLIEEGVGFEIASIAELDLLMSLGVPAAEIFYSNPMKSRAYIEYAAAKGVEWYVLDSIEELRKIVSIKPDAKLYLRIDTPNIGSDWPLAGKFGTHLVDVSEIIDEAVRLKADLAGVTFHVGSQCRNPQNWRVGIERAQTVFASMREAGLKPRLLNLGGGYPVRHVKPIPSIEVIAEVINEAIADLPEDIHVMAEPGRYLVSDSACFVCRVVGTATRNGKRWMYWDAGIFGGIIEVSEGLRYEILTQRNGSLIPWSVAGPTCDSVDVLMHDEMLPEDIQENDFIFIPNAGAYTTSYASNFNGFPLPDVV

SEQ ID NO: 19617 - protein, 368 aa, Nitrosomonas europaea
MKTRAAVAWQAGQPLTIEEVDLAGPRTGEVLVEIKATGICHTDYYTLSGADPEGLFPAILGHEGAGIVVEVGADVKSLRPGDHVIPLYTPECRECKFCLSRKTNLCQAIRATQGRGLMPDGTSRFSLDGKAIMHYMGTSTFSNYIVVPEIALAKIREDAPFDKACYIGCGVTTGIGAVLFTAKVEVGANVAVFGLGGIGLNVIQGARMAGADKIIGIDLNPEREALGRQFGMTHFIDPSQVENVVDAVIQLTDGGADYSFECIGNTTVMRQALECTHKGWGRSIIIGVAKAGAEISTRPFQLVTGRKWEGSAFGGARGRSDVPRIVDWYMDGKISIDPLITHILKLEEINEGFKLMEAGESIRSVVVF

SEQ ID NO: 19618 - protein, 602 aa, Nitrosomonas europaea
AQINFWYVLIAVLSILFIQNLYNQYTRIEPIPYSRFQSLLEQDKVSEVAITDQQIFGKLKESTSEKFTEFVTTRVESDLAEMLDKHNVTYTGVVQSTWLRDLLSWIVPMAVFVGIWLFIIRRMNKGMMGSGLMSIGKSRAKVYVEKETKVTFANVAGVDEAKEELVEIVNFLKNPKEYSRLGGRAPKGILLVGPPGTGKTLLARAVAGEAGVPFFSISGSEFVEMFVGVGAARVRDLFEQARQMAPAIIFIDELDSLGRARGAGGFGGHDEKEQTLNQLLAELDGFDPSSGIVLLAATNRPEILDAALLRAGRFDRQVLVDRPDKKGRQQILGVHIGKITLAPDVDTEQIAALTPGFTGADLANLINEAALLATRRGGQAVSMDDFNNAIERIVAGLEKKNRLLNPEERRTVAYHELGHTMVALALPGSDEVHKVSIIPRGIGALGYTIQRPTEDRFLMTRKELENKMAVLLGGRAAERLVFDEISTGASDDLARATDIARAMVLRYGMSEAIGNVVYDREQMAFLQPGFPMPQSRDYSEETANKIDQTVRSLLDLALERAIKILDKNRELLDRTAQQLLETETLNQPELLELKRNLRAEET

SEQ ID NO: 19619 - protein, 439 aa, Nitrosomonas europaea
  unsure (1)..(439): unsure at all Xaa locations
NSVMKPIYVGLLGVGTVAAALIPFXNATSRKSLAEPVRNIVIRMIADLDQEKVRHLTAGDDVIVTSDALEVARHPEIDIVIELMGGQTIAKQAILEAIAHGKHVITANKALLAIHGNEIFAAAQQRNVIVAFEAAVAGGIPIIKALREGLAANHIEWIAGIINGTSNFILSEMRSKGLDFTTVLAEAQQLGYAEADPTYDIEGIDAAHKITIMSALAFGIPVRFDQTYIEGITKLANDDIRYAEELGYRIKLLGITRRTANGIELRVHPALIPVKRLIANVEGVMNAIIVKGDAVGPTLYYGAGAGAEPTASAVIADLVDVTRLLTSGPEHRVPVLAFLPELLSDTPIVPMEAVETAYYLRLQVLDKPGVLADITRILADNHISINAMIQKEHADKEDKVNIIMLLHKTREKNVNTAIEKIQNLPAMTDKIIRIRLEEL

SEQ ID NO: 19620 - protein, 229 aa, Nitrosomonas europaea
FSISRYDPDKDEKPYMQDYDVELEPTDKMLLDALIRIKTIDDSLSLRRSCREGVCGSDAMNINGRNGLACITPLAGLREPVEIRPLPGLPIIRDLIVDMSQFFKQYHSIKPYLVNNDPPPETERLQSPEERARLDGLYECILCACCTTSCPSFWWNPDKFVGPAGLLQAYRFLADSRDQATSERLDDLEDPYRLFRCHSIMNCVDACPKGLNPTAAIESIKIMMLNKTV

SEQ ID NO: 19621 - protein, 412 aa, Nitrosomonas europaea
GKQEIELPIVSGNEGPDVVDIRSLYAQSGMFTYDPGFVSTASCKSAITFIDGDKGVLLYRGYPIEQLATRCDFMEVSYLLLNGELPTPDQKAKFVDNIKNHTMLHEQLIKFLSGFRRDAHPMAVMVGVVGALSAFYHDAMDVSDAQHREQSAFRLIAKLPTITAIAYKYNIGQPFIYPHNDLGFTENFLHMMFATPAEQYTPNPVIVRALDRILILHADHEQNASTSTVRLAGSSGANPFACISAGITCLWGPAHGGANEACLNMLEQIGDVSRINEYIARAKDKNDPFRLMGFGHRVYKNFDPRATLMRETCHEVLDELGLHNDRLFKLALELEKIALEDDYFITKKLYPNVDFYSGIVQRALGIPTSMFTAIFATARTVGWVAQWNEMISDPEQKIGRPRQLYVGAPRRD

SEQ ID NO: 19622 - protein, 946 aa, Nitrosomonas europaea
KQLLEDSKLFGNNAAFIEMLYERYLEDPFAVSDQWRQYFDSLQPTETISVRDIPHTPVVESLVRSATLHKPPLSGTPSKQAIEQPSDTETQERKQVAVLQLINAYRFLGVRRANLDPLDLQQKQDILELDPGFHGLTDTDMDKVFNTGSLVGPEHATLQEILHRLQQTYCGSIGAEYMYIADTKQKRWIQNRLESINAQPGFTPEYKRHILERLTAAEGLEKYLHNRYVGQKRFSGEGNESLIPMLDKLLQHAGISGVQEIVMGMAHRGRLNVLVNTLGKMPSELFQEFEGKHPQALTSGDVKYHQGFSSAVMTSGGIMRLALAFNPSHLEIVNPVVEGSVRARQHRFGDKNGDHVIPVLIHGDAAFAGQGVVMETLNLSQTRGYGTGGTIHIIINNQIGFTTSDPRDSRSTLYCTDVVKMIDAPVFHVNGDDPEAVVLATEIAFDFRMQFHRDVVIDLVCFRKQGHNEQDEPMVTQPSMYRVIHQHPGTRKLYADGLIRQGVVDNADVEHMVQSYQDAMDEGRNPNTTICYDYKSPNVANWVPFQASEKWNQPVTTGVPVEDLKYLSERLTTIPATFKLHPRVEKIIQDRRKMGEGSLPLDWGMAENLAYAALLKEGYPVRISGQDCGRGTFFHRHAVLHDQNREQDQWEDGTYIPLRHITPRQPDFVVIDSILSEEAVLGFEYGYATAQPNELVIWEAQFGDFANGAQVVIDQFIASGEAKWGRLCGLVLLLPHGYEGQGPEHSSARLERYLQLCAEYNIQVCVPSTPAQIFHLLRRQIIRPIRKPLIVMSPKSMLRHKEAVSSLEELANGRFQPILPETEAFEIEKVKRLIVCSGKIYYELTAYRREHHITNMAIIRLEQLYPFPHEDFQAEINRYDHATEILWCQEEPGNQGAWHRIQHYLLRHMRPDQILGYALRPSSASPSVGYLAMDRFRQKELIEAAF

SEQ ID NO: 19623 - protein, 423 aa, Nitrosomonas europaea
LIEVKVPALSESVAEATLINWHKQPGEYVERGENLIDIETDKVVLELPAPQSGILAEIIRNDGATVTSGEIIARIDTAAKETKTAAQQPAPIDSGHLEITESTVASMHPAQPLMPSAKKAAEENGLTMEEIAAIHGTGRGGRITRQDVLAHVRNKNSAVTDQQSDSRTDQSAAGIPQADTSPIPVDQTEKPDRLEKRVPMTRLRMRIAERLVQSQSTAAILTTFNEVNMQAIMDLRARYKDSFEKEHGIKLGFTSFFVKAVVAALKKFPIINASVDGNDIIYHDYYDIGIAVASPRGLVVPIIRDADKLTFAGIEKQIADLARRAQEGKLTLEELTGGTFSITNGGVFGSMLSTPIINPPQSAILGIHATKQRPVVENGQIVIRPINYLALSYDHRIIDGREAVLSLVAIKEALEYPVSPLFE

SEQ ID NO: 19624 - protein, 291 aa, Nitrosomonas europaea
AIEVRQLSKRYGKLVALDNIDLVVQPGEFFALLGPNGAGKTTLISILAGLTRASQGSARVMGYDVLSGYREARKRLGVVPQELVYDPFFTVREMLVIQSGYFGIRCNDAWIDEILQHLDLADKAHTNVRALSGGMKRRLLIAQALVHKPPVIILDEPTAGVDVDLRQSLWQFIRQLNLEGHTVVLTTHYLEEAEALCNRVAVLKQGRIAALDSMHNLVRSTRDYTLELRLSTDTLPSGLGTWPGGHDGCLHNLKIKNYTEIEKILSVLRQSGIEVLDMRLLQPDLETVFMK

SEQ ID NO: 19625 - protein, 857 aa, Nitrosomonas europaea
MRFDKFTTKFQQALADAQSMALGQDHPYIEPQHLLLALMQQDDGSITSLLQRAGVNAQPLRQALTQSLKLLPKVEGTGGEINVSRDLANLLNLTDKEAQKRGDQYIASEMFLLAALEDKGETGRLLKQYGATRAALEQAVDSVRGGEKVTDAEAEGSREALKKYTLDLTERARSGKLDPVIGRDDEIRRTIQVLQRRTKNNPVLIGEPGVGKTAIVEGLAQRIVNGEVPETLKNKRVLSLDMAALLAGAKYRGEFEERLKAVLKELAQDEGRTIVFIDELHTMVGAGKAEGAMDAGNMLKPALARGELHCVGATTLDEYRKYVEKDAALERRFQKVLVDEPGVEATIAILRGLQEKYELHHGVEITDPAIVAAAELSHRYITDRFLPDKAIDLIDEAAARIRMEQDSKPEVMDKLDRRLIQLKIEREAVRKEKDDASKKRLALLEEEISKLEREYADLDEILKAEKSRAKGSQEIKEELDKLRREEEAARRKGDLQRASELLYGRIPQLEAQLAEQLHHAESAEEAVQPKLFRTQVGAEEIAEVVSRATGIPVSKMMQGEREKLLFMEDKLHERVIGQDEAVRLVSDAIRRSRSGLADPNRPYGSFLFLGPTGVGKTELCKALAGFLFDSEEHLIRVDMSEFMEKHSVARLIGAPPGYVGYEEGGYLTEQVRRKPYSVILLDEVEKAHPDVFNVLLQVLDDGRMTDGQGRTVDFKNTVIVMTSNLGSQMIQQMSGDDYQVIKLAVMGEVKTYFRPEFINRIDEVVVFHALGEAHIKSIARIQLSNLGKRLAQMEMKLVVSEPALTKLAEVGFDPVFGARPLKRAIQAQIENPLAKELLEGHFSAGDTILVEYSNGHM

SEQ ID NO: 19626 - protein, 290 aa, Nitrosomonas europaea
MFTGSLVAIVTPMLEDGALDLDRFCALIDFHIEQKTDGIVVVGTTGESPTVDFDEHHLLIRTAVTHAAGRIPVIAGTGANSTREAIELTVFSKNAGADACLSVAPYYNKPTQEGLYQHFKAIAEAVDIPMILYNVPGRTVVDISNDTALRLAQIPGIVGIKDATGNIARGCDLLQRVPDNFAVYSGDDATALALLLLGGHGTISVTANVAPRLMHEMCTAAFAGDLARAREINTRLFRLHIDLFVEANPIPVKWAVARMGLINDSLRLPLTALSSQYHELIRKAMLQAGI

SEQ ID NO: 19627 - protein, 683 aa, Nitrosomonas europaea
AESLLLAARQLGLQTSPECVRGAASWVGCDDPNAAVLDIAAQAGLSAKFVEISLTRLSPIMLPALLELDDGQIGLLIDIDAGRATILLTLEGKVLERLLPIDNHPRLLLLVHERTAPRKDRVNDYLVTTTDHWLRDIFISHWKTLFELCAGSLFSNLLAICTALFAMQVWDRVIPARSINTLWVLASGVAMALLLELMLRMMRVTIADHFGKNADIKLSSMFFARVLDIRNDARPRSPGSLIAQLRDLEQLRELLTSSALGVLIDLPFVFAFLLIIWVLGGWLVLVPLAAIPLLVLPGVLAQYPLAKLSKEGMAEAALRNAILMESIYRIEDIKTLQAEPRFRQLWDQTNFINADISLKQRYLSGLLMNLSQTVQQLAYAGVLIEGVYAILDTDLSFGAVMACSILTSRTIAPLSQIPAVLSRLQNARVGKDGLDKLLELPIDHPVDKNTYHKPVLLGRYEFENVSYSFDPQEKPVLTIPCLSIRPGERIAILGRVGAGKSTLLRVLAGLAIPQQGRVLFNDTPISMIDVADVRRDIGTVLQEASLFYGSLRENLLLANPLATDEELLAAMRLSCADQLLLKQPHGLDLLLRENGFGLSGGQKQSLILARTFLRTPNVLLLDEPTASLDENTERNIIENMRQWLGGRTLIVATHRYPLLSLVDRIIVIDSGRIVRDGPREEIL

SEQ ID NO: 19628 - protein, 138 aa, Nitrosomonas europaea
MAVERTLSIIKPDAVAKNVIGQIYARFEAAGLKVVAARMAHLSRVEAENFYAIHRERPFFKDLVEFMISGPVMIQVLEGENAIARNRELMGATDPRKAEKGTIRADFAESIDANAVHGSDAPETAVVEIACFFPSLEI

SEQ ID NO: 19629 - protein, 414 aa, Nitrosomonas europaea
VGLYAQWALAFLPIQHWQTANGAQVYFVENHDLPILDLSIEFPAGSSTDTAETSGRAGLVQRLMSMGAGDLSEDRIAETLADVGARLGGTFDLDRAGLSLRTLSHQQERVRALDVLAQIVQRPEFLEKILERERARIIAALKEADTKPEVIADRTLMKLLYGKHPYGLRESGEPDALAALRRQDLVDFYRAHYTAGNAIIAMIGDIKRDEAARIAEMLTRNLPTGKTYKTLPPVEKPVPIIQKIAHPATQSHIQIAYPGLSRKDPDYFPLLVGNYILGGGGFVSRLMNEIRETRGLAYSVYSTFAPYQEKGPFEIGLQTKKEQAEQALQLTQKTLRDFVEQGPTEEELQAARQNIVGGFPLRIDSNQKILGYLGVIGFYDLPLTYLEDYVKAVEKVTVAQIRDAFKRRIDPAGM

SEQ ID NO: 19630 - protein, 941 aa, Nitrosomonas europaea
NLFNSLSTLSLASGKTVQFYSLPALGAAGLGAISRLPVSIRIVLESILRNYDEKKITETHVRQLAGWQPRAERTQEIPFVVARIVLQDFTGVPLLVDLAAMRSAARRLGKNPELIEPLVPVDLVVDHSIQVDYYGDSQALARNMEVEFQRNQERYQFIKWGMQAFDTFGVVPPGIGIVHQVNLEYLARGVHQKDGLMYPDTLVGTDSHTTMINSIGVVGWGVGGIEAEAGMLGQPVYFLTPDVVGVNLTGRLREGVTATDLVLTVTEMLRRANVVGKFVEFFGEGAASLSLPDRATIANMAPEYGATMGFFPVDDVTLTYFRHTGRTDEEIDAFERYFKAQELFGMPHPGEIDYSQELTLDLNTIVPSLAGPKRPQDRIALKDLKYSFTELFSKSVKENGYGKPAEVLDDTYSTRDSRHVESKLCIAPDTSQSELTLPPGSARNAVEMVNNHPTQQTAVPVSLARPIKLHHGDILIAAITSCTNTSNPSVLIAAGLLAKKAVEKGLSVRKHIKTSLAPGSRVVTEYLGAAGLLPYLEQLGFSLAGYGCTTCIGNSGPLLEVIEETIVKDDLVCAAVLSGNRNFEARVHPSIRANFLASPPLVVAYAIAGTVLKDLTREPLGEGKDGKPVWLQDIWPDSAEIESMMKFATQAETFRRLYSDFTRDHPLWNGITAVTGRLYDWPDSTYIAEPPFFEDFSLEIDRTRTPDAIHGARALAIFGDSVTTDHISPAGAIKESSPAGQYLLAHGVTRMDFNSYGSRRGNHHVMMRGTFANVRIRNLMIPGSEGGVTLYRGKDDPDGKQMSIFDAAMRYIEDGTPVIVFAGKEYGTGSSRDWAAKGTQLLGVKAVVAESYERIHRSNLVGMGVLPLQFKEGDSVSSLGIQGNEKFELPDLGNIQPQQEVTLVIHGQDGSRREIRLRCRIDTAIEVDYYYHGGILPYVLR

SEQ ID NO: 19631 - protein, 283 aa, Nitrosomonas europaea
EKVNILAEALPYIRRFHDKTIVIKYGGNAMIEEALKQGFARDVVLLKLVGMNPVIIHGGGPQIDHMLKRVGKEGVFIQGMRVTDAETMDIVEMVLGGLINKEIVNLINRHGGQAVGLTGKDGMFIRAKRMLIQDKEKAGEWINIGQVGEIEYIDPSLIALLDTRDFIPVIAPIGVGEDGESYNINADLVAGRLAETLKAEKLILMTNTPGVLDKNGNLLTGLTAGRVDELFADGTISGGMLPKIKSALDAVKNGVKSCHIIDGRVQHALLLEILTDEGVGTLI

SEQ ID NO: 19632 - protein, 453 aa, Nitrosomonas europaea
MLPAEFIKSLQNLIPSDRLYFDPVDCYAYAYDNSRKFFPPECVIFPLTTDETAKTVRLCNQFKIPLTPRGRGTGTAGGSLAEQGGATLSLEQMTQIISIDPPNRALVTEPGVLNETIQAAAKPHGFFWPPDPSSAAFSTIGGNLATSAGGPHAVKYGTTRDHVLGLTAVTGKGDIIKTGCYTTKGVVGYDLTRLLIGSEGTLAVITEMTLKLTPLPAAKSGLVAHYQDADSCASAIVSIMKEPQGPSALEFLDSGSLNLIRARNPELLPSDSQAMLMIEVDGTEHEIPETTAKLLAACQNSGLLKAVSVQNTADLWKVRKTLSPLLRDIAPKKINEDIVVPVDKIPRLLAGLSALCKQYQIANVNFGHAGNGNIHVNLLIDPDNPSESERAYKCLDQIFDLVISLNGTLSGEHGIGSEKRPYIGKELNDATLTLMKQIKLTFDPNNILNPGKL

SEQ ID NO: 19633 - protein, 934 aa, Nitrosomonas europaea
IIPEPVTASWLLVADESSATLARHLSNRLQSSGQQVTITSRIDDDLLQNTDHIVHLPGWNDTPDQAADTVTRLMEDVKLLAARIGKTPQFWLVTRGGTLISGCPAESESSPAQSALWGFGRVVMNEYPQLACTLIDLVCNPATVNLADRLVNELLVPDGSNEIVLSAAARYCLVMQEATNQQIRTTEQSEKKDERFHLDFHVPGQLRNLVWLPDVKRQLGDDEVEVCTRATGLNFRDVMYLMGLLPDEAVENGFAGASLGLEFSGIISRVGARVKGLLPGDAVMGFGSSCFASHVITRADAVAPMPENWSFEAAATVPTVFLTVYYALKQLAALQPGERVLIHGAAGGVGIAAIQLARYLGAEIYATAGSDEKRDFVKLLGADHVFDSRSLAFADDILDATAGEGVDVVLNSLAGEAMRRSIDVLKPFGRFLELGKRDFFENTPVGLRPFKNNISYFGIDADQLLTARPRLAVQLFHEVMALFREQALAPLPYRVFSANRITDAFRVMQQARHIGKIVVSLADARPDIEQPLQPVPAIRFERNSTWLVTGGLSGFGLESARWLAERGVDHLVLAGRRGMDTPGAKEIIETFAVQGVKVIAQACDITHAAAVDTLIERIGKTLPPLKGVLHAAAVFDDQLISSLDQKRISNVMDAKLLGAWHLHQATLGTPLDYFILYSSVTTAIGNPGQANYVAANAGLEGLAAMRRHMGLPATCIAWGPVSDTGYLARNQAVRDSLEQRLGKPPLPAAEALTQLDVALNDETGFVIPADFDWNTLSHLLPSASGNRFAILNRNRRSTSQTTESIDIRTFIIGKTRAEVTEIVRGFVVEEVAQILSISPDRIESGRSLHDHGMDSLMAVELALGLERRFGIQLPVMMLNDAPTIHTVTARIVEKLTNKGDMPEGEQSVSQVTEFIRQHGEELMPEEIDILSEDV

SEQ ID NO: 19634 - protein, 409 aa, Nitrosomonas europaea
AAPASAECPTRYSSIPDAFTRFDRFPGYEKMLVPKAASERLGLVNPFFRSHDGVAGATTLIGGREFINFSNYSYLGLAGHPAVSRAAKEAIDRYGTSASASRLVAGERPAQRKLEEALANLYEVDDCIVFVSGHATNVSTIGCLFGPKDLVIHDSLIHNSVLQGIQLSGAARRSFPHNDMAALEQILAEIRAQFERVLIVTEGLYSMDGDIPDLPELIRIKQHHKAFLMVDEAHSLGVLGETGKGVREHFGIQGKAVDIWMGTLSKTLAGCGGYIAGERALVEHLKYAAPGFVYSVGMAPSLAAASLEALRIMQREPERVARLRERGQQFLELMQSLGVNTGLAQGYAVIPAIIGSSLKAARLSNQFFDAGINVQPIIHPAVEEKAARLRFFLSAMHTDQHVRYTCEVM

SEQ ID NO: 19635 - protein, 284 aa, Nitrosomonas europaea
KIRKAVFPVAGLGTRFLPATKASPKEMLPVVDKPLIQYAVEEAWAAGITEMIFVTGRSKRSIEDHFDKAYELESELERRGKTEMLQYVRNLLPDDMKCVYIRQSEALGLGHAVLCAQPAVGDEPFAVLLADDLLEGDPVVIRQMVDVYEYYKCSVLGVQQVPREDTRSYGIVASQPIRDDLEAVQFIVEKPDPEEAPSTMAVVGRYVLTPRIFHHLIRLGKGTGSEIQLTDGIAALMQEEQVLAYRYKGQRYDCGSKIGYLEATLAMARKHPEVGAQFEQLLQS

SEQ ID NO: 19636 - protein, 403 aa, Nitrosomonas europaea
HVQITYIRSCIVKLSQRVQAIKPSPTLAVTAKAARLKAEGKNIIGLGAGEPDFDTPLHIKDAAITAIRNGFTKYTAVGGTASLKQAIISKFKRENSLEFMPGEILVSSGGKQSFFNLVLATIDPGDEVIIPAPYWVSYPDIVLIAEGKPVFIDTGIEEKFKISPDQLEKAITPRTRMFVVNSPSNPSGSVYSLEELQALGAVLRKYPDILIATDDMYEHILLSGDGFVNILNACPDLKARTVVLNGVSKAYAMTGWRIGYCGGPAAIITAMENIQSQSTSNPNSIAQVAAEAALNGDQSCMVPMIEAFRERNQFLTNALNSIAGIHCLLSEGAFYAFVDVRQAISRLNTQQILQNSSDIAFCNYVLEKAEVAAVPGSAFGCEGYMRLSFATSMDNLQEAVKRI

SEQ ID NO: 19637 - protein, 437 aa, Nitrosomonas europaea
TEFVTWFRSVTPHIHASHGKVFVIAFGGEVVENGKFVELVQDFNLLASLGIQLVLVHGARPQIESRLRANQQEMSYVQGMRVTDAATLQCVKEAVGKVRVEIEALLSMGLPNTPMANAAIRVASGNFVTARPVGVLEGVDLQYTGEVRRINITAILDQLEQGTVVLLSPLGYSPTGEIFNLTLENIAAEVAAALQADKLIFLVDTPGIRQQTESGAVLLPELTVRQGKTLLATMETATDQPDEDTRLYLPWALHACEKGVKRVHLVSRHIDGALLLELFTHSGIGSMITRDPLQIIRQAEIEDIGAILQLIEPLENAGILVRRNRELLEMEIERFTVIEHDNMIIACAALYPFPDDKACELACLAVHPEYRKAGIGRILIDHLEDQAREQGYRRLFALTTRTTHWFVERGFSETTPDQLPRLKQNFYNYQRRSKVFV

SEQ ID NO: 19638 - protein, 442 aa, Nitrosomonas europaea
KFDVVIIGAGSAGLSALREVKKHTDNFILINEGPWGTTCARVGCMPSKLLIEAANAFYRRVSFNEFGITGADQLGVDHKRVLQRVRRLRDDFVTSTLGATRELGERAISGRAHILSPHQVMVNGEKFHTRKIIIATGSRPVVPEPWQSLGKRLFTTDTLFEQEALPERIAVIGMGPVGLEMAQALSRLGVRVTGFGSGRMIGGITDPLINQAAVTLLSKEFSLHLGTRADITVNVDSDVITVNSGDIRIEVDSVLAALGRRPNIDDINLEALGVPLDERGLPPVNPDTLQIADLPVFLAGDVNQRSPVLHEAADDGHIAGLNATREKLVCFKRRVPLTIVFSDPNIAVVGKSFRSLEHEDIRAGEVDFSRQGRARSAQSNRGVLRVYAAANSGRLLGAEMCAPAGEHFAHLLALAIDQSLSVWDLLRLPFYHPVLEEGLRTA

SEQ ID NO: 19639 - protein, 327 aa, Nitrosomonas europaea
VSSPIRIAVTGAAGQISYSLLFRIAAGDMLGSSQPVILQLLDIPESGKVLDGVLMELQDCAFPLLTDIIVTHDPMIAFDQADIAILVGARPRGKGMERKDLLQTNGEIFREQGRALNQVVKRDAKILVVGNPANTNTLITMKNAPDLSPENFSGMLRLDHNRALSQVAMKLNQPVSHIRKMIVWGNHSSTQFPDLSHAEIDHQKVIDLIKDQTWVENSFIPTVQNRGAVVIEARGLSSAASAANAIIDHMRDWIFGTRDDDWITMGILSDGSYKIPKGVIYGFPVVCKNGGRKIVQGLEISPFSRTRLDIAYDELTQELDSIKHLLL

SEQ ID NO: 19640 - protein, 887 aa, Nitrosomonas europaea
MTQMTVEQFAHDLGMLPGLLLEQLQAAGVDKRSAADFVTEQDKTRLLDYLRKSHGSSGPRTRITLARKQTTEIKQSDSTGRPRTIEVKVKKTRVLTRQNEPEVIEKSVSEEPAPLKMVETPEPTIVKSVVDAEQMALRAEEARKRSELIARQAAELKEKQEKRRQQAAAQANVKKEPAPAEQESGPATAVTPGSVTEISSKLPETGAAATPATSTAPATTSTTAATKGHAPQKPVVKPEEKGEKKKKPTKQDAWKDEPVKRREPKARGDLSGGQEWRMRKDKHGKYKSDELQSQHAFSVPTEPVIHEVLIPETISVGALAQKMAVKAAEVIKVLMKMGSMVTINQMLDQETAMVVVEEMGHIAKIAASDNPESFLEEVDVSSDEARMEPRAPVVTVMGHVDHGKTSLLDYIRRTRVAGGEAGGITQHIGAYHVETSRGVITFLDTPGHEAFTAMRARGAKITDIVILVVAADDGVMPQTIEAIHHAKAANIPIVVAVNKMDKPEANFDRIKQELVNHGVVPEDWGGDAMFIGVSAKTGLGIDELLEAVLLQAEVLELKAVREAPAKGVVIESRLDKGRGPVATVLVQSGTLRRGDAVLTGAVFGKIRAMLNERGKSISEASTSIPVEIQGLSEVAVAGEVFIALDDERKAREIALFRQGKFRDVRLDKLQVAKMEDVFGQHEDVSTLNLIIKADVQGSCEALVYALKKLETDEVKINVVHSGVGAIIESDINLALASKAVVIGFNCRADLGARKLITSTGVDVRYYNIIYEAVDEVKKALSGMMMPDRKEKILGMVDIREIYRISKVGVVAGCYVLEGLIKRDALVRLLRDGLVIHSGSLDSLKRFKEDVREVKSGFECGLSLKNFNDIQQGDQIEVYEIVETARVL

SEQ ID NO: 19641 - protein, 715 aa, Nitrosomonas europaea
MEEEKKLFHDTRQPPGHAYLASYLWIREQFSADAIVHFGTHGTQEWTPGKERGLWAYDYPNILVGNLPVIYPYIVDNIGEAIHVKRRGRGVIISHQTPAFSPAGLSDDFVRLNDLIREYQSLDQGLVRDNNRKLIIEQAVRMNIHQDMQWKVADLERNFDNFLRDIEDYLEDLGTAQQPLGLHTLGRDAEQAHQISNVMQMLGQPLYDLLGIEDARTLLREDYRKIQQSEPYRFVETYVFSDQPLNDINDPGLRAMAERGRTFRMNLHAAPEIDSIVKGLSSRWIDPSYGGDPIRNPDALPTGRNMYGFDPGRVPTRAAYEAGGQAVEQLIASYKLTHDKFPEKLAFSMWSTETMRHLGMLEAQIFYAMGVRPVWDEGGRVTGMEVIPLSELGRPRIDTVISLTGLYRDQFPNVMERFNQAITLLAEQDEPDSDNPIRANTRRIRAQLKKLGVTPETAREFALTRIFGNESGDYSTRLTQATLASDKWDEKDGKLENLYLSRMSWAYGPNPAHWSQKLTDGKGNEINAYAEHLRGTSAAVFSRSSNLRGLLDTDHPFEYLGGISMAVRHLDGTSPQLYISNLRDPARARLESAEKFMARELRAVYQHPNWIREMQKEGYSGTLQMLDTINNFWGWQVMDRNITRDDQWEEFHQSYIADRYNLDMRDWFEKSNPAALAQIAERMLEAIRKDYWEASEQTRRELVEVYTDIANRHDI

SEQ ID NO: 19642 - protein, 230 aa, Nitrosomonas europaea
DVTSNSPHPVIEANGLSRHFGDRVAVHDVNLKLHRGDILGFLGPNGAGKSTTMRMLTGNLAPSSGSVHICGTNLLDDPLEAKHHIGYLPEIPPLYKELTVDEYLRFAARLHGLAKTSLQIALDEVKQQCELNDVGKRLIGVLSKGYQQRVAIAQAIIHRPQLIILDEPTVGLDPNQIQKVRALICELGKTHAIILSSHILSEVESVCNRVQIMHQSKLVLDDSLDNLKRQ

SEQ ID NO: 19643 - protein, 486 aa, Nitrosomonas europaea
RLRGALEELGPIFSKLGQVLSTRPDLLPIEYIEELVLLQSRVPPMTESEVVRVSEQELGVPWEDVFKSFDPNPLAAGTIAQVHRATLETGDRVVVKVQRPTARADIEQDLALFEMFAEKVGKRPALNQVINMEDVFKHLSTSLHRELDFRQEANNIERMRTVLADYDRLAVPSIHWDLSTSRLLVMEEIQGIPIKQAPAGPERIQAARQLLESYYKQIIVDGFFHADPHPGNLMWWKDCIYFLDFGMVGAVGADLREHLLLMLMALWQEDAGFLTDVTLMMTNAVNSNDFDVAQFQSEIGEVMAKYRAASLAEMQIGPLLQEMSTVSLRHGVPLPASLTLATKALAQVQLATAELDPTLDPYDVAGKYLMRLMVKRIGAALNPKTFVYQSQKLKVRTLRVIEALENLVGVRPGGPKLVVNFKANSLENIVRHTGRRLALGLTAAASILTSGLTTMSTAVAEWVPVTFGAVAGLLTLGLVIDLLRGR

SEQ ID NO: 19644 - protein, 535 aa, Nitrosomonas europaea
ISYRSSGVDIDAGNRLVERIKPFARRTMRPEALGGIGGFGALFEVPGKYRQPVLVSGTDGVGTKLKLAFQYARHATIGIDLVAMSVNDILVQGAEPLFFLDYFACGKLDVEIATQVVQGIAHGCEDAGCALIGGETAEMPGMYPEGEYDLAGFAVGVVEKDRIIDGSGIRENDIVLGIASSGPHSNGFSLIRKILDLNTVQSDTRLGETSLIDALLTPTRIYVKSLLTLMAELPVKGLAHITGGGLLENIPRVLPDGVMAHIDSSTWVRPSLFDWLQQHGNVAREEMLRVFNCGIGMVVVIAPEHAQTAIEILHNAGETVWQIGEIRPRQSETLPIVHCLKEGAMKSVVILISGRGSNMQAILEAGLPVAAVISNNPAAEGLMFAQTRGIPTQVIDHRTFPDRKAFDAALAETIDTYQPDLVVLAGFMRILSEAFVDHYQGRLVNIHPSLLPAFPGLDTHTRALQEGVKIHGCTVHFVTSQLDHGPIIAQAAIPVLTDDTPTMLATRVLAQEHRIYPQAVRWVSARAIDSGGKPC

SEQ ID NO: 19645 - protein, 291 aa, Nitrosomonas europaea
RNGIIGALTEDLIDTSAESTEAIRALRHTPSGAFGSCRYKLKSLEDNRREYERLIEVFKAHDIGYFFYNGGGDSADTCLKVSQLAGTLGYPIQAIHVPKTVDNDLPITDCCPGFGSVAKYIAVSMLEASFDVASMAKTSTKVFILEVMGRHAGWIAAAGGLASNEDHEVPIIILFPEVTFDQEKFLAKTDHYVKEYGYCTVVVSEGVKGTDGKFLSDQGLRDAFGHAQLGGVAPVIANIVKNGLGLKYHWGVADYLQRAARHIASGTDVEQAYAMGKAAVEYAIAGHNSVM

SEQ ID NO: 19646 - protein, 369 aa, Nitrosomonas europaea
MSQSDYYEVLGVGRDADENELKKAYRKLAMKYHPDRNAGDTKAEERFKNIKEAYEILSDPNKRAAYDQFGHAGLNGGMGGAGAQGFSDAFSDIFSDLFGMRGGGRSSVHRGADLRYNLEITLEQAARGAETQIRIPRQEVCDTCHGSGAKPGTSPKTCPTCNGHGQIRMQQGFFSIQQTCSHCQGSGKVVSDPCGDCHGAGWVKRQKTLSVRIPAGVDEGDSIRLTGEGEAGANGGQAGDLYIVIHLASHPVFQREGNHLHCEIPISFTVAALGGEIEVPTLDGHARIKVPAGTQTGKIFRLRSKGITGVRNQSTGDLLCHVAVETPVDLTARQKELLEEFESISQKDGSRHHPRAKSWMEKAREFFAE

SEQ ID NO: 19647 - protein, 644 aa, Nitrosomonas europaea
MAKIIGIDLGTTNSCVAVMEGNKPKVIENAEGARTTPSIVAYAEDNEILVGASAKRQAVTNPENTLFAIKRLIGRRFDEEVVQKDISVTPYKIVRADNNDAWIEARGRKIAPPEVSAQVLIKMKKTAEDYLGEPVTEAVITVPAYFNDSQRQATKDAGRIAGLEVKRIINEPTAAALAFGLDKKEGDRKIAVYDLGGGTFDISIIEIAEVEGEHQFEVLATNGDTFLGGEDFDSRVIEYLVDEFRKESGIDLKKDMLALQRLKDAAEKAKIELSSSQQTEVNLPYITADASGPKHLAVKITRAKLESLVEELIERTAGPCRTALKDAGLSVSDINDVILVGGQTRMPKVQEKVKEIFGKEPRKDVNPDEAVAIGAAIQGGVLKGDVKDVLLLDVTPLSLGIETLGGVMTKLIQKNTTIPTKAQQVFSTADDNQTAVTIHVLQGEREVASGNKSLGQFNLTDIPSAPRGMPQIEVIFDIDANGILHVSAKDKATGKENKIKIQASSGLSEDEIQKMVKDAEAHAEEDKKALDLVNSRNQCDAMIHSVRKSLAEYGDKLEGDEKSRIEAALKEAEEALKSGDKQTIDAKTQALTEASHKLAEKMYAQEQAQAGQQAGAGTASDQSQDKPVEGEVVDAEFEEVKDKK

SEQ ID NO: 19648 - protein, 407 aa, Nitrosomonas europaea
FEYRDSQLFVESVPLAEIAAKFGTPCYVYSSAAIRTTYQIFDHAFGQRDHLICYAVKANSNLAILNLLARLGSGFDIVSGGELQRVLKAGGDPQKTVFSGVGKTPEEIRAALAANILCFNVESEMELMVLNEIAGQMGKIAPVSLRVNPDVDANTHPYISTGMKENKFGIPAAEAGRIYSLAHQLPHIQVSGLDCHIGSQLTEIAPFIEAADKMLDLLARLQTMGVTIKHLDLGGGLGIRYDRESPPSIEAYIKALCTIAENHPQQLLIEPGRSMVGNAGLLLTRVHYLKHTSHRNFAIVDAAMNDMLRPALYQAYHSILPVTKRTGETKTYQIVGPVCETGDFLGHDRNLALTKNDLLAVMSAGAYGMSMSSNYNTRPRAAEVMVDGSTVHLIRARETVEDLYALE

SEQ ID NO: 19649 - protein, 426 aa, Nitrosomonas europaea
MQWLDLPHVQRAQGNVRLPGSKSISNRILLLSALAEGTTMVSNLLESDDTGRMLDALRLLGVAIVRTDDGKYRVAGCKGKFPVREAELFLGNAGTAFRPLTAVLALMQGHYRLSGVPRMHERPIGDLVDALRQIGAVITCLEHEGFPPLEIHPAVIRPGNISIKGNISSQFLSGLLMALPLTGEPVTIVVSGTLISQPYVALTIAQMARFGVQVKQESWQRFMLPENQTYRSPGKIAVEGDASSASYFLAAGAIAGGPVRIEGAGSDSCQGDIRFVEALEAMGARISMGSDWIESGAPDGGALKAIDFDCNHIPDAAMTLATMALFARGTTTLRNIASWRVKETDRIAAMSAELRKLGARVEAGDDFLRITPPDGPLTADAVIDTYDDHRMAMCFSLVSLSVPVRINDPGCVAKTFPDYFEKFAAI

SEQ ID NO: 19650 - protein, 637 aa, Nitrosomonas europaea
MSKKLIIAEKPSVASDIARALGGFVKQKDYFESDEFVVSSAIGHLLELIVPEEYEVKRGKWSFDHLPVIPPRFDLAPIEKTTDRLKLLSKLIKRKDVDMLINACDAGREGELIFRYIVRHVGSKKPIKRLWLQSMTPSAIREAFANLLNDAEVQSLADAAVSRSEADWLVGINGTRVMTAFNSQEGGFHKTTVGRVQTPTLAILVEREEAIKKFVVRDYWEVHATFQAESGVYKGKWFDEGFSKRKDESESRADRIWDHAKAEVIRDKCAGRTGVVTEESKPSRENCPLLYDLTSLQRDANSRFGFSAKVTLGLAQALYEKHKVLTYPRTDSRALPEDYPAIVKDTLQVLKGSRYDRFASQILESDWVKPNKRIFNNAKVSDHFAIIPTALVPKKLNEAEEKLYDLVTKRFLAIFYPAAEFLITTRITRVENEPFKTEGKVLVHAGWQTVYGKVESAQGQEEESVLVAVTPGETVLAQEVAVVAGKTRPPARYNESTLLSAMEGAGKLVEDEELRAAMSAKGLGTPATRAAIIEGLIHENYVERSGRELQPTAKAFSLVTLLRGLKIPELISPELTGDWEFKLRQIEQGQLKRDVFMEKIAAMTRHIVEQAKNHRDKTISGDFATLQVPCPGCGGVI

SEQ ID NO: 19651 - protein, 134 aa, Nitrosomonas europaea
DHEIQRRTGVGIPVIFEIEGEAGFRKRESEVLRDIVRQQNIVLATGGGAILHPDNRALLRQHGTVVYLCAPVTELRRRTYLDKNRPLLQTGNVHAKLIELFTQRDPLYRETAHIIMDSGRQSARAFVQKLIQKL

SEQ ID NO: 19652 - protein, 346 aa, Nitrosomonas europaea
NRSYSIHIGQGLLSRMDLLLPHLPGKKAAIVTNTTIAPLYLEKLRSALAEHHVETFAITLPDGERYKHWETLNLIFDALLEHRCERRTPLIALGGGVIGDLTGFAAATYLRGVPFIQIPTTLLAQVDSSVGGKTGINHPLGKNMIGAFYQPQLVLTDSATLTTLPDRELRAGIAEIIKYGLIYDADFFDWLEQHMNSLLARDPAAVNYAIRRSCEIKAEIVSLDERESGLRALLNLGHTFGHAIENAMGYGAWLHGEAVAAGTLMAADLSRRLQRITSQEVDRIRYLFENTGLPVKGPRISPERYLESMQLDKKVKEGAIRFILLDSIGKASPGDTVPTPLLLETL

SEQ ID NO: 19653 - protein, 446 aa, Nitrosomonas europaea
ILTKNPASGKLLQTYTPYSEAMVFSMLEHAHAAHLAWRQVPLHERTALLLKLADVLRENSESYARLMTEETGKTIRAARAEIEKCAWACEIYADKAAAWLAEEEIAADGIKHRVVIEPLGVILAVMPWNFPFWQVMRFLIPALLAGNGALLKHATNVTGSALKIQEAVNEAGFPKGLFVTLLVSHTVVEQVIAHPLCQGVSLTGSAEAGRAVASVAGRHLKKVVLELGGSDPFIVLGDADIPAAAKAAVIGRFQNNGQSCIAAKRLIVLKEIEEVFTSTLLAEVEKLVVGDPLDEATDIGPLVSEQAAETMEQFVLDAVAKGAMVRTGGTRKGAYFTPTVLTGVHSAMEVMTQEVFGPVLPVITADTVEEAITLANATRFGLGASVWSRDLEKGEQVARQLAAGATFVNSITKSDPRMPFGGIRESGLGRELSYWGVREFANIKTV

SEQ ID NO: 19654 - protein, 924 aa, Nitrosomonas europaea
  unsure (1)..(924): unsure at all Xaa locations
MSVDISTKPVIRVQNVNLRYGDTLALDALDVEIPAHCMAGLIGPDGVGKSSLMSLLTGARVMQQGQIEVLGGDIADPAHRRVVCPRIAYMPQGLGRNLYHTLSVFENIDFFGQLFGHEQIERHQRIDELLESTGLAPFRDRPAGKLSGGMKQKLGLCCALIHDPDFLVLDEPTTGVDPLSRAQFWELISRLRTQHVNMSVLVSTAYMDEAERFDWLAAMDAGKILATGTAAELRTRTDTDSLEAAFIRLLPAEKRRGYREIIIPPRDIRDDQEIAIEAHDLTMRFGDFVAVDRVNLHISRGEIFGFLGSNGCGKSTTMKMLTGLLPPSEGEAWLFGQVIDAGNLATRKRVGYMSQAFSLYSELTVRQNLELHAKLFHLPDADIPARVTEMAERFLLEAVMDSFPDALPLGMRQRLSLAVAVIHQPDLLILDEPTSGVDPIARDMFWELIIGLARRDQVTIFISTHFMNEAERCDRISLMHAGKILASDTPAALIERSGHSTLEAAFISYLKQASGISDKPVKMPVPSTTQAQATVAPEETHAVMTLNTRFSLLRLFSYTLREALELRRDPIRGSIALFGTVLLMFIMGYGISMDVENLRFAVLDRDQTTLSRNYILDLSGSRYFIEQPPITDYGELDQRMRSGELSLALEIPPNFARDLARGDNVRIGAWIDGAMPTRAENILGYVQAMHQNWLLEQARHHATDHLPAGLMTIETRFRYNPDVKSLPAIVPAVIPMLLMLILAMLSALSVVREKELGSILNLYVTPVTRLEFLLGKQLPYIALGMINFFLLCILAVFVFGVPHKGDFLLLTVAALLYVTAATGLGLLVSAFTRSQIAAIFATSLATIIPSSRFSGMIDPVSSLEGGARLVGEIFPATYFLTISRGTFSKALGFAELGSLLLPLALAIPVITSLAVILLKKQERX

SEQ ID NO: 19655 - protein, 528 aa, Nitrosomonas europaea
  unsure (1)..(528): unsure at all Xaa locations
MSNLFHELIYQSAARYPDSTALIDQKRHLSYAALSEAVQSIASALHTLGLGRGERSAVYLEKRLETVIALFGASAAGGAFVPVNPLLKAEQVAYILKDCNVRILITSAERLDLLSPVLPQCHDLHTVIITGDLHKASLPGLNVVSWRQTQTLSDAARLPDCIDSDMAAILYTSGSTGKPKGVVLSHRNLVTGAISVSRYLNNRPDDRILAVLPLSFDYGLNQLNTAFYTGATAILMNYLLPRDILTTVKQEQVTGLAAVPPLWAQLAQLDWKDAQSLRYITNSGGAMPRATLAHLRSALPDTQIFLMYGLTEAFRSTYLPPGEVDKRPDSMGKAIPNAEVMVLREDGSHCAPGEPGELVHRGPLVSLGYWNDADKTAACFRPLTPRQSGLTIPELAVWSGDTVRMDDEGYLYFIGRRDDMIKTSGYRVSPTEVEEVIYATEKVAEAAAFGVPHPTLGQAIVVVAVPRTGFALDRDVLQSACKQHLPAFMQPALIELRQTSLPRNPNGKIDRKMLAGEFQQAFQAGESX

SEQ ID NO: 19656 - protein, 409 aa, Nitrosomonas europaea
MTHPKHAPMTQFPIRNHCLVIGDLPLTRLAQRIGTTPFYAYDRKLISARIQFLRQHLPAGIHLHYAMKANPMPAVVQHLAGLVDGMDVASVGEMKVALDAGITPENISFAGPGKSRQELICAIAAGIVINVESEYELETIAQLAEETGFQPKVAVRVNPDFELKSSGMKMGGGSKQFGIDAECVPAVLQRIAQLRFDFEGLHIFSGSQNLRVEALREAHEKTLQLGLQLASTSPVPVRAINIGGGFGVPYFPGESPLDLNAVGTNLQRLLAEIPSQFSAIRFVIELGRYIVAEAGIYVCRVLEKKISRGQTFLVTNGGLHHHLAASGNFGQVIRKNYPVAIGNKMKIDETEIVSVVGPLCTPLDLLADRMELSRAEPGDLVVVFQSGAYGLTASPTAFLSHPASLEVLI

SEQ ID NO: 19657 - protein, 1198 aa, Nitrosomonas europaea
  unsure (1)..(1198): unsure at all Xaa locations
GTHVNRERMMHYLKTWLTGEDVSAAAPPIELPDSGIYHPDAEQMVFASLPEYLDWWQQRHNQPWRDNPIIGMETASSYLSDGQTRQLDETIAAIERAEGVPLIFYRASRSRSRSTTRSPEQDEQQGRRSEGKMPGNIRIAVQTIGTADSSGFPNPASQPMDVADEPLIMLDGKTILDVLMVNTFLGINPDERKAWYRSLDIPVINFMQYRNGLCRGXNRYQQLMLPFMLTVAEYIGLQDPVLVTTNEDGELVSMPEQMDLLIGKLINLARLKTLPNAEKNVALLFWNHPPGEHNQGASNLNVPRSITHLTERLRDEGYAFDTVSEDQVIAAVGEMLRPVYRKDSLPELMQTPHWDFLPLVTYREWFATLPEEVRERIDTYWGKAERSPWVVQHEDGTTGFVIPRLKLGRLAVLPQPPRGEIADENEEKLFHDTKIPVNHFYLATYLWIRTQQPAHAIVHFGTHGTQEWTPGKERGLWAFDDPNLLAGNVPVIYPYIVDNIAEAIHVKRRGRGVIVSHQTPPFSPAGLSDDFAQINDAIREYESLDEGLVKENARKQIIDLVIRMNIHQDMSWKVADLERSFPDFLREIEDYLEHLAIAQQPLGLHVLGQDMERAHMISTVMQMLGQPLYEAFGFNNAGEVFTEDYRQIQASAPYHFVDEWVLSDKSLDTLKNKIRVELAECGRVFAATFRTAGEIESVLRALAARWIDPSYGGDPIRNPDALPTGRNMYGFDPSRIPTRAAYEAGKESLEHLILTYQSTHDGQFPDKLAFTLXSTETMRHLSMLEAQILYALGVRPIWDEGGRVTGMEKIPLAELGRPRIDPVISITGLYRDQFPNVMERLNEAIVMLAAEDEPAEQNFVRTNSLRILAEMLARGLSREDAGAIAHTRIFGNESGNYGTGLTDATLASNRWEEGDGKLERQYLSNMSWTYGPSTASWSKKYTDSKNGEVNAYAEHLRGTRATVFSRSSNLRGLLDTDHPFEYLGGISMAVRHLDGAAPQLYISNMRDPNRAQLEAADKFLATELRSVYQHPNWLAEMMKEGYSGTLQVLNTINNFWGWQVMDRNIVRDDQWQSFHEIYINDHYQLGLREWFEHNHPAALAQIVERMLEAIRKDYWQAGEQTIQELITIYIELAQQHDIHTGNETFKAYVQELMTNFGMAALDNKPAESATTTLSDAVPADSAPQVTGETENISGQQMS

SEQ ID NO: 19658 - protein, 284 aa, Nitrosomonas europaea
FGAGVLKKLPDIIESYGNHILLVTGAHSFMNTPYWRLLIDQFEHRAITWRHAMVAEEPSPALIDDFVIDYANEHFAAVIGIGGGSVLDTAKAVAGLLQVQHSVMDYLEGVGPELSYQGPAVPFIAVPTTAGTGSEATKNAVLSVQGENGFKKSFRHDKLVAEYAIVDPDLLASCPPGVIAANGMDALTQLLESYVSLKANALTDALAISGLQAVRDALLPFYHQQGELAQHREKMAYAALLSGITLAQTGLGSVHGLASPLGAFYPIPHGVVCGTLVAAATRIN

SEQ ID NO: 19659 - protein, 886 aa, Nitrosomonas europaea
TAWHALTLPEVRQILHTDSAGLKTDEVNDRFARFGPNSLIPPKRRGPLLRLLLQFHNVLLYIMIAAAAITAVLGHWVDTGVLLAAVIINVIIGFIQEGKAETALDSIRAMLSPHATVIRDGTRYEIDAAGLVPGDLVLLASGDRVPADIRLISVKELQVEEAALTGESLPVRKRIETALPDTLPGDRYGMAFSGTLVVYGQASGIVVATGSATELGKINRLLEDTQHLSTPLLRQIDHFGFKLAVFILAASAATFLLGTLWRNHAPAEMFMMAVALIASAIPEGLPAIMTVTLALGVQRMARRNAIIRRLPAVEALGSVTVICSDKTGTLTRNEMTVQRIVCADHTIDVSGVGYVPTGEYSIDGHTIDPAHYPALTLAIRSGVLCNDALLREKDGLWSVEGDPTEGALLILGAKNGFSNHHANTAWPRRDVIPFESQHSFMATYHHDNENEPWIFVKGAPERILDMCTTQLQQNGKQPIDIDYWQRMVSATAAKGLRLLALACKRSAPQEDSLKINDMKTGFTLLALVGIIDPPREEAVQAVAECHRAGIRVKMITGDHAETARAVGAQLAIGAGRPVLTGMEIAAMDDDTLRDIVMDVDIFARTSPEHKLRLVKALQAGGQVVAMTGDGVNDAPALKRADVGVAMGMKGTEAAKEASDMVLADDNFATIAYAVREGRVVYDNLKKFILFMLPTNGGEALVIIAAILFEFTLPLTPAQVLWINMVTVSTLGLALAFEPAERNIMNHRPRSPKEALLSGFFVWRVLMVSVLMMIGGLGLFLWEQHIGVSTETARTMAVNAIVMSEMFYLINSRHTFASVLHLEGLTGNRYVLLAIVACLLLQITYTHLPTMQSIFNSTDLTMLQWCKSIAAGLMVFCVIEIEKSVIR

SEQ ID NO: 19660 - protein, 266 aa, Nitrosomonas europaea
TPLNIAVAGSTGRMGRAIMETIAEADDLRLSAALEQPGNPYLSQDAGSLTGTPPGVAISSDYVSALAGSDILVDFTRPAGTLSHLATCRKLGVRMVIGTTGFSPEEKDIIRNAAQDIAIVLAPNMSVGVNLLFRLLEVAAKALPEGYDVEIIEAHHRHKVDAPSGTALRMGEVIAQAQSRDLEKVAIYGREGNTGERRADTIGFSTIRGGDIVGDHTALFAGIGERLEITHKASSRKTFAAGALHAARFLMTRKSGLFDMQDVLGL

SEQ ID NO: 19661 - protein, 303 aa, Nitrosomonas europaea
ICGSIAYDTIMVFEDRFKRHILPDKIHVLNVAFLVPEMRREFGGCAANIAYNLKMLEGKPLIMATVGDDFQPYTYRLEKLGLAQTHIRRIQDTFTAQAFITTDLDDNQITAFHPGAMNFSHQNSVKDAIDVSLGIIAPDGRDGMLTHAREFHEAGIPFIFDPGQGMPMFSGNELTDFIDMADYIAVNDYEAQLLQSVTGYKLSELATRVKALIETKGAEGSVIHAQGKQFQIPAVRPQKVVDPTGCGDAYRAGLLYGIAQDMDWQTTGQLASLMGTLKIAHRGGQNHQYQRDEIGQRYFEAFG

SEQ ID NO: 19662 - protein, 126 aa, Nitrosomonas europaea
SVPAELKYTESHEWVRLEADGSVTVGITQHAQELLGDMVFVQLPDVGRALAQREDCAVVESVKAASDIYAPLGGEVIAVNSEVETSPEKINEDCYAAWLFKLKPANAGEVDGLLDAGGYQKLLDSE

SEQ ID NO: 19663 - protein, 934 aa, Nitrosomonas europaea
  unsure (1)..(934): unsure at all Xaa locations
MSLNTRANIIPEKNTPNEKDYPLREDIRLLGRMLGDTIRELEGETMFNLVETIRQTSVRFRRDQDEAAEHELDTILNHLSHKETIAVVRAFSYFSLLSNIAEDLHHNRRRRAHLRAGSPPQDGSVTLALQRVVKKGIDAEQLQNFFASALISPVLTAHPTEVQRRSILDYQLKIQRLLKERDRTQLTPNEMRHNEEDLRSAIQTLWQTRVLRSVRLTVQDEIENGLIYYHYTFLRQIPYIYAKLEDILERHMDKAAPRIASFLRIGSWIGGDRDGNPFVTHQIMLHAAERHSALILDFYISEVERIGQTMSLSERLIKVSSDLEGLASTAPGLPASRIDEPYRRVFLGIHARLIATSRHLGSSIRGCCQENNAEPYADSAEFVHDLDIVIRSLRQHRSDRLAQGALRDLRRAADVFGFHLAPLDMRQHSKIHEQVISELYEKNTRDDRNYLEMSRSERVEWLLAELRHPRSLVTSFSDFSDVTQGELRILKMAAEIQRRFGHAALPNYIISMATGVVHILEVALLLKEAGLLQFGDDPRSTVNIIPLFETIDDLRGCASVMDELFSLPDYRKLLLSRDNLQEVMLGYSDSNKDGGFVTSNWEIYKAEIELTRVFDRHGVRLRLFHGRGGTVGRGGGPSYQGILAQPPGSVSGQIRLTEQGEVIASKYTDPEIGRRNLETLVAATIESTLLDRDAVHYHAPHYHQIMEELSSSACAAYRDLVYKTPGFKQFFLESTPIREIAGLHIGSRPTSRKPSDKIEDLRAIPWVFSWSLNRTMIPGWYGFGTAVENFVQQAGNEQEALKQLQEMYRTWPFLQTLLSNMDMVLSKSDLGIASRYAELVTDPELRQSVFTSIRTEWELCMKWLFAITGYSELLQDNPTLARSIRIRTPYIDPLNHLQIELLRRYRSGDDDDTVRRAIHLTINGVATGLRNSGX

SEQ ID NO: 19664 - protein, 183 aa, Nitrosomonas europaea
  unsure (1)..(183): unsure at all Xaa locations
MTIPSLSPPRLAILAAVSANRVIGLNNTLPWHLPADLKHFKQLTTGQIVVMGRRTFDSIGRPLPDRTNVVLTRQRHFNQPGILTAGSIQEVLEHFCGDDRQIFIIGGAEIYQQTLPFCQRLYLTEIQQDFAGDTFFPEYDRDNWREISREMHQATDSGIEYHFVVLDRKQPVNAGACSTDLSX

SEQ ID NO: 19665 - protein, 631 aa, Nitrosomonas europaea
NIEHLNFQAEANQLLKLMIHSLYSNKEIFLRELISNASDAADKLRFEGLSDAALYESDPDLKIRIAYDKEARTITIIDNGIGMSRQEVINNIGTIAKSGTREFFDSLTGDQAKDANLIGQFGVGFYSAFIVADKVTLTTRRAGLTIEHGVRWESGGEGEYTLETVEKPDRGTEIVLHLREGEDELLSSFQLRSIIRKYSDHITLPIVMKKEVWDDESKSYRLSDEDETINQASAIWARPKNEITQEQYDEFYKHVAHDFEPPLAHVHARVEGKQEYIQLLYIPAHAPFDLFDREHRHGLKLYVRRVFIMDDAEKLLPGYLRFVRGIIDSSDLPLNVSREILQESKDIDSIRAGSVKKVLGLIEDLAMSDKSEDQEKFKTFWREFGQVLKEGIAEDYSNRERIAKLLRFTSTHDEREEQTVSLDDYIARMKPEQEKIYYITADGLKAAQSSPHLEIFRKKGIEVLLLCDRIDEWLVANLNEYTGKSLQSIAKGNLDLGKLEDEEEKKEHEKEAGDFQELTNKMKEVLGEQVKDVRITYRLTESPACLVADTHDVSGNLGRLLKSAGQKVPDSKPFLEINPHHPMIQRLKYEEAKFADWSHILFDQALLAEGGQLEDPAGFVKRLNDLLLQNI

SEQ ID NO: 19666 - protein, 712 aa, Nitrosomonas europaea
MINIEIDGKQVTVAQGSTVMDAARQIGIYIPHFCYHKKLSIAANCRMCLVEVEKAPKPLPACATPVAEGMKVSTHSQQAVTAQKGVMEFLLINHPLDCPICDQGGECQLQDLAVGYGSSGSRYQEPKRAVTNKNLGPLIATDMTRCIHCTRCVRFGQEIAGIMELGMAGRGEHSEILTFVGRAVDSELSGNVIDLCPVGALVSKPFRYSARTWELSRRKSISPHCGLGSNLVVQVKKNRVMRVLPRENEAVNECWLSDKDRFSYEGLNSEDRLTVPMIRKSGQWQVCGWQEALAYAAEGISNVVKNQGPLSIGALGSAHSTLEELYLLQKLMRGLGSHNIDHRVRQSDFRTDAVLRGAPWLGMQIAEVSQLKAVLVVGSTLRKDHPLLAQRMRQAVKEGGQLSLINPSGDDQLTKIAYRAIVAPSAMLDMVLQVLKAAAEIKNIPVPGHIKSAANAVEVSEVARGIANSLINHAPAAVFLGNLAQHHPHFADLHCAALAVSKITEAQFGLLGEAANSVGAYSAGALPWSTGTHSVNKTVSEKVGLNAGQMLGLGSPDGEPACSAYVLLNLEPELDCYDTGRALQVMNKAEFVVSLSSYKGNIPDYADVILPVAPFTETSGTFVNTEGRIQSFSGVVPPLGEARPAWKILRVLGNLLQLEGFDYDSSEQVRAEIVSAEEEFVRGLNNALEAFSISENHQKNSGIERIGEIPIY

SEQ ID NO: 19667 - protein, 249 aa, Nitrosomonas europaea
RAGFVAGNWKMHGSLVRNQELLDAVVSGTRSLQNVSCVVCVPYPYIAQTQSVLEGSHVLWGGQNVSQYHHGAYTGEVSADMLADLGCRYVIVGHSERRTLFGEGNQVVAEKFRAAQERSITPILCVGETLAQRESDETEQVIAMQLDAVIDLAGIEALGQSVIAYEPVWAIGTGKTATPQQAQDVHKFIRSRIAVHSGGIAENIQILYGGSVKADNARELFTMPDIDGGLIGGASLVAAEFISICLAAQ

SEQ ID NO: 19668 - protein, 245 aa, Nitrosomonas europaea
KLVLLRHGESIWNQENRFTGWTDVDLTPKGLKEAEEAGRLLRENGFSFDIAYTSLLKRAIRTLWIALDEMDQMWTPIELNWRLNERHYGALQGLNKAETAKQYGDEQVLVWRRSYDIRPPSITINDERYPGFDLRYRNMSSGDIPLAESLKDTVARFLPYWNQSIAPQIKAEKKVIIAAHGNSLRALIKHLDNISDQDILNCNIPTGIPLVYELDDDLKPLNSYYLGDAGQIGEAISAVANQGKS

SEQ ID NO: 19669 - protein, 559 aa, Nitrosomonas europaea
FLKPYKLSLSFSLAALFLTAGITLSLGQGIRLMVDRGFATQSPDLLTRYVLVFLLLVVLLAIGTFTRYYWVTWLGERVIADIRRKVFAHLIELHPGFFEANRSLEIQSRLTADMTLLQSVVGSSISVALRNLIMLAGGIVWLFITNVKLTVIVMLSIPLVIVPILLFGRRVRVLSRQSQDRVAAVGAYVGEMLGQIKTVQAYNHQAMDKMHFDQYVEDAFHIARQRTLQRAWLIAVVIVLVFGAIGMMLWVGGMDVIEGKISGGELAAFVFYSIIIGSAVGSISEVLGELQRAAGAAERTMELLEEPSQISSPVDPRQLPAVTGNIVFQRVCFAYPSRPEIQVINDFSLAVRPGETLALVGLSGAGKSTLFDLLLRFYDVRSGCISLEGVNIRDLDLSDLRRSFALVSQNPVLFHGSIEQNLRYACPDASDAEIEMAAKAAFIHDFIVSLPQGYQTSLGDTGLGLSGGQKQRLAITRAILADAPVLLLDEATSALDSQSEHWVQQAITRLSTGRTTIVIAHRLSTILTSDRIALIHHGRLEALGTHVELMESSELYARL

SEQ ID NO: 19670 - protein, 440 aa, Nitrosomonas europaea
VSFENLNLHPAIVKAVLAAGYTAPTPIQQQAIPDLIAGHDVMASAQTGTGKTAAFMLPALHRLATPAQIRGRGPRILVLTPTRELALQVSDAASKYGKFLPRINVVSILGGMPYPLQNKLLSQTVDVLVATPGRLIDHIERGRIDFSRLEMLVLDEADRMLDMGFIQDVERIALSTPATRQTLLFSATLDVAIEKIATRLLKAPKRIQVAAQHTKLDHIEQRMHYVDDLTHKNRLLDHLLRDTTIKQAIVFTATKRDADSLADNLSSQGHKAAAMHGDMTQRERTRTLTGLRQGRLKILVATDVAARGIDIADITHVINFDLPKFAEDYVHRIGRTGRAGASGIAVSFASGKDVAHLKRIERFTGNRFEFHVIPGIEPRTKPRFGRSDDKPGRRPSSSAAAHKTRRSWSDNPNTRTASPGHRGDKDAGFGQPFGRETRKR

SEQ ID NO: 19671 - protein, 384 aa, Nitrosomonas europaea
LDIHEYQAKEILAEYGIKLAEGGLAHTVEEAVQRSREIDGNVWVVKAQIHSGARGKAGGVKVCRTHEEIEVAAESLLGKKLVTHQTGPAGKLCSRLYIEAGTEIAREVYLAFMIDRSHERIVMVGSAQGGMDIETLAATNPDAIKKIHIEPAVGLQDFQARTMAFALGLEDVLLNHAVKTIRGCYRAMRDLDANILEINPLVVTRNNELIALDAKMSFDENALFRRHRISELRDNSQIDSREIAAAEAGLSYVGLDGDIGCMINGAGLAMATMDMIKLAGGEPANFLDVGGGASAERTEKAFRLVLADNNVKAMLVNIFAGINRCDWIAEGVVQAVRNIGMTVPLVVRLSGTNVEEGRRIIADSGLPIITAETLADAAEKVVHA

SEQ ID NO: 19672 - protein, 260 aa, Nitrosomonas europaea
VAILINEQTRIIVQGFTGRIGTFHAQEMIDYGSNVVGGVTPGKGGQKHLGLPVFNTVREAVEQAGAEASIVFVPPAFAADSIMEAADAGIKYCVSITDGIPTQDMMTVKNFLRLFPEEDRMMLTGPNCSGTISPGRAMLGIMPGHIYSRGVVGVVGRSGTLGYEAADQMRRLNIGISTSVGIGGDPIIGSSHRNVLQKLEEDPETKVTLMIGEIGGPMEVEAGLFAKENMSKPLVAYIAGLTAPPGRRMGHAGAIISSAG

SEQ ID NO: 19673 - protein, 735 aa, Nitrosomonas europaea
  unsure (1)..(735): unsure at all Xaa locations
LVSAMAVAISTVLTVNPIQAESQPQPTMNSFWWPDQLDLRPLRQNSAESNPLGKAFNYAEQFKTLNLKAVKEDIANVLHTSQPWWPADYGNYGPLFIRMAWHSAGVYRIFDGRGGASGGXQRFEPLNSWPDNVNLDKARRLLWPIKXKYGSKLSWADLMVLAGNVALEDMGFKTIGFAGGRPDDWEAEIVNWGTEKEFLADERHDKRGELAKPLAAVQMGLIYVNPEGPGGNPDPLAAARHIRESFGRMAMNDEETVALIAGGHTFGKAHGAHKPEECVGKEPAAAGIEEQGLGWANKCGSGYGVDTVTSGLEGAWSTNPARWTHDYLTWLYAFEWETTKSPAGATQWIPKGGKGDNFVPDAHDPTKRHAPIMFTTDIALKVDPEYQKISKRFLDNPKEFGIAFAKAWFKLTHRDMGPKARYVGAEIPAEDFIWQDPIPKVDHKLIDAQDIARLKSAILASGLTIPELVRTAWASAATFRGTDMRGGANGARIRLAPQKDWEVNDPAELAKVLTRLESIRNNFNRTLKGGKKVSFADVIVLGGSAAVEEAARKAGYKVQVPFKPGRMDAAQAQTDVESFAVLEPKADGFRNYFGKGNAYSPAEMLVERANFLTLSVPEMTVLVGGMRALDANAGHSRHGIFTSRPGTLTNDFFVNLLDMSTKWARSATEGLYEGRDRATGQIKWIATPVDLIFGSNSELRAVAEVYASDDTKEKFVHDFAQAWAKVMDLDRFDTR

SEQ ID NO: 19674 - protein, 309 aa, Nitrosomonas europaea
LMVFTGTANPKLAHDVVKYLNINLGRANVGRFSDGEVMVEILENVRGNDVFVLQSTCTPTNDSLMEILVIVDALKRASASRVTAAIPYFGYARQDRRTRSARVPITAKVVANMLTSVGVDRVLTMDLHSDQIQGFFDIPVDNVYGMPILLGDIWKHDYQNLIVVSPDVGGVVRARHLAKRLECDLAIIDKRRPKPNESKVMNIIGDVRGRTCVIIDDMVDTANTLCEAASALKREGAASVIAYSTHAVLSGKAVERVQTSDLDKLVVTDTIPLREDASKCNRIHQLSVASLLGESMLRISNESSLSSLF

SEQ ID NO: 19675 - protein, 213 aa, Nitrosomonas europaea
FPAPAKLNLFLHVIGRREDGYHLLQTVFRFIDHSDRLHFDITHDGVIRHENLIPGLTETDDLCVRAAKLLRQRFGRESLGVKIHLEKNIPLGGGLGGGSSDAATTLIALNRLWGINWKRERLMALGLELGADVPVFIYGRNAFAEGVGEELHAVDLPSAWYVVLTPPVQISTAAVFTSKELTRNTIPIKMAAFSMGQGHNDLEPVAMRMQPVI

SEQ ID NO: 19676 - protein, 188 aa, Nitrosomonas europaea
LLVLVGCAGPEVHQGEVTTVVIQPVQEQADIANEPFVLTGRLAVNARQHRFSGGIRWQHTGQSDEIYLFSPLGQIVAEIFRDQTGVRLVTSEPAIYRAQNAEYLTSQVLGWELPLAGMRFWVRGTHFPDTVAEKDLDKNRRTVAIRQDGWQVVYQNYYPAQEGMSVLPRLLEFSRPDVKMRLLVDQWQ

SEQ ID NO: 19677 - protein, 156 aa, Nitrosomonas europaea
MNYYTFLESPVDRLLLTSDGEFLTGVYMEIEIQKLLPRMTDDWRQDAAPFAEAIAQLNAYFAGELIQFDLPMKATGTPFQEAVWQSLSTIPYGETVSYKNIAERLHLPKAARAVGMANGQNPISIIIPCHRVIGANGKLTGYGGGIHRKQWLLAHE

SEQ ID NO: 19678 - protein, 429 aa, Nitrosomonas europaea
IKIRRLSSVDDHFQAELDQLLSFEVSVDSEIERTVTQILHQIRTHGDRALLELTRQFDNPDIDRIEEIELPRDEWQSALMSLDKVQREALEQAASRIRAYHEKQLAQSWDYVELDGTRLGQKITALDRVGLYVPGGKAAYPSSVLMNAIPARVAGVRELIMVTPTPKGEKNPLVLAAAAICEVDRVFTIGGAQAVAALAYGTTTVPKVDKIVGPGNAYVAAAKRHVFGTVGIDMLAGPSEILVICDGKTNPDWIAMDLFSQAEHDEQAQSILLCPDKAFLDRVADSISRLIDTLPRRDVIRSSLENRGALIHVRDLEEACMIANRIAPEHLELSVDEPEQWVDSIRHAGAIFLGRYTCEALGDYCAGPNHVLPTSGTARFSSPLGVYDFQKRTSLIQVSAAGASRLGETASILAKGEGLDAHARSAESR

SEQ ID NO: 19679 - protein, 225 aa, Nitrosomonas europaea
LQQKVEQLHSLLGNIQRDYSPAVFASSFGAEDMVLTDLIARHYPEIGIFTLDTGRLPEETYDLMQKVKERYGVSIHAYFPDASAVEHYVAQHGPNGFYDSVALRKRCCYIRKVEPLKRALADKKAWITGMRRDQSTTREELELSAYDSDHGLHKFNPLCDWTEKDVWNYIRQHDVPYNALHDRFYPSIGCAPCTRAITPGEDIRSGRWWWENPESRECGLHTRKI

SEQ ID NO: 19680 - protein, 549 aa, Nitrosomonas europaea
ESLKAESDYLRGTIALGLLDRITSAVPGNDIKLMKFHGIYEQDDREIRDERRRQKLEPAFQFMIRVRLPGGICTTERWLKISELACAHGNETLRMTTRQTFQFHWVLKQNIVPLIRGLHEVLLDTVAACGDDSRGVMATVNPQFPALQAELAALAKTVSDHVIPKTRAYHEIWYGEERIASSEPEEPFYGQTYMPRKFKIGFVIPPNNDIDIYAQDLGYIAIIGENGKIAGFNVAIGGGMGRTDKAPHTYPRTASVIGFITPDRLISVTEAVMGVQRDYGNRADRSRARFKYTIDDKGLDWIKLAIEDRAGPLESARPYDFTSNADIYGWIESGDGFHHFTLFIENGRLNRDMLDKIAQIAHVHKGHFRLTPNQNLMIANVATADKPEIEALLRETGLIAFNERSVLRLNSMACVALPTCGLAMADSERYLPDLITKIEGILTRYNLQNEPITLRMTGCPNGCSRPFIAEIGLTGRAPGKYNLYLGGGFHGQRLNRLYRENIGEPAILETLNEVLGRYATERLPDEHFGDFTIRAGIIREVTEGRFSND

SEQ ID NO: 19681 - protein, 213 aa, Nitrosomonas europaea
  unsure (1)..(213): unsure at all Xaa locations
ILQPGSNPEYTILWMHGLGADGNDFVPVVQALDLPEIPIRFLFPHAPQQPVTINSGYIMRAWYDIQHTDFVEQEDETGIRRSQHAIVELIEREDRRGIPPDHLILAGFSQGAAMALHTGLRHPDRLAGIIALSGYLPTCSXDXTXSTYHQQDTPIFMAHGNDDPIVPIELAHASLQQLREYYYPVTWHEYPMEHTVCDQELVDISRWLKTILK

SEQ ID NO: 19682 - protein, 561 aa, Nitrosomonas europaea
MTTLKITGMTCDSCATHVKQALEKVPGVQSAVVSYAKGAAQLDLDPGTAPDALTAAVAGLGYKATLADAPPTDNRTGLLDKVRDWMGAADKGSDGEHPLQVAVIGSGGAAMAAALKAVEQGAKVTLIERGTIGGTCVNVGCVPSKIMIRAAHIAHLRRESPFDGGIPATAPAIDRSKLLAQQQARVDELRHAKYEGILDGNPAITVLHGEARFKDDQSLVVRLNAGGERVVVFDRCLVATGASPAVPPIPGLKESPYWTSTEALVSDIIPERLAVIGSSVVALELAQAFARLGSQVTILARSTLFFREDPAIGEAITAAFRAEGIKVLEHTQASQVAHVDGEFVLTTARGEIHADKLLVATGRTPNTRSLALEAAGVAVNAQGAIVIDKGMRTSAPHIYAAGDCTDQPQFVYVAAAAGTRAAINMTGGDATLDLTAMPAVVFTDPQVATVGYSEAEAHHDGIETDSRTLTLDNVPRALANFDTRGFIKLVIEEGSGRLIGVQAVAPEAGELIQTAALAIRNRMTAQELADQLFPYLTMVEGLKLAAQTFNKDVKQLSCCAG

SEQ ID NO: 19683 - protein, 309 aa, Nitrosomonas europaea
HKTDDRRIIRGDELITPVKLLHDHPLTEQATETVVTARQECHDILRGEDDRLLVVCGPCSIHDVDAAVEYASRLSHLRQELKDQLHIIMRVYFEKPRTTVGWKGLINDPDLDNSFNIDKGLRLARDLLLKLGNINMPAATEFLDLISPQYVADLISWAAIGARTTESQGHRELASGVSCPVGFKNGTYGNLNIAIDAIGAASHPHNFLSVTKEGRVATFTTRGNEDCHIILRGGRSPNYDAESVASAVEALRKAKLPPYLMIDCSHANSHKDYRRQPEVAADVAQQIAEGNCSISGIMLESHLVAGRQN

SEQ ID NO: 19684 - protein, 348 aa, Nitrosomonas europaea
MTIKAYGARAGDLPLEPMNITRRTPSAHDVQIDITHCGVCHSDLHQVRSEWAGTLYPCVPGHEIVGRITAVGAQVSGYKPGDLVGVGCIVDSCQHCADCNDGLENYCDHMVLTYNGPTSDAPGHTLGGYSQQIVVHERYVLRIRHSEAQLAAVAPLLCAGITTWSPLRHWKVGPGQKVGVVGIGGLGHMGIKLAHAMGAYVVAFTTSESKREAARALGAHETVVSRNPDEMARHVGSLDFILNTVAASHDLDAFFALLKRDGTMALVGAPATPHPSPNVFNLIMKRRSLAGSLIGGISETQEMLDFCAKHNIVADVEMIRIDEINEAYERMLKGDVKYRFVIDCASLT

SEQ ID NO: 19685 - protein, 370 aa, Nitrosomonas europaea
MMNLSELAPDYIRAIQPYQPGKPISELVRDLGLNKDEVVKLASNENPLGTSPLAKEAMIQALNESARYPDGSGFELKAALSERLGMPADQIVLGNGSNDVLELATRIFLHPDSTAIYSQYAFAIYPLLAQAVGARGIAVPARNYGHDLEAMLAAVTPETRIIFIANPNNPTGTLCDARDLLRFMERVPQDVLVILDEAYDEYLPEANKANSIAWLKNFQNLVITRTFSKAYGLASVRVGFALAHADIANLMNRIRQPFNVNSIGLAAAQAALKDVEFVKLAYMTNRTGMQQMTHGLDQLGIEYIPSFGNFVCCHIDGHPANTLKIYRNLLQQGVIVRPLGNYDMLNHLRVTIGIEEENKRFLQALEQALK

SEQ ID NO: 19686 - protein, 366 aa, Nitrosomonas europaea
RKIYNFSAGPAVLPEEVLEQAREEMLDWHGSGMSVMEMSHRGKEFMSIADETESALRELAGIPDHYKVLFLQGGASSQFAMVPMNLLGKKGKADYVNTGQWSAKAISEAKNYGSVQIAASSESDGFNSVPPLAQWHISPDAAYVHYASNETIGGVEFQWTPDLSAVAGDNKNIPLVADMSSNFLSRPFDVSKFGLIYAGAQKNVGPAGLVVVIVREDLLDIPPLAGTPAMFRYKTHADNASMYNTPPTYAIYIMGLVMEWLKKQGGLTAIEQRNIAKAKLIYDLIDVSSFYHCPVNQADRSRMNVPFTLSDPGLDDAFLKQAQAHGLIQLKGHRSVGGMRASIYNAMPLEGVQTLVTFMREFEKNH

SEQ ID NO: 19687 - protein, 659 aa, Nitrosomonas europaea
KNLTSAIRALAMDAVQKANSGHPGMPMGMAEIAEVLWNHHMRHNPTNPDWVDRDRFVLSNGHGSMLIYALLHLTGYDLSIEDIKNFRQLHSKTPGHPEYGYTPGVETTTGPLGQGITNAVGMALAEKILAEEFNRPYFPIVDHYTYVFLGDGCMMEGISHEACSLAGTLKLGKLVCFYDDNGISIDGHVEGWFTDNTPKRFESYGWHVVPDVNGHDPVAIQAAIEAAKKVQDKPTLICCKTVIGMGSPNKANTSHVHGAALGNDEIAAARPHIGWNYLPFEIPQEVYDAWDARAKGQALESAWNSMFAEYGKKYPAEAAEFTRRMADELPVGWADHVEGTISQINAREETIATRKASQNSIEALAPVLPELIGGSADLAGSNLTMWSGSKGISTESTGNYVFYGVREFGMSAIMNGLSLHGGIIPYGGTFLMFSEYARNALRMAALMKIRNIFVFTHDSIGLGEDGPTHQPVEQTATLRMIPNMDVWRPCDTVESIVSWVSAIERREGPSSLIFSRQNLPFQKRDAVTISLIRKGGYILSEAANRKPQAIIIATGSEIGLAMAAQKTLAESGIAVRVVSMPCTNIFDRQDQAYRDSVLPKGIARVAVEAGVTDYWRKYVGLEGDVIGIDRFGESAPAEKLFEYFGFTVENVVNAVKRVI

SEQ ID NO: 19688 - protein, 310 aa, Nitrosomonas europaea
INGFGRIGRMVFRCSIEEFDDIEVVAINDLLEPDYLAYMLTHDSVHGRFRGDVSVSGNNLIVNGKQIRLTAIKDPTELKWDEVGADIVVESTGLFLTKELAQKHIQAGAKKVVLSAPSKDDTPMYVYGVNDKAYGGEAIISNASCTTNCLAPIAKVLNDTWGIKRGLMTTVHAATATQKTVDGPSNKDWRGGRGILENIIPSSTGAAKAVGVVIPELNKKLTGMAFRVPTSDVSVVDLTVELEKDASYEDICNAMKEASAGSMKGILGYTDQKVVSTDFRGETCTSVFDAEAGIQLDKNFVKVVSWYDNE

SEQ ID NO: 19689 - protein, 392 aa, Nitrosomonas europaea
VSVIKLVDLDLKNKRVFIRADLNVPVKDGKVTSDARITASMATINHCLKQGAKVMVTSHLGRPEEGVWTEENSLQPVADDIARRLGKPVRLIKDWVEGGFEVASGELVVLENCRINKGEKKNLEETAKKYASLCDVFVMDAFGTAHRAEASTHGIAKYAPIACAGILLTEELDALTKALHQPAHPLVAIVGGSKVSTKLTVLESLAEKVDQLVVGGGIANTFLKAAGNNIGKSLCEDELVPVAKSLMDKMNKRNATIPIAVDVVVGKKFAEDEAAVLKAANAVSDDDMIFDIGPESAQELVDIIMKAGTVVWNGPVGVFEFDQFGEGTRAIAKAIAETDAFTLAGGGDTIAAIQKYDIYDKVSYISTAGGAFLEFLEGKKLPAVEILELRAK

SEQ ID NO: 19690 - protein, 471 aa, Nitrosomonas europaea
MRRTKIVATLGPASSNAEVLGRMLEAGVDVIRINFSHGTKDEHIASVELVRSLARSLGRTVGVLADLQGPKIRIGKFEQGKIRLKTGDEFILDAECQLGNQERVGLDYRELPNDVEAGATLLLDDGRIVLTVAKVRESEIFCEVLQGGILSNNKGINRKGGGLSAPALTAKDLLDIKTSAVIRADYLAVSFPRSGDDIRRARALMQEAQGHSLLMAKIERSEAILALDDILEASDAIMVARGDLAVEVGDAAVPALQKRMIRSAREANKLVITATQMMESMISNPIPTRAEVSDVANAVLDGTDAVMLSAESAAGQYPVEAVEAMARVCLEAEKEYTPSLRARRSPDTQSISIEDAIARATMYAAGSLNIQAIAALTQSGVTALFMSRRSSKAPIFALSPQEDTLGKVTLFRGVYPIEFGQGLCDPEIILGMAEDELLKRGAVRDEDLIIMTIGEPVGKAGGTNTMKIIKV

SEQ ID NO: 19691 - protein, 349 aa, Nitrosomonas europaea
MALVSLRQLLDHAAENGYGLPAFNVNNLEQIHAIMQAADECDSPVIMQGSAGARKYAGEAFLRHLIAAAVEAYPHIPVVMHQDHGASPAVCINAIRSGFSSVMMDGSLEEDGKTPSSYEYNVDVTSKVVAMAHAVGVSVEGELGCLGSLESGQGEAEDGHGAEGQLSHDQLLTDPEQAADFVKQTGVDALAIAIGTSHGAYKFTRKPTGDILAIQRVKEIHERIPNTHLVMHGSSSVPQEWLEIIREYGGDMKETYGVPVEEIQQGIKYGVRKVNIDTDIRLAMTGAIRRHLAKNKSEFDPRKFLKDATAAAKDICKARFEAFGSAGQAGKIKPISLETMANRYLRGEL

SEQ ID NO: 19692 - protein, 416 aa, Nitrosomonas europaea
MQKLVIHGGAKLQGEISISGAKNAALPVLCASLLTADTFTIQNLPHLRDITTMLALLEQIGVRILTNDPGTAELSAASITNPTASYDMVKTMRAAILVLGPLLARTGQAYISLPGGCAIGMRPVDQHIKGLQAMGADISIEQGYIRAQAGRLSGTRIVMDLVTVTGTENLMMAATLASGTTILENAAREPEVVDLADCLIGMGAKIEGAGSDIIVIEGVDHLHGSSHTVMPDRIETGTFLTAVAACGGDITLTRTRADTLDVVLGKLIETGAAIDTGEDWIRLRMQHRPQPVSLRTAPYPAFPTDMQAQFMALNSIADGTSVMTETIFENRFMHVQELKRLNADIQVEGNTAIVHGIPQLDGASVMATDLRASACLIIAGLVAQGETIVDRIYHLDRGYERIERKLAQAGAQIKRI

SEQ ID NO: 19693 - protein, 455 aa, Nitrosomonas europaea
KKTWSGRFSEPVAQLVQRYTASIGFDYRLAEYDIQGSLAHARMLAATGIIQPADLAAIEQGLAQIREEISKGEFEWQLEQEDVHLNIERRLTALTGDAGKKLHTARSRNDQVATDIRLYLRTAIDEIIDLIHTLQYVLLDLAEQQAATIMPGFTHLQVAQPVSFGHHLLAYHEMLQRDGQRLQDCRKRVNQLPLGAAALAGTSYPVDRAMVAYELGFDDICHNSLDAVSDRDFAIEFCACAALIMMHLSRLSEELILWMNPAFGFIRLADRFCTGSSIMPQKKNPDVPELVRGKTGRINGHLVALLTLMKSQPLAYNKDNQEDKEPLFDTVDTLKDTLTIYADMLAGLHVNPEAMRQAALRGYATATDLADYLVKKGIPFRDAHEAVAQAVRFAESKACDLSELSLADLRQFSEVIEQDVFEVLTLEGSLQSRNHPGGTAPEQVREAICRARSQL

SEQ ID NO: 19694 - protein, 390 aa, Nitrosomonas europaea
MSGNSIGKLFSVTSFGESHGPAIGCIVDGCPPGLTLSVEDIQQELDRRKPGTSRHVTQRREADRVEILSGVFENTTTGTPIALLIRNEDQRSKDYSKIMDVFRPGHADYTYWQKYGIRDYRGGGRSSARETAVRVAAGAIARKWLQQRYGIVIRGYMAQLGSIAIPFKSWDVVNQNPFFVADNDYVQKLETFMDSLRKSGNSAGARINVVAEGVPVGWGEPVYDRLDADIAYAMMSINAVKGVEIGAGFNSITQKGTEHSDEITPEGFLSNNAGGILGGISSGQPVVVSVAIKPTSSIRLARRSIDKAGNPVLVETHGRHDPCVGIRATPIVEAMLAIVLMDHALRHRAQNADVVCSTPRIPGSTTNQIHPVEMQASAPRAEDPEPDESS

SEQ ID NO: 19695 - protein, 459 aa, Nitrosomonas europaea
  unsure (1)..(459): unsure at all Xaa locations
MSNIAPEIFKAYDIRGIVETALTPATVELIGHAIGSEARERQLTTIAIGRDGRLSGPELAQALTNGIRKSGIDVIDVGMVPTPVLYYAAHELCGYSGVMVTGSHNPPEYNGLKIVLGGETLAAEAIQSLRLRIEQANFQHGQGSYRQHDIVQSYLQRIIADVKLARPVKIVVDCGNGVTGVLAPELYRRLGCEVIELFCEVDGTFPNHHPDPSVPENLQDVIRTLATTDAEIGFAFDGDGDRLGVVTKDGSIIYPDRQLMLFAADVLSRNPGGQIIYDVKCTRTLAPWIIRHGGKPVMWKTGHSFIKAKLKETGALLAGEMSGHIFFKERWYGFDDGLYAGTRLLELLSKQVDPATVLHALPDTINTPELQIKLKEGENHALIAQLQRDADFPEADQVITIDGLRVEYKDGFGLIRASNTTPVAVLRFEADNRAALERIQQDFRRVILQARPDAALPFX

SEQ ID NO: 19696 - protein, 310 aa, Nitrosomonas europaea
  unsure (1)..(310): unsure at all Xaa locations
MGEVDNVIQQKLHSQVALVRQVSEYIIHSGGKRLRPALVILAAGLFDYKGLHHHNLAAVVEFIHTATLLHDDVVDESELRRNQATANALFGNAASVLVGDFLYSRAFQMMVEVGNMRVMEVLADATNTIAEGEVLQLLNCRDPDVEEENYLQVIRFKTAKLFEAAARLGAILGGATPAEEEALAAYGMHLGTAFQLVDDLLDYSGNDQDTGKNLGDDLAEGKPTLPLIFAMRSGIPEQVDTVRHAIETGGKDGFEPILKIIQESGALDYAKQCAQNEANMAISAITAIRDSIYKQCLLELAEFAITRNYX

SEQ ID NO: 19697 - protein, 216 aa, Nitrosomonas europaea
LDTINWSADGLIPAIAQDKNNGKILMVAWMNREALKRTVESGEAVYWSRSRKKLWHKGEESGHTQKISAIHLDCDEDILLLSVEQKGGIACHTGRQSCFFRQLKNGEWVVTEPVIKDPHKFIPNDSIDHLQRLARTIEARKNADPSISYTAKLLNSSQDKVLKKIAEEAAETIMACKDNDREQIIYETADLWFHCLIMLTRHDISPEDILRELERR

SEQ ID NO: 19698 - protein, 256 aa, Nitrosomonas europaea
LAKRIIPCLDIKDGRVVKGVNFVSLRDAGDPVEIARSYNEQGADELVFLDITASSENRDLILHIVEKVAAQVFIPLTVGGGVRKAEDVRRLLNAGADKVSINTSAVLNPMLIKESADHYGSQCIVIAIDARQIPDANPESPRWEVFTHGGRKPTGIDAIEWAQKIQALGAGEILLTSMDRDGTRSGFDLTLTRAISDSVDLPVIASGGVGHLDHLVEGILAGHADAVLAASIFHYGEYSILQAKQYLSSHGIEVRL

SEQ ID NO: 19699 - protein, 192 aa, Nitrosomonas europaea
AQVTRNTQETQITVTINLDGQGKAELDSGVPFLDHMLDQIARHGMFDLSVAAKGDLHVDAHHTVEDIGITLGQALNRAVADKKGLVRYGHAYVPLDEALSRVVIDLSGRPGLQFNTTFTRAVIGNFDVDLIQEFFQGFVNHAMVTLHIDNLTGKNAHHQAETIFKAFGRALRMAVTTDPRCDNLIPSTKGVL

SEQ ID NO: 19700 - protein, 348 aa, Nitrosomonas europaea
VIRQEILALSAYHVPPAKDMVKLDAMENPYRLPPFLCEEISRIAADTSINRYPDPHAAALKEVLSTTLSVPAGMEIMLGNGSDEIIQIIMLAAAKPEAKLLTIEPGFAMFKMIATFANMQYIGIPLKPDFSLDIDRMLAAIERHQPSVIFLAYPNNPSGNLFDTSALEKIIEISPGLVVIDEAYHPFAGKSFIGRLADYPNLLVMRTLSKLGLAGLRLGLLAGRPEWLSHLEKLRLPYNVNVITQLVATKIMQHYDVLQQQADAIRQTRTRLRTFLENLNGIEVFPSNANFILFRLDGASQIFRLLQQHGILVKNLDNSHPLLKNCLRVTVGTPEENDRFCNTLQDLI

SEQ ID NO: 19701 - protein, 140 aa, Nitrosomonas europaea
ANILVIHGPNLNLLGRREPAVYGQTTLEDINRNLTVKAQAAPVALSIFQSNAEHELIDRVQGAMSDGTDFIIINPAALTHTSIALRDALAATSLPFVEIHLSNVYARESFRRTSYFSDIAVGVISGLGAAGYELALQFAL

SEQ ID NO: 19702 - protein, 449 aa, Nitrosomonas europaea
MFEKILIANRGEIALRIQRACRTMGIKTVAVHSEADAEAKYVKLADESVCIGPAASAQSYLNIPAIISAAEVTDAEAIHPGYGFLSENADFAERVEKSGFFFIGPRPDTIRLMGDKVSAKNAMRQAGVPCVPGSGGALPESLDEVKKIVKEIGYPVIIKAAGGGGGRGMRVVHTEAALSNAVITTRNEAQTAFGNPVVYAEKYLENPRHIEFQVLADEYGNVVHLGERDCSMQRRHQKIIEEAPARGISVQLRDKIGELCVEACKRINYRGVGTFEFLYENNEFYFIEMNTRLQVEHPVTEAITGIDLVQAQIRVAAGEKLSLQQKDIVFKGHAIECRINAEDPYKLTPSAGRITQYHAPGGPGIRVDSHIYHNYRVPPYYDSMIAKVIAYGDDRDLAIARMRIALTEMIVEGIKTNIPLHLDLLTDCNFLSGPVSIHHLEGKLALYNK

SEQ ID NO: 19703 - protein, 387 aa, Nitrosomonas europaea
MSNYLFTSESVSEGHPDKVADQISDAILDAILQQDPHARVACETMCSTGLIVLSGEITTDATIDYNAIPRGIVREIGYTSSEIGFDASTCAVLTAFNKQSPDIAQGVNRSKDEEMDQGAGDQGLMFGYACDETPQLMPLPIYYAHRLVEQQAKLRKSGRLSWLRPDAKSQVSVRYEDGFPKNIETIVISTQHSPDVPRDELVEGVIEEVIKPVLPAEMLSNHIQYLINPTGRFVVGGPMGDCGLTGRKIIVDTYGGTAHHGGGAFSGKDPSKVDRSAAYAARYVAKNIVAAGLARKCEVQVAYAIGVAKPVSLMVQTFGTGKIPDGKLAELIARHFDLRPRAIIHELDLLRPIYGKTAAYGHFGREEPSFTWEKTDMAEQLKADAGI

SEQ ID NO: 19704 - protein, 463 aa, Nitrosomonas europaea
DCKVADLSLADWGRKEIAIAETEMPGLMALREQYADKKPLAGARIAGSLHMTIQTAVLIETLVALGAEVRWASCNIFSTQDHAAAAIAARNIPVFAYKGESLEEYWDYAHQIFEWASDGSHTANMILDDGGDATLLLILGSKAERDPSVIANPTNEEEQVLFASIRSRLASHPGWYSRNLAAIRGVTEETTTGVHRLYEMEKKGELPFPAINVNDSVTKSKFDNLYGCRESLVDGIKRATDVMIAGKIAVVCGYGDVGKGCAQSLRGLGATVWITEIDPICALQAAMEGYRVVTMDDACDKADIFVTATGNLRVITHDHMLKMKDQSIICNIGHFDSEIDIASVQKYQWENIKPQVDHVIFPTGRRIIVLAQGRLVNLGCATGHPSFVMSSSFTNQVLAQIELWQNGKDYQKKVYVLPKRLDEMVARLHLGKLGVKLTELTDEQAHYLNLDKNGPYKPEMYRY

SEQ ID NO: 19705 - protein, 294 aa, Nitrosomonas europaea
  unsure (1)..(294): unsure at all Xaa locations
MTRRGLILAGGSGTRLHPATLALSKQLLPVFDKPMIYYPLSTLMLAGIRDILIISTPQDTPRFQQLLGDGEQWGLNLQYAVQPSPDGLAQAFLIGEDFIGNHPSALVLGDNIFYGHDLQRLLTHAMMRTEGASVFAYHVHDPERYGVVEFNAQGKVLSLEEKPIQPRSSYAVTGLYFYDTQVVDHAKALKPSARGELEITDLNRLYLEQGNLSVEIMGRGYAWLDTGTHATLLDASQFIATLENRQGLKVACPEEIAYRQGWIDAARLEMLAQLLAKNGYGQYLLKILRENVFX

SEQ ID NO: 19706 - protein, 471 aa, Nitrosomonas europaea
  unsure (1)..(471): unsure at all Xaa locations
MKTLYDKLWSDHVVHAESDDPNGMVILYIDRHLVHEVTSPQAFESLKLAGRKPWRTGSILAVADHNVPTTDRSSGISDPVSRLQVETLDQNCEEFAITEFRMNDERQGIVHVIGPEQGATLPGMTVVCGDSHTSTHGAFACLAFGIGTSEVEHVLATQCLVARKSKTMLVRVEGDLPPGVTAKDIALAVIGEIGTAGGTGYAIEFAGSAIRSLSMEGRMTLCNMAIEAGARAGMVGADEVTIDYIKGRPFAPQGALWDQAVAYWRTLKSDEDAVFDRMVELKAVNIKPQVTWGTSPEMVTTVDGYVPDPADISDPTKRHDVEHALGYMGLKPKMPIQEITLDKVFIGSCTNSRIEDLRAAAEIVKGKRIAPNIRLAMVVPGSGLVKSMAEKEGLDKIFLSAGFEWREPGCSMCLAMNDDRLLPGERCASTSNRNFEGRQGPGGRTHLVSPAMAAAAAIAGHFVDVRSFIRX

SEQ ID NO: 19707 - protein, 374 aa, Nitrosomonas europaea
  unsure (1)..(374): unsure at all Xaa locations
MKQVGFVGWRGMVGSVLMQRMREENDFSLIESVFFSTSQVGEKGPDIGREAGLLKDAYDIAALREMDIIISCQGGDYTGDVFKKLRESGWQGYWIDAASTLRMSDDAIIILDPVNRSVIDDALNKGVKNYIGGNCTVSLMLMAVGGLFDQDMVEWASIMTYQAASGAGAQNMRELLQQMGETHDVAKDLLEDPASNILDIDRKVAEKLRDKEFPAQNFGVPLAGSLIPWIDREVAHGQSREEWKGQAETNKILGHGDDPVPVDGICVRVGAMRCHSQALTIKLKKDIPLEKIEEIIAASNKWVHVIPNEREATTRELTPVAVTGKLDIHVGRIRKLNMGSEYLSVFTVGDQLLWGAAEPLRRMLRILVEDKAAX

SEQ ID NO: 19708 - protein, 196 aa, Nitrosomonas europaea
  unsure (1)..(196): unsure at all Xaa locations
MAAVQHGADAIGFILWPQSERYISPEEAGRIVKCLPPFVRAVGVYVNPDKSWVEETSATAGLDLLQFHGDESADFCSRFHLPYIKAVRVRDGLDLLQYAQHYAGARGLLLDAYTAGIPGGTGHVFDWKLIPAELPLPWILSGGLHPGNITDAIGQTHLSAIDVSSGVEVAKGIKDVNKISAFMQRVRSCEDVRSSX

SEQ ID NO: 19709 - protein, 431 aa, Nitrosomonas europaea
  unsure (1)..(431): unsure at all Xaa locations
MIDIRPATLESWLSYLEKLHPKMIDMGLERVKKVRDALKLKPEFPVITIAGTNGKGSVCAMLESILGCASYRVGCYTSPHLLRYNERIRIDRHEITDEVLCEVFAEIESARESVQTTLTYFEFGTLAAMLIFLRSRVDVAILEVGLGGRLDAVNVFDTDCAILTSIDLDHTDYLGSTREAIGQEKIGIFRADKPAICAEPDIPGNLREKMRAMNVRLYCIDEAFSYTADHLQWRYQGVSGRHCSLPLPALKGDCQLQNASAVLAALDVLEEVFPVPMDAIRRGLVEVTLAGRFQMISARPVIILDVAHNPAAARRLSANLETLPVKGCTYAVVGMLKDKDMAGTLRALKNNVDCWLISGLDVARGASANEVLQALEEAGVERRNILHAFPDVQSAYVYAHEHASDDDRICVFGSFHTVSPVMTGLGESDSX

SEQ ID NO: 19710 - protein, 392 aa, Nitrosomonas europaea
  unsure (1)..(392): unsure at all Xaa locations
MTNDLDPETLAIHTGVHRSQFNEHSESLYLTSSFVFDSAAQAAARFSGQEPGNIYSRFTNPTVTAMQERLAVLEGAEACIATASGMSAILTCVMGLLSAGDHIVASRSLFGSTVSLFNNILSRFGIQTTFVSATDPAEWQAAVRPNTRLFFLETPSNPLTEISDIAALAEIAKRAGVWLAVDNCFCTPIIQQPLKLGADLVIHSATKYLDGQGRVLGGAILGKRDLLMDSGIFSFLRTAGPSLSAFNAWIILKGMETLSLRVKAHSDHALEVARWLETHPRVGRVFYPGLPSHPQHELAMRQQKTGGGIVSFEVKGGREAAWRVVDAARLMSITANLGDTKSTLTHPATTTHGRISQEAREAAGIRDGLLRIAVGLESPDDLKADLARGLQX

SEQ ID NO: 19711 - protein, 353 aa, Nitrosomonas europaea
MTKLENDTFIRALLRQPVDYTPVWMMRQAGRYLPEYNQTRARAGSFLSLCKNPDFATEVTLQPLARFSLDAAILFSDILTIPDAMGLGLYFADGEGPRFERPLREEREIRSLIVPDPDTHLRYVTDAVRQIRTALNNRVPLIGFSGSPFTLACYMVEGAGSSEFRQIKTMLYARPDLLHHILGVTAQAVTAYLNAQIEAGAQAVMIFDSWGGALSHAAYQEFSLRYMNQILDGLKREHNGDRIPNILFTKGGGLWLESIMASGCDAIGLDWTIDIGEARRRTQDKVALQGNLDPAVLFSSPEVIAAEAGKILASYGHGHGHVFNLGHGISQFTPPENALALIEAVHAQSVRYH

SEQ ID NO: 19712 - protein, 531 aa, Nitrosomonas europaea
GKALLNDPVQNKSTAFTREERERYGLQGLLPYSVTDIGKQQQRVLANLRSKNSNIEKYGYLNDLLERNQRLFYRTLIDYIGEIMPLVYTPTVGEACMKFTQIFRKPQGFYITPEDRGKILPLFENWPENDVRIIVVTDGERILGLGDLGANGMGIPIGKMALYVACAGIRPEYCMPVMLDVGTSNQILREDPLYLGYPRPRLTGQDYLSLVEEFVAAVQNKFPQALIQFEDFSSQNAFRLLDRYAGSVRCFNDDIQGTAAVTLAGIYASCRITHKPFVDLKIMLLGTGSAATGVAELLLSAFMMAGLSEAEARSRISFVDRQGLVVTVREEIKPRVRSFASEHAAMDFVGAITAIRPDVLIGATGTAGAFDEIAIRQMARCQEHPVIIALSNPTSHTECTADQAYRWSDGRAVFASGSPFAPVTLDGRTRYPAQGNNVYIYPGIGLGMVASHARLVVEHMFLATAEELANCVLPEEIERGSIYPEIARVRDVSQKIAVKVCQVARQEGLAGVDLPDDLETYVYTLMYEPGY

SEQ ID NO: 19713 - protein, 392 aa, Nitrosomonas europaea
  unsure (1)..(392): unsure at all Xaa locations
MPTTRHYDIVIIGGGIQGAAVAQAAAALGYNVLVLEKTALAAGTSSRSSKLIHGGLRYLESGQFGLVWESLKERAALLRLAPSLVRLQPFHIPIYDQTSRDTLTIRAGLSLYALLAGLSKGAGFHSIPRRRWGELDGLSTRGLRHVFQYWDAQTDDQALTRAIMHSASSLGVELHCPAEFIHARISGEICEIEFLENNQAYQCTASSLVNAAGPWVSQVAERISPAPPAYPVELVQGTHLILEGSLDKGCYYLESPQDRRAIFALPWKQHILLGTTETVFEGAPDKALPLVSEENYLLGCFRYYFPDHGATVRERFTGLRVLPVSRNNPFGRSRETHLQCDSPESPRIVGIYGGKLTVCRATARKVLHTLRPSLPVRIPKADISQLTLKLPX

SEQ ID NO: 19714 - protein, 296 aa, Nitrosomonas europaea
  unsure (1)..(296): unsure at all Xaa locations
MSATIISGSLIASKFREELKQRVKILSETWMQPGLAVILAGDNPASCVYVRNKAKTCEELGIRSEIFNFPGDISQKALLQQIQDLNVNPEIHGILVQLPLPGHIRIDEVIAAIAIGKDVDGFHPCNVGALVTGHALFHPCTPFGVMKMLAEYDIPLQGQHAVIIGRSNIVGKPMALMLLEKGATVTVCTSRTRDLASHTRNADIVVMAAGKANLLTSDMIRTGATVIDVGINRLADGRLCGDVEFSGVKEKAGYITPVPGGVGPMTIVMLMNNTIEAAERAKAVALAGGWHSSVQX

SEQ ID NO: 19715 - protein, 429 aa, Nitrosomonas europaea
  unsure (1)..(429): unsure at all Xaa locations
MVKPGDSVQVEDPLIVLESDKATVEVPSPYSGIIREIRVQMGSKVSKDSEILTMEVVSAESDNKTTSSQPQPSAGSQPAQPTRPIETGAGQSEEEPAAKPAATTTKPATPSAPIQIPDHTIDQHNKIIPHASPSVRRFARELGVDLSKVVGTGPKQRILKEDVQAFVKQALTGGRNARGGTLDLLPWPHVDFAKFGPIELKSLSRIREISGANLHRNWVMIPHVTQFDEADVTDLEALRKNHNETRQNNGTKLTILAFLIKAVTAALKKFPEFNASLDNSTTESQLIIKRYYHLGFAADTPNGLVVPVIRDADQKGVIGIAEELTRLSSLAREGKLKPGDMQGASFTISSLGGIGGTGFTPIINAPEVAILGVSRASLKPVYQNGQFVPRLVLPLSLSYDHRVIDGASAARFTAHLASILADMRLALFX

SEQ ID NO: 19716 - protein, 391 aa, Nitrosomonas europaea
RNVVVLSGARTAIGDYGGALKDLAPATLAAITVREAITRASVDSDKIGHLVAGHVIPTEAQDMYLARVAALEAGLPQSVAALTLNRVCGSGLQAIISAAQAVMLGDTEVAIAAGAESMSRGGYLLPALRWGQRMQDSTAVDMMVGALTDPFDRVHMGITAENIAERWSITREQQDRFALESHRRAIHAVHNGYFREQIVPVEVSTREGVAMFDTDQHPRDNISMETLGKLRPVFREDGTVTAGNASGINDGAAALVLMEERAAERNHHQPMARLVAYGHAGVNPRYMGIGPVPAVKQALNRAGLDLAEMDVIESNEAFAVQACAVARELNFDPDKVNPNGGAVALGHPIGASGCILAIKAIYELQRINGRYALVTLCIGGGQGIAAIFEKL

SEQ ID NO: 19717 - protein, 538 aa, Nitrosomonas europaea
TRSPAWLALSAHQTEIANRPLRTLFDEDPQRFDKFSLQFKDLLLDYSKQPVDATTIRLLLALAEQQKLVDWLGRMANGEKINFTESRAALHIALRANSPVFMDGVDVTQEVRRVLRQIEQFVQKIHNQSHRGYSGLPITDVVNIGIGGSDLGPVMVTEALKPYHLPQLRTHFVSNLDGAHLSDTLQHINPATTLFVIASKTFTTQETLANAHSARKWFLAGGGSKQDIAAHFVAVSTNREAVSQFGIDPDNMFEFWDWVGGRYSLWSAIGLPIALAVGMEHFHSLLAGAQAMDDHFLTAPFEQNLPVILGLIGIWQINFFHITSQAILPYDQSMHRFPAYLQQLEMESNGKRVTRNGEAVDYSTGIIIWGEPGTNGQHAFYQLLHQGTQKFTADFLAPCRCHHPLSEHHPMLLANFFAQTEALMRGKTEQEVRSELANQNLSADLVEHLLPHRVFPGNHATTSILFKKLDPATLGMLIALYEHKVFVQSVIWEINPFDQWGVELGKQLAGKILAELALDKPVTGHDASTNGLINFYRA

SEQ ID NO: 19718 - protein, 479 aa, Nitrosomonas europaea
RVLFVTSEVFPLCKTGGLGDVSAALPAALRELKADVRLLVPGYPSVLSGLKYKRKLAEFDLLPHFPPTTLFSSRLQINESVSLPLYVIHCPELYQRPGGIYLDDDGQDWPDNAQRFGLLSKMGALLASDASPLSWIPDIIHCNDWQSGLTPAYLHYHSGKKAASLMTLHNLAFQGCFPPDEVARLGLPPESFSVHGVEYYGNLSFLKAGIYYATRITTVSPTYAREIQHEPLGFGLQGLLAERSNAITGIINGIDNTVWNPATDPHIVKKYSSRNLAAKKINKLALQREMGLEENETIPLFAGISRLSYQKGYDILLQVAPMLADLPAQLVLLGKGDQSLEKQLVMLAQTNPARIAVRIDYDEALSHRINASADCFLMPSRFEPCGLNQMYSQRYGTPPIVHTTGGLIDTVTDLAPDTPAGESASGFHFHEMTADAFMNGIGRAIDAYYNTRLWKTLQHNGMRKDFSWRSSALAYLSIY

SEQ ID NO: 19719 - protein, 425 aa, Nitrosomonas europaea
EMQFQDIRLAVVGLGYVGLPLAVEFGRKRSVVGFDINQRRIDELKNGNDFTLETTREELAAAKYLTYTTNIDDLRDCNCYIVTVPTPIDEHKRPDLTPLIKASETVGKVLKKGDIVIYESTVYPGCTEEDCVPVLERVSGLKFNQDFYCGYSPERINPGDKEHRVTTIRKVTSGSTSEVADLVDELYNEIITVGTHKAESIKVAEAAKVIENTQRDLNIALINELALIFNKMGIDTEAVLKAAGSKWNFLPFRPGLVGGHCIGVDPYYLTHKAQAIGYHPEIILAGRRLNDSMGTYVVAQLVKAMTKKRIQVEGARVLVMGLAFKENCPDLRNTRIVDIVAELKDYNCVVDVYDPWVSLQEAQHEYGITPIGTPKPGSYDAIILAVAHHQFKDMGASAIRALGKPDAVLYDLKYVLDPQGADLRL

SEQ ID NO: 19720 - protein, 1160 aa, Nitrosomonas europaea
LTEIKLAGFKTFVDPAVVPVPGNLVGIVGPNGCGKSNVIDAVRWVLGESRASALRGESLQDVIFNGSATRKPIGRASVELVFDNSSGKAAGQWKSYSEIAIRRVIQRDGESSYYINNIHVRRRDITDMFLGTGVSGRGYAIIEQGMISRIIEARPQELRTFLEEAAGITRYHEKRHETGLRLADARGNLQRVDDILEELDKQQQHLEAQAECAVRYQDLHRQLTAAQHTLWTLHKQQAAESRHQAQVEVERLVQEMETIRSGMQETGEKLDELRLYHRVVNDRQHQIQGALYAANGEIARIEQNIRHIRANREQLDRQLAEAELQLQNHEQQLNEVNENLTSWQDKLEQAKNCHLSCKEEHIVEAGKLPQMESAAQADQVRLIGLREKLALARQNEKLLQNQQAYAEKTLHQLVVRRERLLEEQSSQPEIDPVQLDELQMESAELAAMLEQKQHSLSTLETQAYTVQQERDAILQIIQSLERDMARANARCDVLQRLQDQIEDNQELNAWMARLQLNLLPRLWQQISIESGWETALEAVLRERIQAVTVDRLEQMLEWEAQRPSAKWAVCELVPDRPVSNDTDQRTWKPLSTLLSCRSPAVQAVLGNWLYGVFVTDSLTAALADRSLLTSGEMLVTAEGHSITSCGVSYFAPDSAVHGILQRQREIAQIREECEQIGQSVLSQQQTLAAVEQDDQQIAADIVQLRKVIEEIRTQQHDRQIQIVRLTQQIERVAQQQAQLEIELADLAVQIEEESSQKQQAETELVVCEAERVELEAQVNQAESACQSSGRALASQRSRVQRLSDRLHETAFGEQDCQNRVIDCERRIGMITRNSVILTENMQRLQHARADLDESTLTADTVHWQIQRDQHEQALMAVRHELENMDDTLREMEQARMYAEQRLQECGEAVGQARLREQEAEMTEARFADKLAESGETMLEMVPQFVNESPAKLQTRINRLTGEVTALGPVNLAALQELEALKSRRIHLEEQSHDLREAITTLEQAIRQIDRETRERLQETFDQVNQNLAGLFASIFGGGVAELVLSGEDILDAGVQLNAHPPGKRNSSIHLLSGGEKALTALALVFSLFRLNPAPFCLLDEVDAPLDDSNSVRFCELVKRMSGETQFLFISHNKITMQMAQQLIGVTMREQGVSRVVTVDI

SEQ ID NO: 19721 - protein, 459 aa, Nitrosomonas europaea
MDQYREEHDAIGTVQVPASALWGAQTQRSLNNFNISGERMPSALIHALALVKRAAASVNHDLGLLDENIARAIITAADEVLAGEHAGEFPLVVWQTGSGTQTNMNMNEVLANRASEILGGTRGKGRKVHPNDHVNKGQSSNDVFPTAMHIAAVEAIRNRLIPALEALRKTLSSKSAAFSDIVKIGRTHLQDATPLTLGQEFSGYVSQLDHGLAHLESALPHLLELALGGTAVGTGLNTHPEFARRVAAEIARLSGYPFITAANKFEALAAHDALVHAHGVLKTLAAILIKIANDVRWLASGPRCGIGEILIPENEPGSSIMPGKVNPTQSEAVVMLACQVMGNDVAINLGGAMGNFELNTMKPLIIHNFLQSTRLLADGAESFNTHCAAGITANTVRIKQHLQESLMLVTALNPHIGYDKAAEIAKKAHHEMLTLKEAAIRLGYVTAEQFDVWVDPQKM

SEQ ID NO: 19722 - protein, 366 aa, Nitrosomonas europaea
RQQEGLYRSRPVLEGPQSPHVTIDGRDFLAFCSNDYLGLANHPALIEAAAEGARCYGVGSGASHLISGHFRAHHELEEALAAFVGLPRTLLFSTGYMANMAVVTALAGRGDAIFADRLNHASLNDAALLSRARFIRYPHLDLDTLARQLETTKARRRLVVTDAVFSMDGDMAPVAELLTLCQRFDAWLLLDDAHGFGVLGERGKGSLYHSQRIERDTPYLIYMATLGKAAGVSGAFVAAQAPVVETLIQHGRTYGYTTAAPPLLAHTLLTSLQLISQESWRRERLALLIERLRQRLHSLPWPLLLSETPIQPLLVGESQEAVRLDLALRERGIWVPAIRPPTVPQGMARLRISLSAVHTEADVDRL

SEQ ID NO: 19723 - protein, 490 aa, Nitrosomonas europaea
MDNLFDVAVIGAGPGGYVAAIRCAQLGLNTVCIDDWKNEQGKPSLGGTCLNVGCIPSKALLESSENFERAGHKFAEHGIKVDGLSIDVPAMIARKNKIVKAFTGGIGMLFKKNKVTALHGRGTLQKHDQARDGGDDSWEIQVSADGKEQSVHARHVIIATGSTPRTLKVAPVDGNNVLDNAGALALQQTPGKLAIIGAGVIGLELGSVWRRLGAEVTLLEAQADFLPAADEQVAKEAYKALTRETGLTIHTGVEIKSTRASENGVEIDYVDRDKNAQNLKVDKLIVAVGRVPNTSGLGAEAAGLKLDERGYISVDEFCQTSLQNVYAIGDVVRGPMLAHKASEEGVAVAERIASGRQGATDSSGHVDLGMMPWVIYTAPEIAWVGKTEQTLKAEGVAYKAGQFPFMANGRARALGETTGFVKILADAESDRILGVHMVGPYVSEMIAEAVVAMEFSASSEDLARIVHAHPSLSESLHEAALGVDKRAIHI

SEQ ID NO: 19724 - protein, 431 aa, Nitrosomonas europaea
MARNVVVIGTQWGDEGKGKIVDWLTDRATGVVRFQGGHNAGHTLVVGGEKTVLHLIPSGILRENVTCYIGNGVVLSPGALLEEVDMLEQAGVDVSGRLRISETCPLILPYHIAVDGARELAKGMEKIGTTGRGIGPAYEDKVARRAIRLQDLFRPERLACKLKEVLDYHNFLLKNYYHAATVDYHQVLDDCQIKAERIRPMVADVPKLLFEASQADNNLLFEGAQGALLDIDHGTYPFVTSSNCIAGAASVGSGVGPQMLNYVLGITKAYTTRVGSGPFPTELSDATGEHLAQRGNEFGSTTGRPRRCGWFDAVAARRSIQINGVSGLCITKLDVLDGLETLRIGVGYKSKQSGEMYDALPFGADDLAAAEPVYEELPGWQERTAGIRNFDQLPQAAQNYLKRMEEVCQTPISMISTGPDRTETIVFHHPF

SEQ ID NO: 19725 - protein, 770 aa, Nitrosomonas europaea
NLPELPADVIALVPMRNVVLFPHVIMPVAVGRTRSIAAIQHTLQSKVPVGIVLQKNPSVDEPGLDALCQIGTIANVVRHIASEDGTHHAVCLGVERFRIEALVEGYPFLAARIRRIPEAIPDTTQVEALTLQLRERAMEIVSLLPSVPAELAHALQATRAPSDLADITASLLDTEVAEKQKLLETIDIEERLHSVLQILARRIEVLRLSQEIGERTKEQMEDRERKFLLREQLRTIQKELGEDGENEQEVVKLEEAITAAGMPTDIEQQTHKELQRLQRMPAASSEFSMLHTYLEWMTELPWQLPEDKPIDLDAARTILEADHFGLERIKQRIIEFLAVQKLKPQGRAPILCFAGPPGVGKTSLGQSIARALQRPFVRVSLGGVHDEAEMRGHRRTYVGAMPGNIIQGLRKAGARNCVMMLDEIDKMTASAHGDPAAALLEILDPEQNSTFRDNYLGVPFDLSRVVFIATANVIDQIPPPVRDRMEIIDLPGYTQEEKLQIALRYLVQRQSEANGLQTDQCMLTSAALQGIIANYTREAGVRQFEREIGRIMRHAALQIAQGTQQQVQIDAQNLEDILGPEKYEHELALHTDLPGVATGLAWTPVGGDILFIEATRINGSGRLILTGQLGDVMKESAQAALTLVKARAEDLHIPTSVFEGIDVHLHVPAGAIPKDGPSAGVAMFIALASLFANRPVRHDVAMTGEISLRGLVLPVGGIKEKILAAQRAGIRTVLLPARNRKDLHDVPEATRTAIQFVFLETADNAVQAAL

SEQ ID NO: 19726 - protein, 566 aa, Nitrosomonas europaea
  unsure (1)..(566): unsure at all Xaa locations
MNFILLKERHMMNKLPQQEENRRTVENRKNYLLRRQAQYQYAYEYANTIAVVRKLPCREIPGPGYWLRGGINLLQLIPSLPSLLVTYMRYLLGKPMESYRDYIFYPFSPPNPALVDNFQQDLIFGLQRVIGVNPVVLRAVTSQHPLPQKLPESEIQRVFAKYVDETDYATAITQKRVYILDYADLEILQRNPGQIDGGRKQYVTTPIVVLFLQADGILRPIAIQLYQDAGPDNPIYTPNDGNLWLAAKTFAQVADGNHHILVTHATRIHYVMEAIIMASRRQLYKSHPLCVLLNPHLRHTLNVNHQHTFLRDRKGRPGRYGELFAGDYDATTQCMANGMTSFDFRASAFPNDIASREVDNPDLFYPYRDDGVLLWNAIQHFATEYIDVCYQSDGDVAEDCEIQAWAHDIGARDRGRIPGFPARFASRQELAETIGHVIFLCTAFHSCIHFNQYKYPGFVPNMPHSAYAPPPVGKGAEMDADGLLKFQPAFRAAYSQTWTYFQTNFTVNRIGQYPLRQFDPAARDVIERFRKRLQEIEGRIDQRNSSRPVPYDRMNPRIIPNGVTVX

SEQ ID NO: 19727 - protein, 206 aa, Nitrosomonas europaea
  unsure (1)..(206): unsure at all Xaa locations
MPVRTGQIISSFNNPACMFQQPRLLPWKSTLDNIALGLKAAGTGRDERTRRARMLGLQTGLAHEDLGKFPHQLSGGMQSRVALARALAIMPDLLLLDEPFSALDIGLKAELYALLLHHLNTCSLGVLMITHDLMEAIRLSDTILVMAPSPGRIVHRFRIDLPAMQRDDAFVYKMTAELLQDSAVRTSFRLAPIKSELLTRQELPCX

SEQ ID NO: 19728 - protein, 667 aa, Nitrosomonas europaea
  unsure (1)..(667): unsure at all Xaa locations
MSISPTFSGSSLQKSSLSDHSTISEPFTVVDRVNGISAVALDDAITRARSALLAQQREDGHWCFSLEADCTIPAEYILMMHFMDEIDTALERRIANFLRNRQVTDGHGGWPLYYGGDFDMSCSVKVYYALKLAGDSPEAAHMVRARNAILERGGAARSNVFTRLLLAMYRQIPWRGVPFVPAEIMLLPRWFPFHLSKVAYWSRTVMVPLSILCTLKAKAANPRNIHVRELFTVDPEMEKNYFPVRTPLNHLLLYLERLGSKLEPLIPSFIRRRALKKAEQWTIERLNGRDGLGAIFPAMVNAYEALTLLGYDHDHPLLQQCRLALRELLVNEGEDITWCQPCVSPVWDTVLASLALQEDERADNGPVRHALDWLVPLQALDQPGDWRNSRPDLPGGGWAFQYANPHYPDLDDTAAAAWALCQADTEDYRTSITRAADWLAGMQSSNGGFAAFDIDNVHYYLNEIPFADHGALLDPPSSDVTARCIGLLALNGEARHQETVKRGLTFLFNEQEPSGAWFGRWGTNYVYGTWSVLEALKLARVDHDHQAVKRAVQWLKSVQRADGGWGETNDSYLDSELAGQLETSTSFQTAWAVLGLMAAGEVGSTAVRNGIDYLIRTQSAAGLWEEPWFTAPGFPKVFYLKYHGYSKYFPLWALNRYRAMNSRSVVX

SEQ ID NO: 19729 - protein, 324 aa, Nitrosomonas europaea
  unsure (1)..(324): unsure at all Xaa locations
MSDDDQIRIDGAIARKTPYGMLREPTFSGMLSFMRCNFRKDLTGAELVISGIPLDLAVSYRSGARFGPLGIRQASAEVASLKPYPWGFDPFEHLAVIDSGDCFLDVHNPLTIHGAIVDHARHILASGARMLTFGGDHSISYPLLQAHVEKTGAPLSLIHFDAHCDTWPDDSLASLNHGSMFYKAVREGLIDVKRSVQIGIRTWNDDFMGINILDADRIHRQGTDAVVAEIERIVGTQPAYLTFDIDCLDPAYAPGTGTPVCGGLSTAQALAIIRGLTAINLIGMDIVEVSPPYDHSQITALAAAHIACDLICLLAKRKADGLLX

SEQ ID NO: 19730 - protein, 742 aa, Nitrosomonas europaea
MTALLTDLNPEQLEAVTWSHQSALVLAGAGSGKTRVLTTRIAYLLQSGRTRPQNILAVTFTNKAAREMVARIGAMLPVNTRAMWVGTFHGLCHRVLRAHHEDAGLPQAFQILDMADQLAVIKRVLKERSLDEKMLPPRQLQWFINNAKEEGLRASQVDVHGGFNQTLAECYQAYEIVSMREGTVDFAELLLRCYELLSRNEILRDHYRSRFEHILVDEFQDTNRLQYKWIKLLAGPGSQQHAAIFAVGDDDQSIYAFRGAHVGNMRDLEKDFSVPKIIRLEQNYRSHGNILDAANALIEHNKGRLGKNLWTAAGKGEPVRVYHAATDMDETSFIIDEIKALHADGLALSDIALLYRSNAQSRVLEHGLFNASVSYRVYGGMRFFDRQEVKHALAYLRLIALPDDDNALLRIINFPPRGIGARTLEQLQDQAAMLGTSLWQAAFKVYEGGKAVATRNSQPGRGIAGFVSLVLSMQQDGEGLPLPEIIRRVIDQSGLAAHYQAEREGGERLENLKELINAATSFVHESEDDSLTAFLAHASLEGGEHQAEGYQDAVQLMTVHAAKGLEFHSVFISGLEEGLFPHENSRNEPDGLEEERRLMYVAMTRARQRLYLSYAESRMLHGQVRVNIPSRFIDEIPQDLLKRLRSDFSGRSFRQGVSGTGQTVASTINSSQKGRSTMAAAVGMTSSGLNSAGFHVGQQVSHAKFGTGIILNYEGSGTDMRIQVNFHQAGTKWLSLAYAKLE

SEQ ID NO: 19731 - protein, 305 aa, Nitrosomonas europaea
KIGVLMINLGTPDAPTAKALRAYLKQFLSEPRIVEFPRWLWWFILNGIILNVRPAKSAKKYEQIWTSEGSPLRVHTARQTALVAALLEQQADSSLVVEYAMIIGNPSIAEKLQQMKVQGCDRILVLPLFPQYAASSTGCVLDGVFSELRKMRNIPDIRTVRHYHDDPGYIAALAQNVRDYWEKHGQPDKLIISFHGVPRKTLEMGDPYHCECQKTGRLLAEALELADDRYQICFQSRFGFAQWLGPYTAEILAELGKQKTGRVDVVCPGFVSDCLETLEEIALEGKAIFTEAGGGEFHYIPSLNE

SEQ ID NO: 19732 - protein, 552 aa, Nitrosomonas europaea
MLQNLSIRNFIIVDHIDLHFKSGFTVLTGETGAGKSILIDALELVLGRRADTSQIRYGCKRAEITAQFSVNTIPALQEWLVENALEDETGICLLRKIMESGGRSRNFINGHPATLQQLRTVGEWLVDIHGQHAHQLLMHGHKQCELLDAWAGESNLAREVASAYRHWQDLCQQRLAWEQHSEQNLQEHETLTWQLQELAALNFSLEEWENLQIEHNRLTHTASLLETAQFSLESLSENETAVLAQLSTVLTRLNSLIDIDNTLEPLCNQLQSAQIQLQEIVYELKRYQQHLDIDPRRLQETETRIAAIHGTARKYRIMPEILPDLLETTRQRLESLENAASSEALMKAEKSARNNFENLAARLSQARQHAADQLSGLVTETMQTLAMAGGRFNVALIPIPSGNLHGMEQIEFQVSAHRDLPLRPLNKVASGGELSRISLAIQVITSKAGTVPTLIFDEVDTGIGGRIAAIVGKLLQQLGKTRQVMSITHLPQVAARGDHHWRVSKTSETEDEQLPASHISELDAAERTEEIARMLGGENLTAATRQHAAEML

SEQ ID NO: 19733 - protein, 341 aa, Nitrosomonas europaea
INAGIVGGTGYTGVELLRILVQHPKVKLKVITSRQEAGTGVDELFSSLRGQIALKFSDPAKVDFSKCDVVFFATPNGIAMQQAKALLDSGIKVIDLAADFRIKDVAEWEKWYGMTHAAPELVAEAVYGLPEVNREKIRDARLIANPGCYPTAVQLGFIPLIEAGAVDADHLIADTKSGVSGAGRKAEIHTLYAEASDNFKSYAVPGHRHLPEIRQGLSERSNGPIGLTFVPHLTPMIRGIHATLYARLTRDVDLQTLYENRYANEPFVDVLPAGSHPETRSVRGSNFCRIAVHRPGNGDTAVILSVTDNLVKGAAGQAVQNMNIMYGLPETTGIRHVPLLP

SEQ ID NO: 19734 - protein, 332 aa, Nitrosomonas europaea
  unsure (1)..(332): unsure at all Xaa locations
MHTRRNNNPFLYSCLTLFILIFLSLSSSLAQAGKVREYWIAAEKTDWNYAPTGANQIDLASDLGVWGKTLTYTKYRYIGYTDGSYSHPLPQPEWMGILGPTIRAAVGDTIKIHFLNKTDMPLSMHPHGVMYDKDNEGADGGKGGSIPPGERYTYTWIVDQDAGPGPGDPSSIVWLYHSHVMAEEEVNLGLIGTLIITAAGKAYSDKNPAPRDVDQEFIALYMIFNEENDEESGLKHAINGRIFGNLSGFETRRGQRVRWHLVALGNEVDNHTVHWHGQTVLDHGRRTDVVEIMPASMTSVDMVPRSPGNWLFHCHVNDHMIAGMATRWLVKX

SEQ ID NO: 19735 - protein, 613 aa, Nitrosomonas europaea
  unsure (1)..(613): unsure at all Xaa locations
MNPTTHTLPTHNLDMISVETARTLDGLFRERVRRSPHATAYRDYDVSEEIWRDYTWDDMANAVKRWQMALSQENLSPGDRVAVMARNCPQWVMFEQAALGLGLVVVPLYTEDRAENAAWCLDNAGTALLLLENMTRWEAMNEAMTGLQQLKRIVILDASPEDVRQTGDKRAIALQDWLPETPGDIPSVQNDPHVLATIIYTSGTTGRPKGVMLSHNNILSNAYSSAQVVTVRPDDVLLSFLPLSHTFERTAGYYVPMLCGATVAYARSIRQLQDDLLIIRPTILISVPRIYERIYAGIQAKLAEGPAISRLLFKLAVDIGYSRFERQQKRVGWRISHLLWPLLDKLVARKVMEKLGGRLWQVMSGGAALSPEISRVFIGLGLPILQGYGLTETSPVVCANRLDDNLPSSVGRPAPGVEVRLGEQNALLIRGPNVMLGYWNNPEATHAILSADGWLNSGDTASIDAQSRVTITGRLKDIIVTSTGEKIPPADMEAAILRDPIFEQVMIVGEGRSYLSALTVLSKRGWEVVATHCNAKNDPHALACDEYAEEIILEKIARQISGFPGYAKVHRALLISEPWTVENEMLTPTLKLKRKKIYEHYQGEIDQLYASRX

SEQ ID NO: 19736 - protein, 276 aa, Nitrosomonas europaea
  unsure (1)..(276): unsure at all Xaa locations
MKLKFTKMHGLGNDFIVIDAINQSVSLDPATIRRWADRHFGIGFDQLLVVEKPGESGDFRYRIFNADGGEVEQCGNGARCFARFVRDHDLTRKNTIRVETACGIIMPTVEENGEVSVDMGIPRFDPARIPFITQERALTYPLNVNDREIEISAVSMGNPHAVQIVPDIDLAPVTSEGPAIESHPFFPEKVNAGYMQIVDRTHIRLRVFERGTGETLACGTGACAAVVSGISRGLLDSEVQVTMRGGNLRIRWEGEDQPVWMTGPAVSVFEGTIDLX

SEQ ID NO: 19737 - protein, 577 aa, Nitrosomonas europaea
  unsure (1)..(577): unsure at all Xaa locations
MRTLITYIMVFPKRSAFVLVALLLAGIAEALSLTALLPLLSIAVGESIDSSMGKLVVDTLHQVGLSPTLEIILLVIVGGMFLKGAILLLTNQQVGHTVAHVATALRLDLIKALLASRWQYYLRQPAGALANSIATEAYRAAMGFEHSVNVLALAIEALVYGIVALFISWEATLASLLIGTILFVVLNRLVRAAKRAGNKQTHLLRHLLTYLSDVLGSVKSLKAMARDNVADAILHEQTRMLEKATRKEVTNRAALLALQEPILAALTASGLYLALVVWKLSLPEVMVMVFLLTRILGLLNKTQRRYQQLVAQESAYWALRNAAEEARMEAERSTGTLVPTLEQGLNLRHIVFGYERKTIFSDLNLEIPVHSFTALIGSSGAGKSTLLDLLCGLAEPKSGEILIDGVSLHHIDLRRWRHMIGYVSQDTVLLHDTILNNILVGEPAISVEDAERALRQAGAWDFVSSFPDGIHTVVGERGGMLSGGQRQRIAIARALAHQPKLLLLDEPTSALDPESERIICATLQNLAKEFTIIAVSHQPAVINAASQVFIVSNGKAELLSDAAAHLPDITGAKEGNX

SEQ ID NO: 19738 - protein, 277 aa, Nitrosomonas europaea
  unsure (1)..(277): unsure at all Xaa locations
MDTYAVIGNPVAHSKSPFIHARFAQQTGRIIHYTALLAPLDRFEQTVLDFRKTGGKGMNITVPFKFEAFTLASRLTDRASAARAVNTFRFEETGEILGDNTDGVGLIRDIEVNLNFPLAGKRILLMGAGGAASGVILPLLQQQPDLLAIANRTPDKAVSLQRQFASYSNITTGHYHDFAGQHFDLIINATSASLHNELPPVPADLFRNAFAYDMLYSSRLTPFLELARVQGAGYLADGAGMLVEQAAESFLLWHGIRPETQTVIRQLRDNLRHPTSX

SEQ ID NO: 19739 - protein, 321 aa, Nitrosomonas europaea
  unsure (1)..(321): unsure at all Xaa locations
MTMYSRIIGTGSYLPEKVLTNQDLESMVDTSDEWIRTRTGIERRHIAAEGQMASDLALEASRNAIEAADIQAKDIDLIIVATTTPDMIFPSTACILQNKLGMSNGPAFDVQAVCSGFIYALATADMFVSSGKARNALVVGAEVYSRIMDWNDRSTCVLFGDGAGAVILTRDQKPGILSSHLHADGSYSQVLTAPASIHSGKIQGTPFITMEGGTVFKFAVKVLEEAALEALQANQLQPSDIDWLIPHQANIRIITSTAKKLGIPEEKVVATVSQHGNTSAASVPLALDQAVRDGRIQPDQHIVLEGVGGGFTWGSVLVRWX

SEQ ID NO: 19740 - protein, 313 aa, Nitrosomonas europaea
  unsure (1)..(313): unsure at all Xaa locations
MKAAFVFPGQGSQSVGMMNSYSELPSVRGTFNEASDILQQDLWSLVSNGPEDSLNLTTNTQPVMLAADVSIYRAWQQAGGIEPHYLAGHSLGEYAALVAAEVLTFTDALKLVRYRAKVMQETVPEGTGGMAAIVGLDDDIVSSVCTEVINAMPDTSLEPANFNAPGQVVIAGHSQAVARAVVLAKSKGAKLAVILPMSIPSHCSLMQSAAEKFALLLEEIALQPPRIPILHNADVQQHSETASIREILVRQLYRPVRWTETIQAIAAQNVKYVVECGPGKVLSGLNRRIDKNLENIALTDSGSLLKTVETLKX

SEQ ID NO: 19741 - protein, 248 aa, Nitrosomonas europaea
  unsure (1)..(248): unsure at all Xaa locations
MLLEHKIALVTGASRGIGKAIALELGKHGATVIGTATSETGAGHISQYLSEARISGMGLIMDVSNIEHIKSGIETIQQSLGDVAILINNAGITRDNLLARMKDDEWDNVIQTDLKSVFCLSRAVLRTMMKARSGRIINISSVVGATGNPGQTNYAAAKAGMIGFSKSLAKEIGSRNITVNCVAPGFIDTDMTRSLSPDQQQSLIQHIPLGRFGRPEDVAAAVVFLASPAADYITGATLHVNGGMYMEX

SEQ ID NO: 19742 - protein, 86 aa, Nitrosomonas europaea
  unsure (1)..(86): unsure at all Xaa locations
MGVSMEITEIEQRIKKIVAEQLGVNESDVKNESSFVSDLGADSLDTVELVMALEEEFECEIPDEQAEKINTVQEAIDFVAANAAQX

SEQ ID NO: 19743 - protein, 344 aa, Nitrosomonas europaea
  unsure (1)..(344): unsure at all Xaa locations
MDIFIQYGMAAAIQAIRDAGISDVSGFNADRIGVNIGSGIGGLPMIENTDAAYHAGGPRKISPFFIPSTIINMVAGNLSIMFGYKGPNLAIVTACTTATHCIGSSARMIEYGDADIMVCGGTESCVTPLAVGGFASARALSSNNDDPAAASRPWDLKRDGFVLGEGAGILVLEEMEHARKRGAKIYAELAGFGMSADAHHMTAPCEDGEGAARCMTNALSDAQMHADELHYINAHGTSTPLGDIAETIAVKRCFGEHAKDLAVSSTKSMTGHLLGAAGGVEAIFSALAVYHQIAPPTINLDDPDPACDLDYVPNNAREMKIDAALSNSFGFGGTNGTLVFRKIX

SEQ ID NO: 19744 - protein, 874 aa, Nitrosomonas europaea
  unsure (1)..(874): unsure at all Xaa locations
MNKAEQSSHTPMMQQYLRIKAQHTDKLLFYRMGDFYELFYEDAEKAAKLLDITLTQRGSSAGEPIKMAGVPFHAADQYLARLVRLGESIAICEQTGDPATSKGPVERQVIRILTPGTLTDAGLLEERSNSIVLALALHRGSIGLAWLNLAAGDMRVLETSSDNLTSELERLHPAEILLPESLDLPATLNNFAGPKRLPDWQFDYEHAMQQLTRQFGTRDLNAFGCEDLHAAIMAAGALFEYVRLTQQTATDGSSGQLPGHLHTLQVERQDAYLRMDAATRRNLEITLTLRGEDAPTLSSLLDTCSTGMGSRLLRHWLHHPLRNRITLQQRLDTVSDLIGAQPETLYAGIRQQFKHIADIERITSRIALRTARPRDLSGLRDSLMRLPGIIELIATSAAAAVHRFIPPMQPDPLLTQLLVRALQPVPGAVIREGGVIADGFDAELDELRGLQGNCDEFLLQLEARERERTGIPNLKVEYNRVHGFYIEVTRAQGEKIPPDYRRRQTLKNAERYIIPELQAFEHKTLSAREQALAREKMLYERLLEQLADFIIPLQEIARSVAELDVLCAFAERAALSGYTKPVFTDDPVLIIEAGRHPVVENQVEHYIANDVQLGAITRENRQMLVITGPNMGGKSTYMRQTALTVLLAHCGSFVPAQIARIGPIDQIFTRIGAADDLAGGRSTFMVEMTEAAGILRNATAQSLVLVDEIGRGTSTFDGLALAFAIARHLLTQNQSYTLFATHYFELTRLAEEFPQAVNIHVTAVEHKRRIVFLHRIEEGPASRSYGLHVAALAGVPDRVIRNAAKILARLEQETLSRSPQQTLFETVEENAKAVPASVHPVLDYLERIHPDELTPRGALEQLYLIKSMLNQTDX

SEQ ID NO: 19745 - protein, 415 aa, Nitrosomonas europaea
MYQHIKVPTTGSKIRVKDDSSLVVPDNPIIPFIEGDGIGVDITPVMISVVDGAVKKAYGDSRKISWMEIYAGEKSTRVYGQDIWLPDETLQAAKEFVVSIKGPLTTPVSGGIRSINVALRQLLDLYVCLRPVRYFQGVPSPVKQPEKVDMVIFRENSEDIYAGIEWEAGTEAVEKVINFLTAEMGITKIRFPRSSAIGIKPVSKEGSERLIRKAIQYAIDHKRRSVTLVHKGNIMKFTEGAFKKWGYELAAKEFGAELLDGGPWMILRHNGNEIIIKDVIADAFLQQILLRPDEYDVIATLNLNGDYISDALAAQVGGIGIAPGANMSDSIAIFEATHGTAPKYAGKDQVNPGSIILSAEMMLRHIGWHEAANIVISSMEKTIQDRIMTYDLARLTPNAKQATSSEFGNAMVARM

SEQ ID NO: 19746 - protein, 233 aa, Nostoc punctiforme
  unsure (1)..(233): unsure at all Xaa locations
PDIALIKTYLLTLQDNICAALAQADGHAEFTEECWVREEGGGGRSRVLVNGAVFEQAGVNFSHVSGAMLPASATAHRPELAGRSFQALGVSLVIHPLNPYLPTSHANVRFFIAEKPGEDAVWWFGGGFDLTPYYGFEEDAIHWHQVAHSLCQPFGEQIYPRYKKWCDDYFYIKHRQEARGIGGLFFDDLNSPDFMTCFNFTQAVGDGFLAAYMPIVARRXALAWGDRERXFQL

SEQ ID NO: 19747 - protein, 70 aa, Nostoc punctiforme
KVKKIVIEQLSVEDASKITPQAKFMEDLGADSLDTVELVMALEEEFDIEIPDEAAEQIVSVQDAVDYINN

SEQ ID NO: 19748 - protein, 245 aa, Nostoc punctiforme
  unsure (1)..(245): unsure at all Xaa locations
AVXPAAARGEITFEQVSFHYPQARTGAALQEVSFHVPAGQIVALVGPSGAGKSTVARLLLRYADPDKGHIRIGGVDLRDMQTDTLMKQLSFVFQDNFLFADTIANNIRLGAPDTPLEAVIAAARVAQAHDFISALPEGYNTRVGERGVFLSGGQRQRITIARALLQDRPILVLDEATAFADPENEAALIKALAAAMRGRTVIMVAHRLSMVTQADVILLFSDGQLREMGNHTQLLAXGGLYQRLW

SEQ ID NO: 19749 - protein, 221 aa, Nostoc punctiforme
  unsure (1)..(221): unsure at all Xaa locations
HPYVPTVILNIALEAGQWVVGGVXLXTYYPFAEDAAHYTXPLXQACDKHPPRVLPVFKKWCDEYFYLKHRDETRGVGGLXFXLPDGQGALYRGPNPNGEAAIYSNQVGTPATRNWEDLFAFVQGCGRAFLPAYVPIVERRHGMEYGDRQRNFQLYRRGRYVEFNLVYDRGTIFGLQTNGRTESILMSLPPLVRWEYGYQPEPNSPEAELYETFLKPQDWIN

SEQ ID NO: 19750 - protein, 345 aa, Nostoc punctiforme
KAYSAASATSPMSSTQIARRDPTEHDVQIEILFCGICHSDLHSVRNEWSSIISTVYPIVPGHEIVGRVTEVGSAVTKYKPGDLAAVGCLVDSDGTCLNCKAGLENFCPNQILTFNSPDKHLGGVTYGGYSDSIVVDERFVLRVPSNLDLAGAAPLLCAGITTYSPMRHWGVTEGKKVGLVGLGGLGHMGVKFAHAFGAHVVVFTTSPDKKEDALRLGADEVVVSRNADEMQKHAGSFDFILDTVSAKQNINAYLNLLRLDGNITLVGAPEKPLDVAAFSLIMARRSLSGSNIGGIPETQEMLDFCGKRGITADVEVIPIQKVNEAYDRLLKSDVKYRFVIDMASL

SEQ ID NO: 19751 - protein, 246 aa, Nostoc punctiforme
IKDKVVIITGASSGIGEASAKLLASKGAKVVLGARRDRQLRQLVDEIQRDGGQAVYQVMDVVNPSDSAEIVNLAKERFGGIDVIFLNAGIMPNSPLSALKTDEWNQTVDINIKGVLNGIAAVLPTFISQKSGHVITTSSVAGLKAYPGGAVYGGTKWFVRDFMEVLRMESAQEGTKIRTATIYPAAINTELLNQITNQDMAEKMTELYEQYGISPDRVANVVAFAIDQPEDTNVNEFTIGPTTQPW

SEQ ID NO: 19752 - protein, 198 aa, Nostoc punctiforme
  unsure (1)..(198): unsure at all Xaa locations
GNYTGKVAFVTGAANGIGRATALAFAREGANVVVADVSEQGNQETVRLIEDLGGRVLAVKCDVTRTEDVTAALSKTIETFGRLDFAFNNAGVEQKKAATAELEEAEWDRIVNTDLRSVFLCLKHEIPLMLKQGGGAIVNTSSGAGVIGIKGGAAYTAAKHGVIGLTKAAALDYASQNIRINXVCPGYIDTSMMDRFTG

SEQ ID NO: 19753 - protein, 473 aa, Nostoc punctiforme
MNIKKFAKQATVLTFTTALLAGGATQAFAKETNQKPYKETYGISHITRHDMLQIPEQQKNEKYQVPEFDSSTIKNISSAKGLDVWDSWPLQNADGTVANYHGYHIVFALAGDPKNADDTSIYMFYQKVGETSIDSWKNAGRVFKDSDKFDANDSILKDQTQEWSGSATFTSDGKIRLFYTDFSGKHYGKQTLTTAQVNVSASDSSLNINGVEDYKSIFDGDGKTYQNVQQFIDEGNYSSGDNHTLRDPHYVEDKGHKYLVFEANTGTEDGYQGEESLFNKAYYGKSTSFFRQESQKLLQSDKKRTAELANGALGMIELNDDYTLKKVMKPLIASNTVTDEIERANVFKMNGKWYLFTDSRGSKMTIDGITSNDIYMLGYVSNSLTGPYKPLNKTGLVLKMDLDPNDVTFTYSHFAVPQAKGNNVVITSYMTNRGFYADKQSTFAPSFLLNIKGKKTSVVKDSILEQGQLTVNK

SEQ ID NO: 19754 - protein, 196 aa, Nostoc punctiforme
LTLYHSPISPNSRRVWITLLEKGLEFELVDIKLDGEQFQPEFLAINPFHHIPALVDDDFNVVESLAILDYLEAKYPTPAMLPKDAKDLAIARMVQLVTVNELLPAATTFLPQILGLPGADPEKIEKAKHKIATVLKFFENLLDDRPYFASHNLTLAEVVAGTVVNVLPSVGIFLSEYPKLNAWHDRLIVRPSWQAT

SEQ ID NO: 19755 - protein, 158 aa, Nostoc punctiforme
MGVSGSGKTTIGKLLADSLSWEFSDADSFHSPENVDKMRRGIPLTEADRMPWLQDLQTAIKHWLQENKNVVLACSALKDSYRQFLVSDSDRCTNAKSDRIKLVYLKGFYELIQMRLQERSNHYMSEKLLNSQFDTLEEPLDTISIDVAQPPQIIVQNI

SEQ ID NO: 19756 - protein, 545 aa, Nostoc punctiforme
MAKTILYKDTARWTLEKGFDALTEAVAVTLGPKGRNIVLEKKFGAPQIVNDGVTIAKEIELEDPAENTGISLLRQAASKTNDVAGDGTTTAIVLAHAMLKEGLRNVTAGADPLTVKRGIDKATEFVIEKIKEHARPIKDSRDIEQVATISAGNDPEVGRIVAEAMERVGKEGVISLEEGRSTTTELEVTEGMRFDRGYVSPYFVTDPERMEAVLEESHILITDRKITMVQDLVPILEQIARTGKPLLIIADDIEKEALATLVVNHLRGVLRVAAVKAPGFGAQRKAMLEDIAALTGGQVISEDTGLKLENVRLEMLGKARRAIVTKDDTTIVAEGNEEAVKARIEQIRRQIQEVESSYDKEKLQQRLAKLAGGVAVIKVGAATETELKDRKLRLEDAINATKAAVEEGIVPGGGTTIAHIAPQLEEWAKSQMKDEELTGTMIVARALHAPLRRIADNAGANGAVIMERVRELPFDEGYDAVANKFVNMFEAGIVDPAKVTRSALQNAASIGGMVLTTEGVVVEKPDKQAKAPAGVGPGPGEGFDY

SEQ ID NO: 19757 - protein, 324 aa, Nostoc punctiforme
EGLVHLLQLGEYQLNKNQFQEALGTFQAVLTIVRLIKERQLEARTLHNIGVVYREMKNYPQALEYYQQALAVRIDVGNRRGQGITLNDIGLVYDNQKQYTKALEFYQQALAIHKEVSNKADEGTTLNNIGVVYRKMKNYPQALEYYQQALAVRIDIGDRRGQGITLNDIGLVYYNQQEYPKALNYYQQALAIHKEVSNKIDEGTTLDNIGLVYVKQIDLVSDKQKDYTKALNYYQQALAIHKEASNKADEGTTLNNIGVVYRKMKNYPQALEYYQQALAVRVDIGDRRGQGITLNDIGLVYYNQQEYPKALDYYQQALAIHKEV

SEQ ID NO: 19758 - protein, 275 aa, Nostoc punctiforme
VLVDTQWLENHLNDPNVRIIEVNMSPEPYKNAHIPGAVFWNIFTDLLLPDLKLNLDAIAFERLMARSGITNNTTVIAYGSYPGTGAWIFWLLQVFGHENVKVLNGGYQKWKSEDRPLATELSTFPATDYRARATDPHLRVLHNEVQASIGRSDVYDGLRLRVLLDVRTIQEYCGEWFFDQPPKEGQLTGHIPGAVHLEHTLTLNEDGTFKSFDELKNLYTSKGITADKEVFPYCTIGARSGYIWFVLKYLLGYPNVRNYDGSWNEWSRLPDVAIE

SEQ ID NO: 19759 - protein, 378 aa, Nostoc punctiforme
KNVHFSVEKRLTEIVGDVGKKLHTARSRNDQVGTDTRLYLRDQIQQIKSELREFQGVLLDIAEKHVETLIPGYTHLQRAQPVSLAHHLLAYFQMAQRDWERLGDVSRRVNISPLGCGALAGTTFPIDRHYTAKLLDFDNIYANSLDGVSDRDFAIEFLCAASLIMVHLSRLAEEVILWSSEEFRFVILKDSCATGSSIMPQKKNPDVPELVRGKTGRVFGHLQAMLVIMKGLPLAYNKDLQEDKEGLFDSVNTVKASLEAMTILLREGLEFRTQRLAQAVTEDFSNATDVADYLAARGVPFREAYNLVGKVVKTSIAAGKLLKDLELEEWQQLHPAFAADIYEAISPRQVVAARNSHGGTGFVQVSKALIAARAQIDQ

SEQ ID NO: 19760 - protein, 508 aa, Nostoc punctiforme
VSLLKNPLRVGLQQQGMPEPQIIVIFGASGDLTWRKLVPALYKLRRERRIPPETTIVGVARREWSHEYFREQMQKGMEEAHPDVDLGELWQDFSQGLFYSPGDIDNPESYQKLKTLLSELDEKRGTRGNRMFYLSVAPSFFPEAIKQLGSGGMLEDPYKHRLVIEKPFGRDLASAQSLNQVVQKYCKEHQVYRIDHYLGKETVQNLLVFRFANAIFEPLWNRQFVDHVQITVAETVGVEDRAGYYESAGALRDMLQNHLMQLYCLTAMEAPNAMDADSIRTEKVKVLQATRLADVHNLSRSAVRGQYSAGWMKGQAVPGYRTEPGVDPNSTTPTYVAMKFLVDNWRWKGVPFYLRTGKRMPKKVSEIAIHFREVPSRMFQSAAQQTNANILTMRIQPNEGISLRFDVKMPGAEFRTRSVDMDFSYGSFGIQATSDAYDRLFLDCMMGDQTLFTRADEVEAAWQVVTPALSVWDAPADPTTIPQYEAGTWEPEQAELLINQDGRRWRRL

SEQ ID NO: 19761 - protein, 323 aa, Nostoc punctiforme
MTPATSLFTPVEADLRLLADNLKQLVGNRHPILFAAAEHLFGAGGKRIRPAIVLLISRATMLEQDITPRHRRLAEITEMIHTASLVHDDVVDESDVRRGVPTVHSLFGNRIAILAGDFLFAQSSWYLANLDNLEVVKLLSEVIMDLATGEIQQGLNRFDAGISIETYLQKSYYKTASLIANSSKAAGLLSEVSRETVEHLYSYGRHFGIAFQIVDDILDFTSTTDTLGKPVGSDLKSGNLTAPVLFALAEKPSLEVLIDREFAQEGDLEQALALIQDSQGIHKARELAAHHAKLAIEHLAVLPPSESHQALINIAEYTLSRLY

SEQ ID NO: 19762 - protein, 862 aa, Nostoc punctiforme
MQPTNPNQFTEKAWEAIAHTPDIVKQYQQQQIESEHLMKALLEQDGLATGILTKAGVNLQKLRDRTEQFFQRQPKVSGTSSSVYLGRSLDTLLDRADVYRKEFQDEYISIEHLLLAYAKDDRFGKALFQEFGLDEGKLKDIIKQVRGSQKVTDQNPEGKYEALEKYGRDLTEAARKGQLDPVIGRDDEIRRTVQILSRRTKNNPVLIGEPGVGKTAIAEGLAQRIIAGDVPQSLKDRKLISLDMGALIAGAKFRGEFEERLKAVLKEVTESGGNIVLFIDEIHTVVGAGATQGAMDAGNLLKPMLARGELRCIGATTLDEYRKHIEKDAALERRFQQVYVDQPSVEDSISILRGLRERYENHHGVKISDSALVAAAVLSSRYISDRFLPDKAIDLVDEAAARLKMEITSKPEELDEIDRKILQLEMEKLSLQKESDAASRERLERLEKEIADLKEEQRTLNTQWQSEKDIIDKIQSVKKEIERVNLEIQQAERDYDLNRAAELKYGNLTSLHRQLEAVEAELASAQRSGKSLYGEEVTEADIAEIISKWTGIPISKLVESEKEKLLHLEDELRHRVIGQEEAVTAVADAIQRSRAGLADPNRPIASFIFLGPTGVGKTELAKALAGYMFDSEDALVRIDMSEYMEKHAVSRLIGAPPGYVGYEEGGQLTEAIRRRPYSVILFDEIEKAHPDVFNIFLQILDDGRVTDAQGHKVDFKNAIIIMTSNIGSQYILDVAGDNAHYDEMRRRVMEAMRNSFRPEFLNRIDEIIIFHGLDKKELRQIVLLQVQRLRQRLADRKISLKLSDAALDFLAEVGYDPVYGARPLKRAIQRELETQIAKAILRGEFTDGNTIFVDVQNERLSF

SEQ ID NO: 19763 - protein, 468 aa, Nostoc punctiforme
INMSSTTVRRKSNTFYVILIAGAAALGGFLFGFDTAVINGAVLSLAKAFNTSSWVTGLAVSLALLGSAVGAFFAGQIADRYGRVKAMVVASVLFTISAIGSGMAFTIWDFIFWRVLGGIGIGVASVIAPAYIAECSPTHLRGRLGSLQQLAIVVGIFVALLSDYFIATSAGSADSPFLFGVAAWRWMFWTAVPPAVFYGMVALTIPESPRYLVAKGRESEAVNVLTKILGGDVLPKIEEIRQTVLRERQPKFSDLLSRSGGLLPIVWIGIGLSVLQQFVGINVIFYYSSVLWRAVGFSEKDSLSITVITGAVNIITTLIAIAFVDKFGRKPLLIIGSIGMTLTLGTMAYIFGNAPLDAAGNPSLAGSAGTVALIAANLYVFCFGFSWGPIVWVLLGEMFNNKIRAAALSVAAAIQWVANFLISTTFPPILQYFGLGSAYGLYTIAAATSFFFILFFIKETKGIELEDM

SEQ ID NO: 19764 - protein, 353 aa, Nostoc punctiforme
CPMTNYFRSNVDAMASYVPGEQPQRGTQIIKLNSNENPYPPSPAALAVLRNIEGEWLRRYPEPFGGEFRQAASKVLRVPSDWIIVGNGSDELLSVVIRACAEPGKKVVYPMPTYVLYRTLAEMQGAEIIEISYSEDYSLPLEEMVAVNGSVTFIASPNSPSGHLVAINELRQLANQLSGVLVIDEAYVDFTEENALALVKEYENVIIIRTLSKGYSLAGLRLGFGVANPKLLQGLFKVKDSYNIDAIACAIGTAAITDQAYKNACVAKIKASRNQLSTDLKQLGFHIWDSQTNFLLVQPPQRNAEYLYQQLKEQGILIRYFKQPGLDDKLRITVGTDEQNQVLVEALIYLLGT

SEQ ID NO: 19765 - protein, 245 aa, Nostoc punctiforme
WNPELYERFESERSRPFYDLVDMIHRQENLRILDLGCGTGKLTKYLHDTLAAQETLGIDASEKMLQKARQFEGNGLRFEQGKIEENPGDGEFNVIFSNAALQWLTEHEALFEKLRGKLKPGGQLAVQIPTMDTEPVHKIAVETAKEFSQELGGYVRRLEVLAPETYAKLLYELGFVKQEVKLQVYGHVLPSREAVVEWYRGTLLTAYESKLDAQTYERFVERYQQKLFQLLEDERPFFFPYKRIL

SEQ ID NO: 19766 - protein, 222 aa, Nostoc punctiforme
QGLTRRFGKLTAVNNLSISVEQGEVFGLLGPNGAGKSTVLKMLTTLLPISAGKATLAGYDVTRQPNPVRRAIGYVPQALSADGSLTGYENLLIFAKLYGIPAKGRDRRIYEILEYMGLQDAAKRLVRNYSGGMIRKLEIGISVLHQPQILFLDEPTVGLDPIARTQVWQLVLQLCADYGTTIFLTTHFLEEADSLCNRVAIMQQGEVVTTGTPTDLKASLDN

SEQ ID NO: 19767 - protein, 555 aa, Nostoc punctiforme
  unsure (1)..(555): unsure at all Xaa locations
QIAQTSTNGSAFSGNQSTFTKAESEQQIKDRKINPTPKAASQQIEKESMMLSPRQQRHLDSLIAHFVKRTQESKRLTQAYRSCHANSRAVSGFFPFIKEMIYPIHAERGEGARLWDVDGNEYVDISMGFGTLLFGHSPSFAIAAIQEQSKQGILNGPQSRFAGQLAELICELTGAERTAXCNDGTEAVMAAVRIARSVTGRSKIALFAGSYHGGSDGVLVKGVRTNDGTLRSVPMTSGIPSSLAEDVMVLEYGTPESLNILKDNAHNLAAILVEPIQSSRPDFQPKEFLFQLRQLTQETGTVLIFDEVVTGFRMHPGGVQALWGIQADITTYGKAVAAGIPIGVVAGKAVFMDALDGGMWNYGDESYPQVKTTFFAGTFFKHPLIMGVAWATLNHIKNSGSKLQEELNQRTTQLAETLNSYFEQKQVPIRVVNFGSLFRFNCQTQLGNLFFYHLLAKGIYVWEGRTLYLSTAHTDKDVEQVISAVKESVVEMQAGGFFTSEQTSKNSGQTSANQTLTGSSLNLATESLSVTSNVKSADELFENLIEQIPNALGNT

SEQ ID NO: 19768 - protein, 140 aa, Nostoc punctiforme
ILALHGPNLNLLGQREPGIYGSLTLAEINRLLEEEGFKLQAKVFPLQSNHEGILVDTIHEALGQHQGILINAGAYTHTSVALRDAIAAVNLPTVEVHLSNIYRREDFRHHSYIAPVAIGQISGFGVQSYLLGLQALVNHL

SEQ ID NO: 19769 - protein, 446 aa, Nostoc punctiforme
MKFDKILIANRGEIALRILRACEEMGIATVAVHSTVDRNALHVQLADEAVCIGEPASSKSYLNIPNIIAAALTRNATAIHPGYGFLAENARFAEICADHHIAFIGPTPEAIKLMGDKSTAKETMQKAGVPTVPGSEGLVESEEEGLKFAKEIGYPVMIKATAGGGGRGMRLVRSEDEFVKLFLAAQGEAGAAFGNSGVYIEKFIERPRHIEFQILADNYGNVIHLGERDCSIQRRNQKLLEESPSPALDEDLREKMGQAAVKAAQFINYSGAGTIEFLLDRSGKFYFMEMNTRIQVEHPVTEMVTGIDLVVEQIRIAQGERLKLSQEQVVLRGHSIECRINAEDPDHDFRPSPGRISGYLPPGGPGVRIDSHVYTDYQIPPYYDSLIGKLIVWAPDRPTAINRMKRALRECAITGLPTTIGFHQKIMETPQFLQGNVYTNFVQEMN

SEQ ID NO: 19770 - protein, 192 aa, Nostoc punctiforme
MNTSKPEVVVITGASAGIGRATVRAFAKRGAYIGLVARSRDGLEAARQEVEAAGAKALVLPTDVSDPEQVEAAAAAVEKEFGPIDIWVNDAMASILSPFTEIKPEEFRRVTEVTYLGYVYGTMAALRRMKPRDRGTIVQVGSALAYRSIPLQSAYCGDKSAIRGFTDSIRCELHHDRSNVHITMVQMPAVNT

SEQ ID NO: 19771 - protein, 260 aa, Nostoc punctiforme
LKGQKALVTGASSGIGEAIARNLASSGAAVVINYHSEAQEAQKIVDDIKTANGEAFAIQADVSKEDQVKAMFSKMLQEFGTIDILVSNAGIQKDSAFIDMTLDQWNAVIGINLTGQFLCAREAAKEFLRRGVKPDISCAAGKIICMSSVHQVIPWAGHVNYATSKGGINMMMQSIAQELAPHKIRVNSIAPGAIKTPINKSAWDTPEAEAKLLQLIPAKRVGDVEDIAKAAVWLASDDSDYVNGTTTLFVDGGMTLYPGF

SEQ ID NO: 19772 - protein, 280 aa, Nostoc punctiforme
GASLQKLANGAVHSEGPVYFHEDDSVVWSDAHGNRLLRWSATDNVTVLRDPSDYQSGNYRDLEGRLVACSSGLRAIIRREHDGEWKVLVDRDQGKRLNSPNDLVVKSDGTIWFTDPPYGITEPNQGYGGEQEQPGSYVYRFDPATGEIYPVVTDMVRPNGLAFSPNESMLYVSDTAAFNIPGGPHHIRVYEVVGDGYVKNGRVFAVIEPGQPDGLRVDEYGNVFTSSQDSVQIYAPDGTRLGKIFVPETSANLTFGGKEGRSLFITADHSLYVINLNTRG

SEQ ID NO: 19773 - protein, 223 aa, Nostoc punctiforme
FAVGICQHPRSNVKVWNLNSDKLLHTLLGHQKPVNCIAISPDGQFLASGSNKIKIWNLHKGDRISTLWHSFTVNAAAISPDGTILASGSSDNKIRLWNPHTGDPLRTLNGHSGEIKSVIISPDGEILFSASADKTIKIWHLTTGKVLHTLTGHLEEVRSLAVSPDGEILFSGSTDKTIKIWHLQTGELLQTITEHSGTVNSIAISHDGQFLASASSDKTIKIW

SEQ ID NO: 19774 - protein, 476 aa, Nostoc punctiforme
LYAYLQHHSHRYMSSSFSGALAHRISETSLGVTQTMQMLITEFMPVIVVYTVATTILYRSYPPLAALVGVWAVLFISISFWLATRCRIYSRKAAAARSETTGIIVDTVTNLTSSRLFARLGFERGYLNEQLSRELKQVRKSNWYSERIRWFQFISAAILKISTLYYSLSLWSQGKIATADFVVATSLSLLIISEARNLSRRFLEFFEHIGNVANGVFTIVQPHELVDRDRAIAHPITQGKIEFRRVNFNYSDEKKVFNNLSVTIQAGQRVGLVGFSGSGKSSFVNLILRLFDPQSGQIIIDGVDIRDMTQDALHAQISLIPQDPSLFHRTLLENIRYGRLDATDEEVFEAARKANAHDFIIQSQDGYNSLVGERGVKLSGGQRQRIAIARVILKDAPILILDEATSSLDSITEKAIQDTLDLAMNGKTVIVVAHRLSTIVHLDRILVFDKGHIIEDGSHTKLLALGGAYHRLWKMQ

SEQ ID NO: 19775 - protein, 621 aa, Nostoc punctiforme
MIKRLLVVESPGKVKKLSQILGSDWKVLASCGHIRELSNEGDDSLGFVMDGSNVRCNYVPRDQRAKETIQKLKSAVRQVDEVVLATDPDREGETIAWHLKETLGLKEPKRVIYTEITASAVQSAIANPKKLDQNLIGAGLCRDCLDKLVGYKGSPLVWALNNGAKSVGRVQSATLHLICQRENEILAFVPQDYWSVWVDYAEGFRAFYKGTVDSAKDAADQETETNDDAKVGNSPEHGIKRVLSEAEATRLVEEAQRHPHQVIHFEGKIVNRQPPPPFTTSSLQQAAGSKLRFAPDKTMIVAQKLYEAGLITYMRTDSVMLSPEFCASARKWLEQNDPQNVPHQVAKHRSSKSAQEAHEAIRPTDVFRPSVQLRLELPDDEFNLYVMIWKRSIASQCRAAQLRKTLVITQSGSLLWSARGQVIEFYGYARYWNNLSKDSVLPSLQQGQALKLENAGHEKKQTQPPPRYSEPKLVQLMERKGIGRPSTYAPTVATLKKRNYVELKKDHLQPTALGLEVDAFLLKALPDLLEAEFTAKMEDALDAISEGKNSWQHYLTSWNQNYFIPALSKAKTVVASSPKGKANVITERKYETSKTRCPECKNFLAKIPSTKVKKKYFLKCT

SEQ ID NO: 19776 - protein, 339 aa, Nostoc punctiforme
FQQVFGKPPETQASAPGRVNLLGEHTDYNDGFVLPTAIPQSTTVQLGLSSDSHHHFYSENLNEQVSILDINHSPSGFASYIFGCIEVLQKAGYKIPSLCVYVKSSVPMGSGLSSSAALEVATLRAVRQLLNFPIDDVEIAQFAQQAEIHYAGVQCGIMDQMASSLADTEHILFLDTRTLKRRVMPLPDNAEILVIDSGVPRTLATSGYNQRRAECEEAARSLGVKALRDITDVEVTEKLPEPLRRRARHVVTEDNRVLEVLQGVSSERFGELMNASHASLRDDYEVSVPALDTLVELLQKTPGVFGARLTGAGFGGASVALVVAGEARSIATHVLEQYK

SEQ ID NO: 19777 - protein, 431 aa, Nostoc punctiforme
IHEVFMPALSSTMTEGKIVSWVKSPGDKVEKGETVVVVESDKADMDVETFYEGFLAHIIVEAGETAPVGSAIAFIAETEAEIEQAKSLANSGGVAATTTSAPEPIPATASVVTPALASQNGSNHKEGRLVASPRARKLAKELKVDLTTLQGSGPYGRIVAEDVEALSNKGKQPATAPVAPPATVPTSAPIASPAPRTPAPAPVVAAVPGQIVPLTTFQNAVVRNMVATISVPVFRVGYTITTDGLDKLYKQIKSKGVTMTALLAKAVAVTLQKHPLLNASYSDQGIVYHSDINISVAVAMDDGGLITPVLQNADAVDIYSLSRTWKSLVERARAKQLQPQEYNSGTFTLSNLGMFGVDKFDAILPPGQGSILAIGASRPQVVATPDGLFGVRQQMQVNITSDHRIIYGAHAAAFLQDLAKLIETNPQSLTL

SEQ ID NO: 19778 - protein, 414 aa, Nostoc punctiforme
  unsure (1)..(414): unsure at all Xaa locations
LGLNWDEGPFFQSQRLDLYKEAVQKLLDQGLAYRCYTTSEELEALREAQKARGEAPRYDNRHRNLTPEQRAAYEAEGRSYVIRFKIEDGREIVWNDLVRGKMSWRGSDLGGDMVIARASEEGSGQPLYNFVVVVDDIDMQITHVIRGEDHIANTAKQILLYEAMGAKIPEFSHTPLILNMEGRKLSKRDGVTSISEFQKMGFTAEGLVNYMTLLGWSPPDSTQEIFTLETAAKEFGFERVNKAGAKFDWDKLDWLNSQYIHNTPVDKLTDLLIPFWEAAGYKFDGGRDRAWLEXLVTLISQSLTRLVDAVPQSQLFFSDTVEFSEEGSTQLKQEGSTAVLEAIVTALENQPQLSEAAAQDIIKQVVKEQKVKKGLVMRSLRAALTGDVHGPDLIQSWLLLNQIGLDKSRLSRAI

SEQ ID NO: 19779 - protein, 628 aa, Nostoc punctiforme
MKFSWKVVVLWTLPALVIGFFFWQGAFAGAPTDMSKNAANTRMTYGRFLEYLDGDRVSSVDLYEGGRTAIIEARDPDIENRIQRWRVDLPVNAPELISKLKEKDISFDAHPMRNDGAIWGLLGNLVFPVLLITGLFFLFRRSSNLPGGPGQAMNFGKSKARFQMEAKTGVKFDDVAGIEEAKEELQEVVTFLKQPERFTAVGARIPKGVLLVGPPGTGKTLLAKAIAGEAGVPFFSISGSEFVEMFVGVGASRVRDLFKKAKDNAPCIIFIDEIDAVGRQRGAGIGGGNDEREQTLNQLLTEMDGFEGNTGIIIIAATNRPDVLDSALLRPGRFDRQVTVDAPDIKGRLEILEVHSRNKKLDPSVSLDAIARRTPGFTGADLANLLNEAAILTARRRKEAITLREIDDAVDRVVAGMEGTPLVDSKSKRLIAYHEIGHALVGTLLKDHDPVQKVTLIPRGQAQGLTWFTPNEEQGLISRSQLKARITGALGGRAAEEVIFGAAEVTTGAGGDLQQLSGMARQMVTRFGMSDLGPLSLESQQGEVFLGRDWTTRSEYSESIASRIDGQVRAIVEECYDNAKKIVRDHRTVTDRLVDLLIEKETIDGEEFRQIVAEYAEVPEKQQYVPQL

SEQ ID NO: 19780 - protein, 268 aa, Nostoc punctiforme
  unsure (1)..(268): unsure at all Xaa locations
RTLEIPAXLGLMRQSVAIATXAHNYAQEIAAPGRYEYEIQAEMERIFRVRGGMGPAYPSIVASGVNACVLHYIENNRQMQNGELLLIDAGCAYGYYNSDITRTFPIGGKFTPEQKMLYEIVLEAQKQAIAQVKPGNPFKLVHDTAVRVITEGLVELGILKGEIDKLIEEEKYKPYYMHRTSHWLGLDVHDVGVYQHGQDKPQILQPGQILTVEPGLYIVPDTKLAEDQPETDPRWVGIGIRIEDDVLVTPDGHEVLTAGVPKAVNEVE

SEQ ID NO: 19781 - protein, 420 aa, Nostoc punctiforme
KDSTSSATVEEIGVDPTIFHNPVKGTPDKTYSLKGGYIRNFQFNPSEYNLPSEFVAGLDNTFKWSLYTAKQAINKVVIGVIKLFLAKCGVILGNLSFPTKLSNQLFSPIYQKAINPAVRELLQYEDFNLAVPSGTTASLYNAMISGLPASIVAQALSLSQINLCLDAACSSSFYAIKLASHYLWSHKADVMLAGAISCADSLFVRMLFSGVQGYAENGISRPLDKSSRGLIPADGVGMVMLKRYSDAIRDGDNILATICGNGLSNDGKGKHLLSPNPKGQVLAFERAYNEANFSPKTIDYLECHATGTLLGDTTEFNSIETFFGQNQAAPLVGSAKANTGHLLTAAGMVGLTKVILSMSHGVIPATMNVSEPLTSEKGTISADKIVRTATAWPNNNAPIKRAAISAFGFGGTNSHLILEQ

SEQ ID NO: 19782 - protein, 625 aa, Nostoc punctiforme
ASRKPSKVEGIKENSNFLREPVATEILQDTTHFTENAVQLLKFHGSYQQDNRDNRTKGQEKDYQFMLRTKNPGGLVPPQLYLALDKIADEYGNHTLRATTRQGFQLHGILKKNLKSAIATIVKNLGSTLGACGDINRNVMAPPAPFKNRPEYQYAWEYAQNIADLLTAQTGAYYEIWLDGEKAISAEENPEVKAARQRNGNGTIIHDNEEPIYGTYYMPRKFKICVTVPGDNSIDLYSQDLTLVVITNKKKQLEGFNIFAGGGLGRTHGKEETFARLADPIGYVAKDDVYDIVKAIVATQRDYGDRTDRRHARLKYLINDWGLDKFRAQVEEYFGKSVEAFKPLPEFKYYDFLGWNEQGDGKLFLGISIDNGRIKDEGSFQLKTALREIVEQFNLHIRLTANHNLIFYDIEPDSKQAIQDILSRHGIVDDPSKIEPLVRYAMACPALPTCGLAITESERAIPGILERVRALLDKVGLQNEHFVVRMTGCPNGCARPYLAELGFVGSAPESYQLWLGGSPNQTRLAQPYTEKLHHNDLEIFLEPIFVYFKKSRKSKEKFGDFCDRVGFDAIREFAASYDPNTANGANKSRHRVNLKEEVYSKLKEVAESQGKPMTQLVTEALEAYF

SEQ ID NO: 19783 - protein, 759 aa, Nostoc punctiforme
MSEFTKTLCPYCGVGCGLEVSPPAQLGKATNRDGQGNPTWRVRGDKAHPSSQGMVCVKGATIAESLDKNRLHYPMVRDSLDQEFRRVSWDEAFNLITQRIQTVRFTQGPEALCMYGSGQFQTEDYYIAQKLMKGCLGTNNFDANSRLCMSSAVAGYIQSFGSDGPPCCYEDLELTDCAFLIGTNTAECHPIVFNRLEKYHKKNRKVKMIVVDPRRTPTAEAADLHLAIRPGTDIDLLNGIAHLLMRWNYIDTMFMDDCTSNFPAYAEVIRHYSPEVVARQCGISIEDLETAARYWGESRRVLSLWSMGVNQSSEGTAKVRTIINLHLMTGQIGKPGAGPFSLTGQPNAMGGREAGGLAHLLPGYRVVKNPQHRAEVEEFWGLKPGQISPNPGLTAWDMITGLESDAVGLLWIAATNPAVSMPDLERTKKALLRSPFTIYQDAYYPTETSAYAHVLLPAAQWGEKTGVMTNSERVVTLCQAFRQPPREAKADWEIFAEVGRRLGFEKEFAFANSAEVYAEFVQLTQNRPCDMTGISHEQLTQGPTQWPYPAKKVESVFIDTETGLLSFQPEEETFSDKEAEKKRKYHTLRMGKRLYTDLRFHTPDGRAQFGAYYSKGLAEPPDPDYPFVLTNGRLYGHWHTQTRTGRIEKICKMHPEPFIEIHPRDAAKLGILDNQCVQVRSRRGKAQFPAKVTKAIAPGTVFVPMHWGSLWADNAEANALTHPESCPDSLQPELKACAVQLIPISVEVAVKDYQFQSSQ

SEQ ID NO: 19784 - protein, 526 aa, Nostoc punctiforme
MTDTTTTTTSLNKFEKFKAQKDGLAIRDEIEKFAALGWEAMDETDRDHRLKWVGVFFRPVTPGKFMMRLRMPNGILTSSQMSVLAQVVQRYGDDGCADITTRQNIQLRGIRIEDLPDIFNRFHAVGLTTIQSGMDNIRNITGDPVAGLDADELYDTRELIQQIQDMLTNKGEGNPEFSNLPRKFNIAIAGGRDNSVHAEINDLAFVPAFKEANGQEFSKPPIFGFNILVGGFFSAKRCEAAIPLNAWVAPEDVVAVCRAVLEVFRDHGPRANRQKSRLMWLIDEWGLEKFRAEVDTRLGKSLLPAAAKDEIDWEKRDHIGVYKQKQPGLNYAGLNIPVGRLYAEDMFEIARLAEVFGSGEIRFTVEQNIVIPNISDSRLATFFTEPLLERFSINPGLLARSLVSCTGAQFCNFALIETKNRALEMIKALEEDLIFTNPVRIHWTGCPNSCGQPQVADIGLMGTKTRKNGKTLEGVDIYMGGKVGKDAHLGTCVTKGVPCEDLQPLLQDLLIKNFGAKLKQEALVIS

SEQ ID NO: 19785 - protein, 1463 aa, Nostoc punctiforme
  unsure (1)..(1463): unsure at all Xaa locations
FLWHILRLPMSFYAQRFAGEISDRTRLNDQVAEVLSGQLATTVIDTVMVIFYILVMFQYDEILTSIVVGFAAINILTLRWISRQRIDASQRLMQEYGKAAGASIAGLQYIETLKASGVESDFFSKWSGYYTKAINSQQELGVANQIFSGLPVLLTSLSSALLLVIGGWRVIEGNLSIGMLIAFQAIVQNFQEPVNNLVGFAGTLQELEGNLIRLDDILNNPTDNQIENSNNSLLSVQQDRDIARLQGYIELRNLTFGYSRLDSPLIENFNLSVQPGQRVALVGGSGSGKSTIAKLVTGLYESWSGEIRFDDRLREEIAQEILTNSIALVEQDILLFSGTVKDNLTLWDTTVPDKNLRQACQDAAIEDVVNSLAGAYNSELIEGGTNLSGGQRQRLEIARALAQNPSILVMDEATSALDSEAEKIIDQNLRRRGCTCLIVAHRLSTIRDCDEIIVLERGKVVQRGTHEELWQVEGVYSRLIRSEGEALEEIKNGXPNXRSPLSRKSISSXKQXANPTQRSADYLDSSLWLCSSVCRNGQEWCNCRNSPLSFQQRIWRSSIWYCCSPRLNXESDIGNFNRKSRVTKSRKRMFSGISRXCRYECCGISGRMVAXVQRHTLVSRCPSHSNKSIWTRTIFANCWSNSATKIKYSPLGTSSRRSFILARNQRTYPSITNRNSATDSCYMDRGRXCGSNCYRNHXFPTRYKYFTFWTICAXSAIPILESAEGTARTHRRTTATKKHGKTSISRXRQKLWESXHRHXCLQKLTFFRKVYHYXXLLVPLGKLWGXKFLLLVSQKTSNDSKILWRRSHELHTYGCGKFYSGINGGSKIAALWXHFFRKMKKLIQWRCSLFLPIATNSTIQLPKPATLLMLILPLGXFQLHICFIGLFRIKLFLFLMXLNSPSPGRSKDLLIILFAGVVVTLLGMLVPQATAILIDNAIPDSDRNSLMQVGLGLLVAAFATALFRLVQGFSLLRLETTSDASTQAAMWDRLLNLPVSFFRQYTTGDLLSRTNSVSQIRRQLGGTILIQLITSLFAFLNLGLLFYYSPELSLIAVAIAIVTIAVTTISGMILVRKVHPLLEIEGNIFGQVVELINGISKLRVAGAQKRGFAFWSKNYSRQIKLELSTQQVEDIVAVFNTVMPTLTSGILFWFTVQLLMKAEMTGTAGLTIGTFLAFNSAFGTFVGGATGMSNTVTDILQVIPQWKRAQPIVEMLPEVEHNKADPGKLMGRIAVDRVCFRYRKDGALILEDINIYAEPGEFIALVGGSGSGKSTLLRLLLSFETPEDGSIYYDGQDLLGLDVSAVRRQLGVVLQNGKIMSSSIFDNLAGGARITLDEAWEAARMAGFADDIDAMPMGMHTVISEGGGNLSGGQRQRLLIAKALVLKPRILLFDEATSALDNRTQAIVSESLDKLQVTRIVIAHRLSTIRNAHRIYVLQAGKVVQQGSFDELAFIEGLFAQLMQRQM

SEQ ID NO: 19786 - protein, 367 aa, Nostoc punctiforme
ESSNKFGFKLFSEVLKDDKGENNIFISPSSIAIALAMTYNGASGSTQQAMAKTLELQGINLPEINSSYAAVLKQLLENPDAKVQLSIANSLWANQDVSFAPDFLKRTQDFYQAKVSNLNFKDAAASNIINNWVKENTKGKITKIVESIEPYQVLFLINAIYFKGNWSNEFDKSQTAQYPFYVTSSRRKQHPMMSQEGDYRYYESKEFQAVSLPYGKDGKISFYIFLPKQSSNLKAFYQNLNVENWEKWMTQFNKQKGFIRLPRFKTDYEVTLNDALKNLGMEEAFSNKANFSGMGKNFAISQVKHKTFLEVNEEGTEAAAATSVGIVATSLRDEPEPFRMIVDRPFFCAIRDNQTGNVLFMGSIIDP

SEQ ID NO: 19787 - protein, 806 aa, Nostoc punctiforme
MSELLQAVLDSEERSDLRSFLSELRQQEKKYLLRNDILNVYSEYCSKSQKPEAYYTTSELGKLIYYTQEIIQEDSNFCFIIRSKIASQEVYWLTSDLSIEPMTVQDLLDLRDRLVNKFHPNDGDLLELDFGPFYDYTPIIRDPKNIGKGVQFLNRYLSSKIFQDSKQLLENLLNFLRLHHYNGVQLLVNDRIQSQQQLSEQVKKAIGFVNNRPDDEPYEQFRFQLQSMGFEPGWGNTAARVRETLNILDELIDSADPQTLEAFISRVPMIFRIVLVSAHGWFGQEGVLGRPDTGGQVVYVLDQAKSLEKQLQEDVLLAGLEKLNVEPKVIILTRLIPNSDGTLCNQRLEKVHGTENAWILRVPLRDFNPNMTQNWISRFEFWPYLETFAIDSERELRAEFQGTPDLIVGNYTDGNLIAFLLARRLKVTQCNVAHALEKSKYLFSNLYWQELEEKYHFSLQFTADLIAMNAANFVVSSTYQEIVGTPDSVGQYESYKCFTMPELYHVTNGIELFSPKFNVVPPGVNENNYFPYTRTKDRVESDRQRLAETLFTLEDPTQIFGKLDDPNKRPLFSMARLDHIKNLTGLAECYGQSKELQEHCNLILVAGKLRVEESGDNEERDEIIKLYNIIDEYNLHGKIRWLGVRLSKTDSGEIYRVIADRQGIFVQPALFEAFGLTILESMVSGLPTFATQFGGPLEIIQDKVNGFLINPTNLDETATKIVDFITKCEQNPNYWNEISQRGIDRVYSTYTWKIHTSKLLSLARIYGFWNFTSKENREDLLRYLEALFYLIYKPRAQQLLEQHKYR

SEQ ID NO: 19788 - protein, 599 aa, Nostoc punctiforme
MAKFQDIVNYFRSDWKLSVFSITASSIYEVIDLVVPYAIGQILNVLSAQPLDKPLQSAIATFSDITNYPVNKTLSLSVLLGLIFVVTVVRAPTQPWLTNWFHWDIAFRARREKNETAIAKVLTIPIEFYDENNPGRIAGRVARGISNHTWVYPEIAGQLIPKLARVLGIFVFILFIEWRIAILYLISFVIILSFSLKNLQQLIGYESRLDKYGEDTESRTSELITNIKTVKAFATESRELKRQKQRLDRELTVLDYRIHKGYTILGTWQRTVIQFCVFTILGLTLAATVNGRISLGHFVMTLTLSSMAYAELEPISSLAEVFARRYSSMLRFHEFLQEPTASDSATLLEESNQTESPYKFTGKVELSHLSFGYDAKHQVLQDINLLIEPYQTVALVGRSGSGKSTLVKLLLRYFEPQEGQILIDGQDIRTLDVGKYRRRLAIVHQEVDVFNGTILDNLTYGRPNASLEEVQEACRIARVDEVVQHLPKGYYTVVGERGVRLSGGQRQRLGIARALLVNPDVLIFDEATSSLDYESERSIQLAMRSIQGTCTTIVIAHRLSTVREADKIVVLEQGKIVEVGSHDELLHQEGIYRRLHSLQ

SEQ ID NO: 19789 - protein, 692 aa, Nostoc punctiforme
NPLLQGVGLPPFAEIKPERVVPAFNQLLAELDQQLATLEASVQPTWSGLVEPLEKLTERLTWSWGVVNHLMGVKNSPELREAHEIVQPLVVQFINKLGQSQPIYNAFKALRTSENWATLELAQQRIVEAAIRDAELSGVGLEGEVRERFNAIQMELAELSTKFSNHVLDATKAFSLTLTTQAEIEGLPPSLVSLAAQVARAAGESNATPENGPWRITLDFPSYGPFMQHSTRRDLREKLYKAHITRASTGDLDNNPLIERILKLRQELADILGFKSFAQLSLASKMAPNVEAVNALLEELRHASYDAAVKDLVELKAFAAAQGAAEAEDLKHWDISFWAERQREAKFAFTAEELRPYFPLPQVLDGLFGLVKRLFGVTVTSADGQAPVWHEDVRYFQIADETGSPIAYFYLDPYSRPAEKRGGAWMDVCINRAKITENGVTAIRLPVAYLVCNQSPPVDGKPSLMTFYEVETLFHEFGHGLHHLLTKVNYPGAAGINNVEWDAVELPSQFMENWCYERTTFFGMAKHYETGEALPEHYYQKLLAARNYMSGTAMLRQIHLSSLDLELHYRYHPGSSETPSDVRHRIAKTTTVLQPLPEDAILCAFGHIFEGGYAAGYYSYKWAEVLSADAFAAFEEAGLEDEEAIKATGRRYRDTVLALGGGQHPMEVFKTFRGREPSTIALLRHNGLVSAA

SEQ ID NO: 19790 - protein, 174 aa, Nostoc punctiforme
QEPGVTVWFTGLSGAGKTTICQFVEKELRIQGYRVEVLDGDAVRQNLCKGLSFSKEDREENIRRIGFVAHLLARNNVIVLVSTISPYRKVREEVRQNIPSFIEVYVNASLEVCEQRDVKGLYKKARMGEIKNFTGIDDPYEIPLRPEVECKTNQETLYQSATKVLEKLEELGYI

SEQ ID NO: 19791 - protein, 389 aa, Nostoc punctiforme
APEITEAPTISATSPEIAETPTVSATSPEIDEALVVSTNSPEITETPTISATSPEIDEALVVSTNSPEIAETPTVTAISPEIDEALVVSTNSPEITETPTVTATSPEIDEALVVSTNSPKITETPTISATSPEIDEALVVSTNSPEITETPTVTATSPEIDEALVVSTTSPEIDEALVVSTNSPEITETPTVTATSPEIDEALVVSATSPEIVEKTSIFREIIDNEQAVESENPEISTFAYTWDNPDILDNPTSLQDEVSTAPKVEQNAIAENLPAPKGYATGGHVTDSRVENREQIAPSDTVPAMLTPGEFVINTRDAQKNLPLLHHINTGGTPQDIILPSLQTPNPIEPEATISPETPTKVDSFPDTALQLKSAETDSPEISNSLIP

SEQ ID NO: 19792 - protein, 262 aa, Nostoc punctiforme
LNIDTTSYDPRNPVNLTGVKPTFLGSFGSSNSDNITVQPGKTFFAGDGADFVEGTEGNTIQAGNDDDTVLVGSNSSVSAGDGNDQIVIGQNGAAQNISADGGNGDDVITVVEANGNNNLFGAEGNDTLTVIEGSRQSLFGGLGNDTLTSNGSNNRLYGGSGDDKIFSNTNDSLFGGDGDDVLFAGQGGSNRLSGGAGADQFWIANASLPSSKNIITDFTAGIDKIGLGGIGITQFSGLTLLQQGSDTLVKAGNTELASLVGI

SEQ ID NO: 19793 - protein, 325 aa, Nostoc punctiforme
LNICRILNGMWQVSGAHGRINPQAAIETMFKYLDAGFTTWDLADHYGPAEDFIGEFRCQLIDTRGKDALSKVQAFTKWVPRPGKMTKKLVEENIDISLRRMNVESLDLMQFHWWEYQDKNYLDALKYMAELQTEGKIKHLGLTNFDTENLKLITEAGIKIVSNQVQFSLIDRRPEVNMAEFCQQHDIKLFTYGTLCGSLLSENYLGKPEPRGSDLSTASLKKYKNMIDAWGGWQLFQELLAILKEIANKHKVSISNVAVRYILDQPTVGGVIVGARLGVSEHIEDNAKVFSFSLDADDRDRISAVSRQSRDLYQLIGDCGDEYRR

SEQ ID NO: 19794 - protein, 208 aa, Nostoc punctiforme
MGGKLIVFEGVEGCGKTSQMQLCSQWLESLGVSVVVTREPGGTELGLHLRRLLLEKAEDKPVAEVTELLLYAADRSQHVEQELKPNLAAGKYILCDRYTDSTIAYQGYGRGLNMSLINQLNYIATAGLESDLTIWLDIDVEVGLTRKRGDGIALDRIEQETIAFHRRVQQGYAELAASYPSRIVRVDGSLSKEAVQQVIQEILRVHLK

SEQ ID NO: 19795 - protein, 141 aa, Nostoc punctiforme
IDEQEIEKLWQAFKVLDVDGNGAISTDELGEVMRSLGQNPTETGLRDLIKEIDVDLSGTIDFDEFKTLMIAKVGDRESRLKLAFSAFDEDNSGQITAVELRTVMSQFGLTDAELKEMLQEVDHDGDGSIDFEEFCQLVLEE

SEQ ID NO: 19796 - protein, 75 aa, Nostoc punctiforme
ELFEKVKKIVIEQLSVEDASKITPQAKFMEDLGADSLDTVELVMALEEEFDIEIPDEAAEQIVSVQDAVDYINNK

SEQ ID NO: 19797 - protein, 410 aa, Nostoc punctiforme
TRKRVVVTGVGAITPIGNTATEYWDGLLSGRNGIDYITFFDASSHDCRIAGEVKNFDPHDYLERKDAKRMDRFAQFGVSAAKQAIANAQLVINELNAEQVGVMIGSGVGGIKVLEDQQTIYLNRGPDRCSPFMIPMMIANMAAGLTAIHTGAKGPNSCPVTACAAGSNAVGDAFRLIQGGYAKAMICGGTEAAVTPLSMAGFAACKALSFRNDDPAHACRPFDRDRNGFILGEGSGILILEELQHALSRGAHIYAEMIGYGMTCDAYHITSPVPGGLGAARAIELALKDASITPEQISYINAHGTSTPANDSTETSAIKKALGEHAYKVAISSTKSMTGHLLGGSGGIEAVATVLAIANDQIPPTINLENPDPECDLDYVPNYSRVQKVEVAISNSFGFGGHNVTLAFKK

SEQ ID NO: 19798 - protein, 657 aa, Nostoc punctiforme
AINSIRFLAIDAVEKAKSGHPGLPMGAAPMAFVLWDRFLKFNPKNPKWFNRDRFVLSAGHGSMLQYALLYLTGYDSVTIEDIKQFRQWGSKTPGHPENFETPGVEVTTGPLGQGIANGVGLAIAEAHLAAKFNKPDTKIVDHYTYVIVGDGCNMEGISGEACSFAGHLGLGKLIALYDDNHISIDGSTDVAFTEDVSKRFEAYGWHVQHVEDGNTDLAAIAKAIEAAKAVTDKPSFIKVTTIIGYGSPNKANTAGVHGAALGADEIALTRKNLGWEYEPFDVPQEALNHTRKAVERGASYEAEWNKTFADYKAKYAQEAAEFERYLSGKLPDGWDNVLPTYTPEDKGLPTRKHSETCLNKLAAVLPELIGGSADLTHSNLTEIKGKGDFQKGHYENPNIHFGVREHAMGAICNGIALHTSGLIPYGATFLIFTDYMRAAIRLSALSQAGVIWVMTHDSIGQGEDGPTHQPIETLASLRAIPNLLVFRPADGNETSGAYKIAIEKAKQNAPSLLAFTRQNVPNLAGTSVEGVAKGGYTVVDSEGTPDIILIGTGSELSLAVSAAEKLKAEGKKVRVVSLPSWELFEAQDAAYKESILPKAVTKRLSVEAAASFGWHKYVGTEGDTVSIDRFGASAPGNVCLEKFGFSVDNVLAKAKQL

SEQ ID NO: 19799 - protein, 575 aa, Nostoc punctiforme
MLEHDVIIVGGGLAGCRAAVEIARTDPSLNIAVVAKTHPIRSHSVAAQGGMAASLKNVDSQDSWEAHAFDTVKGSDYLADQDAVAILTQEAPDVVIDLEHLGVLFSRLPDGRIAQRAFGGHSHNRTCYAADKTGHAILHELVNNLRRYGVQVYEEWYVMRLILEENEAKGVVMFHLLDGHIEVVRAKAVMFATGGYGRVYNTTSNDYASSGDGLAMTAIAGLPLEDMEFVQFHPTGLYPVGVLISEAVRGEGAYLINSEGDRFMANYAPSRMELAPRDITSRAIAYEIRAGRGINLDGSAGGPFVYLDLRHLGKEKIMSRVPFCWEEAHRLVGVDAVTQPMPVRPTIHYCMGGIPVNTDGQVRSSGDGLVDAFFAAGETSCVSVHGANRLGSNSLLECVVYGKRTGAAIAKFVQKRKLPSVDEQRYVTEAQQQIQALLEQPGQYRINQVRQAFQDCMTEYCGVFRTEALMSEGLHKLEEIQQRYPQIYLDDKGSCWNTELVEALELRSLMIVGQTILASALNRQESRGAHFREDYSERDDTNFLKHTMAYYSPAGIDIQYRPVAITMFEPKERKY

SEQ ID NO: 19800 - protein, 320 aa, Nostoc punctiforme
MVQDRKSTVVITGASSGVGLYAAKALAERGWYVVMACRDVAKAQLAAQSVGIPHQGSYTIMHIDLGSLDSVRQFVKNFRASGHSLDALVCNAAIYMPLIKEPLRSPEGYELTVTTNHLGHFLLCNLMLEDLKKSSSEPRLVILGTVTHNPDELGGKIPPRPDLGDLQGFAEGFKEPISMIDGKKFEPVKAYKDSKVCNVLTMRELHQRYHESTGIVFNSLYPGCVAETPLFRNHYPLFQKIFPLFQKYITKGYVSQELAGERVAAVVADPEYNQSGVYWSWGNRQKEDGKSFVQKVSPQARDDDKGDRLWQLSAKLVGLA

SEQ ID NO: 19801 - protein, 252 aa, Nostoc punctiforme
  unsure (1)..(252): unsure at all Xaa locations
KRALITGGSRGIGAAIVKRLASVGADVAFTYASSPDRANEIVQAAQALNVQALAIQADSAEASAVVAAVEDTVNKLGGIDILVNNAGVLAIGPIDDFTLADFDRTFAINVRAVFVATQAAVKHMKEGGRIINIGSTNAERMPFPGGSVYAMSKSALQGLVQGLSRDLGPRGITINNVQPGPIATEMNPSEGXVCEMLKKHIAVARYGTVDEVAGLVAYLAGPESGYITGANLMIDGGFSAXLLSDXAMAQSA

SEQ ID NO: 19802 - protein, 497 aa, Nostoc punctiforme
QNLELSCYLFPNKPAIIFEEESFTYKDLDEMVNRVANGLRSLDIRRRDRVALFLPNIPEFVISYLGILKIGAVAVSINIMLKTDEVRYILNDCAAKAIITTESQTEYIQEPDLPQLQHILIAEGRANKGISLKQLMAKSSPEARAVEMSRDDPASILYTSGTTGFPKGATLSHGNVIFNSYCANCCYRIQKSDRLLLFLPLSHCFGQNAILNAGISACTTIILQRRFDPDQVLETITTHQVTMLFGVPTVFIKLLNMDTSNYNLENIRYYFSAAAPMPLQVAENWYKKFGFVIHEGYGLTETSPFAAYNHNLNYKLGSVGTPIANVEMKIVDGDGNQVEIGELGEITIKGANVMLGYWNRPFETAEVIKNGWLHTGDIGRMDEDGFFYVIDRSKDMIVVSGFKVYPTEVENVIYQHPAVAEVAIYGVPDPLKGEIVKANIILKASQTITEQQIIDFCYERMAAYKVPRVINFVNSIPKNSTGKVLKRFLRQESISQV

SEQ ID NO: 19803 - protein, 480 aa, Nostoc punctiforme
IVTVGDRNLTIDEVVNVARHGTQVRLTDNADVIRGVQASCDYINNAVETAQPIYGVTSGFGGMADVVISREQAAELQTNLIWFLKSGAGNKLSLADVRAAMLLRANSHLYGASGIRLELIQRIETFLNAGVTPHVYEFGSIGASGDLVPLSYITGALIGLDPSFTVDFDGKEMDAVTALSRLGLPKLQLQPKEGLAMMNGTSVMTGIAANCVYDAKVLLALTMGVHALAIQGLYGTNQSFHPFIHQCKPHPGQLWTADQMFSLLKDSSLVREELDGKHEYRGKDLIQDRYSLRCLAQFIGPIVDGVSEITKQIEVEMNSVTDNPLIDVENQVSYHGGNFLGQYVGVTMDRLRYYIGLLAKHIDVQIALLVSPEFSNGLPPSLVGNSDRKVNMGLKGLQISGNSIMPLLSFYGNSLADRFPTHAEQFNQNINSQGYISANLTRRSVDIFQNYMAIALMFGVQAVDLRTYKMKGHYDARTCL

SEQ ID NO: 19804 - protein, 324 aa, Nostoc punctiforme
GIVLTGTGSAVPDQCLDNHQLNQMVVTCDDWIKSRTGIHRRHLLPAKNSLTTMATEAAQKAIDMAGITAQDLDLIILATSTPDDLFGNASQIQARLGATQAVAFDLTAACSGFVFGLVTAAQFMRTGTYQNVLLIGAEVLSRWVDWSDRRTCILFGDGAGAVVLQASEYDYLLGFQLHTNGTHNQHLKLEFQEEEKVLVDNISVGQGTYKPIAMNGQEVYRFAIQKVPEVIEKALFRAGLDVKQVDWLLMHQANQRILEAVAQRLGIPDEKIISNLANYGNTSAASIPLALDEAVRRGQIKAHDVVALAGFGAGLSWGAAIFEW

SEQ ID NO: 19805 - protein, 502 aa, Nostoc punctiforme
SEFDFIVVGAGSAGSVLANRLSENPAVKVLVLEAGGANIPPTVDNPSIWPTLLGSEIDWDYTSVPQPSLEGRITHEPRGKIPGGSSNLYIMMHIRGHTSDYDNWAYNGCPGWAYQDVLPYFQKLENQEDDSSPWAGKGGPLNVINAKLHNPNPTSEVFINACLELGYPYTPDFNGPKMEGVGWHHINIKNGKRHSMADAYLNPVLKRPNLTLSTDSQATRLLFSGKRCNGLEYAQNGEIKTAYANYEVIVCAGALESPKLLLLSGIGSSSHLQEFGIPVVADVPGVGENFHNHVLTGVIYETTQLVPPPNLNLSESALFCQSEPGWIGPDLQLGFVHVPFDIIIGQNYPNAISILPGVVRPTSRGWIRLASSNPLDKPLVNPNYLSTQADLERLIQSVEIARNIFATKAFSSWVKQELMPGSDVQTYEQLRAFVKHRADSYHHQAGSCKMGLDNMAVVDPQLHVYGVQGLRVADASVMPVVPSGNCHTGIVMIAERVSDLIK

SEQ ID NO: 19806 - protein, 553 aa, Nostoc punctiforme
FTVGDYLLLRLEQIGIKHIFGVAGDYNMEFLDYIVNHNGIELIPTCNELNASYAADGYGRLNGIAALITTFGVGELSAINGVAGAYAEHVPVVAITGAPATKIQALGSLVHHTLGTGDFSMFARMYEQVTVAQAYLTNENATTEIDGVLGICLLKKLPVYISIPMDVALTEVSAPSDSFIPPVFQSDGATLAEIVDVCVNILEKASQPVILADIGVARYHLHEQLRKLLTATGYPYATMNMGKGLLEETHPQFIGIYNGAASEESVRKRIEQADCVLTIGALMTDFNTGKFSAKLDPSQTIEVHGQYVKVKHALYNNVAMADVLSALSQRLQRRDPQTLNFKSATENLDAGFITPIEGGSSAPITQQYFWHRFAHFLQEDDIIVAETGTCLFGASIVPLPKGATFVGQVLWGAIGYSVASLLGCALAKPTAGIAASQRRSILLVGDGSFQMTAQELSTILRYNLKPIIFLINNDGYTIERDIHGERMPYNDIQPWNYHQLPKVFGGNGWGIKVSTESQLDKALQTAQQNHDQLAFIEVVMDKMDSPEVLLKML

SEQ ID NO: 19807 - protein, 241 aa, Nostoc punctiforme
VRKIVIAGNWKMFKTQAETQEFLQGFLPHLEETPQGREVILCPPFTDLSVLSKTLHGSLIQLGAQNIHWEEFGAYTGEISGPMLTESGVRFVIVGHSERRQYFGETDATVNLRLRTAQRFGLTPILCVGETKQQRDAGETESLIALQLDKGLVDIDQNNLVIAYEPIWAIGTGETCEAVEANRIIGLIRSQLSNPNVSIQYGGSVKPNNIDEIMAQPEIDGVLVGGASLEPESFARIVNFH

SEQ ID NO: 19808 - protein, 463 aa, Nostoc punctiforme
MRVCVIGTGYVGLVTGACLAHIGHDVICVDNNEEKVKLMKSGQSPIFEPGLSEIMQSAIQTQKIHFTSDLAAGVSHGEILFIAVGTPPLPTGESDTRYVEAVARGIGENLNGGYKVIVNKSTVPIGSGDWVRMLVLDGIVERQKTLVPAGGVPSDEKLSEFAAEFDVVSNPEFLREGSAVHDTFNPDRIVLGGNSQRAVALMEQLYDPIVQRKYAEDQSLPPVPILATDLSSAEMIKYAANAFLATKISFINEVANICDRVGADVTQVAKGIGLDSRIGNKFLQAGIGWGGSCFPKDVSALIHTADDYGYEAQLLKSAVSVNERQRLIALEKLQQVLKILKGKTVGLLGLTFKPDTDDLRDAPALILIEQLNRLGAKVKAYDPIISQTGMRHGLSGVLVETDAERLADGCDALVLVTEWQQFSTLDYLKMAKLMAHPVIIDGRNFLDPETLIRAGFQYVGVGR

SEQ ID NO: 19809 - protein, 242 aa, Nostoc punctiforme
DTMNVEQKRRALITGASSGIGKATALAFAKAGIDVALVSRSLNKLEAVAEAVQHTGVEAKAYAVDLARIFEVKEKIQAIALDFGDIDILVNSAGLAYTATLSETPLEGWQQVIDLNLTSVFQCILGILPSMRDRGTGTIINVASIAARQPFPGWGAYSVSKAGLIALSQTLAQEERTHGIRVTAISPGAVNTELWDTETVHVNLDRSKMLTPEIVAQSILHTVLLPQQAVIDELTLMPSAGA

SEQ ID NO: 19810 - protein, 349 aa, Nostoc punctiforme
MAKTPESLESSINEITDRALDRDCTTLSRHVLQQLQSFSPDAQDLSALMNRIALAGKLVARRMSRAGLMEGVLGFTGEVNVQGESVKKMDVYANDVFISVFKQSGLVCRLASEEMENPYYIPENCPIGRYTLLYDPIDGSSNTDNNLSLGSIFAIRQQEGTDSDGKATDLLANGRKQLAAGYILYGPCTMLVYTIGKGVHSFVLDPSLGEFILTEENIRIPNHGSVYSVNEGNFWQWEESIREYIRYVHRTEGYSARYSGAMVSDIHRILVQGGVFLYPGTIQNPEGKLRLLYETAPLAFLIEQAGGRATTGLVNILDVVPKKLHQRTPLIIGSKEDVAKVESFIQNGH

SEQ ID NO: 19811 - protein, 296 aa, Nostoc punctiforme
  unsure (1)..(296): unsure at all Xaa locations
MPWSRIISGIVAIALALSVTLLGGWYFTIMFAVVIFLGQQEYFNLVRARGIAPAAKTTMAVSLFLLVICTIDGSLADAVMPLAGTLICFYLLFQPKFATIADVSASIMGLFYVGYLPSYWVRLRAIDSAVFSNLPLGGYWPTTWADFWEKASYASLPQGFTATMLTFLCIWAADIGAYTIGKFFGKTRLSEISPKKTVEGAVFGITSSVAVAIAGAYYLHLPRSLLTGLALGLLIGIASLLGDLTESMLKRDAGVKDSGQLIPGHGGILDRTDSYIFTAPLVYYFVTLLLPLLXSF

SEQ ID NO: 19812 - protein, 552 aa, Nostoc punctiforme
MAKPIEFNLFAPYNKGAALIGSFSDWQEIPMEKGNDGYFRTSVELKDGVYKYKFRVQSNSWFFEPEQWVDVTDPYATDIDELSGKDDSVIHVKDCERITDTYVWQNDDKPLPADHELVIYELHVGDFSGGEDDPYARGKYKHVIEKLDYLSELGINAIELMPLKEYPGDYSWGYNPRHFFATESSYGSTAELKKLIDECHGRGIRVIIDGIYNHSEASAPLTQIDHDYWYHHEPRDPDNNWGPEFNYEHYDEKLEIHPARKFIGETIRFWIQEYHLDGIRYDAARQIANYDFMHWIVQEAKNTAGAKPFYNVAEHIPETTSITNVDGPMDGCWHDSFYHCILEHICGDTFDLERLKDVIDCKRQGFLGATNVVNYLTNHDHNHIMVELGNREIFDEEAFRRAKLGVAILMTAVGVPLIWMGEEFGEYKPKQPESSKIDWTLLGNDLNRSLFESYKGLTNLRKSNHALYTENIDFIHENPEAKVLAYTRWNDEGSRVVVIANFSENFLAGYHVPNFPSAGTWHEWTGNYDVESGDDGIITDLGPYEAKVFVWQ

SEQ ID NO: 19813 - protein, 342 aa, Nostoc punctiforme
IDNANIENDRILLTPNEIKSKLPLTQLAEQRVLAYRQEIEDILDFQDRRKFIVVGPCSIHDPKAALEYSERLKALSEEVKDKLLLIMRVYFEKPRTTVGWKGLINDPDMDDSFHVENGLLIARDLLLKITELGLPAGTEALDPIIPQYISELITWSAIGARTTESQTHREMASGLSMPVGFKNGTDGNIQVALNALQSARNPHNFLGINQNGQVSVFQTKGNGYGHVILRGGSQPNFDAANVKLVEDKLKQANLPPRIVIDCSHGNTNKDYKLQGAVLENIIQQIVDGNTSIVGMMLESHLYEGSQPITDKQEELKYGVSVTDKCISWEETEKIILAAYEKL

SEQ ID NO: 19814 - protein, 407 aa, Nostoc punctiforme
RRVVVTGMGAITPLGNTIKEYWEGLIAGRSGIDLITQFDASLHICRIAGEVRDFNPYDYLERKDVKHISRFAQFGISASLQAIADAGFEINDSNATQVGVIVGNGMGGLYTVEEQEKVLLTQGSKRCSPFTVPMTIANMAAGLIAIYTGAKGPNFCTVSACAAGGNAIGEAFRSIQLGHALGMICGGTEAVITPLSIAAFGSAKTLSTANEEPTRASRPFDRDRNGFVMGEGAGILFLEELEHALGRGAKIYAEIVGYGLTCDAYHMTAPTPSGEGVMRAMELALKDGGIFPNEVSYINAHGTSTLANDAIETLAIKKALGDRAFQIPISSTKSMTGHLLGAAGGIEAVATVKSVALDLIPPTINLEQPDPNCDLDYVPHKSRTQRVDVALSNSFGFGGHNVSLAFK

SEQ ID NO: 19815 - protein, 385 aa, Nostoc punctiforme
MESLTSRMQDVQSPIIPVVGELIKNSPGTISLGQGVVHYNPPPEAIEFLSKFLADPANNLYKSVEGIPPLLTAIAGKLQAFNGIEINGENCIVVTAGSNMGFMNAILAITNPGDEIILNTPYYFNHEMAIAIAGCRAVLVATDENYQLRPEAIAQAITPKTRAIVTISPNNPTGVVYSEAALRQVNQICDTHRIYHISDEAYQYFTYNGVKHVSPGAFGKSKYTISLFSLSKAYGFASWRIGYMVIPKHLFVAIKKVQDTILICPPVISQYAALGALQAKEEYLQSNIGAIFQVRQLVLDSLNRLEGLCSITPANGAFYFFLKVNTQMDAFELVKRLIQEHKVAVIPGTTFGMDDGCYLRVAYGALQKETAKEGIERLVQGLETI

SEQ ID NO: 19816 - protein, 425 aa, Nostoc punctiforme
APEADSSVLQIWGGHPLRGHVKISGAKNAALVIMAGALLCPGDCRIRNVPLLADVDRMGQVLSALGVRLTRQGDILDINASEIKTSKAPYELVTQLRASFFAIGAILARLGVAQMPLPGGCAIGARPVDLHVRGLQAMGAEVQIEHGICNAYVPGSSRRLKGAKIYLDIASVGATENLMMAATLAEGETIIENAAREPEVVDLANFCNAMGAKIKGAGTSRIIVEGVPKLHSVDYSIIPDRIEAGTFLLAAAITRSELLLSPVAPEHLIPVIAKLRDIGVTIIEDKPEHLRILPAETLKATDIETQYHPGFPTDMQAPFMSLLTLAEGDSVINESVFENRLRHASELNRLGADIRVKGNAAFVRGVPKLSGAPVLGTDLRASAALVIAGLAAEGQTTIQGLQHLDRGYDRLDMKLQQLGAKILRV

SEQ ID NO: 19817 - protein, 257 aa, Nostoc punctiforme
GGLSLRWTLRGKKALITGATKGIGLAVANEFLSLGAEVIIVARNSQDVDQQLIIWRELGLPAYGITADVATAEGRQAIFEQVGKTWDKLDILVNNVGTNISKKVLDYTAAEYQFIIQTNQISIFEMCRLFYPLLQNRENSSIVNISSVAGLVSNRTGAPYGMTKAAINQLTRSLSVEWACDQIRVNTVAPWAIRTPLTESVLDNQDFLKLVLSQTPMGRVGQPEEVAGLVAFLCMPAASFITGQCITVDGGFLAFGF

SEQ ID NO: 19818 - protein, 275 aa, Nostoc punctiforme
MGTRSYRPYTPSTRQVTVSDFAEITKTEPEKSLTTSKHRAKGRNNTGRITSRRRGGGHKQLYRIIDFKRDKHNIPAKVAAIEYDPNRNARIALLYYQDGEKRYILHPNGLKVGTIIISGPESPFEDGNALPLSRIPLGTSVHNVEMTPGKGGQIVRAAGASAQVVAKEGDYVTLKLPSGEVRLIRRDCYATIGQVGNTDARNLSAGKAGRNRWKGRRPKVRGSVMNPVDHPHGGGEGRAPIGRSGPVTPWGKPTLGAKTRNRKKLSSKFIVRRRR

SEQ ID NO: 19819 - protein, 1241 aa, Nostoc punctiforme
KRIVLVAGFESFNADLYRKAAFLANSRCPELDIRVFSDRNITSQRAEVEAALDGADAFFGSLLFDYDQVVWLRDRIAQIPIRLVFESALELMSLTKLGDFAIGDKPKGMPKPVKFILDKFSKGREEDKLAGYISFLKIGPKLLKYVPVQKVQDLRNWLIIYGYWNAGGPENVASLFWTLAEKYLNLKVGDIPPLIETPNIGLLHPDYQGFFESPREYLEWYKTHCRDAIHRVSTKPIIGILLYRKHVITKLPYIPQLIRSFEKAGLTPLPIFINGVEGHVAVRDLMTTDYEIQQRQLGNIETPSLSSEAVKVDAIVSTIGFPLVGGPAGSMEAGRQIEVAKRILTAKNVPYIVAAPLLIQDIHSWTRQGVGGLQSVVLYALPELDGAIDTIPLGGLVGENIYLVPERVQRLIDRVKSWVSLRQKPASERKIAIILYGFPPGYGAVGTAALLNVPRSLLKFLHALKEQGYTVGDLPEDGEELICWVKEADESNPLVGQSSRLPLDNGGQDAHPTSTVNARTLEKWLGYLQTSRIEKQWKSLTGTGIKTYGDEFQIGGVQLGNVWIGVQPPLGIQGDPMRLMFERDLTPHPQYAAYYKWLQNEFEADAIVHFGMHGTVEWLPGSPLGNTGYSWSDILLGNLPNLYIYAANNPSESMLAKRRGYGVLISHNVPPYGRAGLYKELVALRDLISEYREDPQKNYVLKEGICKKIVDSGLDADCPFENAKKLGIAFTPENVRMFSGHAFDAYLVELYEYLQVLENRLFSSGLHTLGEKPSEEELGSYLEAYFGDEEEGNEPQRRGEHREKREEEERLLRDLLMQSTDELTNLLRGLNGEYIPPAPGGDLLRDGAGVLPTGRNIHALDPYRMPSPAAYERGREIAQKIIAQHLDEHGKYPETVAVMLWGLDAIKTKGESLGILLELLGAEPVKEGTGRVVRYELKPLAEVGHPRIDVLGNLSGIFRDSFVNIIELLDDLFQRAADADEPEDRNFIRRHALALKAQGVENASARLFSNPAGDFGSLVNDKVVDGNWESGEELGNTWQSRNVFSYGREDKGQARPEVLNTLLKTSDRIVQEIDSVEYGLTDIQEYYANTGGLKKAAEKQGGKKVTTSFVESFSKDTTPRNLDDLLRMEYRTKLVNPKWAQAMANQGSGGAFEISQRMTALIGWGGTADFADDWVYDQAADTYALDAEMAEKLRKANPEAFRNILGRMLEAHGRGFWEADGEKLDKLRQLYELTDEELEGV

SEQ ID NO: 19820 - protein, 508 aa, Nostoc punctiforme
VDYTKVESLPEVWPLASQRFGDVVALRSPHAKPEIVITYTQLAEQIQLFAAGLQALGVKLGDRISLISDNSPRWFIADQGIMTAGAVDAVRSSQAEKEELLFIIANSGSTAIVVEDLKTLKKLQDRIQDLPIQFAILLSDEAPPTDGTLKVLNFAQLIEIGKNHNFVPVKQNRDALATLIYTSGTTGRPKGVMLSYSNLMHQITTFGTVLQPNAGDIVLSILPSWHSYERTVEYYLLSQGCTQIYTNLRSVKGDLRQFKPNYMVGVPRLWESIYEGVQKQFREQPAKKQRLINFLLGISDKYIKARRVAQGLDLNNLHASAIERLTAKIQAAALLPLHALGERLVYAKVREATGGHVKQMISGGGALPRHIDNFFEIIGVQILQGYGLTETSPVTHVRRPWRNLIGASGLPLPATEAKIVDPETKAPLPIEKRGLVLLRGPQIMQGYYQNPEATAKAIDAEGWFDSGDLGWLTPQDDLVLTGRAKDTIVLTNGENIEPQPIEETCLRS

SEQ ID NO: 19821 - protein, 706 aa, Nostoc punctiforme
EAVECGAAALGIILGYYNRIVPLAELRQACGVSRDGSKASNILNAARSYGLQAKGFKVDLAGLRKLQCPYIVFWNFNHFLIVEGFAKDKVYLNDPATGPRTVSLPEFDQSFTGVVLVGEPSAEFQPGGRKPSLTLSLWDRLQSSLGALVYCVIAGLLLVIPGLAIPAFSQAFVDNVLIEGRSDWLRPLILGMILTAILNGFLTLLQLQFLRRMKIKLAVGMSSRFLWHILRLPVSFYDQRFAGEISSRVRLNDSLANLLSGRLATTVISAFTVIFYAAVMLQYDVVLTAIGIAFVIVNVSVWRWVSRQRVDANLRLMQEQGKVNGVAISGLQSMETLKASGLESEFFSRWAGYYAKAINARQEMDTTNQNLGVLPSFLTSITSMLLLAVGGLRVMDGVLSIGMLIAFQALMQRFLEPVNNLVSLAGELQEMEGNLGRLDDVLRNPIDPAVERDISISPTQLPAANVRLQGYVELRNITFGYNRSAPPLIENFSLSLKPGQRVALVGGSGSGKSTVAKLVCGLYEQWAGEILFDGKPRKHIPRSILTNSIALVEQDISLFAGTVRDNLTLWDSTVPFSNLVRACKDAAIQDVVLSMPGGYNADLAEGASNLSGGQRQRLEIARTLVNNPAILVMDEATSALDSEAEKTIDQRLRERGCTCVIVAHRLSTIRDCDEIIVFDRGKVVQRGSHEELQKVEGKYLQLIRSE

SEQ ID NO: 19822 - protein, 247 aa, Nostoc punctiforme
MTLLQGKVAIVTGASRGIGKAIAIELASQGAIAVVNYASSSAAAEAVVTEITAVGGQAIAIQADVSKGDQVDALVNAVMEKFSRVDILVNNAGITRDTLLLRLKPEDWQAVIDLNLTGVFLCTRAVSKIMLKQRSGRIINITSVAGQMGNPGQSNYSAAKAGVIGFTKSVAKELATRGITVNAVAPGFITTDMTSDLNNPEDILKYIPLGRFGQPEEVAGMVRFLAADPAANYITGQVFNVDGGMVM

SEQ ID NO: 19823 - protein, 529 aa, Nostoc punctiforme
LVLGSNSSAINRLYRISSLILLSTWLRVAFNYFGQVYTELSQLHFGDRLRKQIFEQLQSLSLSYFAKTRSGELINTITTEIERIRQGFSGAAFLVSRGITTLVYLISMFLISWQLTVISALLFTLLGVGLSNLNARVRESSFGMTTANANFTSTAIEFINGIRTVHSCGTQEFERQRYYKASDKVVSSTTKVVFTWTLVKPIAEGAATTVLVGMIILAFTSLVSNGTLQVASLLTFFFVLFRFIPFVQDINGTRAFLSTLHGSADNIKNLLKSDDKNYFKNGKLQFNALERAINLVSVDFGYDDQNIVLHNITLTIEKGKMTALVGASGAGKTTLADLIPRFYNATEGNVYIDEVDIRLFEINSLRRKIAVVSQDTFIFNTDVWQNIAYGTPQATNEQIQEAAKLANALEFILEMPEGFNTQLGDRGVRLSGGQRQRIAIARALLRNPEILILDEATSALDSVSERLIQDSLEKLSVGRTVIAIAHRLSTIAKADKVVVLEAGRIVEQGKYQELLARQGKLWEYHQMQY

SEQ ID NO: 19824 - protein, 325 aa, Nostoc punctiforme
MFPTHRPRRLRTHPQLRRMVRETVLTTSDLIYPLFAVPGEGIANEVKSMPGVYQLSVDKIVEEAKEVYDLGIPSIILFGIPADKDVDATGAWHDCGIVQKAATAVKAAVPDLIVIADTCLCEYTSHGHCGYLQVGDLTGRVLNDPTLELLKKTAVSQAKAGADIIAPSGMMDGFVQAIRQGLDEAGFQDTPILSYAAKYASGYYGPFRDAADSTPQFGDRRTYQMDPGNAREAIKEIDLDIAEGADMLMVKPALAYMDIIWRVKEASNLPVAAYNVSGEYAMVKAAALNGWIDEERVVMETLTGFKRAGADLILTYHAKDAARWL

SEQ ID NO: 19825 - protein, 323 aa, Nostoc punctiforme
MAETLFFNALREAIDEEMARDSSVFVLGEDVGHYGGSYKVTKDLYQKYGELRILDTPIAENSFTGMAVGAAMTGLRPIIEGMNMGFLLLAFNQISNNAGMLRYTSGGNFKIPMVIRGPGGVGRQLGAEHSQRLETYFQAVPGLKIVACSTPRNAKGLLKSAIRDDNPVLFFEHVLLYNLKEDLPEEEYLLPLDKAEVVRQGKDVTIITYSRMRHHVLQAVKTLEKQGYDPEVIDLISLKPLDFDTIGASVRKTHKVIVVEESMRTAGIGAEVIASINDRLFDELDAPVLRLSSQDIPTPYNGNLERLTIIQPEQIVEAVEKMV

SEQ ID NO: 19826 - protein, 413 aa, Nostoc punctiforme
MADWQRITGGITAPRGYQAAGITAGLKPSGLPDLALIFSEVEAIAAGVFTTSQVKAACVEYCRQRLQAKPSARAILCNAGQANAATGNQGYLDTLESSLAIAHALNISSESVLLASTGVIGQRIKMDALRSGIPKVVAALSATGSDAAAGAIITTDLVTKSIALETIVGERPVRIGGIAKGSGMIHPNMATMLAFVTCDAVVSPALWQQMLARAADRSFNSITVDGDTSTNDSLIALANGQSRTPAIIEWGAEAEKLEAMLTAVCQHLAKAIARDGEGATCLIEVEVTGAHDELSARQIAKTIAGSSLVKSAIFGRDPNWGRIAAAAGRAGIPFEQENLQIKLGNFLMLENGQPLTFDRAAASAYLKKAATGAYLQDDTVLISVNVGNGNGVGKAWGCDLSYDYVRINAEYTT

SEQ ID NO: 19827 - protein, 853 aa, Nostoc punctiforme
ITDLKQVEETLRLRERALAATSNGIIIADARLPYNPIIYVNCAFEKITGYTAADVIGQNCRFLQRTDSQQPALNELRSSLQAGTSCKVILRNYSKDGVLFWNELCISPIHDENGKLSHFIGIQTDISQRKQAEASLRRQALTFENMHDGVIITDLGGNIIDWNPAAQSMFGYTKAEILAKHISILHRPEVAATLSAKILEKINQQARWSGEIHFLCKDGSQAICETTVVSLQDEQGETVATVGINHDITENKRAKEALQRQLHRTLLLEQITQEIRQSLDTSKIFETAATQIGKAFKADRCLIHSYISDPTPRIPLVAEYNTLPGYCSMLKLEVPMTNNPHAEQMMAQESAIASPDVYADPLLQAAEPICRKIELKSMLSIRTSYQGEPNGAIGLHQCSYFRQWTPDEIELLEAVAAQLGIALAQAQLLEQETHRREELTLKNFALEQAKRQAEAANRAKSEFLAMMSHEIRTPMNAVIGMTDLLLDTDLTPQQQDFVETVRSSGDALLTIINDILDFSKIESGKLELEEQPFDLRACVEQAISLLAPKAAQKNIELVYLIQPQVPTQIVGDMTRLRQVLMNLLNNAIKFTERGEVVLSVELGAGDSVKQGENSSPLHPSLVRLRPSLREAAPTTTLRTSSRQARPSASSESPIQIQFAIKDTGIGITPEKIERLFHPFTQADVSMTRRYGGTGLGLVISKRLSKMMGGTLWVESQGIVGGNPSPRWKSRKSLSSPYSSQGSTFYFTITAQVPAVPEAEFSNSPMQLQGKRLLIVDDNLTNCQIISLQAESWEMETYAAKSAKEALAQLAQGIQFDIAILDMEMPAMDGITLARQIRRQSGCQNLPLVILTSL

SEQ ID NO: 19828 - protein, 520 aa, Nostoc punctiforme
MTKAPVAPVVLVILDGWGYCEEKRGNAIVAAKTPIVDSLWAAYPHTLIRTSGKAVGLPEGQMGNSEVGHLNIGAGRVVPQELVRISDAVEDGSIALNPALVKICQEVRSRNSKLHLVGLCSEGGVHSHITHLFGLLDLAKNQQIPEVCIHAITDGRDTAPTDGVRAITMLQNYIDRTGIGRIVTLSGRYYAMDRDHRWDRVKRAYDVMTQDGVGDNRTAVEILQASYAEGVKDEFVNPIRIAPGAIEPGDGVIFFNFRPDRSRQLTQALVSPTFNGFERQQITPLSFVTFTQYDSDLPVAVAFEPQNLSNILGEVIANHGLNQFRTAETEKYAHVTYFFNGGLEEPFAGEDRELVSSPMVATYDHAPAMSAVAVTDVAIAAIQKGTYSLVVINYANPDMVGHTGQIDATITAIETVDRCLGRLLESVIKAGGTTIITADHGNAEYMLDDGGNPWTAHTTNPVPFILVEGEKVKIPGYGTNVELRSDGKLSDIAPTILEILQLPQPPEMTGRSLLKTADYE

SEQ ID NO: 19829 - protein, 560 aa, Nostoc punctiforme
MLRLEHISKIYPTGEVLKDINWEVKPGDRIGLVGVNGAGKSTQLKIISGEMEPTAGEIIRPNSLHIAYLNQEFEVDPTRTVREEFWTVFKEANEVQLSLAHIPQEMETASPEELDRLIDKLDRLQRKFEALDGYNLDARIGKILPEMGFGLEDGDRLVSAFSGGWQMRMSLGKILLQKPDLLLLDEPTNHLDLETIEWLENYLRGLITPMVIVSHDREFLDRLCTQIVETERGVSSTYLGNYSAYLEQKAESQSAQLSAYERQQKELEKQQTFVDRFRASATRSTQAKSREKQLDKIERIEAPIAGVRTLHFRFPPAPRSGREVVDIKDLTHLYGDKILFLAANLLIERGDRIAFLGPNGAGKSTLLRVIMGMEPPTEGSVQLGDHNVIPGYFEQNQAEALDLKKTVMETIHDEVPDWDNQEVRTLLGRFLFTGDTVFKAVGALSGGEKARLALAKMLLRPANLLILDEPTNHLDIPAKEMLEEALKNYDGTAIVVSHDRYFISQVANKIVEIRDGEFRVYLGDYHYYLQKIAEEKEQAKLAAIAAEKAAKKAAKASTKR

SEQ ID NO: 19830 - protein, 288 aa, Nostoc punctiforme
EQRIEKARQEGAIELDLSKIELTEIPEAIASLTQLQQLDLSRNQVTQLPEAIASLTQLQTLDLSNNKLTQLPEAIASLARLQRLDLSNNQLTELPEAIASLAQLQELNLRNNQLTELPEAIASLTRLQRLDLSNNQLTELPEAIASLTQLQSFDLSHNELTELPNSLSRLLYLEIFDCGSNLLRQVPSVIKELKGLKELYIYANDLEVIPSWICDLHVLEILSIGGNQISELPKSLDKLQSLEFIILGADDGGNPLSKLPPCIQRIKQIRRIWANNCELHFLPDWLNE

SEQ ID NO: 19831 - protein, 436 aa, Nostoc punctiforme
SPNQELLPLTARVHNHDSLEIGGCDVTTLVKQFGSPLYILDEETLRSACQQYRDAFKQYYKGESQVLYASKAWNCLAVCAIAASEGLGIDVVSGGELYTALQAGVSPEKIYLHGNNKSREELILAIESGVTIVADNWYELRTLVEIAQPGQSIRIMLRLTPGIECHTHEYIRTGHLDSKFGFDPNDLDEVFTFVSQQSTLDCVGVHAHIGSQIFERQPHQDLAAVMVQWLRDAGKYGLNITELNVGGGLGIKYTESDDPPSIEEWVKAICEVVQEACAVENLPLPKLLSEPGRSLIATACVTAYTVGSSKVIPEIRTYVAIDGGMSDNPRPITYQSVYRAVVANKMSSPVTQTVTIAGKHCESGDILIKNALLPKTEPGDILVVMGTGAYNYSMASNYNRLPRPAAVVVANGEANLILQRETYQDLIRQDSLPERL

SEQ ID NO: 19832 - protein, 330 aa, Nostoc punctiforme
MQNLPNFRDYYEILGVSKDASGEEIKKVYRRLARQYHPDLNPGNKESEEKFKDIGEAYEVLSDSAKRSQYDQFSRYWKQKGFAGNKQTPKAKTWQSGASDRNGNQDVDPSQFSDFESFINQVIGVKNKSGASKSSNGNTSDPFRSPRTKVAYTVNTPPRTTRRDIEARLTLPLEKAYQGGNERIRLEDGRSLEVNMPLGMVTGQTIRLRNQGVGGGDLYLKITVEPHPLFKLEGLNILCQVPVTPSEAVLGGQVEAPTLDGPVKMTIPPGVRSGQKFRLGNKGYPSDDGKRGDQLVEIQIVTPKNISQEERELYEKLRQIETFKPRADLL

SEQ ID NO: 19833 - protein, 692 aa, Nostoc punctiforme
  unsure (1)..(692): unsure at all Xaa locations
INTXDTLGEEXRMGKVVGIDLGTTNSVVAVMEGGKPVVIANAEGMRTTPSVVGFSKEGERVVGQMARRQTVLNPQNTFFAVKRFIGRKYAELSPDSKRVPYTIRKDEVGNIKIACPRLNKDFAPEEISAMVLKKLADDASRYLGEPVTGAVITVPAYFNDSQRQATRDAGRIAGLEVLRILNEPTAASLAYGLDRGDTETILVFDLGGGTFDVSILEVGDGIFEVKATSGDTQLGGNDFDKIIVDWLAEQFLETEEIDLRRDRQALQRLMEAAEKAKIKLSAVSVLIIKLPFITARMMGPEHLXTRLTRSQFEGLCGDLVGRLRTPVKRALKDAGLSPRDIEEVVLVGGSTRMPMVKQLVRDLIGTEPNENVNPDEVVGVGAAIQAGILAGELKDVLLLDVTPLSLGLETIGGVMKKLIPRNTTIPVRRSDIFSTSENNQNTVEIHVVQGEREMAGNNKSLGRFKLYGIPPAPRGIPQVQVSFDIDANGILQVTALDRTTGREQSITVQGASTLNESEVNRMIQDAQKYADVDRERKERVEKRTRSEALIFQAERQLREVALEFGMQFARSRRQRIDNICRDLKESLKENSDRGIDQAYADLQDALYELNREVRQTYAEDEDDDLLGTIRDIFTGGDKDKEREFPRDTYRERDSFGKDYGRDYGKDYGRDNSRDYGRDNSRDNSRDSRSSSY

SEQ ID NO: 19834 - protein, 1121 aa, Nostoc punctiforme
  unsure (1)..(1121): unsure at all Xaa locations
NNLRFLDVNEAAVIHYGYSREEFLQMRMTDIFPPENVSIFREYLGKRHTNLHFSGQWLHRRKDGQNIDVEVVTHTIDYANYNARLVNIRDITEHKRIERTLQEQNEFLRRIFESIPLMIALIDTNGKLQWVNQEWESVLGWKFKDFQTGDVLEALYPNAEYRQDVINFMQSAQHNWADFITQVRDGDLLDTSWTNVKLSNGQIITIGQDITERKRTELALKGQAEREQLMRTVAQRIRQSLNLQDILNATVQEVRDLLGVDRVVVYQFDSEMIGTIMAESVEPGWRVSLGVEIYDTCFQTGKGAEYYQVNKRAIANIYEAGLTDCHIRLLEQFEVKANLVVPILLEVSSQTPGSHLWGLLIAHQCSGFREWEKNQLDLLDQVTVQLAIAIQQSSILEQAQTELVQRQKAQVKLKNALAEKEVLLKEVHHRVKNNLQIVSSLLQLQSQTLKDPEAIKVLRESQNRIESISLIHKNLYTSANIGQIDVVDYISNLAASLLISYQIWPERITLETDIDSVNLNVDQAIACGLVINELVSNALKHAFPNQQVGTISIALRNINNSIEMTSKIMELVYQLIXIGQILILWVCHXYMTWLQNSXKATSPXNVIMEQDSKSNLSSXLCISKYQMGQARILVVEDEVIVARAIASQLSQLGYVVTGTASSGKVAIAKALETQPELVLMDIILKGEMDGIATASHIREQLDVPVIFLTAYGDNNTLERAKITQPFGYIVKPFTTKDLKIAIEIGLLKHQLERELRQNRDQLATLLNSISDAVIATNEQGKVTFMNPAAETLTGWQQKDALGNEAANIFHIVDEATDTILENPVTKVLREQQVVYLEEFTSLIRRDGKRVPIGDSASPLKEGPDKINGVVVVFWDLSDRRQTKVLEKALEKEQELNRLKSLFISTVSHEFRNPLTVIQTAVELIEMKGGNLTDEKRGIYLKRIQGAVQSMEKLMEEVLFVGRAEAKKLVYNPAPLNLEQFCLELIKDFSIVESSECEVVFTCHSDRTDAVMDEGLLNYMFGNLLSNAIKYSPRGGKIQFNLICDPIEKVAIFYIQDQGMGIPEADQARLFESFYRGSNVQSIKGTGLGLVIVKRCVDAHRGQISVTSQIGVGTTFTVILPL

SEQ ID NO: 19835 - protein, 329 aa, Nostoc punctiforme
MGKKYDVYGVGNALVDIEYEVSPELLQELKIDKGVMTLLDEDSQNHILENLKNLHCHKSCGGSAANTMVAISQLGGKAFYSCKVANDEFGDFYIEDLLNSQVDTNLKNGDRQSGITGKCLVLVTPDADRTMNTFLGITEKFSTQELVSSALADSEYIYIEGYLVTSPTAKEAAIKAREIAEKAGVKTAMSLSDYNMVKFFKDGLLDIIGPGLDLIFANESEALELADTQDFQVAVDKLKTLSKKFAITRGSKGSVVFDGQELIEIAAPQVKAIDTVGAGDMYAGAFLYGITQSMSYEEAGKLASTAASKIVTSYGPRLKTEELKALVSA

SEQ ID NO: 19836 - protein, 131 aa, Nostoc punctiforme
MKRYWSRLLALVLVVSIGLMGCTGSPDSLTGDYRQDTLAVVNVMRQALNLSQDSSDKTAVQAEARQKINDFSARYQRVNSVSGLGSFTTMRTALNSLAGHYSSYPNRPVPEKLKNRLEKELQQVEAALKRG

SEQ ID NO: 19837 - protein, 666 aa, Nostoc punctiforme
  unsure (1)..(666): unsure at all Xaa locations
INFTLQAIAQFISAEHSCIFELSEDQRRFDLIHEWCGENVEPLIDLAKGSPIESFPYFYTPIVRGNHIQIPSVADLPPDTAERKLFEGMSFQSVAAVPMLHSGKVVGFVGTAMIHLCKAWSQEDINLLKLVGEIIAIGRARHQAEEALRIAKEAAETANQAKSAFLANMSHELRTPLNAILGFSQLMERDTSLNSNQRESLATINRSGEHLLNLINDVLEMSKIEAGQIIFTPEDFDLYLLLQTLQEMFQVKAQTKQLFLKFEIAPNLPRYIQTDEGKLRQVLINLLGNAVKFTQTGGVTLRVRLGSEQGAGETGEEELLSPAQCPMPNAPCPIPNPQSPIPNARFLHFEVEDTGRGIAPEEMNNLFQPFVQTTSGIQTKEGTGLGLTISRQFVRLLGGDIYLTSTPRQGSTFSFDIQVNLAAALKVSPRLNKGRVIALAPGQPSYRILVVDDRKENRDLIVQLLGSIGFEIEAANNGQDAIAMWQTWQPHLIWMDMRMPVMNGYDATKEIRIRERNTNTNHRTVIIALTASAFEEQQASILAAGCNDLVRKPFREQVIFEKIAEYLQVRYICTEESSEDATDNNLKNIQFSILDLRSAITIMPAQWVTELNQAAVEVDAERIFQLIEQIPPTHSPLAEKLTNLVRSFCFDEIIDVTEENCNXVNL

SEQ ID NO: 19838 - protein, 288 aa, Nostoc punctiforme
MNLTPESKVLIQGFCEFISGTHVAQMQAYGTNLVAGVNPGCGGQELHGLPVFDLVEEVIEQFGVIDTTIICVDPYDVLDAALEAIASHISQIIIITAGVPPLDMVQLLRKAEACETLVIGPNSPGIIVPGKILLGTQPSEFYTPGVVGIVSRSSTLTYEVAYELTKAGLGQSISVSIGSDAIVGSSFLQWLQILDEDETTEAIVLVGQPGGGSEEAAARYIAEAIDKPVIAYIAGRQAPPGKSWRQTGTLATVIGRDPNFGTAQSKLAALKEAEVPVAERPSQIPELL

SEQ ID NO: 19839 - protein, 335 aa, Nostoc punctiforme
TWNRHHILSLADFTTTEYDTVLQTAASFQEVLSRRTKKVPTLQGQVVANLFFESSTRTRSSFELAAKRLSADTLNFAAATSSMTKGETILDTAKTYLAMGTDIMVVRHREAGVPNAIAAEMDRLGVRVSVLNAGDGQHEHPSQALLDLFTICTLIDPASPRLELLKGKKIAIVGDILHSRVARSNIWSLIASGAEVHLAAPPTLLPKLFAEYISEELGVRSQELSSHFPTPPLFLHWQLEPALQDADFVMTLRLQKERMTAHLLPSLREYHQLFGITRTELQLCKPNVKVLHPGPVNRGVEISSELMDDPEFSLIQSQVTSGIAVRMALLYLLGS

SEQ ID NO: 19840 - protein, 1075 aa, Nostoc punctiforme
  unsure (1)..(1075): unsure at all Xaa locations
MKTSTELLARLDYYYQQIKTIILARQNPITGLLPASTAITAHGDYTDAWVRDNVYSILAVWGLGLAYRKIDDDKGRTYELEHSVIKLMRGLLFAMMRQAHKVETFKHTQSLLDGLHAKYNTATGDIVVGDDEWGHLQLDATSIFLLILAQMTAAGLQIIYTIDEVNFVQNLVYYIGRAYRTPDYGIWERGNKINRGNAELNASSVGMAKAALEAINGLDLFGVRGSQASVIHVLPDEIARARITLESLLPRESGSKEIDAALLSIISYPAFAVEDLELRDRTLNDIINKLAGKYGCKRFLRDGHQTVLEDNQRLHYEPWELKQFEHIECEWPLFFTYLVLDGLFCGEQEQVKKYQELLESLLIEQDGLRLLPELYYVSGENIEAEKLAPQTQPRLPNENVPLVWAQSLYFLGEMLSEGLLAVGDIDPLGRHLCVGKQREALVQIALLAEDEDLQTKLEVHGIEAQTPTQVEPIQVRKAGEFSAIYTQIGRNDKLGLTGRPVRRLRSLTTSRIFRIRGETIVFLPSFSDSQQFYLTLDYHFLLDQIRSELAYIQKYWSDLGRPTLTLMLTHTMLESGSEALLELMQELKDGICNGVRVKLGRLNQLMLTAGIQRIDFLPNAEFSRSPVKNASPHCYYLAYHPDKNWRLGHTQEFQMECETNFGLLLSSLRASENIYEQIELLQTLTRLQGMKFDTGYGGPGYPVTVGDLLDEVYTKAGDLGIWAVVRRAAGLRQMVDISLSDAVTSILVRGKQIAVGKAYSEASLITVPMSHDEIADKINHFCREDIRDRVLTQEILIYLGILIRSEPQLFQGLLTLRVGYLILLITSELAQKLDVTQDEAYDRLMQLSPFEVKMRLRQVLTGYTGMSNLLRQQESLHVKQKESDIAWVVLPGIAEGIEVPPGGWRRFRQAEGATGRVPKDFFKQVWLLMQHCKGLVIGDKLERRNRLDSEIMLSEMTAGERNFALLVEHLLNKIEAPEYRQVNIEALIELAAIAANNPKLQIEEYIVLDVLIGHAVRLAWLENHSQRSDRYDEDKASAWRSFYNTSPRDCASYILKAFRFLTEFVKDFXTQRGAK

SEQ ID NO: 19841 - protein, 393 aa, Nostoc punctiforme
LESRNPADKTEIVATYPRSQVNDVDTAVASARKAYRSWRTVPAPARAEYIFRVGEILLQHKEELAQLISREMGKPLTEARGDVQEGIDCAFYSAGEGRRLFGQTTPSEMSNKFAMTVRMPIGVCALITPWNFPVAIPCWKAMPALVCGNTVILKPAEDTSACATKLIEIFQQAGLPPGVINLVHGVGEEAGKALVEHPNVDLVSFTGSSETGAFVGATCGRTHKRVCLEMGGKNAQIVMEDADLELALDGAVWGAFGTTGQRCTATSRLILHRDIKEKFTTMLYERTSKLRLGAGNDTDTDIGPIINEKQLQQVSKYLDIAREEGAKVLIGGEIASEGSLKNGYFFQPTILDRVTPDMRVAREEIFGPVVALIEVSSFEEAIAILNDSNYGLS

SEQ ID NO: 19842 - protein, 223 aa, Nostoc punctiforme
  unsure (1)..(223): unsure at all Xaa locations
PXLVQLYPWLXPLILPXPNPVNPPXLNPSSESTSAPTEIKMSPEGMKILCEYFPLNSRCPGGTALTPGAAPGSTTAPAETTPSTAPGSTTVPAETTPSNITPPDSTTAPGSVTPPDSGTPESTPAPGSVTPPAPGAPSNLTPAPGSVTPPEPGAPSNLTPAPGSVTPTEPSTPSNLTPAPGTTPTEPGTPSNLTPAPGTVTPSEPGAPTEPGANSPSTPSTAP

SEQ ID NO: 19843 - protein, 172 aa, Nostoc punctiforme
MDLKSLVRDIPDFPKPGILFRDITTLLRDPEGLRYTIDFLTQKCKEAEIKPDYVIGIESRGFIFGSPLAYQLGAGFIPIRKRGKLPAAVHSIEYDLEYGTDCLEVHQDALRHSSRVLIVDDLIATGGTASATAKLVQKIGCELVGFGFIIELRDLEGRKYLPDVPIISLIEY

SEQ ID NO: 19844 - protein, 467 aa, Nostoc punctiforme
REQVARMSSKIKFGTDGWRGIIADDFTFPNVRKVTRAIATYLETAYTKNRPVLIAYDTRFLADQFAKTAAQVLADLGWTVKITVRDCPTPVIAYNARHLNSAGALMFTASHNPAPYCGIKYIPDYAGPATPEITDTIVANIESASDELPGSNPSGSISIFDPKPDYLQFIYTLLDIEKIKRANLKVKYDALYSTSRGYLDEVLQHSGVQLESFHDWRDVLFGGGMPEPKGEQLVELVEAVVRDQADLGLATDGDSDRFGIVDEQGTVLTPNTVLLVLARHLIKNKGKTGAIVRTVATTHLLDNFAAKNGLQIYETAVGFKYIGEKMRETAVLIGGEESGGLSIIGHIPEKDGVLADMLVAEAIAYEGKPLSQMVKEAIAEADGPLYNNRLDLHLTEAHKTAVIDSFTKNPPTEVVGIKVKEVGRKDGIKLYLEEGSWVLLRPSGTEPLVRVYLETNTPEKLTQIAQE

SEQ ID NO: 19845 - protein, 325 aa, Nostoc punctiforme
TILVTGGAGYIGSHAALALKNAGYEVIVLDNLSNGHRELVEEVLQVKLIVGDMSDRSLLDDIFSTHNITAVMHFAAYIAVGESVTDPAKYYQNNVAGTLTLLEAMLAASVNKFIFSSTCALYGVPKFVPLTEEHPQDPISPYAISKWMVERILSDFDTAYNLKSVRFRYFNAAGADPNRLLGEDHEPETHLIPLVLLTAFGKRESILIFGTDYPTPDGTCIRDYIHVTDLAQAHILGLEYLLKGGESEVFNLGNGSGFSVREVIETAKEITGKEIKIEERDRRPGDPPILVGSSDKATKILGWHPEYPNLNEIIAHAWKWHQQRH

SEQ ID NO: 19846 - protein, 506 aa, Nostoc punctiforme
FTVWSPLLDSVTVKTLTPQEQVIPLKPQSEGYWHAKVNDVYPGTLYRYVLNGQDAFADPASQYQPEGVHGPSQIVDHQFEWTDEEWTGIPVESMIFYELHVGTFTPEGTFTAIISRLPELRELGINAIEIMPIAQFPGDTHIEASLAYRNWGYDGVYPYAVQNSYGSPAELKQLVNACHQNNIAVVLDVVYNHFGPEGNYMSQFAPYFTKTYKTPWGEALNFDDAHSQGVRNYFIENALYWLREFHIDALRLDAIQAIYDLGAKHFLWELAEAVHHFSQQGQKWKRHLIAESDLNNPQIIRPAELGGYGLDAQWSDDFHHSLHALLTGDRQGYYQDFGQTAQLAKAYEDTFVYDWKYAPHRKRFHGISCRDRNLSQFAICIQNHDQIGNQMKGERLTQRISFEGLKLAAGAVLLSPNLPLLFMGEEYGETAPFIYFVSHSDPDLIQAVRAGRKQEFEAFHYADDPPDPESAETFLKSKLNWQLRHEGNHKVLWDWYRQLINLRKTH

SEQ ID NO: 19847 - protein, 208 aa, Nostoc punctiforme
LEGVILDVDGTLVLSNDVHANSWVEAFAAYGLEVPFEKVRPLIGMGGDQLIPKVTPGLNNEEGTGKAIAERRKELILNKYTRQITAANGSRDLILKMQKSGLHLVVASSASSQELDILLKIAQVDDLISEVTTSDDAEASKPAPDIVQAALKKGKMAPDRVVMLGDSPYDIESAGKAGVGVIALRCGGFSDEQLSQALAIYNDPEDLL

SEQ ID NO: 19848 - protein, 750 aa, Nostoc punctiforme
TTIAPEQVNSIVWNQHNDPFEILGSHPIEQDGKTVWAVRAYLPNASAVWVVLPEQRKEYPMQTVHHPHFFECTIETAELANYQLRIKEGEHERVTYDPYAFRSPNLTDFDLHLFSEGNHHRIYEKLGAHPTEIGGVKGVYFAVWAPNARNVSLLGDFNLWDGRKHQMRKGPTGVWELFIPEIGMGEHYKYEIKNFEGHIYEKSDPYGFQQEPRPKTASIVTDLDAYTWNDESWMEKRRHTDPLTQPVSVYEVHLGSWLHASSAEPAKLPNGETEPVVVVSELKPGARFLTYRELADRLIPYVKELGYTHIEMLPIAEHPFDGSWGYQVTGYYAPTSRFGSPEDFMYFVDKCHQNDIGVIVDWVPGHFPKDGHGLAFFDGSHLYEHADPRKGEHKGWGTLVFNYGRHEVSNFLAANALFWFDKYHIDGIRVDAVASMLYNDYCREPGEWLPNQYGGRENLEAADFLRQVNHIIFSYFPGILSIAEESTSWPMVSWPTYTGGLGFNLKWNMGWMHDMLDYFSMDPWFRQFHQNNITFSMWYNHSENFMLALSHDEVVHGKSNIIGKMPGDTWQKLANIRCLFTYMFAHPGKKTMFMSMEFGQWSEWNAWADLEWHLLQHEPHQQLKTFFQGLNHLYRSEPVLYTQDFAEPGFEWIDCSDNRHSVVSFIRRDKDSDDFAIVVCNFTPQPHSHYRIGVPQKGFYTELFNSDARQYGGSNMGNLGGKWTDDWSLHSRPYSLDLCLPPLGVLILKL

SEQ ID NO: 19849 - protein, 467 aa, Nostoc punctiforme
MSKGTLFDKVWDLHTVGTLPSGLTQLFIGLHLIHEVTSPQAFAMLRERGLKVLFPERTVATVDHIVPTENQARPFVDSLAEEMIQALENNCQENNITFYNIGSGSQGIVHVIAPELGLTQPGMTIACGDSHTSSHGAFGAIAFGIGTSQVRDVLASQTLALSKLKVRKIEVNGNLNPGVYAKDVILHIIRTLGVKGGVGYGYEFAGTTFEQMNMEERMTVCNMAIEGGARCGYVNPDRVTYDYLKGRDFAPKGADWDKAVAWWDSIKSDVDAQYDDVVVFDAAEISPTVTWGITPGQGIGVNQSVPQPEELLEEDRFIAEEAYRYMDLYPGQPIKGTKIDVCFIGSCTNGRISDLREAAKIAKGRHVAEGIKAFVVPGSERVKQEAETEGLDKIFQEAGFEWREPGCSMCLAMNPDKLQGRQISASSSNRNFKGRQGSSSGRTLLMSPAMVATAAIKGEVSDVRELL

SEQ ID NO: 19850 - protein, 317 aa, Nostoc punctiforme
SPIACNLPRVTIVGAGRVGSTLAQRVAEKNLADVVLLDIIAGMPQGLALDLMEARGIEIHNRQIIGTNNYADTSGSQIVVITAGLPRKPGMSRDDLLKTNAKIVVEAAKNAIAHSPNAIFIVVTNPLDVMTYLAWQATGLPRDRIMGMAGVLDSARFEAFIALELGVLPADVKAMVLGSHGDLMVPLSRYATVNGIPITELLDAATIERLIERTRNGGAEIVELMQTGGAFFAPASATSVMVESILLNQSRLLPVAAYLQGEYGLEDVVIGVPCRLGCGGIESVLELILSDEEREGLHTSAQSVRQNIERSQEILAN

SEQ ID NO: 19851 - protein, 116 aa, Nostoc punctiforme
MPLIKVQTSVSAPQKAEIESMLLNLSAKLAKHLGKPESYVMTAFEPEIPMTFAGNTDPVCYIEIKSIGTMKPDQTAAMSQEFCQQINQTLGVPKNRIYIEFADAKGAMWGWNGTTF

SEQ ID NO: 19852 - protein, 452 aa, Nostoc punctiforme
  unsure (1)..(452): unsure at all Xaa locations
MTQNSLNDSGTQSSKTLGLKPALTAALASLEVPLDQELARYRRTRNGLVSSNQRRVASYISSQTQSLSAIPTTLGTTQSSVTEIKTNVPPAVPVNHQGTPAPVTEIDVPPASSVAVNSEMNRAPVTANIEELNNLNVPSTQDSAKTQTQLPPPPPNFSSSIVPAIVKDTKSENLLQTDNTPKHPDDYLESSEALLRSLTEEQPETQKPSNSSDSLLSPLGIGSMLLLLLASLTLGYVVFNPKGLPQWNLANLFNGNSSPAPGNTEEVGSNVQPQIQPPSTSSMYPNLAAQEFPDVRDPNDLVGLQPKVQPTVAVVPNPGVRQNPVNPQAPLSNPNTALKPTNPIALAPVPTVQPLPPLNLPPISTAKTSPQPIAASPKPNAEIKPGTDGFYHVVIDNKGAAFASARQVIPDAYLSPNKELIYLGAFKTKEQVQKQMQLLQAKGIKARVQQPX

SEQ ID NO: 19853 - protein, 184 aa, Nostoc punctiforme
MLKLYGGARSRASIVQWYLEEIQVPYEFVKLDMQAGEHLKPEYLAINPVGKVPAIIDGDFQLWESGAILLYLAEKYGKTPPSLEERAVFSQWVLFANATLGPGIFVEASREREMPRLLTPLNEIFSKQPFLLGDEFTVADVAVGSILSYIPVMLKLDLSSYPSVLNYIKQLSERPAFQKSIGGR

SEQ ID NO: 19854 - protein, 410 aa, Nostoc punctiforme
LYLGIDFGTSGARGVVIDEEAYCIQAEVRYPFQDSTATITPKIWQEALFVLLEQIPDQLRRKIKAIAINGTSSTVLLVDAAGNPTDAPLMYNDARGSLLLEHLRSIAPPNHTVLSATSSLAKLLWMRQLPSFSEARYFLHQADWLGFLLHGQLGISDYHNALKLGYDVEELKYPEWLEKLQIPIQLPHVLTPGTPIAELRPEIMDKFGFSRDCLVCAGTTDSIAAFLASGAKLPGEAVTSLGSTLVLKLLSRTRVEDARYGIYSHRLGDLWLTGGASNTGGAVLKQFFTNAELESLSREIDASIARELDYYPLLKAGDRFPINDPNLAPRLEPRPDNPVEFLHGLLEGITRIEARGYELLQQMGADKLSRVYTAGGGAANDTWTAIRARYLQIPVVASVYTEAAYGTALL

SEQ ID NO: 19855 - protein, 178 aa, Nostoc punctiforme
GILFYGLPGCGKTLLANAFANESGRYFFKFSPADIVSVWIGQSQKNIRDIFAQAKKKAPSVLFIDELDSIGFNRNEDNAHTDQKATINQLLIELNNLQNSDVIVIAATNYLSGIDSALKRSGRLDWKIPIFPPSQVERIELFIHYLSKIDMNQLVNFEMLAEKSMKFTSSDIELVCRE

SEQ ID NO: 19856 - protein, 295 aa, Nostoc punctiforme
IVVLGAGPAGCSAGYHLAKSGHKVMLIDKDCFPRDKTCGDGISLGSVQALSTMGIYPDDIKRLASEYAQIDGFLLGVSNEISHLCPTELKGYCIPRFVFDNLLYQKAINAGCVARTQRISDIEGYHQELYSDFDYIIDARGVYAGEANAIAIRAYWSIKVADFPKIYLSKAQIYFDKAFGVNGYGWIFPVAVDSELVKLNVGVGVWLDEYQKNNTNIIRLFNEFVQRNQATKQLLSLVVSQQKPKAYPLATAKRANTVSYGKVFKIGDAANLTDPLTGEGIANAILSGLYVTQAI

SEQ ID NO: 19857 - protein, 315 aa, Nostoc punctiforme
IMTKTALVTGITGQDGYYLSHLLLNRGYRVVGLVPPHRQPNLTKLGTLANQVEIFTVDLRDSRALLTAVEQLRPQEIYNLAAPSFVPDSWNDPLGTLDLITGTATRLLEAVRQVGLSTRFYQASSSEMFGDVFSSPQDEETPFRPKNPYAAAKMHAHWTMVHHRQRYGLFACSGILYNHESPLRAPQFVTRKVSLAAASIKLGLTDTLEMGNLDAKRDWGFAGDYVEAMWLMLQVDEPEEYVIGTGKLHSVRDLVATAFESVGLDWTRYIVLNTSLLRQDEHFQLVADPSKAKRNLGWEPQVSFEELLEKMVKTD

SEQ ID NO: 19858 - protein, 263 aa, Nostoc punctiforme
IMDLQLRGKVALITAASKGLGKATARQFAREGAKVAICARSESIDTTAAEIASETGTEVLSLRADVTSQADIERVINTTVERFGGLDILVTNAGGPPAGTFDDIDLATWETSINLTLLSAVRLVKFALPHLRQSTTPAILTITSTSTKQPVENLVLSNSIRLAVIGLTKTLSQELGSDKIRVNSILPGWTYTERVEELINARIAKSGETKEAEIARVSATVPLGRIGTPEEFANVAVFLSSPAASFVNGVMLEVDGGAIQGTF

SEQ ID NO: 19859 - protein, 480 aa, Nostoc punctiforme
ALVTPGGRSLTYKQLRDNVVGLVSQLNSFGLTRGERIAIAMTNGSPMAITFLAAALCGTAAPLNPKYKQDEFAFYYEDTQANALITLSGEPEAAIAAVTPNMMLINAKVNADGTLSFELVKTGSKPRESSNPAAPNADDLAMILHTSGTTSRPKRVPIRHRNLIASANNIITAYSLTDADTTLCLMPLFHVHGLVGCLLSTLASGGTLICPNGFNALEFWKLVDTYKPTWYSAAPTMHQTILARASRNTEIVQANRFRFIRSSSASLPPIIIEQLEATLNAPVVESYSMTEASHLMTTNPLPPKERKPGSVGYGFGVDVGIMDSEGNLLSQGSLGEVVVKAPNVIDGYENNPEANATAFVNGWFRTGDQGTVDADGYLRLTGRIKELINRGGEKISPLEVDDVLLRHPAVAEALAFAVPHKSLGEDIHAAVVLKGEVGEKELLAHCSTMLADFKVPKQIHILDQLPRGATGKLQRLAMAK

SEQ ID NO: 19860 - protein, 195 aa, Nostoc punctiforme
LRLYDFLPSGNGYKIRLLFTQLGMPFERVELNILKGETRTPEFLSKNPNGKIPILEIEPGQYLAESNAILVYLSEGTEFLPYDRFLRAQVLQWLFFEQYSHEPFIATSRFWISILGKTEEYSEAIKEKREPGYAALSLMEKHLTSNTFFVGERYTIADIALFAYTHVADEGGFDLTPFSAIQAWIKRVKAQPRYI

SEQ ID NO: 19861 - protein, 701 aa, Nostoc punctiforme
SDCGASCLVMISRYWGKRFNVNRIRDLTNVSRSGASMRGLTAAAESIGFSTRPVKASFDKLAQQPLPAIAHWEGKHYVVVYEVNKKRVIIGDPAIGQRTLTASEFKAGWTGYALLLQPTDLLKETQEATTAFWQFFDLVKPHSQVLLEVFLASVLIQVFGLVTPLFTQLLLDRVIVQGSTLTLNAVGLGLLIFGFFRVALNGLRQYLLDHTANRLSLTLLVGFIKHTFRLPLAFFESRYVGDIVSRVQENQKIQRFLTGEALSIGLDLMTVFVYLALMFWYSWQMALFSLAIVPPFVFLALVATPFLRRISREVFNASAKENSYLIQSLTGIRSVRSMAIEQTVRWHWEELLNNVIKKTFSGQVISNQLQIFSSSIESLVTTGLLWFGAWQVIQNQLTIGQLIAFNMLLGNVIRPFQRLVVLWNQLQEVIISTERINDVLEAEPEEDLQFQPRQSLSSLRGHIVFENVTFRYHPESEINVLENLSFEIKPEQTIAVVGRSGSGKTTLSKLILGLYLPTDGKILIDGQDVTNISLRSLRSQIGVVDQDTFLFGGTIQENISIAHPEVSQEEIIEAARLAGADEFIKLMPMGYETQIGEGGGMLSGGQRQRLAIARALLGNPCFLIFDEATSHLDAESERIIQHNLTKILQGRTSLIIAHRLSTVRNADLILVLDRGILVESGTHEQLIAKKGHYFYLNQQQL

SEQ ID NO: 19862 - protein, 1063 aa, Nostoc punctiforme
  unsure (1)..(1063): unsure at all Xaa locations
MTPTVSQSHTKIISQAIEQLRSFCQVNLQSSWLYQESNLIITDVVAADLSHWQPVQLNAKEHIAWTGGKNVLWLVQRLVVPQDLQGYPLAGLSLRLALVWWADSAEIYVNGELVLEGDLFDCSPRVLLSQGVTPGEEFIVALRLVSPGHCDGALVRSLLVYESTVDNNPDPGFVADELAVVQLYLERFAPEKLDALVEVVEEVTNRRGAEGTEKGELAKSFLSLRQNLIQSDILAEGWGDQKSKIFLLGHAHLDLAWLWPVSETWNAAQNTFESVLKLQEDFPELIFCHSTPALYAWIEEHRPDLFQAIQAQVAAGRWEVVGGMWVEPELNLIAGESIVRQLLYGQRYIQEKFGQFSTMVWVPDTFGFCATLPQFFANAGIEYFVTQKLRWNDTTKFDYGAFWWRSPDGSEVFSLMSAPIGENIDPVKMASYALEWQSQTGLSESFWLPGVGDHGGGPTRDMLETAQRWQKSPFFPDLEFTTAEKYLQQIVETRWIASVSNYNSPPASPAPPAFPTWDDELYLEFHRGCYTTHADQKRWNRRCENLLYEAELFATLATISCGATYPKAEIEAAWKQVLFQQFHDILPGSSITQVYTDALPQWQQVEKVGMKILQESLLAIASHITLSEPPKPNSLPIFVFNSLNWQRSEVVSVALPTSQEWQIYDTSGKQLVSQLSEPSTLLFLATEIPPVGYRIFWLSPSSPSFPPSPSLLSDWILENEFLRVVIDPDTGDLSSVFDKTYQRELLSGAGNQLQAFKDSGQYWDAWNIDPNYAQHPLPSTNLQSIQWLEEGPVQSRVRVVRQLGESEFCQDYILQAGSPLLKITTTVNWQENHVLVKAAFPLNIEADFATYEIPCGAIRRTTKPQTPAEEAKWEVPALRWADLTGETQEGIHGVSLLNDCKYGYDSKPNQLRLTLLRSPNWPDSEADKGFHEFTYTLYPHAGSWESAHTVRRGYELNIPLQVILNPPNENPPLSTGKDGLGVSFLDLSAENLILMALKPSEDNPQQLILRCYECHGETAELSLQSNLGLNLGDTVDLLERSSTTEFSSRQQIXTIQPWKIGGV

SEQ ID NO: 19863 - protein, 252 aa, Nostoc punctiforme
RGILAIVHGLGAHSDRYSNVIQHLIPKQYAVYALDLRGHGRSPGQRGYINAWSEFREDLGAFLQLIQTQNPGCPIFLLGHSLGGVIVLDYILRYPQQASVLQGAIALAPTLGKVGISPIRVLLGKMLSRVWPRFTLNTGIDISAGSRDPQVLAAIAQDTLRHTLGTARLATEFFATVDWINAKAGDWQLPLLILHGGADRVALPAGSDIFYQRINYTDKLRIEYPEAYHEIQRDLNYREVMADLENWLERHL

SEQ ID NO: 19864 - protein, 176 aa, Nostoc punctiforme
MSAKVVEILSSEEIRRTLTRLASQIVERTRDLSQLVLLGIYTRGALLAELLARQIETLEGVAVSVGALDITFYRDDLDTIGLRTPTKSEIPFDLTGKTVVLVDDVIFKGRTIRAALNAVNDYGRPEVIRLAVLVDRGHRELPIHPDFIGKKLPTAKEEVVKVYLQNYDGRDAVELI

SEQ ID NO: 19865 - protein, 402 aa, Nostoc punctiforme
GNKFEVNCALSLRKSLHPGNIVQLDESQTLAIAKVKPRLHIRSGGNDGIVVEISDRLFQEGVEIGDLIRVDTRLQFAFEKLPSYQTGGLTLEEVPDVTYEDIGGLDDQTEAIKDAIELPYVYQKLFEEYQLVRPKGILLYGPPGCGKTMIAKAVANSLTQSIRSHLQEVEQKIILYQELSKNPDNQDALVAYQQLANNSRSPETVALIQNNISPEETQQQLVADLRLSNIDLEDINNSLERIQNILRREDGIRSFFLNVKGPELLNKYVGETENRIRKIFAEAKRRATFYTPVVIFFDEMEAMFRTRGSGRSSDVETTIVPQFLAEMDGVEATENIVIIGASNRPDMIDPAIQRPGRLDIKIKIDLPSRDSAIAILALHLTPDLPLQPYGLTNFTDSTVSTV

SEQ ID NO: 19866 - protein, 499 aa, Nostoc punctiforme
IRKVSTTPLSDQKPGTSGLRKSVKVFQQPHYLENFIQSIFDSVGDLHSQTLVLGGDGRYYNRQAIQIILKMAAANGIGRIKVGQRGILSTPATSAIIRKYQAIGGIILSASHNPGGPNGDFGVKYNISNGGPAPEKVTEAIYDRSKVIDSYQILEAPDVDLETLGESHLGETVVEVIDSVQDYQELMESLFDFERIQQLLTRGNFRFSIDALHAVAGPYAHAIFEQRLGAPVGTVQNGTPLEDFGGGHPDPNLVYAHDLVDILYGENAPDFGAAFDGDGDRNMILGRKFFVTPSDSLAVLAANAKLVPGYSEGLAGVARSMPTSQAVDRVAAQIGIESYETPTGWKFFGNLLDAGKATLCGEESFGTGSNHIREKDGLWAVLFWLNILAVRQQSVEQIVREHWQTYGRNYYSRHDYEEIQTEQGNTLIERLRSLLPNLKGKQFGNYQVEYSDDFSYTDPVDGSISEQQGVRIGFTDGSRIVVRLSGTGTQGATLRHHVK

SEQ ID NO: 19867 - protein, 336 aa, Nostoc punctiforme
VIRVAINGFGRIGRNFARCWVGRENSQIDLVAINDTSDPRTNAHLLKYDSMLGKIKGAEISADDNSIIVNGKTIKCVSDRNPEKLPWRDWGIDLIIEATGVFTSKEGALKHVNAGAKKVLITAPGKNEDGTFVVGVNHHDYDHNIHNIISNASCTTNCLAPIAKVLNDKFGIIKGTMTTTHSYTGDQRLLDASHRDLRRARAAAINIVPTSTGAAKAVALVIPDLKGKLNGVALRVPTPNVSMVDFVVQVEKRTITEEVNQALKDAAEGPLKGILDYSELELVSSDYQGSDASSIVDSSLTLVMGNDLVKVMAWYDNEWGYSQRVLDLAELVAEKW

SEQ ID NO: 19868 - protein, 772 aa, Nostoc punctiforme
  unsure (1)..(772): unsure at all Xaa locations
VLGYSPVDRIFXPTNSGILASLTSGYGGRKRDIFLLFQSFSNSLRWDFQPSQPPTQKRLPAANLIISNYPFVASWNTAAACLTMVAQQLENSVQLEWVQRQLRGQRPKQVVEAGEKLGLVMRRLQVSWGELRQLSFPALLLWNSDSPQSPSWVVAYGVKGDRLIIANPLNPDRICESLPQSIVEASWDGRLWQVELISKQETFNLSWFTPAVWKYKGLLTEVLLASFTLQLLGLTTPLITQVVIDKVMVQGSLPTLDVMAIALLCVAIFESVLGILRLFIFTHTARRLDLSLSAQLFRHLMRLPLAYFESRRVGDTVARVQELEQIRQFLTGTALTVILDSIFAVVYLALMFYYNVPLTFVALAVLPLFATLTIVATPILRNWLNETFNRSADSQSFLVETITGIHSVKAHAAEPVARDRWEGLFARFIRTGFKASTTSNISSNIGDFLTNFSTMLILWFGAKLVIEQKLTIGQLVAFQMLSGRVTGPLLRLVQLWQTLQQVLLSVDRIGDILNVSPEAELGTGLVLPPLKGQVTFEQVFFRYRPNFEAILRGISFNAEPGQFVGIVGRSGSGKSTLSKLLQRLYQIESGRILIDGFDIKSADLASLRQQVSVVLQEDFLFNGSILENITLGTPDITAEQVVEAARLAVAHDFISQLPYGYETNVGERGTALSGGQRQRIALARLFLSQAPILVLDEATSALDSETEQQVLQNLQKVSANRTVFLIAHRFAPLKRADLILVLEQGVIAERGTHSELLQQKGLYWSLYQRQQA

SEQ ID NO: 19869 - protein, 1155 aa, Nostoc punctiforme
YREEARVEPVDSTDAADEYLPCPYRGLFHFGPNDADVFCGREIFIEELYSATKTNNFIPVLGASGSGKSSVVLAGLVPKLQTAGHWQFTHFRPGSDPFHALALALVPLYTPNLDQTDQIAQARKMAGYLQDGSVILLDVFAKIQQNHPNHRVLLIADQFEEIYTLCNNQEIRRKFLDCLLASLVTPTSLTSSATVLVTTMRADFLGNALSYRPFADVLQNADVKLGPMNREELTEVIGKPAQKFGVTFADGLVERILDDVENQPGNLPLLEFALTELWNKRTGKQLTHKIYEEIGQVEGALARHADEKYGNLTDDEKEKVRRIFIQLVRPGEGAEDTRRIAMKAQLGEQSWSLVKKLADARLVVTSRNLSSQETVEVVHEALIRNWGELRQWMNTNRVFRAWQERLRAAKGQWEATNKDSGSLLRGAALAEAEEKLKERPEDLIDEQEFIEQSIKEGNRLKQVEAARRKREIRTAWAIAAGSVVAVVISSGLGLTAWNQTKQAQLNQAESLSRYSLSLINEHKDLEAFVTAIKAGKILQSQHTTKLETFNALQTVLVQGRERNRLEGHQSAVNSVSFSPDGKTIATASQDKTARLWNLQGQLLQEFKGYQGTVLSVSFSPDGKTIATASSDKTARLWNLQGKLLQEFRGHRSGRGMSFSPDGKTIATASEDGTTRLWNLQGQLLQEFKGHQGSDEGVSFSPDGKTIATASQDKTARLWNLQGQLLQEFKGHQGEVSSVSFSPDGKTIATASSDKTARLWNLQGQLLQEFKGHQRGVNSVSFSLDGKTIATASSDKTARLWNLQGQLLQEFKGHQGLVLSVSFSPDGKTIATSSDDKTARLWNLQRQLLQEFKGHQGEVSSVSFSPDGKTIATASEDGTAQLWNLQGQLLQEFKGHRSGRGVSFSPDGKTIATASADRTAQLWNLQGQLLQEFKGHQNVVSSVSFSPDGKTIATASWDCTARLWNLQGQLLQEFKGHQGAVNSVSFSPDGKTIATASVDETARLWNLQGQLLQEFKGHQSGVNSAKFSAVNSVSFSPDGKTIATASSDNTAQLWNLQGQLLQEFKGHQGLVLSVSFSPDGKTIATASSDNTARLWNLQGQLLQEFKGHQRGVNSVSFSPDGKTIATASYDKTIKLWDLDLHPLMRRSCDSVRDYLT

SEQ ID NO: 19870 - protein, 280 aa, Nostoc punctiforme
  unsure (1)..(280): unsure at all Xaa locations
MRKFFNFCFEVEFYLKIAITCTIVQQIFYWLLHNIELNFITQVLLYWLVGSISFYSIGLFIEKVIKNNDNLREKLTARVKKVKTQPFPSFTAKGIITGEIKSFIAALIILYLAPEVNRGNSLLSNLGWFLMRIIVADFCFYVSHSLLHRKFLQKIHLKHHEFADSSSFVAGHKSLTEYIIVTITDLLPIFIFGYDITQLCAWTIIGNAYNLEGHSSLSIFFVPSDFHDLHHSCFKRNYGIQGFWDRLFNTLNPPTKKPGIMFPVAYLEHITMKLSNPLNX

SEQ ID NO: 19871 - protein, 350 aa, Nostoc punctiforme
KPDGRKLKLYSRYPITSQLEATSPSNEPVQANPHLRWHPLRGEWVAYASHRQGRTFMPPPEYNPLAPTTNPEFPTELPQGKYDVAVFDNRFPSMTPTANNPPDTIVETLPANGACEVVVFTQDARASLSSLELDHLDLLLEVWGDRTRELGLNPQIQYVLPFENKGVEVGVTLHHPHGQIYAYPFIPPVPARMLSMQQEYYEKHRRGLLQDLIQKEIADNRRIIYQDEYAIAFVPVCARYPYEVWIAPKEPVSTFMDLTPEQRWGLAKALKTVTLKYDGLWNRPFPYLMAWFQAPTDGLAHPEAHLHAEFFPPYRTSERLKYLAGTELAAGMFANDALPEEKAKELQAVV

SEQ ID NO: 19872 - protein, 516 aa, Nostoc punctiforme
  unsure (1)..(516): unsure at all Xaa locations
HPRPLLKRSRWQSLNGLWKFSFDDQGKCVEPSDFSQWSNYIEVPYAPESTKSGINDRGFHPNCWYEREFETPPGDGRLLLHFGAVDYRARVWVNDKYIAEHEGGHTSFTLDITHALNDSGTTKVTVWAQDDPHDLAKPRGKQDWHLKPHSIWYPRTSGIWQTVWLERVGETYIGNLRWIPDCERWEIGFEAGLAGNLLTSGVQIKIKLSAGGRVLASDTYEIFNGEITRRIVLSDPGIDDCRNELLWSPEKPTLIDAQIQLWDKDCLLDEVQSYTAMRTVSIQRDRFMLNGRPYYLRLVLDQGYWPETLMTPPSDEALRHDVELVKAMGFNGVRKHQKIEDPRFLYWADVLGLLVWEEMPSAYRFTPKAVERMTHEWTEIIKRDVSHPCIVAWVPFNESWGVPNLVETAAHRNYVLAMYHLTKTLDPTRPVIGNDGWESTDTDILAIHDYETPAXAISPSLQSGYSNIGFIXAXPSWGAYPHPGXLSPSGTTSDVDRVWWHRLCPHXPTXCRSSLG

SEQ ID NO: 19873 - protein, 284 aa, Nostoc punctiforme
ISLKPLRNQVVVITGASSGIGLVTARMAAKQGAKLVLAARNEDALRQLVDEIRAKGGQAIYVVADVGQEEDVNRIAERAIAEFGGFDTWVNNAGVSIFGRCMDVSIPDMKRMFDTNFWGVVYGSRAAVNHFKQRKSGSGALINVGSFLGDRAVAVQSTYSASKHALHGWTDALRTELEAEGAPVSVTLIHPGRIDTPYNEHARSYMPKQPAHRGMIYPPEAVTEAILYAAEHPKRDMFVGFQAKALAVLAGISPRLHRQVDRALGVSLATVRSPLARSRRQCAL

SEQ ID NO: 19874 - protein, 285 aa, Nostoc punctiforme
LQEQQPKPPFPEQQQEVPGLESQMNPKPDYGENSYRGSGKLQGKAAIITGGDSGIGRAVALAFAREGADVLIAYLNEEPDAEETVRIVEKEGRKCVAIAGDIQQEAQCQQIVERAQSEFGKIDILVNNAAFQMTRESLDEISSEEFDRTFKTNIYAMFYLCKAAVPHMQPGSAIINTASINAAEPKPKLLAYSATKAAIVNFTGGLAQLLAEKGIRVNAVAPGPVWTPLIPATMPNEQVTQFGQQYPMKRPAQPAELAPVYVLLASSEASYVSGAVIPVTGGQPV

SEQ ID NO: 19875 - protein, 271 aa, Nostoc punctiforme
YNLNGKTVLITGGSRGLGLVMARQLIQAGARLAICARDPEELERSRIELEQRGGEVLAVPCDVTDKTQVEQMVQQVRDRFGAIDILINNAGVDFVGPMDLMTVEDYDDAMKLHFWAPLYASYAVLPQMRERHQGRIVNISSIGGKVVFPHMLPYCASKFALTGLSEGMRAELAQEGISVTTVCPGLIRTGAPENVIFKGQHRKEYAWFSISDSLPLLSMSAEVVAYKTIAALKRGDAEIILSLPAQIATRFHGLFPGLNTNLLTWVNWLLP

SEQ ID NO: 19876 - protein, 324 aa, Nostoc punctiforme
  unsure (1)..(324): unsure at all Xaa locations
QENDDNLSEASKLLRQGIQQQQAGELIAALKSLQQALGLFQAVGDLQKQAQALSFLGLVTYSAGDYKGAISYSEECLSLLNNTSNLALQMQALSHLGNSYRHLNDHNKAIEFLEKCLKITQQLQDKRSQVAALNNLGLVYKSLSNFTQAIEYQQQSLEIVRELKDNWGEEQVLKNLGNAWYALNNYSKAIAYYEQCVVLARSLKNVRSASQVLKNLGNACYALGDYAKAIKYYEDRLLLAREIQDKRSEEQSLGSLGVACEALGDYNKAITYYEQRLLLARNIKDRRSEEEALDRLRVACYALGDYVKAMQYQQGTSSNSXKAK

SEQ ID NO: 19877 - protein, 183 aa, Nostoc punctiforme
AINDYTQAIRINPNVAVAYKNRAEARSHIGDNQGAIEDYTQAIKINPHYADAYKNRGIARYLLSSQPGFPQAIKINPKDAIAYKKRGNARSDLGDFEGAIEDYTQAIQINPNYADAYYNRDNAHSDLGDFERAIEDYTQAIQINYNYADAYYNRGNIRLEIADKQGAIEDFHKAADIYRKEGK

SEQ ID NO: 19878 - protein, 616 aa, Nostoc punctiforme
MAIKEQPKSPRFRIVANILLAVSGLFLLLNLFLPGLFASGPTGVPYSLFIHQVQEGEVNRVSVGQNQILYELKTENGEPGPVFATTPIFDLELPKLLEEKGVEFAATPPPKNTWFTTLLSWVIPPLIFIGIWQFFLARGGGGGPQGALSIGKSKAKVYVEGESAKITFADVAGVEEAKTELVEIVDFLKTPARFTQIGARIPKGVLLVGPPGTGKTLLAKAVAGEAGVPFFSISGSEFVELFVGVGSSRVRDLFEQAKKQAPCIIFIDELDAIGKSRSSNGFYGGNDEREQTLNQLLTEMDGFAAGDATVIVLAATNRPESLDSALLRPGRFDRQVLVDRPDLSGREAILKIHAQKVKLGNDVDLKAIATRTPGFAGADLANLVNEAALLAARNLRESVAQEDFAEAIERVVAGLEKKSRVMNETEKKIVAYHEVGHAMVGALTTGNGRVEKISIIPRGMAALGYTLQLPTEDRFLMNEDELRGQIATLLGGRSAEEIVFNSITTGASNDLQRATDLAERMVTSYGMSKVLGPLAYQQGQQSMFLGNGGANPRRAVSEDTSKAIDSEVKEIVETAHEQALEILRQNRDLLEAIATQLLETEVIEGEKLHDLLSQVK

SEQ ID NO: 19879 - protein, 436 aa, Nostoc punctiforme
  unsure (1)..(436): unsure at all Xaa locations
LYYLAKAQEHIGEVEEALYNYQEALKLCSDEYETEKAAILHDLADLYVKQGNYQQALTICQQVMKIDEKDNNKLGKAKSLSQIADIKRELGEPEEALKLYMEVLELTQETGDKNFLYTVQNNIATLQVDLGQTDAGITYYQVXFHIERSPENLEDKIPLLSNTASLRLKQGEIEEAREILEQLNKLLPQIDNSWLKAMLLHNLATFRSECGDRELALELYNQALELHRKNGDQPREAMTLQEIGILYERQNNVSEALKFLEDSYQLSLKIGNKDTQAHVLPRIASILIDQDNLDEAEEKLNTALAILNQFNNPKHHALALREMGRLKIKQENYNTGADFLGEALEKCSSVVDVVLRATILKLLGEVLSFLGEVDVAFEHLTESLNIYQKLNWTNDVEKVRGLIKNTQLIKPMRLYQSAATEAEKGNARAALDLLEQ

SEQ ID NO: 19880 - protein, 754 aa, Nostoc punctiforme
TLTLKLRGMSCAGCANNIEKAIRSVSGVIDCNVNFGAEQAAIRYDRSLASLEKIQTAIAAAGYSSDSLQSELLSEEDDTEIASRQALQRELFLKVIVGGVISIFLFLGSLPMMTGLNFPLIPSFLQNPWVQLALTTPVIFWCGGSFYRNGWKSLKRHTATMDTLIALGTSAAYIYSLFVTVFPNFFIVQGLIPHVYYEVAAIVITLILLGRLLENRARGQTSEAIRKLIGLQARDARVIRDGREIDVPIAEVRINDVILVRPGEKIPVDGEVIAGDSTVDEAMVTGESLPVKKQPGDEVIGATINGAGAFQFRVTRVGNDTFLAQIVKLVQQAQGSKAPIQRLADRVTGWFVPAVIAVAIATFVIWFNFTGNLTLATMTTVGVLIIACPCALGLATPTSVMVGTGKGAENGILIKGADSLELAHKIQTIVLDKTGTLTQGKPTVTDFVTVNGTANGNEIKLLQLAATVERNSEHPLAEAVVKYAQSQEVSLIEVKNFQANAGSGVQAVVSNQLVQIGTQRWLTELGINTMTLQQYKDTWETAGKTVILIAVDGELQGIMGIADALKPSSAAVVKALQKLGLEVVMLTGDNRKTADAIAAEVGIERIFAEVRPDQKAAIIQSLQGEIKKSPNSKSKIVAMVGDGINDAPALAQADVGIAIGTGTDVAIAASDITLISGDLQGIVTAIQLSHATINNIKQNLFFAFIYNVIGIPIAAGILFPIFGWLLNPIIAGAAMALSSLSVVSNALRLRKFQP

SEQ ID NO: 19881 - protein, 259 aa, Nostoc punctiforme
LKGQKALVTGASSGIGEAIARYLAASGAAVAINYHSEAESAQKIVDDIKAANGEAFAIQADVSKEDQVKAMFSLTLKQFGTIDILVSNAGIQKDSAFIDMTLDQWNAVIGINLTGQFLCAREAAKEFLRRGVKPDISCAAGKIICMSSVHEVIPWAGHVNYATSKGGINMMMQSIAQELAPHKIRVNSIAPGAIKTPINKSAWDTPQAEANLLKLIPAKRVGNVEDIAKAAVWLASDDSDYVNGTTLFVDGGMTLYPGF

SEQ ID NO: 19882 - protein, 695 aa, Nostoc punctiforme
AFGSPGIDPRWTHANKDAVGTAYFTSSRVWFTVCNGVVTEVYHPTVDKPQIRDLQYLISDGKSFFHEEKRHLESKVEQMWTHGLGYRVTNSDPQGRYAAIKEVIADPHLSCILQHTKLIGEREFISQLQLYALCAPHLEVGGRGNNGYVIEVAGHQILTAEKAGRWMVLGATVPFSRLSCGYVGQSDGWTDLADNFQMDWEFDRALDGNIALTGQLNLDESHEFTLGLAFGTTLHNAISTLFQSLNIPFQQQKQHYIEQWKRSRQGIKPLENISFDDGNLYHHSISLLLAHEDKTYPGALIASLAIPWGEAKDDQDQGGYHLVWTRDMVSSVSGLLAAGETETAVRSLIYLATSQQEDGGFAQNFWVNGEPYWKGIQLDEVGFPILLAWLLHQQKIPLNFDIYPMILRAAGYLIRHGPATQQERWEENSGYSPSTLASNIAALICAAQFVRERGDEVTAKFIEEYADFLECHVEVWTVTTEGTLVPGINRHYIRITPTDINNPQPNENPNQGTLLISSQPPGEPAEFPAKEIVDAGFLQLVRYGIRKPDDPIIVDSVKVIDAVLKVNTPVGPCWHRYNHDGYGQQEDGSPYTGWGKGRAWPLLTGERGHYELAVGGDVKTYIKAMEGFASDTCLLPEQVWDEADRPESHMYLGRPTGSAMPLMWAHAEYIKLLRSNHDNQVFDFIPEVANRYLGE

SEQ ID NO: 19883 - protein, 478 aa, Nostoc punctiforme
KTEAALKQAKETADAANLAKSQFLSNMSHELRTPLNIILGFTQLLLRNRSLNSQQQEYLDTINRSGEDLLTLINDVLEMSKIEAGRVILSETNFDLYGLLDRLQQMFALKAQSRGLQLILERSPTIPQYICADESKLRQVLVNLLGNAIKFTRIGQVTLRVETPNQNITPDEPITLNFSVEDTGCGIADSDFNRLFEPFVQTEAGQKAQEGTGLGLPISQRFVQLMGGDIRVNSTLGKGSIFTFDIRTRAVIMDTLPTPAPSRQVIGLEKGQPSYRILIVEDKLENRQLLVELLTPVGFEVREAVNGQAAIELWQNWSPHLIWMDLRMPIMNGFEATKHIKAAGAQTPVIIALTGSAFEEDRLTALSVGFDDFVRKPFRTTIIFEKMAEYLGVRYVYADEREKQEKASWPSNASFITPKLTVADLSVMPSDWIEQLHQAALRINAKEILMLIKQIPEQHAHLIVALTNLVDCFCFEEI

SEQ ID NO: 19884 - protein, 243 aa, Nostoc punctiforme
TALITGASSGIGKAFAQELAARNTNLVLVARSKEKLSQLAKQLQEQHKIQVDVIIQDLTEPNAAATVFDATKAKGLTIDLLINNAGFGYYGDFAEGDGERQIKIVQLNILALVDLTHKFLPLMRQRRSGSIINVSSITAFQPIPYLSVYAASKAFILSFSEALWAENRQYGVRILVTCPGPIETNFFAEANFPPALASSTDKVYSSEKVVWECLDALEKGYPTVISSDTSTQIRSKLSRLVPR

SEQ ID NO: 19885 - protein, 216 aa, Nostoc punctiforme
FNAEPGQAIALVGATGAGKTTIISLLSRFYDVSGGAIKIDDIEDIRKVTQASLRCQIGVVSQDTMIFSYSVAENIAFGNPQATTAEIEAAAKIANIHNFILTLPQSYETQLGERGINLSKGQQQLISIARAVLVNPRILILEEATSNIDGQTENLVQQAIANLLQGRTSFIIAHRLATVTNADKVLVIEQGQIIEQGIHTQLMEQKGVYANLYSLQ

SEQ ID NO: 19886 - protein, 542 aa, Nostoc punctiforme
KAYIIVPILYGSQIWGLLASYQNSDSRQWKPGEINIVVQIGNQLGVALQQAQLLAQTQRQSQALQEAVITADAANRAKSEFLANMSHELRTPLNAILGFTQIMSHDRALSTEHQQNLAIINRAGEHLLNLINDILEMSKIEAGRITLNLNSFDLIRLLENLEEMLRFRATSKGLELNFEYTSYLPQYIQADESKLRQVLLNLLGNAIKFTRSGRVMLRVAMENMGEKILPHPPHLFFEVTDTGRGIAPQEINLLFEAFGQTETGRKSQQGTGVGLAISRKYVELMGGDISVTSIIGEGSTFAFDIQIDLAAASEIQIQQIRRQVLSLAPAQNEYRILVVDDSIDSRLVLVKILTSIGFAVQEAANGTEAIALWQQWQPHLIFMDMRMPIMDGYEATKIIKAREETSIPNRKTIIIALTANAFEEQREATIKAGCDDYINKPFREEELLKKLSEYLEVKYIYQEDNYQIKNANQQITESILKLTDLVPLLSEMSPEWVKQVYTAAAQCSDDLILELIEQIPSENATLSNFIQNLAHNFQFEKI

SEQ ID NO: 19887 - protein, 620 aa, Nostoc punctiforme
MVQVRYGGQNGQQYELAISDEHVVVRTESRSTLIGARPFEVAPVSPTARSILNQFELTTRFRQAGVEILRAKVPTQGVALRDRAREILNQESEVQFAGRVLIDPASSQPIIYTENLFVKFDNEEESRVCQEILGRYSLTIKRRLEYARNAYFVNAPTNTGIAIFDIAERLLNEESVELCHPELVRESRQRQVFPQQWHLKQTTINGKVINAHANVEAAWKLSDGTGAIIAIIDDGVDLDHEEFRSSGKIVAPRDVTRKNDNPRPGNDNNHGTACAGVACGNGKFGASGVAPGAKLMPIRLASSLGSQDEADAFIWAAQNGADVISCSWGPADGTWFEPNDPLHKQKVPLPDSTRLAMDFAINKGRNGKGCVILFAAGNGNESVDNDGYASYQKVIAIAACNDFGTRSAYSDFGQAVWCAFPSNNGDSSQTPGIWTTDRVGVLGYNSGNVNLGDAGGNYTNEFGGTSSACPGAAGVTALIIARNPNLRWDEVRDIIKRSCDRIDQAGGKYDANGRSPFYGYGRINALKAVELAKPAQTSPISIFKAVQDIPINDLQTSTLSLAIANTSLLKSIKVNVDIEHTYIGDLVVTLLPPVQIGILPIILHDRQGELQIISKQPMTR

SEQ ID NO: 19888 - protein, 321 aa, Nostoc punctiforme
  unsure (1)..(321): unsure at all Xaa locations
QRRKLGRSELEVSPISFGGNVFGWTIDENSSFEILDSFIEAGGNFIDTADVYSKWVPGNQGGESETILGKWLKQRGNRDQVVIATKVGNDMDVRGQGLSREHIQQAVEDSLQRLQTDYIDLYQSHIDDENTPLEETLETYAELIRQGKVRAIGASNYSAERLGQALEISRQHGYPRYESLQPRYNLYDRDGYEQDLQQICQEQEIGVINYSSLCSGFLSGKYRSEKDLSISLRGNSVKRYLNPRGLQILEAIDRVATTYNFTPTQVSLAWLIANPSITAPIVSATKVEQLNDIIKAVNIKLDQDAIDLLNQASSSNTXYGY

SEQ ID NO: 19889 - protein, 252 aa, Nostoc punctiforme
IMNSNIKKLTGKVALVTGGSRGIGAAIAKRLAEDGADIAISYATSSETAAIVVRELEEKGVSAAAFKADQADPLQVGNLVKMVAERFGRLDILVNNAGIFVLGVVGDSASDIASFERQFAINVGGVVAAVRAAVPLMTEGGRIISIGSCVGTHSLWAGISDYSATKSAIAGYTRGWARDLGSRAITVNVIQPGPIETDMNPSDSDFAVIQKAATALNRYGKPEEVAAAVAFLASPDAAFITGATLDVDGGMN

SEQ ID NO: 19890 - protein, 472 aa, Nostoc punctiforme
GHATSLKDYENLFPVISLPAIAKTYQEDEVFAYMRVAGYNPVTIKRVTTLSDRFPVTDEHYQAVMGTDDSLAAAGIEGRLYLADYKILDGAINGTFPHEQKYLYAPLALFALPKGSDPTRLLRPVAIQCGQTPGPDYPIVTPNSGKYAWLFAKTIVQIADANIHEAVTHLARTHLLVGVFAIATARQLPLTHPLRILLRPHFDSTLAINDAAQRILIAPGGGVDRLLSSSIDNSRVLAVLGLQSYSFNSTILPNQFQQRGVDDPNLLPIYPYRDDALLIWNAIHQWVWDYLNLYYTTDEDIQKDRALQAWAAEIPAYDGGRIPDFGEDGGIKTLNYLIDATTLIIFTASAQHAAVNFPQKDLMGYAAAIPLAGYLPASTLKREVTEQDYLNLLPPLDQAQRQYNLLSLLGSVYYNKLGEYEQGYFTDEKVKPLLQAFQSHLQQVENTIKQRNLHRPPYEYLLPSKIPQSINI

SEQ ID NO: 19891 - protein, 504 aa, Nostoc punctiforme
  unsure (1)..(504): unsure at all Xaa locations
LRRLKIKLAVGMSSRFLWHILRLPVSFYAQRFSGEISNRTTLNDQVADVLAGRLATTIIDTFMVFFYALVMVQYDWVLTLIVVSFAAVNVLTLQLISRQRVDANQRLIQEYGKAAGVSIAALQSIETLKASGLESDFFSRWSGYYTKALNSQQELGVTNQTFSVLPTLLSALSSMLLLVVGGLRVMDGHLSIGMLIAFQGLMLNFQQPVNNLVNFGTTLQELEGNLIRLDDVLDNPIGEGAGGDGGVTSSSSPSSAYLVPKLQGYVELQNITFGYSRLEPPLIENFNLSIKPGQRVALVGGSGSGKSTVAKLVSGLYQPWAGEVYFDGKPREQIPQQLLTNSVAMVEQEILLFGGTVRDNLTLWDTTVPDKSLMRACVDAAIADVILSMSGGFDAELIEGAANLSGGQRQRLEIARALVNNPSILIMDEATSALYAETEQIIDRNLRRRGCTCIIVAHRLSTIRDCDQIIVLERGKVVQLGTHKELWQVDGAYSRLLGTQGXRR

SEQ ID NO: 19892 - protein, 164 aa, Nostoc punctiforme
MGVSGSGKTTIGKLLADSLSWEFSDADSFHSPENVDKMRRGIPLTEADRMPWLQDLQTAIKHWLQENKNVVLACSALKDSYRQFLVSDSDRCTNAKSDRIKLVYLKGSYELIQMRLQERSNHYMSEKLLNSQFDTLEEPLDTISIDVAQPPQIIVQNIRTALRL

SEQ ID NO: 19893 - protein, 278 aa, Nostoc punctiforme
MSDLILNKLFSLKDRVAVVTGGSGVLGGAMAKGLALAGARVVVLGRNEARASAVVSDITANGGESMAVLADISDRSQLEIAREAIIQRWDQIDILVNMAGGNIPAATITPDATIFDMPHTAFEEVVSLNLLGTLLPSQVFGQAMVERNQPSGCIVNISSMSAIRAISRVVGYSAAKAGIDNFTRWLAVELAQKYGDGMRVNAIAPGFFIGEQNRDLLLNADGSLTERGQKIIEHTPAGRFGKPDELLSTLIWLCSSGSSFVNGVVIPVDGGFSIYSGV

SEQ ID NO: 19894 - protein, 460 aa, Nostoc punctiforme
MRILFVAAEAAPIAKVGGMGDVVGALPKFLREMGHDVRIFLPYYGFLPDKMEIPKEPIWRGSAMFQEFAVYESVLPGTDVPLYLFGHPVFLPRRIYSGDDEDWRFTFFSNGAAEFAWNYWKPDIIHCHDWHTGMIPVWMHQDPDITTVFTIHNLAYQGPWRWYLEKITWCPWYMQGHNTMAAAVQFANKVNTVSPTYAEQIKTPAYGETLEGLLSFISGKLSGIINGIDTEVYNPEDDKYIAQTFTTETLDKRKANKIALQEEVGLEVNSKAFLIGIVTRLVEQKGIDLILQILDRFLSYTDAQFVLLGTGDRYYETQMWQLASRFPGRMATYLLYNDALSRRIYAGTDAFLMPSRFEPCGISQMMSLRYGSVPIVRRTGGLVDTVSHHDPENAAGTGYCFDRYEPLDLFTCMIRAWEGFRFKPQWQELQKRGMSEDFSWYKSAKEYVKLYRSIYGLPEE

SEQ ID NO: 19895 - protein, 318 aa, Nostoc punctiforme
VSSPPRTIRIGSRKSQLALVQTYWVQEQLQKSFPDITFEVHTMSTQGDKILDVALAKIGDKGLFTKELEVGMLNQEIDFAVHSLKDLPTNLPEGLTLAAITERENPADALVVHEKHKDKQIDTLPEGAVIGTSSLRRLAQLRHHFPHFTFKDVRGNLITRLAKLDAGEYDALILAAAGLERLGMSDRVHQIIPKEISLHAVGQGALGIECRADDSELLTLLKAIEHPATRDRCLAERSFLRSLEGGCQVPIGVNTEISGENLTLTGIVASIDGQKLVKDTVTGIANNAEALGTELAELLRQQGAQEILSEIFAVIQRG

SEQ ID NO: 19896 - protein, 387 aa, Nostoc punctiforme
MGRVGVLLLNLGGPDKLEDVGPFLYNLFSDPEIIRLPFRWLQKPLAWFIASRRTRTSQQNYKQIGGGSPLRRITEAQGEALKKQLGYLGQEANIYVGMRYWHPYTEEAIAQITQDNIEHLVILPLYPQFSISTSGSSFRLLDKLWQEEPKLQPIEYTVIPSWYKQPGYLQAMAELIAQELEQFPNPDEVHIFFSAHGVPKSYVEEAGDPYQQEIEECTALIMQTLNRPNAHTLAYQSRVGPVEWLQPYTEDALKELGAQGVKDLVVVPISFVSEHIETLQEIDIEYREVAEESGIHNFRRVPAPNTHPVFINALAELVIDALKNPSFKLSQAAQMKKMVKMYPQERWEWGLTTSAEVWNGRIAMLGFIALIIELITGHGFLHMIGLL

SEQ ID NO: 19897 - protein, 512 aa, Nostoc punctiforme
TPNSHFLGAADTDYAVEEIRTKAAQAFQSVRQQLGKTYLPLINGEYVNTPEFVDSLNPSNFSEVVGKVGLISVEQAEQAMQAAKAAFPGWRKTPAKQRADILRKAGDLMELRRAELSAWIVLEVGKPVKEADGEVSEAIDFCRYYADEIERLDKGVNYDLAGETNRYIYHPRGIVVVISPWNFPLAIACGMTVAALVSGNCTLLKPAETSSVIAAKLTEILIDAGFPKGVFQYVPGKGSQVGAYLVNHPDTHVIAFTGSQEVGCRIYAEAAILKPGQKHMKRVIAEMGGKNAIIVDESADLDQAVVGVVQSAFGYSGQKCSAASRVIVLEPIYEAFVQRLVEATKSLNIGEAELPSTQVGPVIDANARDRIQKYIEIGRQSAEVALELPAPKQGYFIGPVIFSEVSPNAVISQEEIFGPVLAVIRVKDFQEALAVANGTNYALTGGLYSRTPSHIQQAQTEFEVGNLYINRNITGAIVGRQPFGGFKLSGVGSKAGGPDYLLQFLEPRAVTE

SEQ ID NO: 19898 - protein, 279 aa, Nostoc punctiforme
SVAFSPNGKLLATGDTNGEIRLYEVANSQQLMTCKGHTGWVWSVTFSPDGQVLASGSNDQTIKLWDISNGQCLKTLEGHSGGVRSVTFNPDSQLLASGSDDQTVKLWNISTGKCLKTLQENGCSIWSVAFNPKGDVLASGNDDYKVRLWDINSNSCIHTLEGHTQRVYSVCFSPDGNTIASASHDQTVKLWDTSTGKYIKTLQGHTDLVHSVTFSVDGSALVSCGDDQTVRVWDFVSGQCLKTLQGHKSRVWSLAICINQNICASSSDDQTVKLWNMST

SEQ ID NO: 19899 - protein, 280 aa, Nostoc punctiforme
SVAVSPTDNNILASGSNDQTVTLWDITAGKCIKTLREHGRRVTSVGFSPDAHLLASGSEDQTVRLWDLSTSKCLKILKGHSNRVTSVTFSADSYFLASGSDDQTIRIWDITTGQCLNALREHSGRTWSVTFSPDSHVLASGSHDQTVKLWDVRTGRCLHTLQGHTEWVWGVAFSPNGGMLASGSGDQTIKLWDVSTGQCIRTLQDHTNTVYSVAFSSDGRILASGSGDQTVKLWDVNTGSCLRTLLGHTRWVWSVTFRSDDQTVVSCSEDETIKIWDVQT

SEQ ID NO: 19900 - protein, 265 aa, Nostoc punctiforme
YDNIYVFGDSLSDIGNVFNATNGIIPPSPTYYDGHFSNGPNWVDYLASDLGLTSNLKNNFAFGGATTGIENIGLATLPGLQQQINNFVAAETADPNALYIIWAGTNDYLSYFFDGEPNPSNTVANLSTALTSLVADGAKDIMVVNLPDLGKSPFANFTSERSNLFSTFSSEHNSSLNTELKTLSQQLSPDINIIELNVNSLFDRIVAAPEEFDFTNVTNSCISKDLSVVPIDVPTQQVFCNPEEFLFWDEVHPTTTAHKLIGELA

SEQ ID NO: 19901 - protein, 295 aa, Nostoc punctiforme
DMEMLPYLSDPFRGTIERWVLSHEESSLTLEYCAATDALNAAKLSINDIDLMIVASVWPEQIGFGNAAFLARKLGLVGAAWNLDGTCGSTPVVLQTASALVRAGEYRNVLVVISCSYSRVFDEQDTVSWFLGDGAGAFVVSSMEGNQGILGTKTVHTGALCEVVSAELTKDEQGNSRVRMQTGNGAKALRETAAEFLSICCEGAIASAGVTLEQIDFFLFNTPTAWMTRFCTRLLNINPERTIDLYPLYANIGPVLTVANLYHAAHLGKIHENDLVLIYGSGAAGVASASVMRWG

SEQ ID NO: 19902 - protein, 304 aa, Nostoc punctiforme
MLGQLLDGRYQILQVLGGGGFGQTYIAQDTHRPGFPKCVVKHLKPVTRSPEFLETARRLFTSEAETLEQLGNHDQIPRLLAYFEDNQEFFLVQEFIEGHTLKAELLPNQPWAEYQVIQLLQQMLGILQFIHSHNVIHRDIKPDNIIRRQQDGKLVLIDFGAVKQVQTQLLTVSGRTGATIIIGTPGYMSTEQGQGKPRSNSDIYSLGIIGIQSLTGLHPINFEEDQDTGEISWQHQANVSSELASVLSKMVLHHFKQRYQSAAEVLQVLKNLDSKVEAQSLQSPSFRQPYQASLSQQNSIEYPP

SEQ ID NO: 19903 - protein, 711 aa, Nostoc punctiforme
KNYQCVLQLSEEDCGAASLASICKHYGRFLSINRSRDAVGTGQLGTTLLGLKRGSENLGFNARAVKASPAIVDRITEINLPAIIHWRGYHWVVLYTKRGNKYVIADPAVGIRYINQEELTEAWNGVMLLLEPDPVRFFEQPAEEAKGGLSRFLVRILPYRGLLTQVLTINIVLGLLALGTPVLIQLLTDDVLVRGDTQLLTVVISAVVVMSLFGSTLQLLQAIMIAHFGQRLQLGLVLEFGRKILQLPLNYYEARRSGEITSRLRDINDINQLVSQIVVLLPSQFFVAVVSFGLMLFYSWKLTMAVVVFAGLITLSTLPFLPILQQKTRSLLVLGTENQGVLVETFKGAQVIKTTNAAPQFWDEFQSRFGCLANLTFSTIQIGIINGTISKLIASLGGVILLGLGSILVINGELSIGQMLAFNALQFNVLALINSLVGLVDEYFRSQTAISRLLEVIDATPEVVGGSQKPVVQISSDADIRCSHVQFHHPGRVDLLEDFSLKLPGGKAIALIGKSGCGKSTLAKVIAGLYQPNSGNIRIGFYNINDLSLDCLRQQVVYVPQEPHFWSRSILENFRLGTPYISFEEIVKACQIADADEFISQLPNQYQTVLGEFGANISGGQRQRLAIARGILTNPPVLILDEATAGLDPVSESHVLDRLLEYREGKTTILITHRPSVINRADWIVLLDKGQVQIQGDLETFLSQQGEHLKF

SEQ ID NO: 19904 - protein, 465 aa, Nostoc punctiforme
IIKAFEVVLGKNGVVQRREELITYECDGLTGYRQRPAVVVLPRTTEQVAQVVKICNQYSIPFIARGSGTGLSGGALPVEDSVLIVTSLMRQILSIDLENQRTIVQPGVINSWVTQAVSGAGFYYAPDPSSQIICSIGGNIAENSGGVHCLKYGVTTNHVLGLKIVTPEGEIVDLGGQIPEMPGYDLTGVFVGSEGTLGIATEITLRILKSAESICVLLADFTSIEAAGATVSDIISAGIIPGGMEMMDNFSINAVEDVVATNCYPRDATAILLIEIDGLEVEVAGNKQRVTEICKKNGARNVTSASDPETRLKLWKGRKAAFAAAGHLSPDYYVQDGVIPRTQLPFVLHEIEALSEQYGYRVANVFHAGDGNLHPLILYDNSVPGALEQVEEMGGKILKLCVQVGGSISGEHGIGAEKKCYMPQMFSPVDLETMQWVRQVFNPKGLANPEKIFPTPRTCGEAANA

SEQ ID NO: 19905 - protein, 368 aa, Nostoc punctiforme
ESQNYLDLAKSLAKEFAQTAVERDAQGGTPKHERDRLRQSNLLKLIVPTEFGGLGQSWITVLQITREFAKVDSSIAHVFSYHHLGVVIPHIFGSAQQKQRYYSETIHNNWFWCNALNPLDKRTTLTPENDYFRLNGIKSFCSGSQDSDILPITATHQETNELNILVIPTQRQGVTVHDDWDNMGQRQTDSGSVTFENVLVYPEEILGSRNKANQPFNTIRACLTQLNLANIYLGIAQGVFEAAKTYTSTNTKPWLTSGVESATQDPYILQHYGKIWVDLQAAVYLTEQAGELLQAAWEQEWSLTAEQRAECALLVATAKVFATKVGLDITNRIFEVMGARATSAKYGFDRYWRNLRTFTLHDPVDYKI

SEQ ID NO: 19906 - protein, 476 aa, Nostoc punctiforme
SPSEAEGLGKGIESSFGLNLIPLPANPLFGTDGIRGRVGELLSAPLALQVGFWTGIVLRNHATQIGPVILGQDSRNSSDMLAMALSAGLTAAGLEVWYLGLCPTPCIAYLTSISDAIGGVMISASHNPPEDNGIKVFGANGGKLPQILQAEIEAGLRGKISPIAKVSNCGRHYSRFELVGHYGDALKKPLNSTLNLQGMKIVLDLAWGAAVGLAPSVFTEMGAEVICLHNEADGDRINVNCGSTHLDILAATVQEHNADIGFAFDGDADRVLAVDNTGRQVNGDYILYLWGRHLQKNQQLPDNLIVSTVMANLGFEKAWQQIGGKLIRTAVGDQYVQAEMQRTGGMLGGEQSGHILCRHYAVTGDGLLTALHMAALVKEAGVSLAELVDQSFQTYPQILRNVRVTDRDRRLGWQDCEPVQQAIALAEAAMGDSGRILVRASGTEPVIRVMVEAANAELTNYWTNELVSKVQQHLMD

SEQ ID NO: 19907 - protein, 325 aa, Nostoc punctiforme
  unsure (1)..(325): unsure at all Xaa locations
LGIAITGSGSAVPATSLHNQTLTELVETSDEWIATRTGIRQRRLAVSSESLSGLATAAGSRAIAASGIRPEDLDMILLATSTPEDLFGSACQVQAQLXATNAVAFDLTAACSGFVFGLVTAAQYIRTGVYKNVLLIGADILSRWVDWQDRRTCVLFGDGAGAVVLQASKSDRLLGFALKSDGTQNHHLNLAYAGASQELLPGVNITKGTYQPITMNGKEVYRFAVQKVPEIIDKALFQANLKVDQIDWLVLHQANQRIIDAVAQRLNIPEHKVISNLAQYGNTSAASIPLALDEAVRQGKIKPHDIVATSGFGAGLTWGAAIFQW

SEQ ID NO: 19908 - protein, 289 aa, Nostoc punctiforme
KTAWVFPGQGSQTLGMGIDLLDIPFAKDKFAQAEEILGWSVTKICQNEEAKLSQTLYTQPSLYVIESILADLLQERGQQPDLVAGHSLGEYSALYVAGVFEWSAGLYLVKRRAELMDNAVGGMMAALMNFDREQLEKVIAHTPDVVLANDNSSAQVVISGTTEAVQAVMTQVKAKRAIPLKVSGAFHSHLIAPAAAEFQNILESVEFQPATVPVLSNVEPIPSIDAEILKQRLNKQMTGSVRWREISLQLPANGIQRVVEVGPGKVLTGLIKRSSPDLILENIQSGADL

SEQ ID NO: 19909 - protein, 603 aa, Nostoc punctiforme
MGKVIGIDLGTTNSCVAVLEGGQPLVISNSEGGRTTPSIVGFGKSGDRLVGQLAKRQAVTNAENTIYSIKRFIGRRWEDTDTERERVPYNCVKGRDDTVDVQIRSKNYTPQELSAMILQKLKQDAENFLGEEVTQAVITVPAYFTDAQRQATKDAGTIAGLEVLRIINEPTAAALAFGLEKQDQEQLILVFDLGGGTFDVSILQLGDGVFEVKATCGNNHLGGDDFDNAIVRWLMERFQQQEKIDLSQDKMALQRLREAAEKAKIELSSMVNTSVNLPFITSDETGPKHLEMEFSRSKFEELAGKLIEGTIEPMIQALKDADLKPSAIDRIILVGGSTRIPAVQNALIKFFNGKAPDRSINPDEAVALGAAIQAGVLGGEVDNLLLLDVTPLSLGIETLGEVFTKIIERNTTIPTSKSQIFSTAVDGQTSVEIHILQGERAMSRDNKSLGKFLLAGIPPSPRGVPQIEVSFEIDVNGILKVSAQDKGTGREQSIRITNTGGLSTNEVERMRQEAELFSEEDRRRKELVELKNQADNLLFSYESTIKDNSNFIGEQMKTLASEKVSQLQAAMIDSSISTVEFKQRLDEFQQTLFAIGADVYNRA

SEQ ID NO: 19910 - protein, 362 aa, Nostoc punctiforme
EATEAEFRVEGYEKIEFSLVYVNGAFDISNREIADSYEKFGRCLTVIDANVNRLYGKQIKSYFRHYGIDLTVVPIVITEPTKTLATFEKIVDAFSDFGLIRKEPVLVVGGGLTTDVAGFACAAYRRKSNYIRVPTTLIGLIDAGVAIKVAVNHRKLKNRLGAYHAPLKVILDFSFLQTLPTAQVRNGMAELVKIAVVANSEVFELLYEYGEELLSTHFGYVNGTKELKAIAHKLNYEAIKTMLELETPNLHELDLDRVIAYGHTWSPTLELAPMIPLFHGHAVNIDMALSATIAARRGYITSGERDRILSLMSRIGLSIDHPLLDGDLLWYATQSISLTRDGKQRAAMPKPIGECFFVNDFT

SEQ ID NO: 19911 - protein, 492 aa, Nostoc punctiforme
DAIVIGSGIGGLVTATQLAAKGAKVLVLERYLIPGGSAGYFERQGYRFDVGASMIFGLGQNGTTNLLTRALTAVNVSQDAIADPVQIHYHLPQGLDLKVDRVYEKFLQNLIAHFPHEEKGIRRFYDECQKVFKCLNSMDLLSLEEPWYLLRVFFQHPLACLGLVKYLPQNAGDFARRYIKDPKLLKFIDMECYCWSVVPSDMTPMINAGMVFSDRHYGGVNYPKGGVGQIAQKLVEGLEKAGGKIQYKARVTKILTEKGKAVGVQLANGKVYRGKRIVSNATRWDTFEQLLPAEEMPLNEKKWQQNYQKSPSFLSLHIGVKESVLPVGTECHHILLEGWEKMTAVEGTIFVSIPTLLDPDLAPSGYHIIHAFTPHWIDDWQELSPSEYKAKKEEAAGRIIDRLEKIFPGLDAGLDYLEVGTPRTHRRFLGRQDGSYGPIPRRKLRGLLKMPFNRTAIPGLYCVGDSTFPGQGLNAVAFSGFACAHRIAVDLG

SEQ ID NO: 19912 - protein, 285 aa, Nostoc punctiforme
ITGKTKLLGVIGHPVEHSLSPAMHNAAIANLGLDYVYLPFPIAPENLEVAIAGFAVIGVVGFSVTIPHKQAIMPLLSEITPLAQMIGAVNTVSRQNNQWVGTNTDIEGFIAPLQTTYKQDWSQKVAVILGNGGAARAVVAGCHQLGFAKIHVVGRNVQRLQEFRDSWSNSPISENLQVHQWEELSKLIPQANLLVNTTPIGMYPKVDESPLSIEEIANLPTGAIAYDLIYIPKPTQFLELAQKQGAIAIDGLEMLVQQGVAALKIWLQQENIPVEVMRQALLNQL

SEQ ID NO: 19913 - protein, 305 aa, Nostoc punctiforme
SRVLCLGEILFDCLADQLGLKLEEVKSWTPYPGGAPANVACALVKLGTTAGFIGAVGEDEPGNALVKLLQDVGVDTTGVQRHPTAPTRQVYVTRDLAGDRTFAGFGQYDTAEFADTRLQAKQLPDALFQEADFLVLGTLELAYPESEQAIYRALELAEHYDLKIVLDINWRPVFWTEPKIAHQKIPELFKRVDFLKLSKEEAEWLFETADSWAITYRLASIEGVLVTDGENGCTYCLGENEGKLPSFSIPVVDTTGAGDSFLAGFIHQLSHYGIHSLRDAETAKRIVTYASAVGALTTIKPGAIA

SEQ ID NO: 19914 - protein, 265 aa, Nostoc punctiforme
EQILQDRYQIQHQLGNNGIRQTWLAKDLLASDGENSTVVVKLLAFGGTIQWDDLKLFEREAQILKTINHPRIPRYIDYFCIDDRTLWFGLIQQYIPGESLKEKLALGKRFTEKRARKIAGEILNILMYLHELNPGVLHRDIKPSNLIWGEDNRIYLVDFGAVQDKAAREGVTFTVVGTYGYAPMEQFGGRAVPASDLYALGATLIHLLTGTCPSDLPQQDLRLQFADRVNLSPSFASWLQKLIEPAPEQRFPDARQALNALKSGL

SEQ ID NO: 19915 - protein, 209 aa, Nostoc punctiforme
FGKKQVMPTPEEALSGRAQSMSVPAAHYVNKNPLKAPYPDGLEKAIFGLGCFWGAERKFWQLKGVYTTAVGYAAGFTPNPTYEEVCSGRTGHNEVVLVVFDPKVISYSELLKVFWESHNPTQGMRQGNDAGTQYRSGIYVYSESQKQLAEASREAYQQALNDAGYGKITTEILDAPEFYYAEAYHQQYLAKNPNGYCGLGGTNVSCPVG

SEQ ID NO: 19916 - protein, 330 aa, Nostoc punctiforme
QGFSAFITNLGIRDTTDDFVFIKSEVPCVADGVFTQSLFAGPSVTISRDNLKDSQVQGIVVISKNANVANGAVGIADAQEVLQLVATETGIAAHNMVIASTGVIGRRYPIEKIRAGLLGLGKKLTPADFNAAARGIMTTDTVSKLATRQVGNAKLVGIAKGVGMIEPNMATLLTFFFTDAAISANSLRSIFRSTIDKTFNCLSVDTDTSTSDSAVILANGIAGEVSEADFASALQEVAQELVLKIARDAEGATKIIEVTVDSAINYVQAKKVAKAIVNSPLVKTAVYGADPNWGRVAMAIGKCENEQQINPERVVISFDDVKVYPIAILN

SEQ ID NO: 19917 - protein, 532 aa, Nostoc punctiforme
LLRTSSLQLCFAILAGIFSGGTAAGLIALINTTLSQNQPSKTILIWSFVGLCLLRLIANFVSQVLLIQLSQKAILNLRVLLTRSILASPLRHLEQIGAHGLLAVLTEDIQTISNTVITVPFVCINIAIVIACLIYLSWLSKIVFLIGISFMFLGIFSYSLPMMKAMSFLKLAREQEDRLFKHFRSVIQGTKELKLHRRRRQAFLSEELHTTASSFRRHNVVGMSIFAAAASWGQVLFFVAIGLLLFIIPTINKIPPAILSAYALTIIYLISPLEYIMSMMPSITKALVALKKVESLGLSLASYSNEICDNVSLASDQYWNCLELVNITHAYYQEREESNFILGPIKLKFHPGELVFIVGGNGSGKSTLAKLISGLYIPETGNIYLDDQLIDNHNLEWYRQQFSVVFSDFYLFDRFLGLDSGDLDIQTRKYLIELQLDHKVKVNNGVLSTTDLSQGQRKRLALVTAYLEDRPIYMFDEWASDQDPVFKEIFYTQLLVELKKRGKTVLVISHDDQYFYLADRIVKLEYGQVKTE

SEQ ID NO: 19918 - protein, 483 aa, Nostoc punctiforme
MTEPQNLTTADGIPVSDNQNSLTAGARGPVLIQDFHLIEKLAHFNRERIPERVVHAKGAAAHGTLTITNDITRYSKAKLFSEIGKKTELILRFSTVGGEKGSADAERDPRGFSLKFYTEEGNWDLVGNNTPIFFIRDPLKFPDFIHTQKRNPQTNCKDQNAKWDFWSLSPESLHQVTILFSDRGIPKTHRHMDGFGSHTFSLINAEGDRVWCKFHFKTLQGHQTLTEEESAKIKGEDPDHATHDLFEAIAKKDYPKWRMCIQVMTEEQAEKHPDNPFDLTKVWKQGEYPLIEVGILELNRNPENYFAEVEQAAFSPSAVVPGVSFSPDKMLQARIFSYPDAQRYRLGGNYQQLPVNQPKCPVMHYQRDGFMASGNNGGSVPNYEPNSAEGTPKENPAYAEPPSHLGDVTVDRYSHREGNDDYTQAGNLYRLLTPEQQERLAKNIVGSLSQAREDIQMRQLCHFFRADVSYGRRVAEGLGIAID

SEQ ID NO: 19919 - protein, 268 aa, Nostoc punctiforme
RHSYVLAIGGGAVLDMVGYAAATAHRGIRLLRVPTTVLGQNDSGVGVKNGINAFGKKNFLGTFMPPYAVLNDFDFLTSLDDRDWRSGIAEAVKVALIKDADFFDFIMTNADKLANRDMDIMERLIYRCSQLHLEHIAGGGDPFEMGSSRPLDFGHWAAHKLEHLTNYSLRHGEAVAIGIALDTTYSYLTGQLLKSEWQSVLYTLSKLGFTLYVPALTEQLDRLDHPDCLFRGLTEFREHLGGNLTITLLEGIGQGIEVHQVDLSLYRD

SEQ ID NO: 19920 - protein, 278 aa, Nostoc punctiforme
MAIEFTKYHGLGNDFILIDNRSSSLPVLTPEQAIQLCDRHFGIGADGVIFALPGENGTDYTMRIFNSDGSEPEMCGNGIRCLAGFLADLEGQSRNKDSYRIHTLGGVMTPQLLSDGLVKVDMGLPRLLAGEIPTTLAPVEEKVISVPLEVAGKTWEVTCVNMGNPHCITFVEDVAAIELESIGPKFEHHPAFPQRINTEFIQVVRRDYLKMRVWERGAGITLACGTGACASLVAGVLTGKCDRTATVELPGGPLQIEWSEIDQRVYMTGPAERVFTGK

SEQ ID NO: 19921 - protein, 282 aa, Nostoc punctiforme
TAKLLDGKAIAAKIQQELSVAITQLQPEIGRPPGLAVLMVGDNPASAAYVRNKEKACAKVGIASFGKHFPAETTFRELEKVIAALNDDERVDGILVQLPLPDHLDAVALLHQIDPDKDADGLHPVNLGRLVRGEIGLRSCTPDGVMRLLQEYEIPLQGKQAVVVGRSILVGKPMALMLLEADATVTIAHSRSHDLKSITQNADILIAAAGRPGLITADMVKPGAVVVDVGMNRVTDASGKSRLIGDVDFESTAGVAGFITPVPGGVGPMTVAILLQNTFTSY

SEQ ID NO: 19922 - protein, 310 aa, Nostoc punctiforme
MVATDNVQKTPPEEATFNLVAYLKERQKLCDNALDRAIPIIYPEKIYEAMRYSLLAGGKRVRPILCLATCEMMGGTIEMAMPTACAVEMIHTMSLIHDDLPAMDNDDYRRGKLTNHKVYGEDVAILAGDGLLALAFELVALKTPANVNRELTLQVIVRLGRALGAAGLVGGQVVDLECEGKSDISLETLNFIHRHKTSALLEACVVSGGIIAGASTEDVQRLTRYAENIGLAFQIIDDILDITSTKEQLGKTAGKDQKAKKVTYPSLWGLEESRLKAQELVKVACAELEPFGDRAKPLQAIAHFITSRNN

SEQ ID NO: 19923 - protein, 278 aa, Nostoc punctiforme
MTNQAPIPVIVNGAAGKMGREVIKAVAQAPDLNLVGAIDHSLEHQDKDAGELAGLSEPLEVPITNQLEPMLGYVAGDRQSPPGVIVDFTHPDSVYDNIRSAIAYGIRPVVGTTGLSPEQIQDLADFADKASTGCLIIPNFSIGMVLLQQAAIAASKYFDHVEIIELHHNQKADAPSGTAIQTAQLLGELGKTFNPALVEETEKLPGARGSIADEGIRIHSVRLPGLIAHQEVIFGAAGQIYTLRHDTSDRACYMPGVLLAIRKVLALKSLVYGLEKIL

SEQ ID NO: 19924 - protein, 508 aa, Nostoc punctiforme
MKLAYWMYAGPAHIGTLRIASSFKNVHAIMHAPIGDDYFNVMRSMLSRERDFTPVTTSVVDRNVLARGSQEKVVDNIVRKDAEEHPDLIVLTPTCTSSILQEDLHNFVERAQLEAKGDVMLADVNHYRYNELQAADRTLDQIVQYYIEKARKRGELAEGKTAKPSVNIIGTTTLGFHNNHDCTELKRLMADLGIKVNTLIPEGASVNDLKKMSQAWFNLVPYRELGLTTARYLEEQFGTPYIDITPMGVVETARCIRKIQQVINAQGAEVDYENFINEQTLHVSQAAWFSRSIDCQNLTGKKAVVFGDNTHAAAITKILAREMGIHVVWAGTYCKYDAGWFREQVSEYCDEVLISEDHGEIGDAIARVEPSAIFGTQMERHVGKRLDIPCGVIAAPIHVQNFPIGYKPFMGYEGTNQITDLIYNSFTLGMEDHLLEIFGGHDTKEVITRGISADSDLNWTKDGQAELNKIPGFVRGKVKRNTEKFARDRGFKEINAEVLYAAKEAVGA

SEQ ID NO: 19925 - protein, 247 aa, Nostoc punctiforme
MTGKLKEQVAIITGASAGIGEATAIALAAEGATVVLAARRGDRIQALAERIEASGGKALPIVTDVTDENQVNHLVAKANVELGRVDILVNNAGIALLGTIEAGNSSDWRRSFDINVLGLLYATHAVLPLLKAQKSGHIVNISSVAGRTARAGVGVYNATKWGVNALSEALRQEVHKDNIRVTIIEPGLVDTEIDNQITDPVAKQRIEERRKAITPLHSEDVAAAIVYAVTQPSRVNVNEILIRPTGQ

SEQ ID NO: 19926 - protein, 402 aa, Nostoc punctiforme
LRVAVIGSGPAGSSAAETLAASGIETYLFERKLDNAKPCGGAIPLCMVSEFDLPPEIIDRRVRKMKMISPSNREVDINLINEDEYIGMCRREVLDGFLRDRAAKLGANLINATVHKLDIPGNNTDPYTIHYVDHTEGISQGIAKTLKVDLIIGADGANSRVAKEMDAGDYNYAIAFQERIRLPEDKMAYYNDLAEMYVGDDVSTDFYAWVFPKYDHVAVGTGTMHINKASIKQLQAGIRARASEKLAGGKIIKVEAHPIPEHPRPRRVVGRIALVGDAAGYVTKSSGEGIYFAAKSGRMCAETIVEASNSGSRIPTEGDLKIYLKRWDKRYGLTYKVLDILQSVFYRSDATREAFVEMCDDLDVQRLTFDSYLYKTVVPANPITQLKITAKTIGSLIRGNAL

SEQ ID NO: 19927 - protein, 342 aa, Nostoc punctiforme
LSASANVNSPLRQLAAAKGKLYGAAVSSEFLLQEKGYADLIARECSIVTPNGELKWNATEPQPGKFTFESADAIAGFCQKHNIQLHGHTLFWHMGKPDWLPYPPTLKMLERHIKGVMGHYRNSPVLKSWDIANEIIADSENETDNATYGLRKGVKRELIRDLFLIAASVDNTKKFYLNDFGIEGATWKSDRFLKMVEYLKNSDVKIDGAGIQSHLWFSTAYGFDKKGFNSVLKRLNDLQVKPIITELDIIIDAPLPDSIKKLDQMVADSYKRYLDLCFAAGVDTVITWGITDRHTWIRHPDWMPGKTFRNNPSLWKFLRPLPFDENLQPKLARNAIAQAFQQ

SEQ ID NO: 19928 - protein, 152 aa, Nostoc punctiforme
RFTCMSAIQVVNLLNSIFSTFDRLTEQHGLKRIKTINDAYMVVGGLPTRRPDHTQAIALFNTENNQNFNNRIGIHSGSVVAGVIDLNKFAYDLWGDTLNIASRMESQGIVGKIQVTEDIYKSLCNKFLFQKRGEIEVKGKGKMTTYFLVGQK

SEQ ID NO: 19929 - protein, 173 aa, Nostoc punctiforme
  unsure (1)..(173): unsure at all Xaa locations
VGEDLTRRLLKTPKRVAEAMRFLTSGYNQSLEELVNDAIFDEGHNEMVLVRDINFFSLCEHHMLPFMGRAHVAYIPNQKVVGLSKLARIVEMYSRRLQVQERLTRQIAEAIQTILEPRGVAVVMEASHMCMVMRGVQKPGSWTVTSAMXGVFQEEHKTREEFFNLIRHQPTFF

SEQ ID NO: 19930 - protein, 206 aa, Nostoc punctiforme
MRVKICGITQPQQSIAIASLGATALGFICVPNSPRYVTTSQIRAAVAELPADIDTIGVFANSSIVEISQIVVDSGLTGVQLHGDELPDFCYQLRQALPNVEIIKALRIRSLEHLGTAADYTKYVDTLLLDAYHPEQLGGTGKTLDWKILEQFNPNCPWFLAGGLTADNIVEALSQVSPSGVDLSSGVERAPGDKDLDKVSKLFEKL

SEQ ID NO: 19931 - protein, 272 aa, Nostoc punctiforme
MTIKFGLIGGGVMGEALLSRLIARGIYQSSEVIVSEPLPSRLDFLQQQYGVSVTTDNSEVFTQAKEVVFLAVKPQVFSAIAQELADIDIINREQSPLIISILAGVPLNQLEAAFVQLPVIRAMPNTPATVGAGITAICLGAYTNTKHHQIAQQVFSAVGEVVEVSEGLMDAVTGLSGSGPAYVALLVESLADGGVSAGLPRAIANQLALQTVLGTAKLLYETKMHPAELKDRVTSPGGTTIAGIAKLEQAGFRSALIEAVKAATERSQELGK

SEQ ID NO: 19932 - protein, 872 aa, Nostoc punctiforme
IFPFDLDQFQKDAIASLNAGRSVVVCAPTGSGKTLVGEYAIYRALSRGKRVFYTTPLKALSNQKLRDFREKFGFDQVGLLTGDASIHRDAPILVMTTEIFRNMLYGTPIGQVGISLVDVEAVILDECHYMNDRQRGTVWEESIIYCPREVQLAALSATVANSDQLTDWLNRVHGPTDLIYSDFRPVPLEFHFCNPKGLFPLLNDSKTKINPRLLQKKKRGGERDRGRSGRPEAPGIIYTLSQLEQRDMLPAIYFIFSRRGCDKAVAEVGDLWLVNNEESQILRQQIDDFLARNPEAGRSGQIAPLYRGIAAHHAGILPAWKALVEELFQQGLIKVVFATETLAAGINMPARTTVISTLSKRTDTGHRLLNASEFLQMAGRAGRRGMDKQGHVVTVQTPFEGAKEAAYLGTSKPDPLVSQFTPSYGMVLNLLQTHTLEQTRELIERSFGQYMATLHLRPEYDEIAELEKQLAQLHEQIAAVDENELAIYEKLRQRLKVERQILKTLQEQAQEDRQEELGMMLDFAVSGTLLSLKGKNITVSSPVTAVLVGKSPGSGQAPYLVCLGHDNRWYVATTGDVVDLYAELPRIEVSPDVLPPPEMPLKPGQSRRGNEETFAIATRIPNPIESLHLAPEVAEQLSRTAAVQEQLEAHPLHQSGNAATLFKRRAKYVELEAELEQLQGQVEQQSQRHWEEFLNLILILQHFGALDNLVPTQLGRIAAAIRGENELWLGLVFASGELDNLDPHHLAAAAAGLVMETPRPDSKVNFELSNEVAEALAKLRGIRRQMFQLQRRYNVALPIWLEFELIAIVEQWALGMEWTELCENTTLDEGDVVRILRRTLDLLSQIPHVPHLPDSFQRNAYRAMQLIDRFPV

SEQ ID NO: 19933 - protein, 683 aa, Nostoc punctiforme
LLRQIADQVGIALAQAQMLYAETQQRRELEVARHQAELASKTKSAFLANMSHEIRTPMNAVLGMTGLMLETPLNSEQQDFIETIRISGDALLSLINEILDLSKLEAGEMALETLDFDLSTCLEEVLELLAPSAHNKGLEIAALIYPNVPTQLQGDAGRLRQILMNLISNAIKFTSNGEVVVRAELRSLSSTTATIYFAITDTGLGITFEDQCRLFTPFTQVDASNTRKYGGTGLGLAICKQLVSLMGGEIGVESRLGKGSKFWFEVTFAQQLYPISSESERELLINRRLLVVDDNATNRKIIHHQATRWGMLVDQAASATIALKAIEETAKQKNLYDIAVIDMHMPEVDGMTLGEQIKANSAIAGLPLIMLTSTNQRDEIQRALKIGFAAYLVKPVKPSRLLDTIMTILGTQIKEETEVRSQEFKLKDYENNSNDHSSSSRLLARDFHKLRILLAEDNLVNQKVALKQLQSLGYSADVAGNGKEVLQLLEKIPYDLILMDCQMPVLDGLETTKEIHRWQESSFVSSRRPVVIAMTANAMKEDQQMCLDAGMDDYLSKPVIKEKLAAALQRWGSVIFQAKEIYVLEQKKGSKTDVGSVDLPIDWERLHQLSENNPEFELELLEIFVEDMQPRLEIIKIAIADNDYEQLALQTHQIKGASANVGATTMHLAAQKLEQLAHNQERR

SEQ ID NO: 19934 - protein, 376 aa, Nostoc punctiforme
NRLKDEFLAVLSHELRSPLNPILGWAKLLQTRKLDEAKTAYALATIERNAKLQSQLMEDLLDVSRILQRKLSLKISSVDLSAVIEVALDTVRLAAQAKSIELKTEFEPNIGQVLGDPSRLQQVVWNLLSNAVKFTEDGGQVEIRLERVGTQAQIQVSDTGKGINPEFLPHVFDYFRQADNTTTRTFGGLGLGLAIARQIIELHGGAIQAESEGDDKGATFTVLLPIKSVEPQTSEDKGLANDSPNLEGVNVIVVDDEVDTRELIVFTLQQYGASVRAFASASLALDAFRVEKPHIILSDIGMPEMDGYMLIREIRRREAACRQTSLPPEQGGEIQAIALTAYAGEINESKILQAGFQKHLTKPIEPVKLAMVIASL

SEQ ID NO: 19935 - protein, 488 aa, Nostoc punctiforme
RRTKIVATIGPATSSPEMLKAIIEAGATTLRLNFSHGTHADHQRSIRLIRQTAFELNQPVAILQDLQGPKIRLGKFDNGSIVLAKGDRFTLTNRPVVGTQEISCVTYDYLAEEVPVGAKILLDDGRVEMVVEEINRDKGDLHCRITVPGKLSNNKGVNFPGVYLSIKAMTDKDREDLMFGLDQGVDWVALSFVRNPQDMIEIKELISSTGKQVPVVAKIEKHEAIEQMEAVLALCDGVMVARGDLGVELPAEDVPVLQKRLIATANRLGIPIITATQMLDSMVSNPRPTRAEVSDVANAILDGTDAVMLSNETAVGSFPVEAVATMARIAERMEQEEAQHLNLRSVRDSRRSIPNAISQAVGQIAEQLGAAAIMTLTQTGATARNVSKFRPNTPILAVTPHVNVARQLQMVWGVKPLLVLGLPSTGQTFQAAINVAQELKLLSEGDLVVMTAGTLQGISGSTDLIKVEVVTAVLGHGIGLGQGLVSGR

SEQ ID NO: 19936 - protein, 272 aa, Nostoc punctiforme
LQGGKYVIDKVLGQGGFGITYKALHVELNRTVVIKTPNEYLSPDPEYGKYIDRFIQEGRTLARLSQDPHPHIVGVIDLFKEGTIHCLVMDFVPGENLFEAVKRRGALPEAEIVPCIRQIGEALVVVHQAGLVHRDAHPGNIMLRSNGKAVLIDFGIAKELVPKTLSSKGIAGNEAFAPYEQMSRGSRDPTVDVYCLVATLYYAVTGQRPTTSLARKLDNTFLIPPKQINPSISDQLNQAILKGMALEAKDRPQSMQVWLAMLEHQKQQPLLP

SEQ ID NO: 19937 - protein, 495 aa, Nostoc punctiforme
QFLWHILRLPIGFYDQRFAGEISSRMQLNDRVAEVLSGPLATTLIDAVMMVFYLLIMIQYDQLLSAIAVGFAAINIFALLFLSQTRVDANIRLAQEYGKVGGVTVSGIQTIETIKASGLESDLFARFAGYYAKALNAQQELGLKTQILTTLPTILTALTTASILLVGGFQVMNGNLSIGMLVAYQSLTLSFLEPVNSLVNFGSTLQDLEADLNRLDDVLQNPVDLEVEERQGEGGREQGAGEAGGAGGEITFSSLWQLQGHIELRNITFGYSRVEPALIENFSLTVQPGQRIALVGGSGSGKSTIAKLICGLYQPWAGEICFDGVERSQIKRSVLANSLAMVEQDIFLFAGTVRDNITLWDSTVPEADLVQACQDAAIHDAIASMPAKYDFELIEGGMNISGGQRQRLEIARALVRNPTILVLDEATSALDVETELMINHNLRQRGCSCIVVAHRLSTIRDCHKIIVLDQGKIVQSGTHEELWQQGGTYVRLLHA

SEQ ID NO: 19938 - protein, 267 aa, Nostoc punctiforme
  unsure (1)..(267): unsure at all Xaa locations
PEPLTGKTILVTRSVGQSSTFSDRLTTLGATVIEMPTLEIGPPSSWEALDDAIAHLSQFDWLILTSSNGIDYFFERLIAQGKDTRALAGVKIAVVGEKTANSLKQYSLQPDFIPPNFVADSLIENFPEKLDGKKVLFPRVESGGREILVKELTLKGAKVIEVAAYQSCCPSSIPSGAELALQNHNVNVITFASSKTVQFFYQLTEKIFSQNSDVSQLLENVCIASIGPQTSKTCHDLFGRVDVEAQEYTLDGLTQALIIWATNYXYQ

SEQ ID NO: 19939 - protein, 392 aa, Nostoc punctiforme
LPFSGKLAQEFLSTYGSPLYVYNGDHLRETIECITKAISYRRTQFRFASVTNGNIALLKIFRSFGWGLHANTPGDIYLGLQAGFDPSEIVYSGSNLNRAEMIQVLNWGVTTLNLDSLAQLQLCCKVLPKHREKSIRLGLRLNLPEITGDSRIGVRPEEFGDAIALTREVGLKLSGLHFYRGTGTNATEAFTQVIDAVIATAQLLPDWEYLDFGGGFGYPYHHNKTAFDWEVFGAELSERITHLGRKIDLVIEPGRSAIAGCATLLAQVVSVKWQGEKQIIGVDTTVANLSVPSVHGGYREIFTWKQADNLRSLFTTDICGNTTYSRDYLGKNCQLPALEIGDIVAILDVGAYGYAMSSHFLHRPKPAEVLLENGTHRLIRRREDYSVLLTNQ

SEQ ID NO: 19940 - protein, 547 aa, Nostoc punctiforme
IEFRQETIYFLVVDRFYDGDPDNSEGENSELYDPNRQEWGKYWGGDLQGVIDKLDYLKNMGVTALWLTPLFEQVEELFISNAAMHGYWTKDFKRINPRYIADGENPSLNATQEEKNTTFDRLVTELHKRNMKLVLDIVCNHSSPDTSGSKGELYDDGVKIADFNDDVNHWYHHYGEVQNWEDDWQVQNCELAGLATFNENNTEYRQYIKSAIKQWLDRGVDALRVDTVKHMPIWFWQEFTGEMTNHKPDVFIFGEWIYSNPSDDRSVEFANHSGMTLLDFGLCVAIRAALGQGSEMGFQTIQYIFDQDYRYSGATELVTFIDNHDMCRFQSLNPDPAMLKVAIALIMTSRGIPCIYYGTEQYLHNDTDGGNDPYNRPMMENWDTDSEVYRCIRLLSGLRRLNPAVSMGSHWQKYLTADIYCYVRRYRDSLCFVALNRGGEVILPEVETELPDGEHTCVVTRNKYEVKDGKIYNLVLEERGVLVFSHVGERIKAQTIVRVQLNGVDTQPGEIIVVTGDCPELGNWDISKAYPLEYINSNTWSAEIPFD

SEQ ID NO: 19941 - protein, 1102 aa, Nostoc punctiforme
GRMQDVNRLIERISRDDHKLTVIYGQSGVGKSSLVQAGLLPALKQRAIDARDVVPVLLQVYTDWTKVLGTCFVESLEEVRGLSFPLFLDSMAGFVEELNKNIEKGLLTVLIFDQFEEFFFAYKDQDKRRPFFEFIRDCLNIPYVKIILSLREDYLHYLLECNRLTHLDAIDNNILDKKILYYLGNFSPEDARSVIQSLTESSQFYLEPPLIDELVRDLARDFNEIRPIELQVVGAQLQTEKITTLIQYQEQGPKEKLVGRFLEEVVKDCGNNNEQFAKLVLYLLTDENNTRPLKNRAELEADLALEPARLDLILKILVKSGLVFQVPGFPADRYQLVHDYLVPFVREQQSARLIAELEKEKEQRKLTEAKLNQVLTQQLRTARKQTVTLIGLITAISVIAVGVTAAYINTSLTSDISSKDDIGLGELVSAIKVGKKLKFLSIGVIPETRLKVISNLSNAIHKIKEINRIEGYDKAITALSFSQDSKMLATASEDGKVKILNISDGQERIWSAHKKSVTSISFNSDGKMLATVSEDGNAKIWNIPERKSWSTPKFKPIKILKIDKDGLGFITFSPNDKLLATTTKNKTVKIWSWEDGKLKSLPQRFNDKNIIVNFSPDNKTVATGGRYDTVKLWKLTPKKLENKPTEIYDSGTFTMNFNNSGDAISLFNKQGNLRVWSTDDKPHLIKSAENVCKNSFGLKDFLNNSLDNQLSIFQDSEDKKTFFETIIFQGQCSNYNIFKHDDSITYTSFSPDSKLLASASKDGVVKIWDIDDNKLPSFQRTDRDEDINRKIRFSFDGQTVALGSSDNSIELQNRDGTHIKTIRGDSSILSFSPDNQTLATGSPDDILKLWKLDTNKEITLKGSTNKITTIDFSPDGNLVAAASADNFVRLWRSSDGTFIGHLKGNTKQVTNVSFSPNSQIIATISDDNKVQLWNSRDRSLIQALKTDSDKVTTVIFSHDSKMLAICDDNLVKLYKSDGTPVKPLIGHNAKVQSVEFSPDDKKLMSVSANSGEIKIWDISNSEPLQSIDNYGMISAKFNPNGKYITSINQNYTVKLWTVEGEPRATLKGHNDTITKVDFSHDGTKIVTSSADNTIKIWDINQL

SEQ ID NO: 19942 - protein, 298 aa, Nostoc punctiforme
LQKHIKGVNDVAFSFDNKYIASASADNTVNIYNGNGNFIKQLSGFSNGINDDISIDKVSFSSDGKIIGATSCKTYWSNEIYRSKYVMKFWSIEDSAKFQELKSIKGHANFSCNNIDSFIRFSLNKKTVASVSKDDSLKLWDLKGKPLATLWGHTDWVNSVAFSPNKKIIASASDDKTVRFWNRNGKLLKPIIKHGDKVNSVSFTHDGKIIASASDDQIIRLWNLDGKLQKPTIRDPDKITNIRFQADDKKIAFISGSSAKLGNLDNGKIEPLKTDYSSNTLSFDNDNKMLAVGSDYNT

SEQ ID NO: 19943 - protein, 283 aa, Nostoc punctiforme
MIGKLLDHRYQVIRVLAMGGFGQTYIAQDTRRPGNPICVVKHLKPGTDPRVFDTAKRLFNSEAETLEKLGNHDQIPRLLAYFDENQEFYLVQEYIEGHTLAEELTPGKRWSESQVIQLLQEVLEILEFVHSQGVIHRDIKPDNIIRRASDNKLVLVDFGAVKQLRTQMVTVGGQASATVVIGTPGYMPTEQGQGKPRPNSDIYSLGIIAIQALTGLLPTALQEDPETGEIIWQQSVTVNYRLAAVLTKMVRYHFKDRYQNATEALQACKDAINPVPTLSQPQE

SEQ ID NO: 19944 - protein, 584 aa, Nostoc punctiforme
LKGHEGSVNSASFSPDDKLIVTAGADNTARVWDFSGKQLVELIGHQSNVYSANFSPDGKLIVTASFDGTARIWDISGKQLVELKGHQGNVYSANFSSDGKWIITASADKTARIWDISGQQIAQITGHENIVTSANFSSDGKRIITASADKTACMWDLSGKLLVQLKGHTDTVWSANFSPDGQRIVTASDDKTARVWDLSGKVLAELKGHGDSVYSASFSPDGKLIVTASIDRTARVWDATGKVIGKLEGHQGSVNNAKFSFDGTQIVTASSDGSILIWNTSKKIFIELLGHLGEVFSASFSPDGKQIITTSKDGTVRIWNTLNKQITEIKAQVAVQSANFSPNGKLIVTTSSEKFAQVWDTSGKILTELKGHESRVNSATFSPDGKFIVTASDDTTARIWDISGKLLTELKADHGRVVSANFSYDGKQIITGSGNTAFIWNTSGKLISKLELKGPQYSVISANFSRDRQLIVTASHDGSAWIWDSSGKVITKIEFPNNITENYSENRVYGADFTPDGKYLVTVTSDGGRVWDISGKLIAEFKGHQDEVINFSLSPDGKQMLTASDDRTVRVWDISNKSLAQINS

SEQ ID NO: 19945 - protein, 756 aa, Nostoc punctiforme
  unsure (1)..(756): unsure at all Xaa locations
ITSLAFSPDNQFFVTGSKSGNVKIWDTSGKLLNELRGHEYQINGINFSSDGKSILTVSLDFARVWSNSGKLLAEIKGKQKHDAALTSASLSPDGKLIVTGYSSFQQNAYLWDSSGKQQMELQGHQNFVNSVNFSPDGKLIVTASDDETACIWDTTGKLLNELKGNSSKVKSASFSPDGKKIITTSSDGTAIIWDTFGKLLAKFNIGFPISSYSSTRVNFSPDGRFIIAQIEGGFTRLWGADGTVISTDESLGNITFSPDGKLIAIVRRGGSASVGIPEEKKLAILQIEPYLVQRVIFSHNSKFFVTISEIPFSSVDKIQVWDVGKLDWMTETSKXFNICAFAYLGKRRRTKPLRLKQXKHFEANRNKSIRLILFLIALSLFPFTXFIFKIMTFTKFACGCILLLISACLFIPNRQLIVTASTIFKDIAQASGASKYSPIELNPYASTVENASFSPDGRFIITGFDNGTARIWDKSGNLITELKAGENKVKSAFFSPNSKFIVTSSNRTKIWDTSGKKLVELKGYNPSISPDCKFIVTTFLGATLWDTSGKLLVEFKEDKDNPVMSASFSPDSKLIITALRNGIVRVWDTNGKLITEFTADRNLLKSAVFSPNGKLIFTTSFGTSRVWDILGKLLAELKGRHLSIQSANFSPDSKLIVTTSLNNSDFFNRNAQVWDTSGKEIAELKGHEGDVTGANFSPDGKRIVTVSNDGTARIWDTNGKMLLTLKGHQGNVSKASFSPDGQLVITASDDGTSRLW

SEQ ID NO: 19946 - protein, 213 aa, Nostoc punctiforme
  unsure (1)..(213): unsure at all Xaa locations
MKLYSVPISPFAARVRLSIYRKGLNIEIVPPPEGGIKSDAYLALNPMGQVPTLLLDSGFALPESATILEYLEDVFPTPSLRPTDVEDLARVRLFLRLPDFHIRPSIFALRGMRDPANRNEDVVKTQFEVLDQGLSYIDHYLSEDVWAVGNRPSIADCALVPIFNIVSFMVLVYNHSDIISKYQKLSAYWQAAKTDEINAKVIAEQLAAIPKAX

SEQ ID NO: 19947 - protein, 388 aa, Nostoc punctiforme
MKALCWHGANDVRVDTVPDPKIINPRDAIVKITSTAICGSDLHLYDGYIPTMEKGDILGHEFMGEVVELGSAVKNVKIGDRVVVPFTISCGSCFFCQKDLWSLCDNSNPNAWIAEKLMGHSPSGLFGYSHMMGGYAGGQAEYARVPFADVGLFKIPDGLTDEQVLFLTDIFPTGYMAAENCDIQPGDTVAIWGCGPVGQFAIRSAYMLGAERVIAIDRVPERLQMAKDGKAEVLNYEEVEVGEALKDMTGGRGPDACMDAVGMEAHGTGPDAFYDQVKQAVRMETDRPTALRQVIVACRKGGTVSIPGVYGGFVDKIPMGAAMNKALTFKMGQTHVHKYLRPLLDRVQNGDIDPSFVITHRLPLEQAPHGYEIFKHKKDNCIKIVLKP

SEQ ID NO: 19948 - protein, 265 aa, Nostoc punctiforme
AIGQGTWYIDNGDRASAIAALRQGLDLGMTHIDTAEMYGSAEEVVAEAIAGRRDRVFLVSKVLPGNASRRGTIIACEKSLARLHTDRLDSYLLHWRGQHPLEETIAAFEQLQHEGKILCWGVSNFDVPDLEAVQKIAGEGSLVCNQVLYHLRQRAIEHAVIPWCEKHGVAVVAYSPFGHGDFPSSRTTAGRVLQEIAAAHNATPRQVALRFLVRHSSLFAIPKASNPKHAAENAGAGELNLTQTELDRIDAAFPTGSRPRVLPML

SEQ ID NO: 19949 - protein, 249 aa, Nostoc punctiforme
IILITGASSGIGTACARIFAGAGAKLILAARRLERLQQLKDALIKEFGIEIHLLQLDVRDRNAVESAISTLPPAWSNIDILINNAGLSRGLDKLHEGSFQDWEDMIDTNVKGLLYVSRYVVPGMVSRDRGHVVNLGSIAGHQTYPGGNVYCATKAAVRAISEGLKQDLLGTRVRVTSVDPGMVETEFSEVRFHGNTERAKTVYQGVIPLTADDVADVIFFCVTRSPHVNINEVVLMPVDQASATLVNRR

SEQ ID NO: 19950 - protein, 353 aa, Nostoc punctiforme
VSPTAQSTASARRVVFPFTAIVGQEEMKLALLLNVIDPKIGGVMIMGDRGTGKSTTIRALADLLPEISVVANDPFSSDPSDPDLMSDEVRQLLEQGAEIPVAHKKVQMVDLPLGATEDRVCGTIDIEKALSEGVKAFEPGLLAKANRGILYVDEVNLLDDHLVDVLLDSAASGWNTVEREGISIRHPARFVLVGSGNPEEGELRPQLLDRFGMHAEIHTVKEPALRVQIVEQRADFDQNPLVFLENYKPQQEALQEQIVNAQQLLPEVKLDYELRVKISEVCSELDVDGLRGDIVSNRAAKALTAYEGRTEVTVDDICRVITLCLRHRLRKDPLESIDSGYKVAKVFSRVFGV

SEQ ID NO: 19951 - protein, 455 aa, Nostoc punctiforme
MTLQSFGVIGLAVMGENIALNVERNGFPIAVYNRSREKTDAFMAQRATGRNVKAAFTLEEFVALLERPRKILVMVQAGKPVDAVIAQLKPLLEEGDIIIDGGNSWFEDTERRTQELEPAGLRYLGMGVSGGEEGALNGPSLMPGGTTSSYEFLSPIFNKIAAQVDDGPCVTYIGPGGSGHYVKMVHNGIEYGDMQLIAEAYDLLKNVAGLNPSQLHDVFAEWNTTDELDSFLIEITKNIFPYIDPETNKPLVDLIVDAAGQKGTGRWTVQTALELGVAIPTITAAVNARIISSIKDERVAASKVLTGPSGKYDGQTKDFINKVRDALYCSKICSYAQGMALLSTASKTYNWNLDLGEMARIWKGGCIIRARFLNKIKKAFSENPALPNLLLAPEFKQTILDRQTAWREVIATAATVGIPVPAFSASLDYFDSYRRDRLPQNLTQAQRDYFGAHTY

SEQ ID NO: 19952 - protein, 269 aa, Nostoc punctiforme
LPIIDISALVSGKGNLYSAASQIRQACRESGFFYIIGHGVDENLQQRLEELSRQFFAQDLETKLKIRMALAGIAWRGYFPVGGELTSGKPDLKEGIYFGTELPDEHPLVQAGTPMHGANLFPANMPQFGETVLEYIEAMTKLGHTLMTGIAMSLGLEESYFADRYTSDPLVLFRIFNYPPNLSPSDGNPIWGVGEHTDYGVLTILKQDDSGGLQVKSKSGWVAAPPVPGSFVCNIGDMLDKMTGGFYRSTPHRVQNQSQNHRLSFPFFF

SEQ ID NO: 19953 - protein, 188 aa, Nostoc punctiforme
  unsure (1)..(188): unsure at all Xaa locations
AKQLVSSLLQGVNLYLIGMMGVGKTTVGPLLAKHLGYGFLDLDGVIAKATDKSINQLFAEEGEAGFRQIESDVLSQVCAFTKLTIATGGGIVLRRENWGYLHHGLIVWLDVPVELIYRRLAEDTTRPLLQDADLKGKLRSLLEQRTPLYSQADLHITVQEGETPEDIANRIIEVIPNVLKPQASHXQD

SEQ ID NO: 19954 - protein, 290 aa, Nostoc punctiforme
EYIRQTEATRVRVLSEALPYIQQFAGRTVVVKYGGAAMKDSTLKDKVIRDIVFLSCVGLRPIVVHGGGPEINSWLDKLGIEPQFKNGLRVTDAATMDVVEMVLVGRVNKEIVALINQAGGLAVGLCGKDGNLFTARPQGQEGIGFVGEVSNVNIKILDTLASNGYIPVVSSVAADETGQAYNINADTVAGEIAAALGAEKLILLTDTSGILKDYKDQSTLIPKVDIREARELIVNGIVTGGMIPKVNCCVRSLAQGVRAAHIIDGRIPHALLLEIFTDVGIGTMILGSQF

SEQ ID NO: 19955 - protein, 633 aa, Nostoc punctiforme
  unsure (1)..(633): unsure at all Xaa locations
RSWKIEDSEELYRIEGWGQPYFSISAAGHVTVSPKGDRGGSLDLFELVNSMKQRNLGLPMLIRFSDILEDRIERLNACFAKAIARYNYPGVYRGVFPVKCNQERHLIEDLVKFGKPHQFGLEAGSKPELMIALAVLDTPGALLVCNGYKDREYIETAMLAQRLGQTPIIVLEQIEEVDLVIDANRQLGIKPILGVRAKLSTQGMGRWGASSGDRAKFGLTMPEVIEAVDKLREANLLDSLQLMHFHIGSQISAINVIKDAIQEASRIYVELAMLGADMKYLDVGGGLGVDYDGSQTNFYASKNYNMQNYANDIVAELKDTCAERQITVPTLISESGRAIASHQSVLIFDVLSTSDVPLDSPEPPQEGESPIINYLWESYQSINQENYQELYHDAAQFKEEAISRFNLGILRLRERAKAERLYWACCQKILNITRQQEYVPDELEDLEKIMASIYYVNMSVFQSAPDCWAIDQLFPIMPIHRLDEEPIRRGILADLTCDSDGKIDRFIDLRDVKSVLELHTYKPGEPYYLGMFLNGAYQEIMGNLHNLFGDTNAVHIQLTPKGYQIEHVVKGDTMSEVVSYVQYDSEDMVENIRQRCEKALEEKRITLAESQRLLQTYEQSLRRYTYLNSXLGM

SEQ ID NO: 19956 - protein, 151 aa, Nostoc punctiforme
IAMERTFLAIKPDGVQRGLVGEIIRRFETKGFTLVGLKFLKVSKELAEQHYGVHRERPFFGSLVEFITSSPVVAMVWEGDGVVASARKIIGATNPLTSEPGTIRGDFGINIGRNLIHGSDAPETAQQEIALWFKDEELVNWQPHITPWLHE

SEQ ID NO: 19957 - protein, 300 aa, Nostoc punctiforme
RIGRLVLRAGLDNPNIEFVGINDLVPPDNLAYLLKYDSTHGQLKHKVEAKEDGILIDGHFIPCVSMRNPAELPWGKLGADYVVEATGLFTDYEGAANHLKAGAKRVVISAPTKDPDRVTTLLMGVNHHLFDPGKDIIVSNASCTTNCLAPIAKVINDNFGLTEGLMTTVHAMTATQPTVDGPSKKDWRGGRGASQNIIPSSTGAAKAVALVLPELKGRLTGMALRVPTPDVSVVDLTFKTAKATSYKEICAAMKEAAAGSLAGILGYTDEEVVSTDFQGDTHSSIFDAGAGIELNSNFFK

SEQ ID NO: 19958 - protein, 489 aa, Nostoc punctiforme
  unsure (1)..(489): unsure at all Xaa locations
RRTKIICTVGPATSAPENLRGLVEAGMNVARLNFSHGAYEFHAQTAHYLRQISNEQQKPIAIMQDLCGPKIRLGTLPPEGLNLEAGTEVTFVLQEKGESIDELPLPLPTLFAMVRPGEPILINDGRVKLIVTDRDADRIRAQVKTGGLISTHKGVNLPQTPLPVSSITEKDLLDLRFGIQLGVDWVAVSFVQSPQDLEPAKRMIEAAGASIRLIAKIERAEALENFDSILKVADAIMIARGDLGVEVPIHEVPLIQKDIIRRCNRAGKPVITATQMLESMISAPDPTRAEATDVANSILDGTDAVMLSGETAVGQYPIAAVQMMHNIAVRTEQALDEGSKHAWCHEAGSLSVTESVAESVCRIAYETGSRAILCNTSSGNTARMVSKYRPTSPIIALTSDITAYRQLALSWGVEALLIPPVHHAEEMFTNVVNTVVDMGLANKGDKVVITSGVPIGKSGTTSLIKVHSIGQPISAXATXNRAVAQDSKQ

SEQ ID NO: 19959 - protein, 334 aa, Nostoc punctiforme
MSKNLLEQLREVTVVVADTGDIQAIEKFKPQDATTNPSLITAAAQMPEYQGIVDQTLLQAKKDAGDGATQAQIVSLAFDRLAVAFGLKILQIIPGRVSTEVDARLSYDTEATLTKARDLIAQYKAAGIGRDRVLIKIASTWEGIRAAEILEKEGIHCNLTLLFGLHQAIACAEAGVTLISPFVGRILDWYKKDTGRDSYPATEDPGVLSVTKIYNYYKKFGYKTEVMGASFRNLGEITELAGSDLLTISPSLLAELQSTVAELPRKLDPAKAASLSIEKISIDKASYDKMHAADRMATDKLDEGIKGFTKALEDLEKLLADRLVRLEGEVVASH

SEQ ID NO: 19960 - protein, 301 aa, Nostoc punctiforme
RRKCTALLRAAIDRGITFFDTAEVYGPFLNEELVGEALAPFRDQVVIATKFGFDISPNSDPRGMKGSPGLNSRPEHIKEAVEGSLKRLKVEAIDLLYQHRVDPNVPIEDVAGAVKELIQSGKVKHFGLSEAGVQTIRRAHAVQPIAALQSEYSLWWRKPEAEVIPTLEELGIGFVPYSPLGKGFLTGKMDESTTFDSSDFRSTLPRFTKEALKANQALIDLLGSIAEQKQATPAQIAIAWLLAQKSWIVPIPGTTKLHRLDENIGAVSVELTPDDLRNIDDAASKIAVQGARYPEKLEQMT

SEQ ID NO: 19961 - protein, 606 aa, Nostoc punctiforme
WRLFLRLVPYARRNGQLLALSMCLLIPIALANAVQPLLIGQVISLIRNEPSAYEFLRNRPLSEGLNILEGLLFVAIAIRLIFTGYQGYLVQKLGQQITAAIRQDLFQHVTSLAVRFFDRTPVGKLITRITSDVEVLGDVFSTGAIGIVSNLFSMLVILGLMFSIEWQLTCLLLLMLLPVTWLIVYIQQQYRKANYKGREELSILNSQLQENVLGINVVQLFRREKFNAELFRATNSRYTQQMDQTIFYDSFISATLEWIGLIAIAAVLCMGGWLLLGKSIAFGTLSAFVLYAQRLFDPLRDFAEKFTVIQAGFTAIERVGDILDEPIEIRDRANVRFSIFDAKFGYIDEIVANLESPDTTSPPELGEICFDRVWFAYKNDDYVIKDLDFTIRPGEKVALVGPTGAGKTSIIRLLCRLYEPTKGRILIDGVDIREVPQAELRRYMAVILQEGFLFAGDVKSNISLGDGYTIEQIQQAAEQTNIAQFIEELPQGYDTQLRERGTNISSGQKQLLAFARAAIRDPQILVLDEATASLDVGTEALVQEALNQLMLRRTAIIIAHRLSTIRNVDRIFVLKRGELIEQGSHDQLLEQGGLYATLHNLQMLGS

SEQ ID NO: 19962 - protein, 599 aa, Nostoc punctiforme
MAKVVGIDLGTTNSCVAVMEGGKPTVIANAEGFRTTPSVVAFAKNGDNLVGQIAKRQAVMNPENTFYSVKRFIGRRYDEVSNEATEVSYKVLSSNGNVKLDCPIAGKPFAPEEISAKVLRKLVEDASKYLGETVSQAVITVPAYFNDSQRQATKDAGKIAGIEVLRIINEPTAASLAYGFDKKSNETILVFDLGGGTFDVSVLEVGDGVFEVLATSGDTHLGGDDFDKKIVDFLAEKFKKAEGIELRKDKQALQRLTEAAEKAKIELSSVTQAEINLPFITATQDGPKHLDTTLTRATFEELCSDLIDRCRVPVENALRDAKLSKGDIDEVVLVGGSTRIPAVQQIVKQVLGKDPNQSVNPDEVVAIGAAIQAGVLNNEVTGILLLDVSPLSLGVETLGGVMTKIIPRNTTIPTKKSEVFSTAVDGQTNVEIHVLQGEREFSNDNKSLGTFRLDGIPPAPRGVPQIEVVFDIDANGILNVTAKDKGTGKEQSISITGASTLDKTDVDRMVREAEQNASSDKDRREKIERKNQADSLAYQAEKQLQELGDKVPDADKTKVEGLVKELREAVAKEDDEQIKKLTPELQQALFAVGSNIYQQ

SEQ ID NO: 19963 - protein, 487 aa, Nostoc punctiforme
AELPINMLAVKTRSLWDPLDELQDYEDYFPVLPKPNIIKTYQSDDSFCEQRLCGANPFVLRRIEQMPDGFAFTILELQEKFGDSINLVEKLANGNLYVADYRALAFVKGGSYERGKKFLPTPIAFFCWRSSGFSDRGQLVPIVIQINPADGKQSQLITPFDDPLTWFHAKLCVQIADANHHEMSSHLCRTHFVMEPFAIVTARQLAENHPLSLLLKPHFRFMLANNDLARKRLISRGGPVDELLAGTLQESLQIVVNAYTEWSLDQFSLPTELKNRGMDDPDNLPHYPYRDDGLLLWNAIKKFVSEYLQIYYKTPQDLAEDLELQSWVQELVSQSGGRVKGISDRINTLDQLVDIATAVIFTCGPQHAAVNYSQYEYMTFMPNMPLAAYKQMTSEGTIPDRKSLLSFLPPSKQTADQLSILFILSAYRYDRLGYYDDKFLDPEAQDVLAKFQQELNEAEREIELNNKSRLINYNYLKPRLVTNSISV

SEQ ID NO: 19964 - protein, 253 aa, Nostoc punctiforme
MIEVEHLSKIYGSTPAITDVTFSVEPGEILGLLGPNGAGKTTTMRILAGYLPATNGNARIAGYDVHENSLAVRQRIGYLPETPPLYPDMTVEGFLHFVAQIKGVPAGDRPNKVTAAIKRCNLEDKRRVIIRKLSKGYRQRVGIAQAIVHDPPAIILDEPTVGLDPRQIIEVRNLIKSLAGTHTIILSTHILPEVSMTCSRVAIINRGKVVATNTPENLMTQLTGGSGYELEIEGEAALAKQVLQNVAGVSLIE

SEQ ID NO: 19965 - protein, 539 aa, Nostoc punctiforme
DVLVIGGGTAGTMAGIKAKQANPDAEVLILEKANIRRSGAIAMGMDGVNTAVIPGHSTPEQYVREITLANDGILNQKAVYQTGKLGYEVIQELESWGVKFQKDVQGNYDLKQVHRVGKYVLPMPEGKDLKTILTRQVKRHKVKVTNRVMSTRVLVKEGGAVGAVGFDVRNGDYIVIQAKAVILCTGACGRLGLPASGYLYGTYENPTNAGDGYSMAYHAGAELSNIECFQVNPLIKDYNGPACAYVAGPFGAHTANAEGNRFISCDYWSGQMMLEIWKELNSGKGPVQLKMTHLDEDTIAEIESILWANERPSRERFHQGRNEDYRTHGVEMHISEIGLCSGHSASGVWVNENAQTTVPGLYAAGDMASVPHNYMIGAFVFGRIAGTDAIEYIQDLDFIEPDTDFLEAEKARIYAPLTRPNGVPHTQVEYKLRRLVNDYLQPPKSGNKIEIGLKHFVQYQQTLDVMGARDPHELMRSLEVHFIRDCAEMAARASLYRQETRWGLYHYRLDYPEKNNEEWFCHVNLKKDELGQMILFKRP

SEQ ID NO: 19966 - protein, 273 aa, Nostoc punctiforme
VGLVTLDLIYLAESAPKNNQKIVATDYTVAAGGPATNAAVTFSHLGNQATVLGVVGSHPMTQLIRGDLANYKVAIADLEPTTDLAPPVSSIIVTQATGERAVVSINAVKTQASSASIPPDILQNVNIVLIDGHQMAVSYFIAQAAKAKNIPVVIDGGSWKPGFEQILPFVDYAICSANFYPPNCQTGEDVFAYLAGFNISYIAITHGQKPIEYLSRTASGIVDVPQIHAVDTLGAGDIFHGAFCDYILRESFTDALALAAKIAADSCKFFGTR

SEQ ID NO: 19967 - protein, 313 aa, Nostoc punctiforme
DNHRLRLFSGSANLQLSQEVARYVGMDLGPMIRKRFADGELYVQIQESIRGCDVYLIQPCCQPVNDHLMELLIMVDACRRASARQVTAVIPYYGYARADRKTAGRESITAKLVANLITEAGANRVLAMDLHSAQIQGYFDIPFDHVYGSPVLLDYLASKELPDLVVVSPDVGGVARARAFAKKLNDAPLAIIDKRRQAHNVAEVLNIIGDVKGKTAVLVDDMIDTGGTIAEGARLLREEGARQVYACATHAVFSPPAMERLSSGLFEEVIVTNTIPIPENNRFPQLVVLSVANLLGETIWRIHEDTSVSSMFR

SEQ ID NO: 19968 - protein, 1124 aa, Nostoc punctiforme
  unsure (1)..(1124): unsure at all Xaa locations
SSQSFHVIKPRKLNNKKHDRVXRPLKXSGFVFSYSKATTMPRRDDLRKILLLGSGPIVIGQACEFDYSGTQACKALREEGYEVVLVNSNPATIMTDPETADRTYIEPLTPELVEKVIEKERPDALLPTMGGQTALNLAVALAKNGVLEKYGVELIGAKLPAIEKAEDRKLFGEAMARIGVAVCPSDTAETLEEAKAVARQIGSYPLIIRPAFTMGGSGGGIAYNQEEFEEMAQVGIDASPVSQILIDQSLLGWKEYELEVMRDLADNVVIICSIENLDPMGIHTGDSITVAPAQTLTDKEYQRLRDMAIKIIREIGVETGGSNIQFAVNPLNGDVVVIEMNPRVSRSSALSSKATGFPIAKMAAKLAVGYTLDEIKNDITKKTPASFEPTIDYVVTKIPRFAFEKFPGSDPVLTTQMKSVGEAMAIGRTFNESFQKALRSLETGRAGWGCDKAEKLPSGEQIRAQLRTPNPDRIFAVRHALQQGMTIEEIYELTGIDRWFLDKLQQLLDVEKFLKRTPLQQLTKEQIYEVKRDGYSDRQIAYATKTTEDEVRAYRKSLGIIPVYKTVDTCAAEFEAFTPYYYSTYEEETEVMPATKPKVLILGGGPNRIGQGIEFDYCCCHAAYALKDAGYETIMVNSNPETVSTDYDTSDRLYFEPLTKEDVLNIIETENPVGIIIQFGGQTPLKLAIPLQEFLNNDTSGLNTKIWGTSPDSIDMAENRERFEKILQELNIAQPPNGIARSYEDALIVAKRIGYPVVVRPSYVLGGRAMEIVYSDAELERYMSFAVLIEPEHPILIDKFLENAIEVDVDAIADHTGRVVIGGIMEHIEQAGIHSGDSACSLPSISLSPAVLNQIRTWTVQLAQALSVVGLMNIQFAVVGASSYSPQVYILEANPRASRTVPFVSKATGVQLAKLASLIMSGKTLEELGFTEEVIPTHIAVKEAVLPFNKFPGTDTILGPEMRSTGEVMGIDSDFGRAFAKAELGAGERLPLTGTVFVSMSDRDKAAAGAVVKEFIDLGFTVMATLGTRRVLLEQGLNIELVLKLHEGRPHVLDAIKNQKIQLIINTPSGEEAHTDARLIRRTALAYKIPIITTIAGAKATVAAIRSLQNTTLDVKTIQEYCPI

SEQ ID NO: 19969 - protein, 112 aa, Nostoc punctiforme
HNCGRRGLSQKCDGQILASSSLDDTIKVWSVTTGREIRTLSGHSNEVKYVAISSDGQILASHTWDKTIKLWEVATGREICTLSLFDPAHSVAFSPDGSWLAAGDVSGNIKIW

SEQ ID NO: 19970 - protein, 702 aa, Nostoc punctiforme
VWPGNVYPLGANWDGKGTNFALFSENATGVELCLFDADNHEIRLPLTEKNNFVWHAYLPGVGPGQRYGFRVHGPWAPELGHRFNPNKLLIDPYAKAIDGEISDTAAIFGYSLDAPEQDLAFSDLDNAEIMPKCIVVDQSFDWGDDKLLSIPWHETIIYETHVRGFTKLHPEIPEELRGTYAGLAHPVAIQYLQQLGITSVELMPVHHFLSSPGFLVNKGLKNYWGYDSINYFTPYSGYSANGSVGQQVTEFKQMVKDLHSAGIEVILDVVYNHTGEGNHLGPTLSLRGIDNAVYYRLVKDNSRYYMDFTGCGNSLNVRHAQVLKLIMDSLRYWVTEMHIDGFRFDLASALARELYEVDSLAAFFDIIHQDPVLADVKLIAEPWDLGEGGYQVGNFPLRWSEWNGRYRDTVRDFWRGEDDSLGQFAYCFTGSPDLYQANGRNPSASINFITAHDGFTLNDLVSYNEKHNQDNGEDSRDGESHNRSWNCGVEGETNDPDVIRLRQRQRRNFLATLMLSQGIPMLLGGDEIGCTQKGNNNVYCQDNEIAWRDWSLQKSNSELLDFARELIYFRHQHPVFRRRKWFQGRPIHGFGISDIGWFNDDGSEMTEKQWLVSYAKAMEIFLNGEGIVTPGRRGERIIDESFLLFFNAHYETIEFALPNVFQDREWEIVIDTNEPRFLSPGKLVMGEQTVPVTDRSLIVLRR

SEQ ID NO: 19971 - protein, 330 aa, Nostoc punctiforme
MTSNLEAQLLALRQEGEKAIAAADTLERLEELRVNYLGKKGELGALLRSMGQMSAEERPKIGAIANTVKESLQTSLDQQRVALEAAQIQVQLEAETLDVTMPGIYSPQGRIHPLNGIIDRALDIFVGMGYTVAQGPEMETDYYNFEALNTPPDHPARDMQDTFYLPDGNLLRTHTSSVQIRYMEREEPPIRVVAPGRVYRRDNVDATHSAVFHQIELLAIDEGLTFTDLKGTIKVFLQAIFGDLPIRFRASYFPFTEPSAEVDLQWNGRWLEVMGCGMVDPNVLKSVGYDPEVYTGFAAGFGVERFAMVLHQIDDIRRLYASDLRFLQQF

SEQ ID NO: 19972 - protein, 389 aa, Nostoc punctiforme
MKAVCWNGANDVRVETVPDPKIINPRDAVIKITTTAICGSDLHLYNGYVPTMEKGDILGHEMMGEVVEIGSAVKNLNIGDRVVVPFPIACGNCWYCQHDFWSLCDNSNPNAWLAEKFMGYSPSGIFGYSHMLGGYAGGQAQYARVPFADTGLFKIPDGLTDEQVVFLTDIFPTGYMAADNCNIQPGDIVAVWGCGPVAQFTIKSAYLLGAERVIAIDRIPERLQMAKDQGKAEILNYEEVDVGEALKEMTGGRGPDACIDAVGLEAHGTGLEGVYDEVKQAVRLETDRPHVLRQVMIDCRKGGHVSIPGVYVGVVDKIPMGAAMNKALVFKMGQTHVHKYLNTLLDHIQNGRIDPSFVITHRLPLDEAPRGYEIFRDKKENCIKVVLKP

SEQ ID NO: 19973 - protein, 429 aa, Nostoc punctiforme
VKKVLSIILGGGAGTRLYPLTKLRAKPAVPVAGKYRLIDIPVSNCINSEIFKIYVLTQFNSASLNRHIARTYNFTGFNEGFVEVLAAQQTPENPNWFQGTADAVRQYLWLMEEWDVEEYLILSGDHLYRMDYRQFIQRHRDTGADITLSVIPIDERRASDFGLMKIDDSGRIIDFSEKPKGEALTQMQVDTSVLGLTKEQAQKQPYIASMGIYVFKKEVLFKLLRESVERTDFGKEIIPDASKDYNVQAYLFDDYWEDIGTIEAFYHANLALTQQPQPPFSFYDEHAPIYTRARYLPPTKLLDCQITESIIGEGCILKNCRIQHSVLGVRSRIESGCVIEESLLMGADFYQASVERQCSLIENDIPVGIGTDTIIRGAIIDKNARIGHDVKIVNKDNVQEAERENQGFYIRSGIVVVLKNAVIPDGTII

SEQ ID NO: 19974 - protein, 560 aa, Nostoc punctiforme
SIIQALPTEVVYLITAGEVIDSLASVVRELVENSLDAGATRIVVSLWPQQWRIRVADNGCGMNLDDLQQAATAHSTSKIRSSADLWKINSLGFRGEALHSLTTLADLEILSRPVDGKLGWRISYGNGGKVVQVEVTAIAPGTVVTVSNLFGNCSSRRQGLPTTAQQMKAVQATIYQIALCHPHVTWQIWQNDRQWFTISPARTTGQLLPQILPQVRQGDLQEVKLEIPNPPHSPLPCTNAIHRVSPHSALTLVVGLPDRCHRHRPDWVRVAINGRMVKTPELEQTILSAFHRTLPRDRYPICFLHLAISPDQINWNRNPAKTEIYLNEIIYWQEQITQAINQALSISSSNLKEAVHTTRVSKLLKAAEAKGGYNFNPQNPKEDRKNPNSLKAVAQVSNTYIVAEHPGGMWLVEQHIAHERVLYEQLCDDWQLVPVEPPIILYQLSLAQVSQLQRIGLDIESFGEQLWAVRNIPAPLQQRDDCAEAILELSWGGDLQTAQVAVACRSAIRNGTPMNQQEMQTLLDNWQRTRNPRTCPHGRPIYLSLEESALARFFRRNWVI

SEQ ID NO: 19975 - protein, 537 aa, Nostoc punctiforme
MLIILILLIIMLVGVTAFNSFVSRYLLDIITEEKDFNEFINTLLVYGAALVCVTLLVGFSKFVRKQIALDWYQWLNNHILEKYLSNRAYYKINFKSNIDNPDQRISQEIEPLIRNALTFSATFLEKVLEMATFLVILWSLSQFVAVVLVVYTIIGNLIAVYLAQELNKIKQEELEFDADYTYGLTHVRNHAESIAFFQGEKQELNIIKRRFNNIIKSAKRKINWELTQDIFNRGYQAVIQIFPFIVFGPLQIRGEIEFGEIAQASLACNLFATAMAELIREFATSGRFSSYVQRLGEFSDAIEFVNKEPEKVSTIKTIEENHLAFENVTLQTPNYEQVIVEDLSLSVQPGEGLLIVGPSGRGKSSLLRAIAGLWNAGTGRLVRPPLEEVLFLPQRPYIILGTLREQLLYPHTTHKMTDAELKEVLQKVNLQNLLSRVDGFDTEVPWENILSLGEQQRLAFARLLITHPRFTILDEATSALDLKNEESLYQQLQDTKTTFISVGHRESLFNYHQWVLELSGDSSWQLISIQDYQLQKS

SEQ ID NO: 19976 - protein, 333 aa, Nostoc punctiforme
IIISDETLRDGEQQAGIFFSYPTKQKLAHLIAQTGVDRLSMMPRVHEQEEELVKSLVSEGLDSLIAAATMTGKQYIDQAKMYGVKRIILFYGLSDRLLFLRDPQIRLLNEFKGKTIDDDIPKKVIERIRQNAIDLIVENLHYATTVAGLTVDFAAEDASRADFDFLVQCIRSFSPYLDHFMLCDTVGVLTPEKSYIWINDLLQRTTGVAFGVHYHNDMGLALENTLQSVIAGATLVSGTFCGIGERAGNVAIEQVLNGLRVRFGIEVKGINYDAIAAVTDYIEQLGIRPAPPYSQTAQRHESGIHVNSLFSDPQSYAALPYNTIEVLFGKWSG

SEQ ID NO: 19977 - protein, 576 aa, Nostoc punctiforme
IAKLSAYLRPHWREASLGILALLSVNALGVYIPWLIRAGVDKLSTTFNWNEILHYVVIIVLLSSAMWLMRMASRIWLFGVGRQVEFDLKQRIFEHLLKLEPAYFASNTAGDLINRATSDVDNIKRLLGFAVLSLANTVFAYALTLPVMLAISVDLTLASLAVYPFMLLLVSLFSDRLRKQQAAVQEQLSEISELIQEDISGIALIKIYAQEANERRAFSKKNQQLLTANLELAKLRNTLFPLIGGLANISSLVIIWLGTARMSSGALQVGDFLALLIYVERLVFPTALLGFTITAYQRGEVSIDRLESILSVTPKIQDAADAIHLPAAELKGEVTAKNLSYSYPGSTTPALENVNFTIAPGETVAIVGAIGSGKSTLANALPRLLDIESGQLFLDGLDITKIALADLRGAIAYVPQDSFLFSTTIKNNIRYGDPISEQEQIESVAKLAKIESEIKSFPQQYETLVGERGITLSGGQRQRTALARAMLVNAPVLILDDALSSVDNQTATQILKNLSSGTERKTVIFITHQLSAAAAADRIFVMEKGKIVQIGNHLELLQQQGLYRTLWSQHQVEELL

SEQ ID NO: 19978 - protein, 339 aa, Nostoc punctiforme
YRIVAIPGEGIGPEVVEASLKILQHVAKIQGFTLQVDYGWLGATAFEQLGSYFPQATTELCDGADGIVFGAVSQGGLLELRKHFDFFCNLRPIRSVNSLLHKSSLRPEKIQGLDILIVRELVSGIYFGPSGRSSDERGNYGYHTMRYYDEEIRRIARKALEQAQYRRGLLTVAHKENALPHLHWTRLVQEEATKFPNVIVEPMLVDNLAMQMVLNPQRFDVILASNLFGDILSDIGGALVGSIGLLGSASLNANGFGLYEAIHGTAPDIAGLGIANPLGTLGACVLMLQQWGEVQAAQQIIAAQDRILAKGYRTADLFTQGEEILVNTATLVDLLLEEL

SEQ ID NO: 19979 - protein, 545 aa, Nostoc punctiforme
KRIESDEHFYGFGEPTGLLDQRSKVKTNWASDAIDYGIMTDSMYQAIPFFIALRPGLGYGLFFNTTYWSRFDLGAQQPGVWQMETQGSELDYYIIYGPEPAKIIQTYTQLTGRMPLPPRWSLGYHQCRWSYESQDIVRKLADEFRQRRIPCDVIHLDIDYMNSYRVFTWSPKRFADPQKLIGNLKQDGFKVVTIVDPGVKYEPEADYKVFDEGLKNNYFIRKTNGQLFHGYVWPDKAVFPDYLRPEVRDWWGNWQKSLTDIGVAGIWNDMNEPALDDRPFGDPGDKISFPLDAPQGPIEEITTHKEVHNLYGLMMAQASYQGAKISRPTERSFILTRSGYAGIQRWSAIWTGDNQSLWEHLEMSIPMLCNLGLSGIPFVGSDIGGFAGNATAELYARWMQLGMLYPLMRGHSALTTAQHEPWVFGDRIEKICREYIELRYQLLPYIYTLFWLAATTGAPILRPLLYDFPNDPKTFSLADQVMLGPSLLAAPIYRPGVEHRAVYLPEGCWYDWWSGETFIGPIHILAYAPLEKMPLYVRAGSIIAI

SEQ ID NO: 19980 - protein, 313 aa, Nostoc punctiforme
KIIVTGAAGFIGSHLVYILLQQGEEVIGIDEFNDYCDPMLKRKNVAHLHSSPGFTLIEADIQFLDWQELLKDVDVVYHQAAQAGVRASWGKAFRGYTERNINATQVLLEAAKDAKHLKRLVFASSSSVYGDAETLPTHEGICPEPVSPYGITKLAAETLCRLYHKNFGVPYVSLRYFTVYGPKQRPDMAFHKFFKSILQDEAIPIYGDGQQTREFTFVGDIVAANLAAASTPQAVGEIFNIGGGSRVVLAEVLDTIEEIVGKPIKRNHIEKAMGDARHTAADVSKAQKILGYQPQVSLRDGLTQEWRWIKSLY

SEQ ID NO: 19981 - protein, 316 aa, Nostoc punctiforme
  unsure (1)..(316): unsure at all Xaa locations
RQSRDEADSLLRIGEQQYASGYADKTIASCLQALELYHSIGDLKAQGLTYNLLAKAYIQIDSAKEAEDALRRGLAIARDTKDFQAQIFVLNNIGTFLLQEGESAAAGKTVEDALAIAHGVKNIEGEGLSLSNLGLVTARLGDYNKAIKLYENALIFRRQTGDAIGEANTLNNLGDAYLASGNYQDTIASYGEAMRTAKTNRDRTNELRAIDGLVKAHTAVGRYERAFDLLEQRLALAKELQNLREELKSFESYAQLYKQQGNYLTARNFYERAIILARTLEDSKQEVQLLDQLTKMLQRKXGQSMPLLSYLIXLIQ

SEQ ID NO: 19982 - protein, 626 aa, Nostoc punctiforme
MCGIVGYIGTQAATDILLAGLEKLEYRGYDSAGIATVWEGEVNCVRAKGKLHNLRSKLEQIEAPAQIGIGHTRWATHGKPEEYNAHPHLDTAKRVAVVQNGIIENYRDLREELKAKGHQFVSETDTEVIPHLIAEFLKNISPSSSSSPFLEAVRQAVNHLHGAFAIAVISADYPDELIVVRQQAPLVIGFGQGEFFCASDTPAIVAYTRAVLPLENGEIARLTPLGVEIYNFAGDRLKKQPRLLNFNPAMVEKQGFKHFMLKEIHEQPGVVRASLDAYFNPAESTESPINLGLPADLYNDLEQIQILACGTSWHAALIGKYLIEQLAEISTQVHYASEYRYAPSPVTANTLIIGVTQSGETADTLAALTMEKERRQGREPKYQARLLGITNRPESSLGHLVPHVISTLAGIEIGVAATKTFTAQLMAFYALALDLAARRQTVSKDTLDKIINGLRQIPKEIEATLESQERLTEQLAHEFAETQDFIFVGRGINFPIALEGALKLKEISYIHAEGYPAGEMKHGPIALLDAKVPVVAIAIPGSVYEKVISNAQEAKARDSRLIGVTPVNDGEAAEIFNDLLPISHVEELLSPILTVVPLQLLAYHIAARRGLDVDQPRNLAKSVTVE

SEQ ID NO: 19983 - protein, 869 aa, Nostoc punctiforme
DHLQVDRSKLSQMYLHYVETKDKYPHAVLLYRVGDFFECYFQDAVKLAQELELVLTSKQAGEQGRVAMSGVPHHAWERYATLLVEKGYAVVICDQVEDASEAAGRLVRREVTRILTPGTLLEEGMLKSSRNNYLAAVVIAANHWGLAYADISTGEFLTTQGSDLEHLTQELMRLQPSEVLVPTNAPDLGSLLRPGETSPHLPECLPPSFCYSLRSQVPFSQGEARPRLLQKFKVRSLEGLGCDRFPLAVRAAGGLLEYLEDTQKQNPVPLQRLRTYTVTDYLIVDSQTRRNLEITQTVRDGTFHGSLLWSLDRTSTAMGGRALRRWLLQPLLDIKGIRARQDTIQELMENTPLRQDLRQLLRQIYDLERLTGRAGSGTANARDLVALADSLSRLPELSHLVTESHSPFLKALQKVPSVLEELAQKLHAHLVESPPILIKEGGLIRPSVNPLLDERKATVEADQQWIANLEVDERAKTGISTLKVGFNKTFGYYISISRTKADQVPANYIRKQTLTNEERYITPDLKEREARILSARDDLNQLEYEIFTALREEVAQEAEVIRNLSRAVAAADVLCGLAELAVHQGYCRPEMLSGREINIVDGRHPVVEQSLPAGFFVPNSTQLGQESLVSSHLSLADNQEQITNTSLREAAPTTTLSTSDQGQMTNDNPDLIILTGPNASGKSCYLRQVGLIQLMAQIGSFVPARLAKLGICDRIFTRVGAVDDLATGQSTFMVEMNETANILNHATSRSLVLLDEIGRGTATFDGLSIAWAVAEYIAVDIRARTIFATHYHELNELASIVPNVANYQVTVKELPDQIIFLHQVQPGGADKSYGIEAGRLAGLPAVVIQRAKQVMGQIEKHSKIAMGLQ

SEQ ID NO: 19984 - protein, 127 aa, Nostoc punctiforme
MSFEYPQDFRYLDSHEYVRIDGEIATIGITEFAVHELGDIVFLELPEIGDALTRGENFGTIESVKAVEELNSPVTGTVIERNEALINSPEEVSEDPYGEGWFLKVRVNDPGEIEDALTADEYRAQVE

SEQ ID NO: 19985 - protein, 217 aa, Nostoc punctiforme
GRLLRTLNGHSDSVKAVAVTPNGQQVISASSDNTLKVWNLATGEEQFTLNGHSDWVKAVAVTPNGQQVISASSDNTLKVWNLATGEEQFTLNGHSDWVKAVAVTPNGQQVISASDDNTLKVWNLATGEEQFTLNGHSDSVKAVAVTPNGQQVISASSDNTLKVWNLATGEEQFTLNGHSDWVKAVAVTPNGQQVISASDDNTLKVWNFLTGKVITTF

SEQ ID NO: 19986 - protein, 537 aa, Nostoc punctiforme
MQEYDVVLIGAGHNGLVCAAYLLKAGYSVLLLEKRSVPGGAATTEECLPQEAPGFKFNLCAIDHEFIHLGPVVEELELEKYGLHYLECDPVVFCPHPDGKYFLGHKSLEKTCAEIARYNERDAKKYAEFVDYWQRAIGAMIPMFNAPPKSIIDIVGNYDIKKFKDLFSVIGSPNKTLDFIRTMLTSAEDLLNEWFDEEFLKAPLARLASELGAPPSQKTLAIGAIMMAMRHNPGMARPRGGTGALVQALVNLVTSKGGVILTDQHVEKVLIDDGKAVGVRVAGGKEYRAKYGVISNIDAKRLFLQMTDKSDVDGADPDLWERLERRIVNNNETILKIDLALDEPLHFPHHAHKDEYLVGSILIADSVAHVEQAHSKCTLGEIPDADPSMYVVMPSYLDPTLAPPGKHTVWIEYFAPYQIAGAEGTGLKGTGWTDELKNKVADRVVDKLADYAPNVKNATIARRVESPAELGERLGAYKGNYYHVDMTLDQMIFFRPLPEIANYKTPIDNLFLTGAGTHPGGSISGMPGRNCARAFLQ

SEQ ID NO: 19987 - protein, 451 aa, Nostoc punctiforme
KLPKGPQSPAVLQMLRWITSPMSFMETCAKRYGDMFTIRLDSKSPPLIFVSKPEVLEQILTNDIKGLEAPGDTNLVFESLLGKHSVITISGAEHQRQRQLLLPPFHGERMRSYSQIISDITEKVISQYQIGQPFNIRSVTQAITLRVIMQAVFGLDEGPRAEKLQHCLAEMLEKGSSVLSAALLYFPALQRDFGPINFWGKQMRRQQAADKLIYEEIRERQEQPDPSRTDILSLLMAARDEAGQPMTDEKLRDELMTLLVAGHETTATALAWAFYWIQKIPTVRQKLLKELDSLGDNPDPSTIFKLPYLNAVCSETLRIYPVAMLTFARVVRTPLSLGGYELEPGIGVIGSIYLTHHREDLYPEPKQFKPERFLERQFSPYEYLPFGGGARRCIGLAFAQLEMKLALAKILSTRELELVDNSEVRPKRRGLVTGQDRPIQMVVTSQRQVKF

SEQ ID NO: 19988 - protein, 547 aa, Nostoc punctiforme
LLSYRSLSQPNQIAYTFLVDGDTEEVKLTYQELDQKARAIAVELQSLKAAPGERALLLYPSGLEFIVAFFGCLYAGVLAVPVYPPRRNQRMTRLQAIVKDSEARFALTTASVLTNIQQGFAQEPELTALHCIAIDKIVSDASNWQKPPLEKSTLAFLQYTSGSTGTPKGVIVTHGNLLQNSEYIKSAFELTPNSVSVTWLPSFHDMGLIDGVLQPLYTGFPSVMMSPASFVQQPIRWLKAISDYKATHCGGPNFGYELCVSKITPEQRANLDLSSWCSAYSGAEPVRRETLEKFAATFKSSGFQAKFFYPCYGMAEATLMISGGGVADEPVYCVVDPKALEKNQIIQVSEDTPKVKHLVGCGYAWLDTKIAIANPQSLTLCAPEQVGEIWVSGSSIAKGYWNRPEQTKETFHAYLADTAEGPFLRTGDLGFLKDGQLFITGRLKDVVIIRGCNHYPQDIELTVEQSHQALKAGSGAAFSVDIDGEEQLVIVQEVERTYLRHLNLDEVVEAIKTSVSQIHELQVYAVLLLKTGSIPKTSSGKIQRHAC

SEQ ID NO: 19989 - protein, 757 aa, Nostoc punctiforme
  unsure (1)..(757): unsure at all Xaa locations
MKLRSYMFLGFFLSLLLTFLPFSSNFINAATPTAVAPVSAVSFTQGVKKTVLDNGLTVLTKEVHTAPVVSVQVWYKVGSRNEVKGENGISHQLEHLMFKGTTARPVQFGRLFSALGSQFNAFTSYDETAYFGTVQRDRLEALLTLEADRMENSLVGSEQLTSEKRVVISELQGYENSPGYRLSRAVMRDAFPNRAYGLPVGGTKADVEKFTVEQVRNYYQTYYSPENATLVITGDFATEPVLKVVKETYGKLAKRSQQGNVRGNVAPSSPVAATTKKAPIVLKQPGSAALLQAVYPLPDIKHPDVPAIDVMDAILTGGRSSRLYQALVESGLASSVSGGAAELIEPGWYEINATAAPGKELSKIAQVLQESLGKLQQQPVTTEELTRAKTQLQASYILGNQDITSQATQLGYNQTIAGDYHFIEQYLAAIAKVTPAQVQKVAKTYLNPAKQTIGFFEPTQPDGKPGTSSAGSGRTVENFSPGKPVDPAQLAKYLPPATSATDSAKQSLPEEFTLNNGLRVLLLRDRSLPTINLSGQIDAGTEFDGNQKAGLANLTAANLMNGTQTKNALTLAKTLEDLGADLSFSASREGVNVSGEGLSKNLPILIQTLADVLENATFPADQLELSRQRALTSLKVQLDDPRGLGRQVFQQAIYPENHPFHSFPTFESLKSISRDDLLGFYQKYYRPDSTTIAIVGDFDPVKVKTLLNQAFGKWQATGKPPVLKISAVPIPQTSTRLGLYIXAPXSVLXVLSCLVKH

SEQ ID NO: 19990 - protein, 548 aa, Nostoc punctiforme
SQFDVLVVGAGAAGLYTALCLPESLRVGLITKETVALSASDWAQGGIAAAVSPEDSPTLHIEDTIRAGAGLCDRTAVEFLAQLAPKCIQSLVDLGVAFDRHGQALALTLEAAHSRNRVLHAADTTGKEVTTTLTAQVLRRPNIQVIQQALALSLWIEPESNRCQGISLFYQGKITWIKAGAVILATGGGGQVFAQTTNPAVSTGDGVAIAYRAGAILRDLEFVQFHPTALTKPGADRFLISEAVRGEGAHLVDNEGRRFAFDYHPAGELAPRDVVSRAIFSHLQRTAVDLATAHVWLDMRPIPADKIRHRFPNIIKVCQHWGVDVFHEPIPVAPAAHYWMGGIVADLMNRTNIKSLYAVGETASTGVHGANRLASNSLLECIVFGAQMSQIELENIGLPSQIPVLPSRKFSVDANEWHIQQAQLETLREKLPRLVWESAGICREQSKLETAIATVESWQQDFAALPLSQFLLALHPTESASFEFPDVERQLRLWAETRNLLDVADLILKSAAFRTESRGGHYRLDYPQPDPNWQVHTLVQRNHWWKSP

SEQ ID NO: 19991 - protein, 488 aa, Nostoc punctiforme
MTLSFQELGISQERVAQLEKIGFTEPTNIQVQAIPQLLGGRDVVGQSQTGTGKTAAFSLPILERLDINQKAVQAIVLTPTRELAMQVHDAIAQFIGDEGLRVLAIYGGQSIDRQMLQLRRGVHMVVGTPGRVIDLLDRGCLKLDQVKWFVLDEADEMLSMGFIDDVIKILSQAPVDRQTALFSATMPPSIRMLVNKFLRSPATVTVEQPKAAPNKINQVAYLIPRHWTKAKALQPILEMEDPETALIFVRTRRTAAELTSQLQGAGHSVDEYHGDLSQQARERLLVRFRNRQVRWVVATDIAARGLDVDQLSHVINFDLPDSVETYVHRIGRTGRAGKEGTAISLVQPFERRKQQTFERHNRQSWQLLSIPTRAQIEARHILKLQEQVREALTGERLASFLPIVSELIEEYDAQAIAAAALQIAYDQTRPAWLSSDVEIPQEESSAPKPRLGKRRESSSDRPRSAWKSDSNNGEERHSSPKPKLRTSG

SEQ ID NO: 19992 - protein, 307 aa, Nostoc punctiforme
VENVTLGQNGPVVTPLCIGTWAWGDKLFWNYGDRYGPEQLQEAFTAALEAGITFFDTAEIYGMGKSEEFLGQFLQHTQQPVQIATKFGPVPWRFTAQSVSDALTASLKRLQLERIALYQVHWPFAFFLSQQTLMNALADEVKRGRIAAVGVSNYSAEQMRDAHQILADRGVPLAVNQVRYSLLSRQIESKGILATARELGVTILAYSPLAQGLLTGKYSIDSAETPTGARKIDSRFKKEGLQKISPVISLLRNFGEKYDRTPAQVALNWLIAQGNVIPIAGVKTAEQVRQNAGALGWRLSDDEIGEL

SEQ ID NO: 19993 - protein, 301 aa, Nostoc punctiforme
DIPIPEPPPGEALVRVLRAGICNTDLELLRGYYPYTGILGHEFVGVVEKGPEHLVNQRVVGEINAVCGHCRFCRSGQLTHCENRTVLGIVNRNGAFGEYLCLPVENLHLVPDNVPTEVATFTEPIAAALEIQQQVPLHPNDRVLVVGDGKLGQLVAQTLALTGCELLAVGRHQEKLANLEARGIKTGLADAVKDGYFDISVECTGNPEGFAIARRALRPRGTLVLKSTYAGNLSLDASSLVVDEITLIGSRCGPFTPALQLLATGQIDVQPLIHATYPLIEGLAAFEHAQSRGVLKILLEI

SEQ ID NO: 19994 - protein, 318 aa, Nostoc punctiforme
SADRNAKTRQLLGMKGAAAGETSIWKIRLQLMKPITWIPLIWGVVCGAASSGNYTWTLENVLKVLTCMLLAGPLMTGYTQILNDYYDREIDAINEPYRPIPSGAIPLPQVIIQIWVLLIAGYGLAFALDVWSGHEFPTITAIAIIGSFIAYIYSAPPLKLKQNGWLGSYALGASYITLPWSTGHALFGDLNSTIVILTMFYSLAGLGIAIVNDFKSVEGDRQLGLNSLPVMFGITTAAWICVVTIDVFQGFIAAYLVSIHENLYAAILVLLIIPQITLQDMYFLRDPVKNDVKYQASAQPFLVLGMLVTGLALGHAGV

SEQ ID NO: 19995 - protein, 356 aa, Nostoc punctiforme
KALILSGGKGTRLRPLTYSGAKQLVPVANKPVLWYGIEEMVAAGITDIGIIISPETGAEVQGKTGNGEYFGANITYIVQEQPLGLAHAVQIARPFLENSPFVMYLGDNLIQLGELRYFLQQFSQQQPDALILLRSVANPSAFGVAEVDDTGRVLQLIEKPKVPPSNLALVGVYFFSHLIFDAIANIQPSARGELEITDAIQYLINQEKQVLAYNLKGWWLDTGKKDDLLEANRLILDTYLIASVLGEIDAQSQIIGRVQIGAKSQVINCTIRGPVVIGSNCHLENCFIGPYSSIANNATLIDTDLEHSVILEGAKIAGIHQRIIDSVIGQRAQLTLAPRRPKALRFLIGDDCQIEL

SEQ ID NO: 19996 - protein, 245 aa, Nostoc punctiforme
IQMNYDIKDKTILVTGANRGIGKAIVESFIEHGATKVYAAVRQLNSVSSLVEQYGLRVVPIPVDLGDPQSIVAAAQTAPDVQIVINNAGVFQAGTPLAENAIAALEFQMKINVYGLLYMAQAFSPILKANGGGVFVQINSVASLKGFPDSATYCASKAAAYSITQALRELLSEQDTLVLSVHPGPIATDMGDAAGMSQVAQPPALVADGIIKALKAGDFHVFPDSIAKQMGDVYKSFAQNVIEVS

SEQ ID NO: 19997 - protein, 381 aa, Nostoc punctiforme
MKVLVIGGDGYCGWATALYLSNRGYEVGILDSLVRRHWDNELGVETLTPIALIQQRLQRWQDLTGKSIDLFIGDITNYEFLSKTLHQFQPNALVHFGEQRSAPFSMIDREHAVLTQVNNVVGTLNLLYAMREDFPDCHLVKLGTMGEYGTPNIDIEEGYITIEHNGRKDTLPYPKQPGSMYHLSKVHDSHNIHFACRIWGLRATDLNQGVVYGVLTEETGMDELLINRLDYDGVFGTALNRFCIQAAIGHPLTVYGKGGQTRGFLDIRDTVRCVELAIANPAQPGEFRVFNQFTEQFSVGDLALMVKNAGNAMGLKVEINHLDNPRVEKEEHYFNAKNTKLLDLGLQPHLLSDSLLDSLLNFAIKYQKRVDHKQIMPKVSW

SEQ ID NO: 19998 - protein, 369 aa, Nostoc punctiforme
MRIALFTETFLPKVDGIVTRLRHTVDHLQRSGNQVLVIAPDGGITEHKGAKVYGITGFPLPLYPELKMALPRPAIGYALEEFKPEVIHVVNPAVLGLAGIFYSKILKIPLVASYHTHLPQYLQHYGLGMLEGFLWELLKGAHNQAALNLCTSTAMVEELTGHGIERVDLWQRGVDTELFHPDLANVEMRSRLSQNHPESPLLLYVGRLSAEKEIERIKPILEAIPEARLALVGDGPHRQALEKHFAGTNTYFVGYLMGQELGSAFASADAFIFPSRTETLGLVLLEAMAAGCPVVAARSGGIPDIVTDGVNGYLFEPTEDVKGAIAATVRLLEQKEQRDIIRQNARQEAESWGWAAATNQLQDYYQKII

SEQ ID NO: 19999 - protein, 163 aa, Nostoc punctiforme
TPTSTELQGINETAIASEIKTTFTSEEIQKLLPHRYPFLLVDKIIDYVPGKKAVGVKNVTINEHYFQGHFPGRPLMPGVLIVEAMAQVGGIVLTQMSSVEGGLFVFAGIDKVRFRRQVVPGDQLVMTVELLWVKQRRFGKMQGRAEVDGQLACEGELMFSLVN

SEQ ID NO: 20000 - protein, 1328 aa, Nostoc punctiforme
MFTHVKSTIRHIAPDNLRGRSLIKVVYVVLESQYQSALSQAVRTINANNPNLAIEISGYLIEELRDPENYEEFKREIENANIFIASLIFIEDLAQKVVAAVEPHRDHLDVSVVFPSMPEVMRLSKMGSFSLAQLGQSKSAIAQFMRKRKEKSGAGFQDGMLKLLRTLPQVLKFLPMDKAQDARNFMLSFQYWLGGSPENLENFLLMLADKYVFKGLEKQNFAPSTYEQPVVYPDLGIWHPLAPNMFEDVREYLNWYTARKDISSDLKDPLAPCVGLVLQRTHLVTGDDAHYVAMVQELEALGARVLPVFAGGLDFSKPVEAYFYEPNTNTQLVDAVISLTGFALVGGPARQDHPKAIEALKRLNRPYMVALPLVFQTTEEWMDSDLGLHPIQVALQIAIPELDGAIEPIILSGRDGATGKAIALRDRVEAVAERALKWANLRRKPKLDKKVAITVFSFPPDKGNVGTAAYLDVFGSIYEVMKALKNNGYDLPELPESAEALMQEVIHDAQAQYNSPELNIAYKMSVPEYEALTPYSQRLEENWGPPPGHLNSDGQNLLIYGKQFGNVFIGVQPTFGYEGDPMRLLFSRSASPHHGFAAYYTYLEQVWKADAVLHFGTHGSLEFMPGKQMGMSGDCYPDNLIGSIPNLYYYAANNPSEATIAKRRSYAETISYLTPPAENAGLYKGLKELSELIASYQTLKDSGRGVSIVNSIMDKCRIVNLDKDIHLPETDARDMSADERDNIVGNVYRKLMEIESRLLPCGLHVIGKPPSAEEAIATLVNIASLDRQEDGIQGLPGIIANSLGRNIDDIYQNNDRGILEDVQLLQDITLATRAAVTALVQEQIDAEGRVSLVSRLNFFNMGKKEPWVESLHKAGYPKVDSAALKPLFEYLEFCLEQVCADNELGALLRGLEGEYILPGPGGDPIRNPDVLPTGKNIHALDPQSIPTTAAVQSAKIVVDRLLVRNKAENEGKWPETIACVLWGTDNIKTYGESLAQIMWMVGVRPVPDALGRVNKLELISLEELGRPRIDVVINCSGVFRDLFINQMNLLDQGVKMAAEADEPLEMNFVRKHALQQAEEMGINLRQAATRVFSNASGSYSSNINLAVENSTWDSEAELQEMYLNRKSFSFNSDNPGIMDESRQIFESTLKTADATFQNLDSSEISLTDVSHYFDSDPTKLVASLRGDGKKPASYIADTTTANAQVRTLSETVRLDARTKLLNPKWYEGMLSHGYEGVRELSKRLVNTTGWSATAGAVDNWIYEDTNETFIKDEEMQKRLLNLNPHSFRKIVSTLLEVNGRGYWETSEDNLDRLRELYQEVEDRIEGIE

SEQ ID NO: 20001 - protein, 365 aa, Nostoc punctiforme
PSLSTQTSSSLFTLTVAPAKVIRGSGVLQAAAAEIACLGSRPLIVAGESTLAISRKNLQPVLETQQLHPVQASYGADCCEASLKSLQKKAKEHKADVIIGVGGGKALDTAKLLAQQLQLPVVTIPTSGATCAAWSALSNVYSENGAFLYDVGLSRCPDLLILDYDLIQTAPQRTLVAGIGDAIAKWYEASVSSGHLQDTLIIAAVQQARVLRDILLQKSAAALKEPGSEVWREVVDASVLLAGVVGGLGGAQCRTVAAHAVHNGLTHISGHGSIHGEKVAFGILVQLRLEEMLQGNQLAASARQQLLKFYTEIGLPQKLSDLGLGNITLGELQTAAEIALVPNSDIHRLPFKVAPEQLMAAMVST

SEQ ID NO: 20002 - protein, 393 aa, Nostoc punctiforme
MSLNWIVPAERIQKLPPYVFARLDELKAKAREQGLDLIDLGMGNPDGATPAPVVEAAIAALKDPANHGYPPFEGTASFRRAITNWYHRRYGVVLDPDSEALPLLGSKEGLTHLAIAYVNPGDLVLVPSPAYPAHFRGPAIAGGKIHSLILKPENDWLIDLAAIPDEVARQAKILYFNYPSNPTAATAPREFFEEIVAFARKYEILLVHDLCYAELAFDGYQPTSLLEIPGAKDIGVEFHTLSKTYNMAGWRVGFVVGNRHVIQGLRTLKTNLDYGIFSALQKAAETALQLPDVYLHEVQQRYRTRRDFLIDGLGELGWDIPRTKATMYLWVKCPVGMGSTDFALNVLQQTGVVLTPGNAFGVAGEGYVRISLIADCDRLGEALHRFKQAGIRY

SEQ ID NO: 20003 - protein, 498 aa, Nostoc punctiforme
DYIVIGAGSAGCVVANRLTEDAETTVLLLEAGNPPNLPEHEIPLAWTKLWGTEADWAYFTEEEPYINNRKIYCPRGKVLGGTSAINAMIYIRGSRLDYDHWEKLGNVGWSYEDVLPYFQKSENQQRGASEFHGVDGLLSVTDPLAPSVISQKFLEAAIGLGYERNPDFNGTQQHGAGFYQLTIKDGKRHSTATAFLLPILERPNLTVTTGALVTRLLFEGTQTVGVEYIHQGTIHQVRVEQEVILSAGAIDSPKLLMLSGIGNAEHLQNFDIPVVVDLPGVGQNLQDHILVGVAHEATQDLQPDLTSNIAEVGLFLHTEGRLDAVPDLQFFSGPVLWTHPAYARSAPGFTATVCVTNPESRGSVSLSSAFSKDPAIIRMNYLQSESDLQKLLAGVKIIRQIFHSSVFDELRGEEAAPGADNKSDETLLAYIRETCDSVYHPVGTCKMGTDADSVVNPELRVHGVAGLRVVDASIMPTITTGNTNAPTIMIGEKAADLI

SEQ ID NO: 20004 - protein, 388 aa, Nostoc punctiforme
LKEAKLTADAANHAKSDFLANMSHELRTPLNGILGYAQILARTASDEKQQRGIDIIYQCGSHLLTLINDILDLSKIEAGKLELQLVPFYLPAFLQSVVEICRIKAEQKSIEFIYQPPENSAMGIVADEKRLRQVLINLLGNAIKFTDKGSVTFRVEVLLGDITNLRFYIQDTGIGMSPQQLEKIFLPFEQVGDSKRQSEGTGLGLAISQRFVELMASKIQVESQLGVGSKFFFNIDCAIATDWVQANSLTSSGRIIGYAGVGKTSVKENRKKILIVDDRWENRSVIVNLLEPLGFEVIEASNGQEGLEKITRDRPDTIICDLAMPVMDGWEMLKQLRQSETLRDAIVIVSSASVFENDRQKSLDAGGNDFLAKPVQADELYAVLAKQL

SEQ ID NO: 20005 - protein, 280 aa, Nostoc punctiforme
LASGSRGETKLWDLSKGELIDTLSEYPWVIPGLVDEVNSLAFSADGQTLVSCGADSTIKLWHVGALDLIDILHKHNGVVRCAAFTPDGRMLATGGDDRKILFWDLMHRQVAIAVSLDDTAAHSLVLSRDGETLVTGSYRKIKVWRTLPQTGIKSLKDAQPLHTLMGHSHIVRSLAISADAKLLVSGSWDQTIKIWQLETGELLHTLKGHRDRVYAIALSPDGQIIASGSADKTIKLWHLQTGELLGTFTGHGNIVTALAFTASGEMLVSGSLDKTIKIWQ

SEQ ID NO: 20006 - protein, 541 aa, Nostoc punctiforme
  unsure (1)..(541): unsure at all Xaa locations
LKSSYTVVVIGSGYGGSIAASRLARAGQQVCILERGKEFQPGEYPKTQSKALAQMQIDLPQHHLGSHTALYDFHVNKDINVFIGCGLGGTSLVNANVSLQAEPRVFADSRWPKELRDDVGTLLAAGYRRAEEMLKPTPYPENFPPLPKLQALEKSSKYLNEKFYRPPINVTFQDGVNHVGVEQNKCNLCGDCVSGCNNKAKNTVLMNYLPDAKNHGAEIYTQVSVRRVERQGNRWLVHYQLLNTGQESFNAPTMFVSADIVILAAGTLGSTEILLRSQAAGLAVSEKLGHNFTGNGDVLAFGYNTEAVINGMVLAIARRMPKNQXGHASPVSXICENSPNXITDXLLEEGSIPGGLAAILPQTLAAAAKILGKDTDSGLGDRIEEKIREVESLTHGAYTGAVRNTQTYLVMTHDDAAGQMYLENDRLRIKWQDVGSQPIFQRVNNRLTEATEPLGGTQIPNPIWSDAFGHDLVTVHPLGGCILAEDAEHGVVNHKGQVFASNQGTNVYENLYVADGSIVPRTLGVNPLLTISALAERCCTL

SEQ ID NO: 20007 - protein, 259 aa, Nostoc punctiforme
PQLSWTNVVFFTTFHALALMSPWFFSWSALGLLVFLHWLFGSIGICLGYHRLLSHKSFQVPKWLEYAIALIGALALQGGPIFWVGGHRQHHAHTEDINLDPYSAQRGFWWSHILWIFYPRPEFFDYDTYKKYAPDLARQPFYCWLDRYFLLLQIPFALLLYGLGGWPFVFYGVFLRCVLLWHSTWFVNSASHLWGYRTFDANDGARNLWWVSLVTYGEGWHNNHHTYPHMAKSGLSWWEIDVTWWSILVLQTLGLAKKV

SEQ ID NO: 20008 - protein, 460 aa, Nostoc punctiforme
GLFYATPAADGILSRIRIPGGIISSQQCRAIADIADQHGGGYVDVTNRANLQVREIRTGINSEVLQHLQDMGLGSRNSVVDHIRNIMTSPTAGIDAQELIDTRPFVQDWDNYIAAHPALSGLSAKFSVCFDGGGIIRVCDRLNDILFAAVLVDGNVYFRLYLSVGTKGQPPSDTGILLTPEQCLPVLAALTEVYLAHSNTTNNRRLRLLELLNTLGCENYLQEVQQRLPFSLLCSNLTPQPPSLVGKGEKFSPLLQGEGLGERLDAKYQHIGIHPQRQQGLFYIGVVLPLGRLESNQMKGLADLAAKYGSGTLRLTPWQNLLLTDIPQQWVGDVQSKIAFLGLDISATNIKSALIACSGNKGCASSATDTKSHALALVEYLETRVTLDCPVNIHFSGCEKSCAQHSKSDITLLGVSIEDGNGTVEGYHVYVGDSEHKFGRKIIYQYVTFAELPALIKRML

SEQ ID NO: 20009 - protein, 275 aa, Nostoc punctiforme
KAVLALAISPDGQTLVSGSEDNIIKVWNLNNSNEILTLTGHSKQINSVAISPDSQTLASGSDDDTIKIWNLKTGEEISTIKANSGTVLSIAISPDQQMIVSGSSDSRVRLWNLKTGECIKTLATHAYRVSSVAISQDGSTVASSSWDTTIKIWPKSTLTGHLKPVTSIAIGLNSQILVSASVDRRIIVWNLNTGEKIYTLDGHSDVVNSVAISPDSQKIVSGSDDEKIKVWNLSNGQEAYTVNGHLDGVNALVFSPDGQILVSGGKDTTIKVWRI

SEQ ID NO: 20010 - protein, 314 aa, Nostoc punctiforme
MQTKQLGNSELHITPIGFGAWAIGGGGWAFGWGAQDDRESIEAIARALDLGVNWIDTAAIYGLGHSEEVVAKALKGRSSRPYIFTKCSMIWDEKGEIGRSLKADSVRREVEASLRRLDIETIDLYQIHWPNPATEIKEGWTTLAKLKDEGKVRYIGVSNFNVEQLKRIQEIAPVTSLQPPYSLVKRDVENEILPFCQENNIGVIVYSPMQSGLLTGKMTSERVANLPDDDWRKKSDEFQEPRLSRNLKLVEVLQDIGKEHDRSAGEVAIAWTLNNPAVTAAIVGARNPKQVEGIIAAGEFRLNQQELDQIAAFL

SEQ ID NO: 20011 - protein, 426 aa, Nostoc punctiforme
  unsure (1)..(426): unsure at all Xaa locations
PGQQVKIGPTKLLINNEWVNSVSNRRFETINPTTGEVICEVSEADAPDVDKAVQAARNAFTNGQWRKISATRRGELLYKLADLIEQNIDELGQLETLDNGKPLQDSFGDLRLVIACYRYYAGWADKVQGKTIPINGHTFASHEPVGVVGQIIPWNFPLLMQAWKLAPALATGNTVVLKTAEQTPLSALRVGELIIEAGFSPGVVNILSGYGPTAGAASYAGSHDAIFFNQGQCCCAGSRLFVEEKCYDEFVARTVERARARVVGNPFDAKTEQGPQVDKDQFDRVMSYIESGMREGAEMLCGGNQVGDKGYFIAPTVFAGVRDDMKIAQEEIFGTVMSIIKFKDIDEVIQRANATMXGLAAAVWTQDIKAHAIANNLRAGTVWVNCYDVFDAAAPFGGFKQSGIGRELGEYGLQQYTEVKTVTIKL

SEQ ID NO: 20012 - protein, 427 aa, Nostoc punctiforme
SPLIAIAQKTRKAASKLAILSTEAKNQAIIAIAQALESAKDEILQANIADCEAANAEGIPKPLYKRLQLDEHKLRDAIVGVQDVGKLDDPVGKVQIHRELDTGLILKRITCPLGVLGIIFEARPEAAIQIASLAIKSGNGVILKCGKEAVRSCEAIVKAIKQGLSHTAVNPDTVQLLTTREETLELLKLDKYVDLIIPRGSNSFVRFVQENTRIPVLGHADGICHLYIDKAADISKAVPITVDAKAQYPAVCNAIETLLVHQSIATEFLPKVADALQERHVELRGDKRTLKILPNIVSATEIDWETEYSDYILSIKIVDSIEDAIAHINEYGSRHTDAIITEDSTSVETFFGLVNSANIFHNCSTRFADGFRYGFGAEVGISTQQMPPRGPVGLEGLVTYKYQMTGDGHIVATYTGANAKAFTHRDL

SEQ ID NO: 20013 - protein, 383 aa, Nostoc punctiforme
AIAPHGGQLVNRIATPEQREEFLSKADFLPRVQLDDRAVSDVEMIAIGAFSPLTGFMSQEDYDRTVTEMRLANGLVWSIPITLSVTEEVASPLQEGGLIRLDNSRGEFIAVLQLTQKYNYDKTREAINVYRTDDVKHPGVQVLYSQGTVHLAGDIWLLQREPHPQFPTYQIDPSASRQLFKDKGWKTIVGFQTRNPIHRAHEYIQKCALEIVDGLFLHPLVGATKEDDIAADVRMRCYEILLEHYYPLDRVTLAINPAAMRYAGPREAIFHALVRKNYGCTHFIVGRDHAGVGDYYGTYDAQYIFDEFAPGELGIVPMKFEHAFYCTRTKQMATSKTSPSRPEERIHLSGTKVREMLRRGELPPPEFSRPEVAAELARAMRIE

SEQ ID NO: 20014 - protein, 993 aa, Nostoc punctiforme
MVDLLRQLRDLCSPEGQATNDQASSAVKLIEQLNINEAIRAARAFALYFQLINIIEQEYEQRQQLSRYEAETEPTDSERASNVNYSSNQREDDAPVSKGIAAELLAKNYLEKAQVKPKGTFAALFPYLFKQNVPPQQIQRLIAHLDVRLVFTAHPTEIVRHTIRDKQRQVVQLLQKLDTLENHAGGTGGGYAWEAADVREQLLEEIRLWWRTDELHQFKPTVLDEVDYALHYFQEVLFDGIPQLYKRFKHTLSNTFPWLEPPSKNFCSFGSWVGSDRDGNPSVTPEVTWQTACYQRKMVLGRYIQSVKNLIELLSVSMHWSDVLPDLLESLELDQSQLSEVYDALALRYRQEPYRLKLAYVLKRLENTRDRNLALYNRETPKNQDSPLYRSGDDFLAELRMIQRNLTETGLSCRDLENLICQVEIFGFNLTQLDIRQESSRHADALNEILQYLQILPQPYNELSEEQKVAWLTGELQTRRPLIPAELPFSEKTNDVIETFRVVRSLQQEFGLNICQTYIISMCRDVSDVLEVLLLAKEARLFDPAIAVGTIQVVPLFETVEDLQRSRSVMRKLFELPLYRALLAGGYEQTKTESVVVDENSSSLASPAPPASPASPAPSPSPLTPNLQEVMLGYSDSNKDSGFLSSNWEIHKAQKSLQQIAEGYDINLRIFHGRGGSVGRGGGPAYEAILAQPGHSINGRIKITEQGEVLASKYSLLDLALYHMETITTAVIQASLLRTGFDDIEPWNEIMEELAARSRQHYRALIYEQPDFVDFFHQVTPIEEISQLQISSRPARRPSGKKDLSSLRAIPWVFSWTQTRFLLPSWYGVGTALQEFLNAEPEEHLKLMRYFYVKWPFFKMVISKAEMTLAKVDMQMAHHYVQELSQSEDQLRFAKVFDQIASEFYLTRDLVLKITDHNQLLDGDPVLQRSVQLRNGTIVPLGFIQVSLLKRLRQSMNTNATSGVIHSRYSKGELLRGALLTINGIAAGMRNTG

SEQ ID NO: 20015 - protein, 635 aa, Nostoc punctiforme
MHLSEITHPNQLHGLSVRQLQQIARQIRDKHLQTVAVNGGHLGPGLGVVELTLGLYQTLDLDRDKVIWDVGHQAYPHKLLTGRYDRFHTLRQKDGVAGYLKLCENKFDHFGAGHASTSISAALGMALARDLKGEKFKAVAVIGDGALTGGMALEAINHAGHMPKTNLLVVLNDNDMSISRNVGAIPRYLNKMRLSQPVQFIKDNLEEQFKQIPFVGESLSPELGRIKEGMKRLAVPKVGAVFEELGFTYIGPVDGHNLEELITTFQQAHQIQGPVLVHVATVKGKGYEIAELDQVGYHAQSPFNVATGKAIPSNKPKPPAYAKVFSHTLVKLAEQNPKIVGITAAMATGTGLDKLQAKLPNQYVDVGIAEQHAITLAAGLATQGMRPVAAIYSTFLQRAYDQIIHDVCIQNLPVFFCLDRAGIVGSDGPTHQGMYDIAYLRCIPNIVIMAPKDEAELQRMVVTGVNHTSGPIAMRYPRGNGHGVPLMEEGWEPLEIGKSEILRTGDDVLIVAYGTMVYPGMQAAEILSEHGIEATVINARFVKPLDTELILPLAKKIGRVITLEEGCIMGGFGSAIAEALMDADILVPVKRFGVPDVLVDHAEPNESKTELGLTSHQIAERVLQAFFKQQVSAVV

SEQ ID NO: 20016 - protein, 473 aa, Nostoc punctiforme
MYEKITPPAAGAKIAFKNGEPIVPDNPIIPFIRGDGTGIDIWPATQKVLDAAVAKAYKGQRQISWFKVYAGDEACDLYGTYQYLPQDTLTAIEEYGVAIKGPLTTPVGGGIRSLNVALRQIFDLYACVRPCRYYAGTPSPHKNPEKLDVIVYRENTEDIYLGIEWRQGSEIGDRLIKILNEELIPATPEHGKKRIPLDSGIGIKPISKTGSQRLVRRAIKHALLLPKNKQQVTLVHKGNIMKYTEGAFRDWGYELATSEFRQETVTEQESWILSNKEKNPNISLEENARQIEPGFDNLTPDKKAQVVKEVETVLNTIWATHGDGKWKEKVLVNDRIADSIFQQIQTRPDEYSILATMNLNGDYLSDAAAAIVGGLGMGPGANIGDSSAIFEATHGTAPKHAGLDRINPGSVILSGVMMLEFLGWQEAADLIKKGLSDAIANSQVTYDLARLLEPPVEPLKCSEFADAIIQHFG

SEQ ID NO: 20017 - protein, 575 aa, Nostoc punctiforme
VAALQNYERLRESQDSLRQSEERYRLLVEGVTNYAIFMLDPNGNVTTWNIGAERILGYQEAEIIGQPFERVFSPEAIKQGLPKQVLRKAVAEGFSRENRWHIRKDGTFFWAHCLITPLLDDDGNLRGFSKIMQDITERKQAEEEKEQLLLREQAARAVSEAAQSAAEAANRSKDEFLAIVSHELRTPMTAIIGWAGMLQTGVLDEAKATLALEIIERNANLQMQLIEDLLDISRIVRGELSLSIDLVDLVEVITAAIEVVQSLANAKDIQLETILDTSIEKIWGDSDRLQQVVLNLLTNAIKFTPNGGRVEVRLSKEMGSREEFSQPAIPNYLQIEVTDTGKGISPDFLPHVFERFWQADSTHTRSNKGLGLGLAIALHLVELHGGTIDAQSQGIGQGATFTVKLPILEESRGAALRLRSVTEEQGSRGAGDNNLHFFSQSPAPNPQSPVPNPLSGLRVLVVDDEADVRQWITAVLEECGAEVSAFSSTGQALEALEKLHPDVLISDIGMPGEDGYALMRKIRKLEPELGGRIPAIALTGYARVEDYKEALAAGFQLHVAKPVRAAELIAVVASL

SEQ ID NO: 20018 - protein, 695 aa, Nostoc punctiforme
AFGSPGIDPQWTHANKDGVGTAYSTSSRVWFTVWNGVVTEIYHPTVDRPQVRDLQYLISDGKSFFHEEKRHLESKVEPMWIHGLGYRITNSDPQGRYAVIKEVIADPHLSCILQHTKLTGDSDFISQLQLYALCAPHLEVGGRGNNGYAVQVAGHRILTAEKAGTWLALSATVPFTRLSCGYVGQSDGWTDLADNFRMDWEFDSAVDGNLALTGKLNLNGSKEFTLGLAFGTTLHNAISTLFQSLNIPFEKQKQQYNEQWKRSRDGIHSLENASYDDGKLYHNSVSLLLAHEDKSYPGALIASMAIPWGEAKDDQDQGGYHLVWTRDLVSSVTGLVAAGETDTAVRSLIYLATSQQEDGGFAQNFWVDGEPYWKGIQLDEVAFPILLAWILHQEKVPLHFDIYPMILRAAGYLIRHGPATQQERWEENSGYSPSTLASNIAALICAAQFVRESGDEATAQFIEEYADFLESHIEAWTVTTEGTLVPGIKRHYIRITPTNINNPQPNENPNQGTLLIASQPPGEPAEFPAKEIVDGGFLQLVRYGIRKPDDPIIVDSVKVIDAILKVDTPVGPCWHRYNHDCYGQQEDGSPYIGYGKGHAWPLLTGERGHYELAAGGDVKTYIKVVEGFASNTCLLPEQVWDEADRPDIHQYLGKPTGSAMPLMWAHAEYIKLLRSNHDGQVFDFIPEVANRYLGE

SEQ ID NO: 20019 - protein, 341 aa, Nostoc punctiforme
  unsure (1)..(341): unsure at all Xaa locations
SSYREKNICKLSQPHSQYCDLTVVRKLSGVAEAIALSSDAHTLVGGGGKSFTVWHLPSQQPQLTLKGHANDIYDLALSADGQTLVSGSLDKTIKVWNLATGKLKFTLKGHSEVVNALAIAPNQQTIVSASSDKTIKMWNLATGQLTSTLAQTPDAVITLVLSSDGKTLVSGDSSNHITVWDLVTGRKRTTLTGHYGVVSALAISRDGQLLASGSAKQVKVWNLTTGKLLQDFGGFYFPQITIAFSPNGQSLIAGGGYKPYRVWNLATGNMEATLPDVSNWSGAMVFSRDGKTLFSGTQDGITVWKFSAPSHPXKNVXKVMRVLRLSYSSGFKTSSFXKTEM

SEQ ID NO: 20020 - protein, 216 aa, Nostoc punctiforme
KQLENKVVIVTGAGKGIGRAIALAFAVEGAHIVIADKSEELASLSADAIKAIGGKAIALITDVTQEQSVADMVEQTLVSFGKIDILVANAGIQRRYFVADLPLAEFQAILDVNLLGVFLTSKAVLPTFYSRQEGNIILIASDSGKHGYSYNAAYCASKFAVVGFMEALADEAKHYQVRVNALCLAGVKTDMGKELKETDGNCVNDTYFMEPEEVAD

SEQ ID NO: 20021 - protein, 78 aa, Nostoc punctiforme
  unsure (1)..(78): unsure at all Xaa locations
MTTEQELQSLFNTLDSDRDGKVSINDLFLSPGLSAIISSETNTTSPQELLVNYDSDKDGSITFEELKGAVEKANNLNX

SEQ ID NO: 20022 - protein, 978 aa, Nostoc punctiforme
MTNTTVDIQEFIADLFPFNYLSPNVLENLLNKVQFCRYRIGQVIVAREAMPDRISIIYQGQARLLAYNSQGQNPATLKLLSSGEVLGWVSHVRGIACETAIASTEVITFNLAIADFLALIQQEKAFAEALHNTASLIEVYELLMEELNRRADGSRNLVKLARTATQAAVIQTFPTRKISLQQLDSELLWLVSSSSSAYFPVGSRLKLDDINPKLKFNASMRLVGLPKSILGENLAPPTSKTLLPAEIPYASEITVTEEPAAKGKQKKFPYIKGRGPLDGSLACFQMLSQYFNISWRKDTLRRVLTKQQEQKGTISLQFCAAAAELMGLTTQMVKVPATAVGRLQLPVMISWQDSFAIIYKNSDRELLIAVPEMGLLRYKLRDFAENWGAEGEVLLLQTTKNTPKARFSLSWFVPSLRRYRKVLIEVLIASIVIQLFGLVNPLATQVIIDKVLVGNSPDTLEVFGIFLLVVAVIEAILTSVRTHLFTDTTNRIDLTLGSEVINHLLRLPLSYFERRPVGELATRIHELENIRSFLTGTALTVVMDAVFSVVYIVVMAIYSPVLTLVALATVPLFGLLNLMVSPLMRRQLQEKAECNAETQSYLVEVMGGMQTIKAQNLEMRSRWQWQERYARYISAGFKTVSTQTTASSISSFLNKFSSMLVLWVGAFLVLNQHLTLGQLIAFRILAGYVTSPLLRLMQLWQNFQETALSLQRLADILDTPQETEIGNSQNILMPSIQGSVRFENLSFSFSENGPMQLCNINLDFPAGSFVGIVGQSGSGKSTLLKLLPRLYEPKSGKILIDGYDISKVELYSLRRQIGMVLQDTLLFDGTIRENISLGYPDASDEEIITAAKVAFAHDFIMSLPSGYNTRVGERGSGLSGGQRQRVAIARTVLQNPQLLILDEATSALDYNAEAQVCGNLARTFQDKTVFFITHRLSTIRNADVILMMDRGAVVEQGTHEELMALKGYYYCLYQQQEA

SEQ ID NO: 20023 - protein, 641 aa, Nostoc punctiforme
INFTLQAIAEFMGAECSCIFEYHEPQQQFHIAHEWYNPSSILNNTTSSEPLPWFYNQILNGNPIQGLQASRIANILPEANVETELTYREIIKSVVAVPMIYAGRVVGLLELDTVNKSKTWNQEEINLLQLVSELIAIGRSRHKAEEALRIAKETAETANRSKSAFLANMSHELRTPLNAILGFAQLMERDTTLNKRQRDSLATINRSGEHLLNLINDVLEMSKIEAGRIVLNPTSFDLHRLLQEMQQMFQVRAKDKKLSLSFELAPNLHQYILTDESKLRQVLINLLGNAIKFTNTGGVTLRVSLGIGEQGSRGEVALSLSPLPLCPSAPLPLVPNSQSLISFKIEDTGLGIPTEELDNLFQPFVQTASARQVMEGTGLGLTISRQFVQLMGGDIRVHSVVGSGSTFYFDIKIELADSLDIAPPTLKRRVIALTPGQPVYRILIVDDREDNCDLLTQLFNSIGFETQAAANGQEAIALWQTWEPHLIFMDMRMPVMDGYEATKQIRATLKGQATVIIALTASAFDEERFVVLSAGCNDFVRKPFREEVILNIISKYLGVRYVYEQEPLQQDQLAKNPNLKLLSLEEILAQMPTEWVTQLHQAALCTDEKLIFSLLEQIPEESALLANTLSDWINNFRIDKV

SEQ ID NO: 20024 - protein, 402 aa, Nostoc punctiforme
AYQASLKLGITKGADRSRAVLAMAQALERSFDDILEANTLDLEASREMAVPELILDWLKLTPTRLEMTVDVLQRLGELSDPLRRVRTADYQLEDSQSYTQLMPLGVIGFIYEAFPDLGAIAAGFCIKTGNSIILKGSTEASHSNAAIAEALQNAIAEVGLPLGCVELITAEHGASIRDLVTQDQYVNLVIPYGRSSLVQQVVRQSTCPVLKSAMGNCYLYWSLNSSLEMVRWMILDSHQSEPDQVNAIEKVLIHRQALPSSLAVLWNSLMEKGFEIRGDAELVQAFPQLQLVKEGEWGNPYLTKTVAFKLVDSLESAIAWINEHSSGHADSIVTESYQESRQFALGVNSASTYINTSPRFSRNPSRGDSVFLGMSNQKGHRRGFISLETLTTVKHIVQGNGR

SEQ ID NO: 20025 - protein, 287 aa, Nostoc punctiforme
SVAITPDGQTAVSASSDNTLKLWTLKLWTLKLWNVETRRETFTLRGHRGLVNAVAITPDGKKAVSVSNNLKLWNLKTGWQISTLTGHKDSINAVAITPDGQKAVSASSDTNLKLWDLETGKAISTLRGHTDSVNAVAIIPDRQTAVSGSADTTLKLWDLQTGNVISTLSGHKDSVTAVAITPDGKKAVSGSADTTLKLWDLQTGKAISTLSGHKDSVTAVAITPDGKKAVSGSADTTLKLWDLQTEKAISTLSGHKDSVTAVAITPDGQKAVSSSTDTTLKLWDLET

SEQ ID NO: 20026 - protein, 556 aa, Nostoc punctiforme
MANLTDFKLFAPRNKGAALIGSFSDWKEIPMSKSEDGYFRTKIKLEDGVYQYKFRIQTKSPNFAPDEWIDVIDPKATEVNETEKYGIVRIQDGQRIVDSYFWQHDEMPLPDNRELVIYEMHVADFTGDEVDSNERGKYLGIIAKLDYLCELGINAIELMPVNEYPGDYSWGYKVRHFFATESSYGSTEDLKRLIDECHGRGIRVFMDGIYNHTDEECPLILIDRNYWYYEHKHYPEDPANYWGPEFNYDFYDKNLNIQPAWEYIGDVVRFWIQEYHIDGIRFDAVRQLANFEFLNWLTKQAKNHAAPKQFYNIAEHIPDTNTVVKPDGPLDACWHESFRYFLVPYICGKSFELEQLKQILDPKQQGYAIATNVINYLATHDRERLLRELGNCGIFDAAAFERAKLAAVLLMTAMGIPMLWMAEEFGEYQQKSEDVTKPQKITWSLLLDDQNYDLFEYYQKLITLRQQTPALQSDNIKFFYENADDKVLAYSRWDEQNSHVVVVVNFSDRSLNQYKISDFPTTEDWRDWVGNREVKSGEDGLVTDLPSYTAKIFVLQ

SEQ ID NO: 20027 - protein, 276 aa, Nostoc punctiforme
KILVTGATGNVGQEVLRLLQSHDCNVCAAVRNPNSAQHLLGSNIQTIPFDFTNPDTFDYAFFQVNKLFLVRPPALANIRKQIAPALNAAKLAGVEHIVFLSILGAERNPFVPHSQIERYINQLGIKATFLRCSFFMQNLNTTHREDIKVRGELLLPAGNGKTSFIDVRDIAAVAVRTLLEDEHQGRAYSLTGAEALTYYEVANIFTSILGKPIRYNPSLLKFIRQMRLSGLPIDFILVMLVIYTTARLGLAGNITSDTEQLLNRSPLTIRQYVEDY

SEQ ID NO: 20028 - protein, 559 aa, Nostoc punctiforme
YLVQQFINGDNLLKELQQRKGYNARDIQSILLDLLPILKFIHDRKVIHRDIKPENIIRHKSDGRLSLIDFGSSKQFTAKVQHKSGTSIGSHGYSPLEQIRDGKAFPASDLFGLGATCFHLLTGTSPFQLWMESGYAWVSNWREYLRSPLNTELDFVIDKLLKKDIHERYQSADEVLKDLTPKQLLALPPAGKSSGKIPATQAPSLPKSYPLLRTLILVSAFILLFGFQESWYKNFRRIQTSLVSRLSQHNNSGKDDVLLGQPPKITLGKVSLANTLQGHENSVLSVAISPDGKTIASSGGDGIIKLWNLSIGKEISSLNAYSQQVNTVVISPDGKTLVSASDDSTIKIWNLATGKQIRTLTGHSDSVRALAISADSETLVSGSDDNTIKIWDLATGEQIRTLVGHTFWVRSVAISPDSVILASGSFDKTIKIWNLTKGYSIRTLEGNYQTVTAVAISPDGKILASASRDRTIKLWDLLTGKEIRTLAGHANTVTTVAFSADGKIIASGSRDRAIKLWNSATGEEILTLTGHTNTVTSVAFSPDSKTLVSGSEDNTIKIW

SEQ ID NO: 20029 - protein, 402 aa, Nostoc punctiforme
ITRNIRRTLDLDIIWQQTVDSLGKALRLERCIICPYQPSSSKVKVKAEYRQPELRSMLGLEIDVASEPAFAQALTTLEPVVMEVPGCTESGRQKTLVVATCYQDQANGLVALNWQDECYTLTESELELAKEAADQLGTAIAHATLYEELEVARQKAEEASRLKSEFLANVSHEIRTPLNGMIGFLKLILEGMADDPEEQNQFLAEAHNLSIHLLNIINDILDIAKIEAGKMELTYAPVKLNELFSDVESFMRPQAEMRNLSFRMQMPATSDEIIVQSNYQRLLQVMLNLLGNAIKFTHEGGVTVSADLVLKKSKLQDQQFPGLVRVRVADTGIGVSLDKQDKLFQLFSQVDGSRTRQYGGTGLGLAISQKLVEAMGGEVHFYSLGEGLGSTVTFTVPLYQQP

SEQ ID NO: 20030 - protein, 398 aa, Nostoc punctiforme
  unsure (1)..(398): unsure at all Xaa locations
VXQMKILVLSWEFPPRIVGGIARHVAELYPELVKLGHEVHLITAEFGHASMYEVVEGVKVHRVPVAHSNDFFHWVVNLNLSMGDHGGKLILEEGPFDLIHAHDWLVGDAAIALKHSFKIPLIATIHATEYGRYNGIHTEIQGYINGKETLLAYNAWRIIVCSDYMRQEVERALHSPWDKIDVIYNGIRAEKKQHHVDFHALDFRRQFATDNEKIVYYLGRMTYEKGVPVLLNAAPKILSEMGGNVKFVIVGGGNTDHLKRQTWDLGIWHHCYFTGFLSDDYLDKFQTVADCAVFPSLYEPFGIVALESFASRVPVVVSDTGGFPEVVQHTKTGIVTWVNNSDSLAWGILEVLKNPGYRQWLVDNAYEDLKRRFSWPKLARQTQEVYQRVVQERSQISW

SEQ ID NO: 20031 - protein, 322 aa, Nostoc punctiforme
ITKPKIFIDGESGTTGLQIYSRLNQRDDIELVSIEASKRKDASERAKLINTVDVVILCLPDDAAREAVSLVSSTTVKILDASSAHRTANGWVYGFPELNPGQREKIASAQYVSNPGCYPTGFLACIRPLIAKGLFKSNFPITVNAVSGYSGGGKNLIKQYHTFHEQQAGGESLYPFGIYGLQFGHKHVKEMHYYSGLASPPLFVPSVGDFEQGMLVQVPLPLGTLDNPPSGEVIYEAIADYYQGEKFVQVAPFQDSTLLRDGIFLDAIAVNGTNIVQVFVFANDTTKEALLVARLDNLGKGASGAAIQNLNIMLGFPEELGL

SEQ ID NO: 20032 - protein, 453 aa, Nostoc punctiforme
TTPSSGYILSLDLGTTGNRAFVFNADGKIVGQAYKELTQYYPQPGWLEHDAQQIWQDTCWVIETAIENARIAPSTIAALGLTVQRETCLIWDKTTGRPLHRAIVWQDRRTAPLCHQLQEQGYADEIYDRTGLIIDAYFSATKLRWLLDKFTDVNLNNVLAGTIDTWVLWNLTGGKVHATDHSNASRTMLMNLKTCEWDDNLLNLFQIPAHILPKIQPSLGVFGVTDATLLGAEIPITAILGDQQAALFGHGCDRPGLMKCTYGTGSFLVAHTGNRIVRSHHQLISTVAWTQANPRGALDVGYALEGSMFTSGACIQWLRDRLKLIKTAAESETMANQVTDNGGVYFVPAFSGLGAPYWDMSARGAFFGITASVQPEHLVRAVLEAIAYQVVEVVQAINSSSSTPVGRLTVDGGACENNFLMQFQADVLGIPVERPIMRDTTVQGAAFAAGLAI

SEQ ID NO: 20033 - protein, 587 aa, Nostoc punctiforme
SSSSSTSLNYGELIKKAKAGEVQKVELDETEQVARVYLKGQKENTPPQQVRLLAQNTELINILKDKNVEFGEISSANSRAAVGLLINLMWILPLLALMLLFLRRSTNASSQAMNFGKSKARFQMEAKTGVKFEDVAGVEEAKEDLEEVVTFLKQPERFTAVGARIPKGVLLIGPPGTGKTLLAKAIAGEAGVPFFSISGSEFVEMFVGVGASRVRDLFKKAKENAPCLIFIDEIDAVGRQRGAGIGGGNDEREQTLNQLLTEMDGFEGNTGIIIIAATNRPDVLDAALLRPGRFDRQVMVDAPDLKGRLEILKVHARNKKIDPSVSLEAIARRTPGFTGADLANLLNEAAILTARRRKEAVTILEIDAAVDRVVAGMEGTALVDSKSKRLIAYHEVGHALVGTLLKDHDPVQKVTLIPRGQALGLTWFTPNEEQGLVSRSQLKSRITATLGGRAAEEIVFGKPEVTTGASNDLQQVTGMARQMVTRFGMSELGPLSLENQSGEVFLGRDWMNKSDYSEEIAAKIDSQVREIVNNSYIKAKELLEENRIVLERLVDLLIEEETIEGDSFRQIVADNAQIADAQLAVPH

SEQ ID NO: 20034 - protein, 605 aa, Nostoc punctiforme
VLPKRASGGFALLDSLHRHGVDYIFGYPGGAILPIYDDLYKVEATGAIKHILVRHEQGAAHAADGYARATGKVGVCFGTSGPGATNLVTGIATAYMDSIPMIVVTGQVARPSIGTDAFQETDIYGITLPIVKHSYVVRDPKDMARIVAEAFHIASTGRPGPVLIDVPKDVALEEFDYVPVKPGSVKLRGYRPTVKGNPRQINAAIQLITESRRPLLYIGGGAIAAGAHEEIKELAELFNIPVTTTLMGIGAFDEHHPLALGMLGMHGTAYANFAVSDCDLLICVGARFDDRVTGKLDEFASRAKVIHIDIDPAEVGKNRIPEVPIVGDVRNVLVDLLRRCKETGVKATPNQNQEWLNLVNRWRDEYPLIVPQHPDSISPQEVIVEVNSQAPNAFYTTDVGQHQMWAAQFLKNGPRRWISSAGLGTMGFGLPAAMGAKVAFPDEEVICISGDASFQMCLQELGTLAQYGINVKTIIINNGWQGMVRQWQQAFYGERYSCSNMEVGMPDVELLAKAYGIKGMVISDRSQLKDAIAEMLAHKGPVILNVHVTRDENCYPMVAPGKSNAQMVGLQKQPPKAAAEPVYCSNCNAKNAPNHNFCAECGTKL

SEQ ID NO: 20035 - protein, 230 aa, Nostoc punctiforme
LKAVLFDFNGVIINDEPIHLQLIDEILIEENLQPQKVSERQASLGRSDRACFQQLLANRGRVANENYLTQLLYRKAQAYTVELEKIEKLPLYPGVEDLIYQVRSRNLKLGLVSGALRQEIELVLHRAKLDQHFKIIVAGDDITTSKPEPDGYLLAVKCLNKEYPELNLQPQECLAIEDTPAGIAAAKRSQMQVVGVANTYPFHMLQRCCNWTVDYLSDLELERVQKIYSQ

SEQ ID NO: 20036 - protein, 424 aa, Nostoc punctiforme
RFETLQVHAGQEPAPGNNARAVPIYQTTSYVFDDTEHGARLFALQEFGNIYTRIMNPTTDVFEKRIAALEGGVAALATASGQAAQFLAISTIAQAGDNIVSTSFLYGGTYNQFKVSLPRLGINVKFVEGDDPESFRQAIDARTKALYVETIGNPQYNIPDFAALAHIAHENGIPLIVDNTFGAGGYLARPIEHGADIVVESATKWIGGHGTSIGGVIVDSGKFDWGNGKFPLFTEPAPGYHGLNFQEVFGPSGSFGNIAFIIRARVEGLRDFGPSLSPFNAFLLLQGLETLSLRVDRHVSNALELARWLEQQEQVLWVNYPGLPNHSYHERAKKYLRHGFGGVLNFGIKGGLEAGKAFINHVKLASHLANVGDAKTLVIHPASTTHQQLSDEEQLSAGVTPDLVRVSVGIEHIDDIKEDFQQAF

SEQ ID NO: 20037 - protein, 249 aa, Nostoc punctiforme
ESIEFEKRCLHKAREIGDRNSEVICLASLGNAYQSIGEYHLAIEFYQQWLDIAKEIGDRFGEAKSLSGLGNAYQSLGKYQRAIEFYHQWLSITRKIGDRTGEAICLGSLGNTYEYLGKYDQAIEFYQQWLSITRKTGDRTGEAICLGSLGNTYESLGQYQLAVEFYHQWLELTRLISDRNGEGMALSGLGSAYKALGQYQRAVEFHQYSLEIRKNLDDQNAEANSWFNLGLVLEKINRESEAMNAFCNA

SEQ ID NO: 20038 - protein, 491 aa, Nostoc punctiforme
RRSESTVNRPYVKFHKSSRIPIFMNKAGNHLQQRYLEAFTTRYNERTKKSKQLAQTYRPIITSNMGPVGFSLSCKEMCYPITAKRSLGSRIWDVDGNEYIDFMMGLGVNLFGHNPPFIQAALKEQLEKGIQIGPQSELTGEVGELICELTGMERVAFSNTGTEAVMAAIRLARTATGRNKIVLFSGSYHGHFDGTLVEVETIDGIPHTVPITSGIPQNIVEDYLVLDYGNPQSLDAIRANKHELAAVLVEPVQSRRPDLQPKDFLLQLRQLTKELGIALIFDEVITGFRVHPGGAQAWFGVEADIATYGKIVGGGMPIGIIAGKATYMDRIDGGMWNYGDASQPQVETTYFAGTFRRHPLAMAAALAVLKHLKMQGSQLQQQLNQRMSQLVETLNAYFEEEEVPLRLRNFSSWFSPAFLENFSLLEYATPSELRELLYYHLLDKGVMLGGPGGYLSTAHTDEDINYIIQAFKDSVRELRKGGFLPPIAPQN

SEQ ID NO: 20039 - protein, 282 aa, Nostoc punctiforme
EIQTVGVVGAGVMGIGVSQNLAQTGHQVILVDVSEDILNHAKQEIRNNVRFQGFFQKNSEAESPDDILNKIKFSTNYKFLEDAEFVVENVTEKWDLKKEVYAQLDAICPEKTAFAANTSAISITRIASVTKRATRVVGMHFMNPVPMKPMVEMIRGHHTSDETIETAKKMLAQMGKECIIVNDSPGFVSNRVLMLTINEAIFILQDQVASIEEVDKIFKTCFGHKMGPLETADLIGLDTILFSIEVLYESFNDSKYRPCPLLKKMVDAGLHGRKSGKGFYAY

SEQ ID NO: 20040 - protein, 369 aa, Nostoc punctiforme
MKLELTPQQKNAQAEFREFVDAEVVSQANQYDQQEYTPSDLVQKFAQKRYLGAVLPKEFGGEAMDMITYGLLNEEIGRGCSSLRSLLTVHCMVSHALCKWGNKSQKNDWLPKLASGEIIAAFALSEPNVGSDAKSVETTATLSGDAYILNGHKKWITYGQIADVFLVFAQCEGKPSAFLVEKNSPGLSIKPIFGMLGVRASMLAELHLNDCRIPQENLVGRLGFGFSYVASSALDYGRYSVAWGSVGIAQACLSACIRYTSDRKQFGVYLKEHQLIRQMITNMIANIKAARLLCYQAGYLKEIGDPSSIIETSIAKYFTSTIASQVASDAVQIHGGNGCSSEYPVERYLRDAKIMEIIEGSTQIQQVTI

SEQ ID NO: 20041 - protein, 363 aa, Nostoc punctiforme
LRGYAGDRINSRLIDERRCIPPYIVLDFGNRGLLGMQIPEEYGGLALSYRDTFRVFEQLAAIDLTLASFVAVHHVLGTRPILNYAPENVRQEILPLLAGGRELAGFAITEQTAGSNPRAIATRAIPDAGGWRIRGEKIWIGHGSWAGVTNVFAQTLDANNQPTGISSFIIRQGTPGFSQGPEALTMGVRGMVQNTIYLKDVLVTPENLLGTLNNGMEVAQDAMMHGRLIIGVMSLGGMKRCAQLMLRYSSRRSVSTGRLLNNPISLVWLSDLTAAITSLETLLFKIADLLDQGRAIPQEAFTACKTAGPELVWQAADRLVQMLGGRGYIETNIAPQILRDARLFRIFEGPTETLNMFLGSRAM

SEQ ID NO: 20042 - protein, 571 aa, Nostoc punctiforme
LVELLLTRAKEQPSRIAYTFLLDGEDESQSIQISYQELDRQARAIAIHLQSIMNAGDVYDGQSPRALMLYPAGLDFITAFFGCLYAGIVPIPAYPPRQNHKLSRLEAIVLDAEAKIVLTTSGVMANLKDIGKYSSALAEIEWLPTNDLILGDGSSWVRPEINGETLAFLQYTSGSTGTPKGVMVTHDNLLRNSADLDLGWDHDENSVIVTWLPTFHDMGLIYGMLQPLYKGCTCYMMAPVSFLQKPIRWLQAISRYRGTHSGAPNFAYKLCAEKITPEQRAKLDLSSWRMALNGAEPVRADVLEEFVEAFKPSGFDGRAFCPGYGLAEATLKVSAVRSKDLPVYLHVDAEALEQHRVVEVSANHPRCRQFVGCGWTEIDTQIVIVNPETLTQRGDDEVGEIWASGSTIPLGYWNRPEATAETFQAYLKDTKAGPYLRTGDLGFVHNGELFVTGRIKDVIIIRGRNHYPQDIELTVEKSHPALRPTCTAAFTVEIEGEERLIVAQEIERLHLRKLDVEEVVGAIRRAVSQQHELQLYAVILLKTATIPKTSSGKIQRRTCRAKFVENALEVV

SEQ ID NO: 20043 - protein, 296 aa, Nostoc punctiforme
IAGLGTFLPGKPVENKQLAEIFNINKDWIEVFIGSKRRYFAVDLVTQETTHTLAEICAHAAKEAIQNSGYSIQDIEFIVMATGTPDFLMPATVNLVAEKLGINLVPTYQLQSGCSGAVQCLDVAQQFLLSGSYKVGLVIGGDICSRFADFNRDFNNMPSGELVNYVLFGDGAGAAVLTSEENKTGFTIEYVLNQLTGLDKEPGQILNWFAVPPAGDTKLPQAVKEDYKAIEKAVPVLAKEILESLMDAVEWELHDIDFILPPQLSGNMSKRIVEFMDIPVEKAVHCVTETGNVANA

SEQ ID NO: 20044 - protein, 279 aa, Nostoc punctiforme
HRWVLAPDESSLMLQERAAREALDAAKLTLKEIDLMLVASVWPEQIGFGDAAFLAGKLGLEGAAWNLDAACGVTPVALQTAFALVRAGEYRNVLVVISCAYSRFFDEDDTLSWFMSDGAGACVVSSLAPNQGILGTKTIHTAALCNSFFAKLTEDDQGNPHIHMRMGKGANKAIRETAVGQLRTCCEGALAAANVKLEEIDFFIFNTSTAWSASFCTRVLGIDPERTINLYSEYANIGPVITIANLYYAAQLGKIHENDLVLIYGLGAAGAASASVMRW

SEQ ID NO: 20045 - protein, 253 aa, Nostoc punctiforme
  unsure (1)..(253): unsure at all Xaa locations
MRMSSQLYGKVALVTGASSGIGKATAIAFARAGAKVVAASRRTTEGEETAHYIQEIGGEAIFIKTDVSKAADVETLIEKTIDIYGRLDCACNNAGLGGAASPIADMSEKDWDQLVDVNLKGTWLCLKYQIRAMLKQGSGAIVNIASAAGVVGFPGFTGYCATKGGVIALSRAAAMEYAKAGIRINVVSPGAIATDMLATLPTDVLAQLTAMHPIGRIAKPEEVAESVVWLCSDGSSFLVGHNMMVDGGYTAQX

SEQ ID NO: 20046 - protein, 447 aa, Nostoc punctiforme
QKTNETFLVFDLGGGTFDVSILEVGDGVFEVKATSGDTHLGGDDFDKRIVDWLATEFQRNEGIDLRKDKQALQRLTEAAEKAKIELSSATQTNINLPFITATPEGPKHLDMTLTRVQFEQMCADLFDRSRIPVEQALRDAKLSPADIDEVILVGGATRMPAVQQLVRQIIGKDPHQGVNPDEVVAVGAAIQAGVLGGEVKDVLLLDVTPLSLGVETLGGVTTKIIPRNTTVPVKKSEVFSTAADAQTNVEIHVLQGEREMASDNKSLGTFRLDGIPPAPRGMPQIEVTFDIDANGILSATAREKATGKEQSISITGASTLDKSEVERMVKEAERNAEEDRRRREQIDTKNMADSVAYQAEKQLQDLGDKVPPADKSRVESLIRDLRQAIEQNNIDRMKSLTNEIQQGLMQIGTAVYSQAGASPNGGTSTDRQGGGEDVIDADFVEQK

SEQ ID NO: 20047 - protein, 881 aa, Nostoc punctiforme
SQLRGTIMQPTNPEQFTEKAWEALVRTPEIAKQFQHQQIESEHLMLALLEQEGLASSIFNKAGVNVQKLHERTIDFINRQPKVSGASSGSVYIGHSLERLLDRAEQYRKEFGDEYISIEHLILAFAKDDRFGKGLFQEFGLDEKKLRNIIQQIRGSQKVTDQNPEVKYEALEKYGRDLTQLAHEGILDPVIGRDEEIRRTIQILSRRTKNNPVLIGEPGVGKTAIVEGLAQRIVSGDVPESLRVGIAGRRHRKLIALDMGALIAGAKYRGEFEERLKAVLKEIQEAQGQIVLFIDEIHTVVGAGATQGSMDASNLLKPMLARGELRCIGATTLDEYRKYIEKDAALERRFQQVYVDQPSVEDTISILRGLKERYELHHGVKISDSALVAAATLSARYISDRFLPDKAIDLVDEAAAKLKMEITSKPEELDEIDRKILQLEMERLSLQKETDSASRERLERLERELAELKERQDALNAQWQAEKQIIDRIRQIRQEIERVNVEIQQAERDYDLNRAAELKYSKLTELQRQLKEAEARLAQIQTSGKSLLREEVTEADIAEIISKWTGIPVSRLVESEMQKLLHLEEELHKRVIGQDEAVRAVADAIQRSRAGLADPNRPIASFIFLGPTGVGKTELAKALAEYLFDTEDALVRIDMSEYMEKHAVARLIGAPPGYVGYEEGGQLTEAIRRRPYSVILFDEIEKAHPDVFNVLLQILDDGRLTDSQGRTVDFKNTIAIMTSNIGSIYILDVAGDDSKYEQMRDRVMEAVRESFRPEFLNRIDEIIIFHSLRKDELREIVKLQVQRLEERLRERKLSLKISDQALDWIVQVGYDPVYGARPLKRAIQRELETPIAKAILRGEFHEGDTIYVHVEHERLVLKRLS

SEQ ID NO: 20048 - protein, 494 aa, Nostoc punctiforme
DIVVIGSGIGGLSCAALLARYGFDVIVCESHSIAGGAAHGFERNGFKFDSGPSLYSGLSYSPSANPLRQVLDAIGSELPCVTYDTWGCCLPEGDFDTAVGAEQFCEVLMKFCGDDAVAEWQELQRVMEPFARAATSIPPAALRFDFGAARTVGPFVPSLTKNVANIIKLTGPFSRIMDGVVKDSFTRNWLNLLCFLLSGLPADGTSAAEVAFMFADWYRPDAILEYPIGGSSALVDSLVQGLERHGGKLMLGAHVEEVLVEGNRAVGVRLRDRSEIRAKLAVISNASVWDTLKLLPEKAIPKQYRSKRQATPECDSFMHLHLGIDAQGLQSNLRCHYIVVNNWELGVTAPQNVVVISIPSVLDPSLAPAGKHVIHVYTPGNEPYSFWQGMDRRSQEYAEQKRSRAEVMWQALERIIPDIRSRCEVTLVGTPLTHERYLRRHQGSYGPAIQAGSGMFPSPSTPLPGLMCCGDSTFPGIGLPAVAASGLIAANTLA

SEQ ID NO: 20049 - protein, 477 aa, Nostoc punctiforme
EPNVSQGFDYDLVIIGAGVGGHGAALHAVSCGLKTAIIEAGDMGGTCVNRGCIPSKALLAASGRVRELRNAHHLKSLGIQIGSVEFDRQAIANHANNLVSKIQGDLTNSLKRLGVDIIRGWGKIAGAQKVAVTGDGAEKIITAKDIILSPGSIPFVPPGIEVDGKTVFTSDQGVKLESLPDWVAIIGSGYIGLEFSDVYSALGCEITLIEALDQLMPGFDRDIAKLAERVLITPRDIETKVGIYAKKVTPGSPVVIELANFKTKEDVDVIEVDACLVATGRIPATKNLGLESVGIELDRRNFIPVDDRMAVLSAGEVVPNVWAIGDANGKMMLAHAASAQGIIAVENIVGRERIVDYRSIPAAAFTHPEVSYVGLTETAAKELGQTEGFEIATSRSYFKGNSKALAENEADGIAKVIYRKDTGEVLGVHIFGLHASDLIHEASAAIANRQSVQSLAHLVHAHPTLSEVLDEAYKRAI

SEQ ID NO: 20050 - protein, 410 aa, Nostoc punctiforme
FDQACSYLEAAAKELNLNQGLLEILSHPRKVVTVSIPVKLDDGEIQVLAGHRVQHSDVLGPYKGGIRYHPAVTLREVSALAMLMTWKCALLGIPYGGGKGGIPIDPKRYSVGELERISRRYISELLKDIGPSVDIPAPDMGTSAREMAWMMDTYSVNVGHAVPGVVTGKPLSIGGSLGREMATGRGTMIIVREALADRGKSLVGVRVAIQGFGNVGGAAAELLHQAGAKIIAVSTGAGGIFSEAGLDIPALKIYAAENRKSIVGFPQSVPISNADLLTLPCDVLIPAALENQITGENVNQVQAQIVAEAANGPVTLEANLALEARGVTVLPDILANAGGVVVSYLEWVQGLSYVFWDEERVNREMEHLMVQAYRKVIQQSNKRQISLRLAAYTLGVGRVAQALTDRGLYP

SEQ ID NO: 20051 - protein, 380 aa, Nostoc punctiforme
VLVTGIGLVSALGGSLEDSWKNLIAGKSGIRLHQPFPEIKPLPLGLIAQQPSELAMLTQMVVTSALQDAGLVPPLADCAVVIGSSRSYQASWEMWRGKCIKIQKTCPFLILEIWLDILPHINAIATARQIGATGMVLAPMAACATGIWSIAQAALLIQTGQCQQAIAGAVEAPITPLTLAGFQQMGALAKTGAYPFDLQREGLVLGEGAAVFVLESAELAKQRQAKVYGEILGFGLTNDAYHSNSPEPEGKSAIAAIKQCLERSCLSPADIDYIHAHGTATQLNDQMESMVIQRLFPQGVAVSSTKGSTGHTLGASGALGVAFSLMALKHQILPPCVGLQQPEFDLEIVTAARLSKIRQVLCLSFGFGGQNVAIALAKSP

SEQ ID NO: 20052 - protein, 402 aa, Nostoc punctiforme
RKSAELKILQAKEAAEVANHAKSEFLANMNHELRTPLNGILGYAQILQRDPATTSKQQKGLSVIHQCGSHLLTLINDILDLSKLEVQKMDLYPQDFHFANFLTTTVEICRIKAEQKGIAFRYHPANLPTAVHADDKRLRQVLLNLLSNAIKFTDFGSVKFTVEAISNEETADTRSTRIRFLVEDTGIGIPTEKWQTIFLPFEQAGKRDRNSEGTGLGLAISQQIVQMMGSSIQVNSTPGKGSKFWFEVDILAAADWLAQPASSNLKVIGYQGERRKILVIDDRLENRAVVMGMLAPLGFKLAQADDGQTGLDLALQMRPDLIITDVMMSKMNGLEMTRRLRQLSDFAVTPIIASPASLSQVDIQEALDAGCSSFFPKPLEFIGLLGELQRHLELQWIYETAP

SEQ ID NO: 20053 - protein, 358 aa, Nostoc punctiforme
TRIMKKLINKPEDFVRESLEGMAAAHSDLIKVNYDPAFVYRANAPIPGKVAIISGGGSGHEPMHAGFVGKGMLDAACPGEVFTSPTPDQMLEAAKLVDGGSGILYIVKNYSGDVMNFEMATELARSEGIRSLNILIDDDVAVKDSLYTQGRRGVGTTILAEKICGAAAEAGYDLPQIANLCRRVNLNGRSMGIALTSCTVPANGTPTFELSDREIELGIGIHGEPGIERTAIKAVDEITEILTRSLLEDAAYSRTLREWDEDKGEWVDVELTNLPFTKGDRLLAFVNSMGGTPVSELYIVYRKLAQICEQQGLQIVRNLIGPYITSLEMQGCSITLLKLDDETIRLWDAPVKTPSWRW

SEQ ID NO: 20054 - protein, 260 aa, Nostoc punctiforme
  unsure (1)..(260): unsure at all Xaa locations
ISMLNLTGKNALVTGIANNRSIAWGIAQQLHKAGANLGITYLPDERGKMEKKVAELVXPLNPSLFLPCNVQDEEQIQFTFETIREQWGKLDILIHCLAFASKDDLSGDFSQTSRSGFSTALEISTYSLVQLSGAAKPLMTEGGSIVTLTYLGGVRAIPNYNVMGVAKAGLEMSVRYLAAELGPQNIRVNAISAGPIRTLASSAVGGILDMIHHVEEVAPLRRTVTQLEVGNTAAFLCSDLSSGITGQVLYVDAGYEIMGM

SEQ ID NO: 20055 - protein, 195 aa, Nostoc punctiforme
PRIATVHRTTGETDVQVTINLDGRGTCTAATGIPFLDHMLHQIASHGLIDIDVQAKGDLEIDDHHTNEDVGITLGQAFNQALGDRKGIVRFGNFLAPLDEALVQVALDFSGRPHLSYGLQIPTQRVGTYDTQLVREFFVALVNHSQMTLHIRQLDGINSHHIIEATFKAFARATRLAVEIDPRRAGLIPSSKGVL

SEQ ID NO: 20056 - protein, 433 aa, Nostoc punctiforme
MKISIFGLGYVGAVTAACLARDGHEVIGVDVNPEKVDLIAKGESPIVEPGLSQLLVDGVAANLITATTDTEAAVLASDVSLISVGTPPIERGEPDLTYVWNVCKQIAKASIHKTESHVVVLRSTVPPGTLEKCQNLIDSITGNNSIHLAFNPEFLREGSAIKDYDQPPYTIIGTESPVAEAAVRQMYATVDAPFTVVKPSVAEMVKYVANCWHAAKVGFANEIGRVAKAFGVDGREVMNIIVQDTKLNISPVYMRPGFAYGGSCLPKDLSALLYYARNMDVPVPLLNALPTTNSLQVDLAAQQVLRLGARKIAILGLAFKPGTDDLRESPAVLLVKRLIGEGCQIKIYDQAVYEARLMGTNLTYIQNNLPHFEELLVAEAEQALKDAELVIVTHANPEFRQILQEALKEIQVLDLASVFTEPIEELNYCGIAW

SEQ ID NO: 20057 - protein, 117 aa, Nostoc punctiforme
PAHTFNGDSSWFGGVRSLSINPSRQIIGCGSDDNTIRLWDLNNGQLLSYPFEHTKSVRSISFTPKGNGLISGGDDATIRVWDLRTSQELLTFNAHSQPVTAVAVVPIYDFVVSGSDD

SEQ ID NO: 20058 - protein, 574 aa, Nostoc punctiforme
FKGHEGSVNSASFSPDGKLIVTAGADNTARVWDFAGKQVAELIGHQGNVKSANFSPDGKLIVTASFDDTARIWDISGKQLVELKGHQGNVYSANFSPDGKAITTAGADKTVRLWDLSGKQLREFKAHNASVYSAKFSPDGKHIVTASADKTARVWDTSGKLLAELKGHTNTVWSANFSCDDKRIVTASDDKTARIWDLSGKQLAVLQGHQDSVYSANFSPDSKQIVTASIDFATLLWESSGTLLGKLQQHTGGVNSANFSPDGKWIVTASSDSTARVWDLSGKMLTELTSFQREVGSARFSSDGQHIVTKSGNIAQVWDLSNRQLVEFKGHQADIRSVRFSQNGELLVTASDDKTARIWDLSGKQLAELKGHEDFIYDARFSPNGKSIITASNDKTSRIWDLSGKQLAELKHQDYVSSATFSPDGQKILIESGSFTLSIWDIYGKFLATIKGDKFDINSGTFSPDGQRILTTSLDDTARVFDIYGKLLTEFRGHQEQVINANYSPNGQRIVTASLDGTIRVWDTSGKQLTLLKGHKGSVNSASFSPDGKVIVSAYDDKTILVWDTSGKILAQIG

SEQ ID NO: 20059 - protein, 679 aa, Nostoc punctiforme
WNSSGKLLAELKKHWGPIRSASFSSNGQQIVTASYDGTARIWDTSGKELALLNHNSFVNSASFSPNGKQIVTASDDNTARVWNSSGKLLTELKGHTQPVLSTSFSLDAKHIVTASADKTARVWDLSGKQLAELQHSAIVSSANFSSDGKQIITTSHDGSAGVWDLNNKTAVRLSHQHIVNEARFSPDEKLVITASRDGTARVWDLSGKQIVLFKHQSSVNSANFSPDGKQIITASDDKTARVWNLSGKLLLELKKSETTLNSASFSPDGKRIVTTSDDGTARLWNTSGKLLMVLKGRPDWLLDASFSPDGKQIVTASDDGTARLWNTSGKILAELKGQEKTVKSASFSPDGQKIVTVSFDAASSSGAVRLWDLSGKLLVELQGHQGQVLCANFSANGQRIVTASDDKTARVWDLSGKQIAILSHQGGVNRAIFSPDGQRIVTASDDGTAHLWDLSGKLLTQFKEHQDAIQSVSFSPNGQLVVTASWDGTARVWNLSGKQIVLFNHQREVIDTSFSPNGQYIVTASIDNTARLWDLSGTLLVEFVGYQGGIGSANFSPDGQWIINLEYDKPSLWNLSLRFPLRFPKASIYAYEDTFPNTSVEKSTALLKEYWVNIGSAKFSPDGQRIISVFSDGSTRVWDLSGRLLAFIKGHQGRVTSSNFSPDGQRILTTSNDGTARIW

SEQ ID NO: 20060 - protein, 432 aa, Nostoc punctiforme
SRRAQVSWQKLGLEGRIEALQQWKAAIVSERDRLTEALVNDTGRLSTSILEIDSFLSSIDRWCRLAPELLQDSAKNTAIPFIALQQTSVPYPLVGIISPWNFPLLLSTIDTIPALLAGCAVIVKPSEIAPRFVAPMTTALNAVPKLRDVLTFIEGAGATGSILIDNVDLVCFTGSVATGRKVAEAAAKRFIPAFLELGGKDPAIVLESANLELATSAILWGSVVNTGQSCLSIERIYVAESIFEKFYHQLVAKAHRLGLAYPTVESGEIGPIIAERQAAIISDHLLDAVEKGAVIHCGGVIEDLGGGWWCRPTVLTQVNHSMKVMTEETFGPIMPIMPFSTVEEAVSLANDSIYGLSAAVFASEAEALEIAQQIEAGAISINDAALTAIMHEGEKNAFKFSGMGGSRMGAAALKRFMRKKAILIKTNATNDP

SEQ ID NO: 20061 - protein, 426 aa, Nostoc punctiforme
VIVIGAGLAGLTAGYELTRAGFDVQVFEARERVGGRVKTVFLEEEQHGELGAEFVDDNHTALISYATQFDLKFEPAFELPDDLCYYIDGNFSTPKTLLPQQQASLNDAYQKLDRLLSQVADPAQTLAQWLTAESIDPFASKVIRQQSYGMYTADPEAIGVGFFAYSGTSGDRSLRIQGGSTQIATAFARFLGDCIHLNTPVVRIQQQEQTVAVSLKTLQGQVEVFCDWVVVTIPWSVLRHLSIEAPLTQIQREAITHLPYGTSVKTLLQYSNRFWQQSSLGLLVGDTPYQTIWESTLTQVGEAGILACTSSGTPSRNISGHSVEFAQQTISALYPNAPKAMSTTVTERSRSAGCAYATTTHNWSADPWSQGSYCYFAPRDLKSWRSDLPYSAGQVIFAGEHTAPIEYCGYMEGAIRSGQRAAEEIL

SEQ ID NO: 20062 - protein, 337 aa, Nostoc punctiforme
MELAMIGLGRMGANMAQRLMRAGHHVVGYVRRTEKLSAMVNEGVIAAGASSIADLVSKLSKPRTVWLMVPAASVDETIETLIPLLEPDDIIIDGGNSYYHDDIRRAATLKDRGIHYVDCGTSGGVWGLERGYCLMIGGEQVAIKRLDPIFATLAPGVGEIDRTPGREKAGGTAEQGYLHCGPIGAGHFVKMVHNGIEYGVMAAYAEGLNILHHANIGNNQREIDAETTPLRNPEHYQYDFNLGDIAEVWRRGSVIASWLLDLTAIALLESPNLERFGGRVSDSGEGRWSAIAAIDESVPTPVLSAALFARFSSRGEADFADKLLSAMRYQFGGHYEK

SEQ ID NO: 20063 - protein, 449 aa, Nostoc punctiforme
PDSDALVFFGATGDLAYKKIFPSLQAMVRRGNLNVPVIGVAGRPWTTDQLRERARDSLEHNGGIDRDAFEKLSGLLQYVAGDYNKPETYEKLRQALGDTTHPLYYLAIPPSLFAQVASGLGKSGCAKNARVVIEKPFGRDLKSARELNQILASVFPESSIYRIDHYLGKEPLLNLLYFRFGNSFLEPIWNRNYVESIQIVMAEDFGIQGRGRFYEETGAIRDVVENHMLQVLASVCMDAPASTAADSIRDEKARILKAIPSLQPDDIIRGQFSDYRNEEGVSPDSQVETFVAVRLFINTWRWSGVPIYIRAGKKLPVKTTEVMVKLKCPPLDVFQEGGKENANYVRFLLDPEVIVGLGARTKIPGEDMSGSAVELLAFYGGGDEMEPYERLLGDAMRGDPTLFVREDTVEEEWRIVQPILDNVTPVYEYEPNTWGPPESDKLLSPIDDW

SEQ ID NO: 20064 - protein, 307 aa, Nostoc punctiforme
GPEGVSGAGAGFQDVGDMGGFADIFESIFSGFAGGMGSPTQQRRRSGPARGDDLRLDLKLDFREAVFGGEKEIRISHLENCEVCSGSGAKPGTRPRTCSTCSGSGQVRRVTRTPFGSFTQVSTCPTCNGTGMVIEDKCDACDGKGANQVTKKLKITIPAGVDNGTRLRISSEGDAGQRGGPSGDLYVYLFVNEDEEFQRDGINILSEIKISYLQAILGCRLEVDTVDGPVELIIPAGTQPNTVMKLENRGVPRLGNPVSRGDHMLNVLIDIPNKVTPEERELLEKLAKIKGDRTGKGGLEGFLGNLF

SEQ ID NO: 20065 - protein, 273 aa, Nostoc punctiforme
VVVTGASTGIGQACALLLDQLGFSVFAGVRQNIDAQTLKQKGSPRLIPIFLDVTDAESIADAVDKVTNEVGGTGILGLVNNAGIAIPGPLELLAIAEFQHQMQVNVTGQLAVTQAFLGLLRQSRGRIINMGSIAGRSPTPFLGAYNASKFALEALTDVMRMELRPWGISVSIIEPGSIATPIWEKSLSQSEVAQYDLPQSAQNLYGQAMNIVRKKMQILASKGISADIVAQTVVHALTAKQPKTRYLVGSDAKLGAVLKHILSDKLHDQIILY

SEQ ID NO: 20066 - protein, 655 aa, Nostoc punctiforme
SEIKTLSASSEALFASQKGIDSLKEGLRAGRKLQQIVWVDSYTREQVQTALYQAVSGLREYNRLEGHLSGVNNATFSPDRSLIASASADTTIKLWLPDGSLFKTLSGHEDVVNSVSFSPDGQIIASASQDKTVKLWSREGVLLVTLLGHQGVVNSVSFSPDGQIIASASTDKTVKLWSRDGKLLKTLPGHDGAVLSVAWSTDGQTIASGSADKTVKLWSRDGKLLKTLQGHEDAVKSVAWSTDGQTIASASLDQTIKLWNLEGKLLRTLSGHSAGVTSVSFSRDGNTIASASTDETIKLWSFEGVLLGTLKGHNNWVNSVSFSPDGRTLASASRDKTIKLWHWDDVLLRKPKADNDDWITSISFSPDDRTLAAGSRDKTIKLFSREGKLLRILTGHQGQVWGVSFSPDGQAIASASKDQTVKLWGADGKLLNTLQGHNSTVLSVAWSPNSQIIASASKDQTVKLWSRDGKLLNTLQGHKDAVNWVSFSPDGKLLASASDDKTVKIWSLDGKLLYTLIGHSRRVNGVSWSPDSQVIASVSIDSTVQLWSRDGGLLNTLTGDGDSFISVSFSPDGKTLAASSDDKIRIWNREGTLLIALKGYEAELTSVSFSPDGKTLAAGSGNGTVIFQNLADIQLEKLLARGCYLLYDYLQTNQK

SEQ ID NO: 20067 - protein, 307 aa, Nostoc punctiforme
  unsure (1)..(307): unsure at all Xaa locations
CVHTLTHLNWVFTTAISPDGKTLASGSSDNTIKIWHLDTGKLLHTLTSHTKWVRCLAFSPDSQTLVSGSDDSTLMIWQVSTGKLLKTLKVHSTPVFSVIISPDGQTILSGGTDSTIKISHIEMGQLLQVLKGHSGLVYSLAICPKQQIFVSGGADNTIKLWNLKSNKLLQTLNGHSGWVMCVAISPDGKILASSSYDQTIKLWNINTGKVINTLAGHCSYVCAIAFSPVGQYLASGSADHSVKLWDVNTGQELYTLNNHSDWVNSVTFSPDSKTLASGSRDMTIKLWQCDIXTQIKNLDDFSNLLDF

SEQ ID NO: 20068 - protein, 154 aa, Nostoc punctiforme
QKATFGAGCFWGVEAAFRQVKGVTSTAVGYSGGHLDNPTYEDVCRGKTGHAEAVEVEYNPAIVSYDQLLNVFWNKHNPTASNHEELNVGYQYRSVIFFHTPEQELLVRASKEQLENSSRYHKNPIVTEILPASQFYRAEKYHQQYLEKHGRASY

SEQ ID NO: 20069 - protein, 185 aa, Nostoc punctiforme
PATDISNAAPQGKQVAVFAGGCYWGMEAVFEHLLGVSDVVSGFSGGDARTADYTLVSAGLTNHAESVKITYDPSKISYNQLLKVYFLVAHNPTELNRQGPDSGKQYRSAIFFANDEQKQAAQEYIAQLNKSRVFDKPIVTELDPLKGFYQAAAYHQNYIVHHPSDRYVVVNDLPKLAKLQAKFPD

SEQ ID NO: 20070 - protein, 252 aa, Nostoc punctiforme
WQDWRNFVVVRKVKESEEITSFYLQPEDKGEITNFQPGQFLTIKLDIPGQDKPVIRTYSLSDYPENCEYYRLSIKREPAPNGLDVMPGIASNFMHDRIQEGSVILAKPPNGKFVLDVQKSIPAVLISNGVGITPMISMAKACSLLNPTRPIWFVHGARDGKFHAFRDEVREISRQNHNLNVHFRYSRPTPEDRGKYHSVGYVDAALIQELVRQEAEYFLCGSPSFMQSIMQGLKESGVPDSRVFFESFGKPM

SEQ ID NO: 20071 - protein, 268 aa, Nostoc punctiforme
  unsure (1)..(268): unsure at all Xaa locations
FMKLEGKVALVTGSSQGIGQGIVLGLAQAGANVVINYRSHPEGAEDTLAKVEAIGGNCHIAQCPKSHGYTVQADLGSVDEVRQLIAESINHFGKLDILVNNAGIEKHAPFWDVTEADYDAVMNVNLKGVFFATQAFVQHLIETKRTGKIINISSVHEELPFPNFTAYCASKGGMKMLARNLAVELGALGITINNVAPGAIETPINTKLLNDPEKLGALLKNIPLGRLGQPQDVASLVAFLASDDADYITGSTFFVDGGLLWNYQEQXG

SEQ ID NO: 20072 - protein, 629 aa, Nostoc punctiforme
  unsure (1)..(629): unsure at all Xaa locations
MAKVVGIDLGTTNSCIAVIEGGQPLVIANAEGQRITPSVVAYTKTGERLVGQIARRQAVMNPENTFYSVKRFIGRKHDEITHEASEVSYKVVRDRNGNVKLDCPALKKQFAPEEISAQVLRKLTDDASKYLGEPITQAVITVPAYFNDSQRQATKDAGKIAGLEVLRIINEPTAAALAYGLDKKGNETILVFDLGGGTFDVSILEVGEGVFEVKATSGDTHLGGDDFDKKIVDYVANDFQRHEGIDLRKDKQALQRLTEAAEKAKIELSSATQTTINLPFITATQEGPKHLDITLTRAEFEKLCADLLDRCRIPVEQALNDANLNNANLDEVVLVGGSTRIPAVQQLVKRITGKDPNQGVNPDEVVAVGAAIQGGVLAGEVKDVLLLDVTPLSLGVETMGGVMTKIIPRNTTIPVKKSETFSTAADGQSNVEIHVLQGERELVADNKSLGTFRLDGIPPAPRGVPQIEVTFDLDANGLLSVTAKDRATGKEQSITISGASTLDKRDVERMVRDAETHAQEDRQRREQIDTKNNADSLVYQAEKQLQDLNGRVSQADKSRAQQLIDELRSAIERENYEQMRSLTTNLQQALMQIGSAVYAQASTATNNPNPTNQPTGQNDDVIDADFVGX

SEQ ID NO: 20073 - protein, 322 aa, Nostoc punctiforme
  unsure (1)..(322): unsure at all Xaa locations
MPTANDFKDYYNILGVSKTATSDEIKRAYRKLARKYHPDVNPGNPEAEEKFKDINEANEVLSNPEKREKYDSFGQYWKQAEASGTPPGGTSTYAENFDQYSNFDDFINDLLGGLGGRTRAGRTYYRTSARQPDDFGSFGSQAPAPDSEAAIALSFSEAFHGVQKRLQLDDETINVRIPAGAKPGSRIRIKGKGRPSPFSQQRGDLYLTIELLPHPFFQFSDDNLTCEVPIRPDEAVLGAQIQVPTPEGRVTLSVPKGVRSGQSLRLRGKGWTQPKGGRTDLIVKLQIVSPKELSEIERDCYEKIQANSSFNPRTALEGVTLX

SEQ ID NO: 20074 - protein, 352 aa, Nostoc punctiforme
  unsure (1)..(352): unsure at all Xaa locations
MIVKAGEAILKFWLVVMEVIFKVIRQQQNSSPIVQTYLVEAEPGNTILDCLNHIKWEQDGTLAFRKNCRNTICGSCAMRINGRSALACKENVGSELARLQQIPSSQSKVNVIPEITIAPLGNMPVIKDLVVDMSSFWNNLEAVAPYVSTAARQVPEREFLQTPQERSRLDQTGNCIMCGACYSECNAREVDPNFVGPHALAKAYRMVADSRDSDTENRLASYNEGTKGVWGCTRCLYCDSVCPMEVAPLEQITKIKQEILTHKEASDSRSIRHRKVLVDLVKEGGWIDERQFGLQVVGNYFKDLRGLLSLAPLGLRMLLRGKFPLSFEPSEGTEQVRSLIESVQQVEGNRQX

SEQ ID NO: 20075 - protein, 428 aa, Nostoc punctiforme
MNIAVVGLSHKTAPVEVREKLSIPEPQIESAIAQLASYPHIDEVAILSTCNRLEIYIVTSEADQGIREITQFLAEYSKLPVLSLRQHLFMLLHDDAVMHVMRVAGGLDSLVLGEGQILAQVKTTHKLGQQYNGIKTILNRLFKQALTAGKRVRTETSIGTGAVSISSAAVELAQIKVANLAACRVVILGAGKMSRLLVQHLISKGAVEISIVNRSRDRAQELAKLFPQQPIKIHPLSEMMSVIADSDLVFTSTSATEPILDRVKLEMVLEVQRSLMLFDISVPRNVHADVNELENVQAFNVDDLKAVVAQNYESRRKIAQEAEKLLEEEVEAFDIWWRSLETVTTISCLRNKVETIREQELEKALSRLGSEFAEKHQEVIEALTRGIVNKILHDPMVQLRSQQDVEARRRCMQTLQMLFNLDAEEQFS

SEQ ID NO: 20076 - protein, 525 aa, Nostoc punctiforme
MDARALWQRYQNWLYFHEGLGLYLDISRMRFDDAFVESLQPKFDKAFADMAELEKGAIANPDENRMVGHYWLRNPDLAPTPELTQEIVQTLEQIEAFAEKVQTGAIHPPRASRFTDIISIGIGGSALGPQFVAEALAPDFPPLKIHFIDNNDPAGIDRVLNHLRNSLASTLVLVISKSGGTPEPRNGMIEVKKAYAGHNLEFAQYAVAITSVDSNLDKLAKDEGWLARFPMYDWVGGRTSEMSAVGLVPAALQGIDVRAMLDGAKEMDDATRVPDVKNNPAALLALSWYFAGNGKGEKDMVVLPYKDSLFLFSRYLQQLVMESLGKEKDLDGNVVHQGIAVYGNKGSTDQHAYVQQLREGVANFFATFVEVLEDRQGPSTEIDPGVTSGDYLSGFLQGTRQALYENHRDSITVTIPQVNPRTVGALIALYERAVGLYASLVNVNAYHQPGVEAGKKAAASILDLQTRVVAVLQKEKTPISLDELAKKAGASDQIEAIYKILRHIHANQRGVVLQGDLHKPGSLTV

SEQ ID NO: 20077 - protein, 326 aa, Nostoc punctiforme
PSMGCGTWAWGNQLLWGYDESMDDHLQAVFNLCVNNGVTLFDTGDSYGTGRLNGRSELLLGRFNREYLGSNKENICIATKLAAYPWRWTRQSMVKACKSSAQRLGKNVDLVQMHWSTANYAPWQEVGLLDGLADLYEQGLVKGVGLSNYGPKQLKQVQKKFAERGVPITTLQVQYSLLSTYPVTQLGLKDLCDELGIKLIAYSPLALGLLTGKYSEQGPLPKGIRGLLFRQILPGMRRRGAASAGSSLLGCLREVAQARNKTMSQVAINWCICKGTIPIPGAKSVEQARENIGALSWQLNVSEIAELDKAAANVGKKMVQNIFQTK

SEQ ID NO: 20078 - protein, 1096 aa, Nostoc punctiforme
VGILFYRAHYLAGNTKVIDALCQALVQKNLQPVPVFVSSLREPDVQAELSEFFQPKEAESIAVLLNTTSFSLARLESETPQTELWEKLDVPVLQVILSGGSIEQWESQFQGLSPRDIGMNVALPEVDGRIITRAVSFKAVQTRNPHLETDVVIYEPVSDRIEFVAQLAANWARLRSKPPQERRIALILANYPNRNGRLANGVGLDTPASCVEILQALHQAGYEVENPPAQGDELIQRLTNGVTNDAEGREWLPVHQSVSWEEYQEYFASLPPAVQQGITERWKMGQSAGGKGESSSPLLPAPCPPASIPVPGIQIGNIFVGIQPARGYDNDPSLNYHAPDLEPTHDYLAFYYWVRETFGADAVVHVGKHGNLEWLPGKSVALSNNCYPEVAFGSLPHLYPFIVNDPGEGSQAKRRAQAVIIDHLTPPMTRAELYGSLQQLENLIDEYYEADSLDPSRLPVIRDRIHELVIKENLHLDLGIQNETEIFKSESLVLNSIGGYLCELKEAQIRDGLHIFGQCPQGKQLRDLIVAIARIPNRHSSGITRAIAQDWGLDFDPLTADLSMPSGEYSIVNGTECRTIGDIVEVLEEHAALLVEQLINQDSEFRIQESCRDAIHRVSTWIRDRLLPALQQTDREITHLLHGLDGGYVPSAPSGAPTRGRPEVLPTGRNFYSVDIRAIPTETAWDIGRKAAETLVEYYTQENGEYPRTLGLSLWGTATMRTGGDDIAEALALLGVKPVWDGAARRVVDFEILPLAILGRPRVDVTLRISGFFRDAFPNLIDLFDQAVSAVADLDEPPEQNPLADAVRQETELWTSQGLTLEEAVVRSHYRIFGSRPGAYGAGLQGLIESQNWTDDEDLARAYINWSSYAYSSGNLVGEQGAGGAGEDKIANPQSSVPSPQSPVPNTEAFKQRLSQMQVVLHNQDNREHDLLDSDDYYQFQGGLTAAVRSLQGKNPKTYFGDNSIPAQPRVRQLKEEISRVYRSRVVNPKWIAGVMRHGYKGAFEMAATVDFLFAYDATAKCVEDYMYQGIVEAYLLDPVVSEFIQEKNPYALRDIAEKLLEAHKRNLWEDVNIGTLEALRNLVHQAEAVIEEKSM

SEQ ID NO: 20079 - protein, 773 aa, Nostoc punctiforme
MTTTIDFLSHLNPSQRQAVEHYCGPLLVVAGAGSGKTRALTYRIANLILKHRVDPENILAVTFTNKAAREMKERIQRLFAEQLAMKQHGQRLDLLTEYQQTQLRSQVYKSTIKDLWCGTFHSLFSRILRFDIEKYVDEKGRKWNRNFSIFDESDVMTLIKELVNKELNLDDKKFDARSVRYAISNAKNQGLSPQEFEQDQPNYRGRVIAQVYNLYQDKLAQNNALDFDDLILVPTRLFQQNEQVLGYWHRKFRHILVDEYQDTNRTQYQLINLLVTNGETKKTEWQWENRSVFVVGDADQSIYSFRMADFTILLGFQEDFGDGLVDDDTRTMVKLEENYRSCENILQAANELIENNTQRIDKILKPTRGGGEQITCHKADEELAEAAFVIDQINTLKNQNPELDWGSFAILYRTNAQSRPFEELLVKYQIPYTVVGGMRFYDRKEIKDVIAYLRAIANPSDTVSLLRVINTPRRGVGKTTIDALMNASQQLGTTLWEILSDETSVNTLAGRATKAVNNFAAMISRWQGQIATLPVTEVLQGILEDSGYVQDLMNQGTDEATDRVQNVQELYNAALQFQEENEEISLRDFLSSAALSSDLDNLKEGQTAVSLMTLHASKGLEFPVVFLVGLEQGLFPGYRSLSDPASLEEERRLCYVGITRAQERLYLSHARERRLYGSREPAMRSQFLDELPEELLATKRASRQSYTKSASSSNGKQDTSQNWQVGNRVLHKTFGLGEITHVFGTGNKMSVAIKFASLGQKIVDPRVAQLQKV

SEQ ID NO: 20080 - protein, 225 aa, Nostoc punctiforme
IQGKVALITGASRGIGRAIALELAQVGIKRLILVARDRQKLVEVANEIEAMGTETAIVPLDLTQTIEVNIAVAQLWRNFGQIHLLVNCAGVAYQSSFLQSKMPQVQEELSVNLLGMYNLTSLIARRMVSQRQGTIVNVSSLMGKVAAPTMATYSATKFAILGFTQALRRELAEHNIRVIALLPSLTDTDMVRDLKLFRWVIPMTPQQVAKALVAGMQNDSPEILV

SEQ ID NO: 20081 - protein, 273 aa, Nostoc punctiforme
  unsure (1)..(273): unsure at all Xaa locations
LHNLXLLSFKKFXXLMKIATWNVNSIRTRLEQVTDWLTNNPVDVLCLQETKVADAEFPRSPFEQLGYNLYISGQKSYNGVALISRQPLLNVSSGFRAILPDLHHEWDEQKRVITGVIDGVRIVNLYVPNGAAVGTEKYEYKLRWLTALHEYLRVLALSEPAICVCGDFNIALEDKDIHEQVSTENHIMATETERQALREILQLGFADAFRKFTTEGGNYSWWDYRAAAFRRNLGWRIDHHYLTPVLYERATSCIIDAEPRKSTQPSDHTPVIV

SEQ ID NO: 20082 - protein, 321 aa, Nostoc punctiforme
GGIELVVSRLTDELVRRGHEVTLFASGDSQTLANLEAVYPRALRLDPNVKEYAVYEMLELSKVYQRAKEFDLIHSHVGISALPLASFITATSTVHTLHNNFTNDTRHAFSYYQKQPYVSISNSQRQVDLNYVGTVYNGIELADYPFVAQPSEPLYLAFLGRFSPEKGPHHAIAIAKQSGWRLKMAGKVDVGDSKFFEQEIAPHIDGQQIEYLGEINHAEKTELLGNAAITLFPINWQEPFGLVMTESMATGTPVIAMNFGSVPEVIAHGKTGFICKSYAEMTAMIPLALELNRQTCRKHVESNFSVNQMVNGYEAIYRQII

SEQ ID NO: 20083 - protein, 303 aa, Nostoc punctiforme
KMSIIVFGSINIDLVATTPRLPVPGETLLGEEFFKVSGGKGANQAVALAKLGIPTQMVGRVGADDFGVELVNNLQSSGVQIDNIFVDETVSSGVAIIAVNHAGENQIIVIPGANGRVNQEDVERLSQLLPEATALLLQLEIPITTVIAAATAARKSKIRVILDPAPAQSNFPDELYPLVDIITPNEVEAAQLVGFPVDGEEQAAKAAEVLLQRGVKCAIVKLGAKGVFCATAEEKFFVPVFPVHAVDTVAAGDAFNGGLTAALFAGFSLHQAVVWGAAAGALATTKSGAQTSLPDRFTFDAFL

SEQ ID NO: 20084 - protein, 519 aa, Nostoc punctiforme
LGVRDVFGQFLIISFLTVIIWILESVFEYAYARLWRNLAQNIQHDLRLDAYKHLQELELAYFEERSTGGLMSILSDDINQLERFLDGGANDIIQVSATVLIIGAAFFILAPSVAWMALSPMPFILWGSFAYQRLLAPRYADVREKVGFLNSRLSNNISGITTIKSFTAETYEASRLELDSEAYRRSNSKAITLSAAFVPLIRMLILVGFTALLLYGGMAAVSGQMSVGTYSVLVFLIQRLLWPLTRLGETFDQYQRAMASTNRVMNLLDTPIAIHTGNVALPVNEVRGEVQFKNVYFAYKDRFPVIKNLSLDIPAGKTIAIVGSTGSGKSTLVKLLLRLYEVQTGNITLDGIDLQSLNLQDLRRCIGLVSQDVFLFHGTVAENIAYGSFETTEQEIITAAKIAEAHEFIVELPEGYETIVGERGQKLSGGQRQRIAIARAVLKNPPILILDEATSAVDNETEAAIQRSLERITVDRTTIAIAHRLSTIRNADCIYVMEHGKLVESGTHEQLLEKDGIYS

SEQ ID NO: 20085 - protein, 426 aa, Nostoc punctiforme
VKLGILGLGTVGTGTVQLLQDKAGRHPLLQEIEIYRVGVKSLDKPRAVELSTEVVTTDLESIVNDPAVDIVVEVMGGLEPARSLILKALSNGKHVVTANKAAIARFGAEIFTTANQAGVYVMLEAAVGGGIPVIQPLKQSLSVNRIHTVTGIVNGTTNYILTRMQTEGSNFSDVLADAQRLGYAEADPTADVDGLDAADKIAILASLGFGGRINLQDVYTEGIRQVSKTDIAYAEKLGFVIKLLAIAKRDTPSSPLSVRVHPTLVPQAHPLASINGVYNAILVEGEPIGQVMFFGPGAGAGATASAVTSDILNLVAVLKTNTAVANPLIACGHQEYCQIAPMAELITRFYARFLTNDQPGVIGKLGTCFGNYGVSLESIVQTGFQGELAEIVVVTHDVPEGNFRQALAEIQNLEAIESIPSLLRVL

SEQ ID NO: 20086 - protein, 406 aa, Nostoc punctiforme
VTEGHPDKICDQISDTILDALLTQDPSSRVAAEVVVNTGLVLITGEITTKANVNFVNLARKKIAEIGYTNADNGFSANSTSVLLALDEQSPDIAQGVNTAQETRQQDSDELFDKIGAGDQGIMFGFASNETPELMPLPISLAHRIARRLAAVRKTGELSYLRPDGKTQVTVVYEDGRPVGIDTILISTQHTATIGEITDEAAVQAKIKQDLWSAVVEPVFGDIDVKPNDQTRFLVNPTGKFVVGGPQGDSGLTGRKIIVDTYGGYSRHGGGAFSGKDPTKVDRSAAYAARYVAKNIVAAGLAEKVEIQLSYAIGVARPTSILVDTFGTGKVDEETLLELINQHFELRPAGIIHTFNLRNLPSERGGRFYQDVAAYGHFGRADLDLPWEQTDKAELLKQAANESLSA

SEQ ID NO: 20087 - protein, 618 aa, Nostoc punctiforme
MALIVQKYGGTSVGSVERIQAVAQRVYKTVQAGNSLVVVVSAMGKTTDGLVKLANEISPNPNRREMDMLLSTGEQVTIALLSMALQELGQPAISMTGAQVGIVTEAEHSRARILHIDTTRLCRHINAGKVVVVAGFQGTSSTGEMEITTLGRGGSDTSAVAIAAALRANFCEIYTDVPGILTTDPRLVAEAQLMDDITCDEMLELASLGAKVLHPRAVEIARNYGVPLVVRSSWTDQPGTWVTSAKPQGRSLINLEIARPVDAVEFDTDQAKVALLRVPDKPGVAARLFGEISRQKVDVDLIIQSIHEGNSNDIAFTVTTPILKRAEAVAAAIAPALRNPSNPKSDEAEVMLEHNIAKVSIAGAGMIGRPGVAAKMFATLAEAGVNIQMISTSEVKVSCVVDAAECDHAVLALRTAFEIEAGEQGSRGAGESACIDSPPPLCPSAPLPNCPPVRGVALDLNQARLAIRQLPDRPGMAAKLFGLLAQHNISVDMIIQSQRCRVIDGVPRRDIAFTVSRIDAESAKKMLTQVAAELGWGEVVLDSAIAKVSIVGAGMVGQPGVAAKMFEALAQHQINIQMIATSEIKISCVVAQEQGVKALQAIHAAFGLAGSEKVVVPA

SEQ ID NO: 20088 - protein, 329 aa, Nostoc punctiforme
GLDKYDAGNYEGAVKDFNHVIELDPKNALAYNKRGDTYYRLGDYEQAQADSSQAILLNPQDGNAYFDRGFAFSELGKYKEAIADYTQAIKLNSDDAYAYYGRGLARVQLKDNKGAIGDFSKAIALKPQYTEAYLQRGIIRRRLRLKQGAIEDFDTVIKINPSDAKAYYQRALTQSINKQKYAALKDYTDAININPKYIEAYLNRGDVFSDLGNKIEATEDYNTILQIDPKFIAAYIHRGIHRFSFGDYKGAIEDYSEALKLDPNNIAAYNNRGNAYLELGNKKSANQDYSQAIAINANNALAYYNRGVIRTKQKNKQGAIADFKKAAKL

SEQ ID NO: 20089 - protein, 458 aa, Nostoc punctiforme
DLLYTSSQIATSLLQNAKDLQEKRVAFLIPPGFEYVATQWGIWRAGGIAVPLCVSHPRPELEYVITNSGASIIVAHPNFESILRSLAEEHNLRFILTSETLPSNVAPLPEVDITRRALILYTSGTTGKPKGVVTTHQNIQAQVTSLNTAWEWTSSDRILHILPLHHIHGIINVLTCALWAGAECHLLSKFDTETVWRRICDGDLTLFMAVPTIYVKLITAWENASKERQKTMSEGCAKMRLMVSGSAALPVQVLEKWQSISGHFLLERYGMTEIGMALSNPLHGERLAGYVGKPLPKVEVRLVDEKGLVSAGTPGEIQVKGPGVFLEYWQNPEATAKAFQDGWFCTGDTAVVENENYRILGRMSVDIIKTGGYKVSALEIEEVLRSHPDIQECAVVGVADIEWGERVCAALVLLQGSKPLTLESFRSWAKERLAVYKVPTQILIVEELPRNAMGKVTK

SEQ ID NO: 20090 - protein, 399 aa, Nostoc punctiforme
RIALISVHGDPAIEIGKEEAGGQNVYVRQVGEALAQLGWQVDMFTRKASLEQDSIVEHSDNCRTIRLKAGPLEFVPRDEIFEYLPEFVENFLKFQVKNEIQYELVHTNYWLSSWVGMQLKKIQGSKQVHTYHSLGAVKYNTIENIPLIASQRLAVEKQVLETAERIVATSPQEQQHMRSLVSTEGNIDIIPCGTDIQRFGSIGREAARAELEIAKDAKVVLYVGRFDQRKGIETLVRAVNESELRDSKNLKLIIGGGSTPGNSDGIERDRIEQIVHELGITDLTIFSGRLSQDILPTYYAAADVCVVPSHYEPFGLVAIEAMASGTPVVASDVGGLQFTVVNEQTGLLAPPQDVGAFASAIDRILFNPEWRDELGKAGRKRTESQFSWHGVATQLSELY

SEQ ID NO: 20091 - protein, 661 aa, Nostoc punctiforme
  unsure (1)..(661): unsure at all Xaa locations
MSTLVIVESPTKARTIRNYLPAGYRVEASMGHVRDLPQSASEIPAAVKGETWAQLGVNVDADFEPVYVVPKDKKKIVTQLKEALKDVDELILATDEDREGESISWHLYQLLKPKVPTKRMVFHEITQEAIKKALKDCRQIDEQLVRAQETRRILDRLVGYTLSPLLWKKIAWGLSAGRVQSVAVRLLVTRERQRRAFHEGTYWDLKASLSKEKTPFAAQLVTLAGTKIANGSDFDATTGQITAGRNVLLLNEDQAVALKERLTGKTWSVTEMEERPVTRKPSPPFTTSTLQQESNRKLRLSARDTMRVAQNLYEQGYITYMRTDSVHLSDQAIAAARSSVEKLYGQQYLSPQPRQYTTKSKGAQEAHEAIRPAGSTFRTPQETGLGGRELAVYDLIWKRTVACQMADSCQTQISVQLQVEDAGFRSSGKRIEFPGYLRAYVEGSDDPEAALEDQEVILPNLKVGDHPNCTDLEAVGHETQPPARYTEASLVKTLESEGIGRPSTYASIIGTIIDKGYAHLVSNALIPTFTAFAVTDLLEKHFPDIVDPSFTSKMEQTLDDIATGEAKWLPYLQKFYLGEKGLETLVKERESQIDATTARTVELENLDAKVRIGKYGPYIEVTNGEGVITASIPKDLTPADLDPKQVEVLLRQKITGPXQVG

SEQ ID NO: 20092 - protein, 352 aa, Nostoc punctiforme
MIIVMKTGSPEAEINRIDEELTSWGLTPEKIVGQHKVVIGLVGETASLDPLQIQELSPWIEQVLRVEQPYKRASRQYRHGEASEVVVNTPNGAVVFGEHQPLVVVAGPCSVENEEMIVETARRVKTAGAKFLRGGAYKPRTSPYAFQGHGESALDLLARAREVSGLGIITEVMDAADLDKIVEVADVIQVGARNMQNFSLLKKVGAQPKPVLLKRGMAATIEDWLMAAEYVLASGNSNVILCERGIRTFDRQYTRNTLDLSVVPVLRKLTHLPIMIDPSHGVGWSEFVPSMAMAAIAAGTDSLMIEVHPNPAKALSDGPQSLTPDRFDNLMQELAVIGKAVGRWQQPAVALA

SEQ ID NO: 20093 - protein, 247 aa, Nostoc punctiforme
STKKLTGKVALVTGGSRGLGAAIAKRLANDGAIVALTYTSSPQKADEVVLAIEAAAGKALALRADSANVEAVKNAVAETVKAFGRLDILVNNAGVATLAPIDQFSMDDFDRLIAVNIKGVFVATQEAVRHMGEGGRIVMIGSVNSDIMPFAGGSVYALTKGAIASFTRGLARDLGPRGITVNNIQPGPIDTDMNPAEGPFADTMKSMIALQRYGRTEEVAEMVSYLASAEAGFITGASLKIDGGFAA

SEQ ID NO: 20094 - protein, 441 aa, Nostoc punctiforme
  unsure (1)..(441): unsure at all Xaa locations
RSQLMSRSANYCTTALVQLRHILSWQQQYQQLSNSNQELERTNQLKNQFLANTSHEIRTPLSSIIGFTNLLLAPGYEPTIERQREYLNIIQSSGKHLLALINDILDLSKIEANQLEVQWECVDVPLLCSNVLALVKEKAANKDLRLCLEIDPDITTLVADSLRLKQMLLNLLFNALKFTSKGSVGLQVVAKGISVHFTVWDTGSGISQEDQTQLFEPYFQIAKAVAGGAEGTGLGLAVTRKLAQIHGGSVKVESEVDSGSRFTLVLPLQQEAGAGIDKRDEGDEEAKYSSSLLPFIPSSSVDVLLVENDLPNADLMQIYLRKLGYQVTWVKNAAEMWEALTQLDPAVILMDVYLPDGNGLNLVRQLREHEQYQTIPVIVQTAMAMKGDRETCLTAGVNDYISKPIDLPLLASLVAKYSKPPIXRAGGRRTRGQGDNKXELE

SEQ ID NO: 20095 - protein, 210 aa, Nostoc punctiforme
EGTKGNTIQTGNGEDTVLAGSDSSVSTGDGNDQIFIGQNGPAQNTSADGGNGNDVITVVEASGSNNLLGGTGDDSLTVIEGSRQSLFGGSGNDTLRSGGSNNRLYGGSGDDKLFSNFNDSLSGGDGDDVLFAGQQGGNRLTGGTGADQFWIANANLPTSKNIVTDFVVGIDKIGLGGIGVTQFSALTLLQQGSDTLVKAGNTELASLVGV

SEQ ID NO: 20096 - protein, 273 aa, Nostoc punctiforme
  unsure (1)..(273): unsure at all Xaa locations
QGYVDYAPVSNADVTPTLARILGLDIPSNGDLKGRAITEALGGRPGCSSLYXRSIDFEKTTNGQATVLDSQSVGNTQYFTAAGFDGRTVGLTTLDLQFGSTNSDDVTLKPNQTLFAGDGADFVEGTKGNTIVTGNGEDTVLVGSGSSVSTGDGNDQVFIGVNSPASNTSADGGNGNDEVTVVEANGSNNLFGGAGADTLTVVEGSRQLSFGGSGNDTLKSNGSNNRLYGGSGDDKLFSSVNDSLFGGDGDDVLFAGQQGGNRLTGGTGADQFW

SEQ ID NO: 20097 - protein, 243 aa, Nostoc punctiforme
LSGKVAIITGASRGIGRAIALKLAGNGASIVVNYAGNAVKAEEVVAEIEKLGVEAIAIQADISKVPDIQRLFEQTLEHFGKVDILVNNAGIAFYKPITQVSEEDFDAIFAINVKGTFFACQQAAQHLSEGGRIINFSSSTTVMMLPTYSAYVGTKGAVEQITRVLAKELGAKAIAVNVISPGPTDTELFREGKTQEQIDRLAQMAAFGKLGDVQEIADVVAFLASDEARWITGQNIRVNGGIA

SEQ ID NO: 20098 - protein, 372 aa, Nostoc punctiforme
ESANRIKDEFLAVLSHELRTPLNPILGWTKLMRSRKLDQATSDRALETIERNAKLQTQLIEDLLDVSRILQGKLNLNFGPINLVSVIEAAIETVRLSAQAKSIEIQTIFEFGVGSVLGDANRLQQVIWNILSNAIKFTPSEGQVKIKLEQVGSQVQICVTDTGKGIAPEFLPYVFDYFRQADGATTRQFGGLGLGLAIVRHLVELHGGTVQAESLGEEQGATFTVRLPCLQNESKGIKDKINTFSLLPEQSLPLFGLEILVVDDDADMREFLPFMLEEYGASVTVVASAIAALTALSQSQPDLIISDIGMPEMDGYMLMRQIRSLKPEQGGTIPAIALTAYAGEMDYQQAIAVGFQQHISKPVDPEELVKAI

SEQ ID NO: 20099 - protein, 347 aa, Nostoc punctiforme
ITFNNPLGSEKSEDTTKLPFNLQDLKAAIPAECFQPNVKKSLFYFFRDILIIGLLYAVASYLDSWLFFPIFWLMQGTMFWALFVVGHDCGHQSFSKHKWLNDLIGHLSHTPILVPYHGWRISHRTHHKNTGNIDNDESWYPVSESQYKEMPLAQKIGRYYVFLLAYPVYLFKRSPNKEGSHFLPGSSLFKPSEKWDVITSTVLLIGMVGLLGFLTYQWGWMWLLKYYAVPYLVFIVWLDLVTFLHHTEPELPWYRGEDWTFLKGAISSIDRDYGLVNHIHHDIGTHVAHHIFLNIPHYNLLKATEAIKPVMGEYFHKSEEPIWKSLWNSCISCHFVPDTGSRVYYTS

SEQ ID NO: 20100 - protein, 347 aa, Nostoc punctiforme
MTTSIINSQKLSDEPGNSNFRLKDIIKTVPRECFQQNRRKAWTQVLLSVLAVALGYYSLIVTPWFLLPLAWIFTGTALTGFFVIGHDCGHRSFAKRRWVNDLVGHFFMMPLIYPFHSWRIKHNYHHAHTNKLDEDNAWHPIRPEVFENWDTTRQSAFKLFMRKRLWWVGSIGHWAVVHFDWRNFKTKDQSSIKLSVAVVVVFAAISFPLLVATTGIWGFVKFWLVPWMIYHFWMSTFTIVHHTAADVPFATANKWNEALAQLAGTIHCDYPRWVEILCHDINVHVPHHISTAIPSYNLRLAYSSIKENWGPYLHDECQFSWPLMKQITDECQLYTTDVGYKTFNEHY

SEQ ID NO: 20101 - protein, 271 aa, Nostoc punctiforme
MTIATSTKPQINWVNTLFFIGLHIGALFAFVPGNFSWTAVGVGFLLYWVTGGLGVTLGFHRLVTHRSFQTPKWLEYLLVFFGTLSCQGGPIEWIGTHRIHHLNSDTDTDPHDSNKGFWWSHMGWLTHYCPAHADVPRFTKDIAEDPVYQFLEKYFILIQVALGVLLLLLGGWPFVIWGIFVRIVWVYHCTWLVNSATHKFGYQSYDSGDKSTNCWWVAVLVFGEGWHNNHHAFQYSARHGLEWWEIDLTWMTVQLLQAVGLATNVKLAPAK

SEQ ID NO: 20102 - protein, 389 aa, Nostoc punctiforme
MKAVCWHGANDVRVETVPDPKILNPRDAIVKITSTAICGSDLHIYDGYIPTMQKGDILGHEFMGEVVELGSAVKNVNVGDRVVVPFTISCGSCFFCNRDLWSLCDNSNPNAWLVKKQMGHSPAGLFGYSHLFGGYAGGQAEYARVPFADVGLFKIPDGLTDEQVLFLTDIFPTGYMAAENCNIKPGDIVAVWGCGPVGQFAIKSAYMLGAERVIAFDRIPERLQMAKEYGKAEVLNYEEVNIGEALKEMTGGRGPDACIDAVGMEAHGTDFMAFYDQVKQAVRLETDRPTALRQVIVSAAKGGHVSLVGVYGGFLDKIPMGAAMNKGLTFKMGQTNVHKYLKPLLEHIQNGEIDPTFIITHTLPLEQAPHGYEIFKHKKDNCIKVVLKP

SEQ ID NO: 20103 - protein, 397 aa, Nostoc punctiforme
  unsure (1)..(397): unsure at all Xaa locations
MKAVCWNGANDVRVQSVPDPTILNPRDAIIKITSTAICGSDLHIYGGYIPTVQQGDIIGHEFMGEVVEVGRGVNNLKIGDRVVVPSTIGCGNCHYCQHDMWSLCDNSNPKGWIEEKLFGNITSAIYGYSHMLGGYAGAQAEYIRVPFADVGVVKVPPDLPDEMLLFISDAIPTGYMGAELCDIQPGDTVAVWGCGAVGQFAMISAYMMGAEKVIAIDRFPERLEMAKKFAKAEVINYEEVNAGEALKEMTGGRGPDACIDAVGLEAHGVGLEDFYDQTKQKLRLETDRPHVLREMMVACRKGGTLSIMGVYGGFVDKIPFGAAFNKGLTFRMGQMHGQKYMHLLLQMILDGKLDPSFVVTHQLPLEQAPHAYHIFQQKKDNCIKVVLKPXMVNSHSA

SEQ ID NO: 20104 - protein, 621 aa, Nostoc punctiforme
QVAEAIAASQQYLLSIQNPAGYWWAELESNVTITAETVLLHKIWGTDQTRPLHKVEAYLRQEQRQHGGWELFYGDGGELSTSVEAYMALRLLGVPATDPAMIRAQAFILQRGGISKTRIFTKLHLALIGCYNWRGIPSLPPWIMLLPKAFPVNIYEMSSWARSSTVPLLVVCDRKPVFITDPTINLDELYAEGIDRVRWELPQSGDWTDLFLTLDQGFKWAESLNLVPFREEGIKAAEKWILERQEATGDWGGIIPAMLNSMLALRCLDYDRSDPIVERGLQAIDNFAIETDNSYRVQPCVSPVWDTAWVMRALVESGFVPDHPAVVKAGEWLLQKQILDYGDWAVKNRQGKPGAWAFEFENRFYPDVDDSAVVVMALHLAKLPNEKIKQAAIARAVNWIASMQCKPGGWAAFDLDNDQDWLNSIPYGDLKAMIDPNTADVTARVVEMLGACDLSIDSDNLERSLTYLLREQETEGCWFGRWGVNYIYGTSGVLSALALIDPQRHKLSIERGAAWLLGCQNLDGGWGETCRSYDDPSLKGKGDSTASQTAWALIGLLAAGEATGKLAVKAIEQGIGYLMATQQPDGTWFEANFTGTGFPCYFYLKYHLYQQYFPLIALGRY

SEQ ID NO: 20105 - protein, 263 aa, Nostoc punctiforme
MDLKLHGKSALVSGSTAGIGLAIAQALAQEGASVIVNGRSEERVTQAIAKIQQSTPEAKVSGVVADTSTASGVEELFQKVPHVDILINNLGIYEPKTFFDITDEDWLNIFQVNVLSGVRLSRQYLQKQLEQNWGRIIFISSESAIQIPVEMIHYGTTKTAQLAIARGLAEMTIGTGVTVNSVLPGPTRSEGVEEFITNLAQERGINRAEVEAEFFQNVRPSSLIKRFATNEEVAAIVVYLSSPVASATNGAALRVDGGVIRSI

SEQ ID NO: 20106 - protein, 403 aa, Nostoc punctiforme
RSFHYGWLVAGLTFLALLVAAGIRSAPGVFIVPLEQEFGWSRATISLAISINLVLYGLIGPFAATVMERIGIRQMMVFSLAVIALGVGLTTLMSASWQLVLLWGVVVGSGSGVIALVLGAIVVNRWFFEKRGLVLGILTASTATGQLVFLPMLASVADRFGWRTAALALTGAALLIIPAIAAFMRDRPADVGLRPFGDNSETVEISQPRANSISSTLNALWLGMRKRDFWLLFGSFFICGASTNGLIGTHLIPACIDHGIPEVKAAGLLAIMGLFDFFGTTMSGWLSDRWNNRYLLCWYYGLRGLSLIFLPFSFNFSFYGLSIFAVFYGLDWIATVPPTVRLVANAFGKENVGVMFGWIVAGHQLGAATAAFGAGVLRTWTGSYLQAFILSGILCLIAAVGVL

SEQ ID NO: 20107 - protein, 227 aa, Nostoc punctiforme
MATTALIVGAGSGLSASLARLFAKEGFTVALAARQIEKLTQLTREIDAVSFAADVSKPNEVEQLFIDIDRKIGSPNVVIYNPSFRVRGPLIDLDPGEVAKTLDVTAYGGFLVAQAATKRFLQLGGGAIFFTGASASVKGYPLSAPFAMGKFALRGLAQSIARELAPKNIHVAHFVIDGAIRSAVRQDPVDNPDSTLDPDAIAQTYLSILRQPRSAWTYEVELRPWVE

SEQ ID NO: 20108 - protein, 206 aa, Nostoc punctiforme
MIDLYYWTTPNGHKITIFLEEVGLQYTINPVNIGAGDQFKPEFLKISPNNRIPAIVDHEPVDGGAPISVFESGAILLYLAEKTGKLIPQDLRQRTQVLEWLFWQMGGLGPMAGQNHHFSAYAPEKIEYAINRYVNETGRLYGVLNKQLADREFVAGDYSIADIAAYPWIVPYERQSQNLEDFPHLKRWFETIKARPATIRAYEKAE

SEQ ID NO: 20109 - protein, 651 aa, Nostoc punctiforme
IESILQENRLFHPPSEFSQNAHIKSLDDYKRLYEKAKADPEQFWADLAGTELEWFQKWDTVLDWQPPFAKWFVGGKMNISYNCLDRHLTTWRKNKAALIWEGEPGDSRTLTYAQLHREVCQFANVLKQLGVQKGDRVGIYMPMIPEAAIAMLACARIGAPHGVVFGGFSAEALRDRLIDATAKLVITADGGWRKDAIVPLKEQVDKALADGAVPSVENVLVVKRTGQETYMQLGGRDHWWHDLQKSASADCPAEPMDSEDMLFVLYTSGSTGKPKGVVHTTAGYNLYTHITTKWIFDLQDTDVYWCTADVGWITGHSYIVYGPLSNGATTVMYEGAPRASNPGCFWDVIEKYGVNIFYTAPTAIRAFIKMGEQHPNARNLSSLRLLGTVGEPINPEAWMWYQKVIGGDRCPIVDTWWQTETGGIMITPLPGAIPTKPGSATLPFPGIIADVVDLEGNTVPNNEGGYLAVRHPWPGMMRTVYGDPERFRRTYWEHIPPQDGKYTYFAGDGARQDEDGYFWVMGRVDDVLNVSGHRLGTMEVESALVSHPAVAEAAVVGKPDELKGEEVVAFVTLEGTYQGSEELSKELKQHVVKEIGAIARPGEIRFTDALPKTRSGKIMRRLLRNLAAGQEVSGDTSTLEDRSVLDKLREG

SEQ ID NO: 20110 - protein, 255 aa, Nostoc punctiforme
IMLSKRILPCLDVKAGRVVKGVNFVNLQDAGDPVELAKVYNEAGADELVFLDITATHEDRATILDVVYRTAEQVFIPLTVGGGIQSLENVKALLRAGADKVSINSAAVRDPDLINRASDRFGNQCIVVAIDARRRNNPENPGWDVYVRGGRENTGLDALLWAQEVEKRGAGELLITSMDADGTQAGYDIEITRAIANAVEIPVIASGGAGNCEHIYTALTEGKAEAALLASLLHYGQLSVAEIKNYLRDRNVPVR

SEQ ID NO: 20111 - protein, 448 aa, Nostoc punctiforme
LLKLPNGPQTHPWIQMYQWLTNPLEYMEACTKRYGDIFTLKLGQNFAHQVFISNPQAIQQIFTTDPKQLDSGESAGIKAPLLGQQSLLALDGKPHQRQRKLLTPPFHGERMLAYGELIREITEQVSSQWQVGETFAVLPSMQAISFQVILKAVFGLEDGPRYKKLNELLIKILNPKIPLLRTVLLIFPSMRQDLGAWSPWGKYLRLRQQIDQLIYAQIQERKAQPNLSGTDILSLMMAARDEAGEPMTDLELRDELMTLLVAGHETTATSLSWALYWIHHRPQVREKLLQELDNLGEKPDPNAIFRLPYLNAVCSETLRLYPVAMSALNRLVKSPLQIGEYNFEPGTILIPSIYLTHHREDLYPESKQFKPERFLERQFSPYEYLPFGGGNRRCIGMAFALFEMKLVLATVLSRWQMELADSKPVRPVRKGLLFSPAGGVQMVVKGKR

SEQ ID NO: 20112 - protein, 481 aa, Nostoc punctiforme
MVTTAEKTNIGYITQIIGPVVDVKFPGGKLPQIYNALKIVGTNESGQEINITVEVQQLLGDNQVRTVAMSSTEGLVRGFEVTDTGAPITVPVGKATLGRIFNVLGEPVDNRGPVNAEASLPIHRSAPKFTDLETKPSVFETGIKVVDLLTPYRRGGKIGLFGGAGVGKTVIMMELINNIATQHGGVSVFAGVGERTREGNDLYNEMIESGVINNENLNESKIALVYGQMNEPPGARMRVGLSGLTVAEYFRDVNKQDVLLFIDNIFRFVQAGSEVSALLGRMPSAVGYQPTLGTDVGELQERITSTTEGSITSIQAVYVPADDLTDPAPATTFAHLDGTTVLSRGLAAKGIYPAVDPLGSTSTMLQPNIVGDEHYNTARAVQSTLQRYKELQDIIAILGLDELSEEDRLIVARARKVERFLSQPFFVAEVFTGSPGKYVKLEDTIKGFQKILSGELDALPEQAFYLVGDINEAIAKAEKIK

SEQ ID NO: 20113 - protein, 467 aa, Nostoc punctiforme
MTVAQQPEALSFECETGNYHTFCPISCVAWLYQKIEDSFFLVIGTKTCGYFLQNAMGVMIFAEPRYAMAELEEGDISAQLSDYEELKRLCLQIKRDRNPSVIVWIGTCTTEIIKTDLEGLAPKLESEIGIPIVVARANGLDYAFTQGEDTVLAAMANRCPDKAPVAETEKSERNAIAKLLNFGKKKEDVAQDESEYVDHPPLVLFGSLPDPVVTQLTLELKKQGIKVSGWLPAKRFTELPVLEEGYYVAGVNPFLSRTATTLMRRRKCKLIGAPFPIGPDGTRAWIEKICSVFGITPKGLDEREAQIWAGLEDYVKLIRGKSVFFMGDNLLEISQARFLIRCGMTVHEIGIPYMDKRYQAAELALLEKTCQEMNSPLPRIVEKPDNYNQLQRIYELKPDLVITGMAHANPLEARGINTKWSVEFTFAQIHGFTNARDILELVTRPLRRNNNLKDLGWDKLVREEAKI

SEQ ID NO: 20114 - protein, 442 aa, Nostoc punctiforme
RLRRQKLANLIKFPVILWSGTNSPRNFPANPFPFRANSHFLYFAGLPLPNAAIRLEGGKLELFMDDPSPSSTLWHGEMPTRNEIAQKIGADVARPMTELESWIEDAVTLAVQDAATWTQQSQLLNRWVLPQSPPQGIDLDLAKAIASIRLTHDEAALTELRKAAAVTVEAHKVGMAATPQAKLEAEVRAAMEGVIIAHNMTTSYNSIVTVHGEVLHNEHYHHPLQPGDLLLADVGAETEMGWAGDVTRTWPVSGKFSSTQRDIYNVVLAAHDACIAKIQPGVEYEDIHLLAATVIAEGLVELGIFQGNPQYLVEMDAHALFFPHGIGHLLGLDVHDMEDLGDLAGYEEGRKRSDRFGLSYLRLNRPLRPGMLVTIEPGFYQVPAILNDANVRSKYQNVVNWQRLSEFADVRGIRLEDDVLVTAEGSEVLTAALPNDADTIEN

SEQ ID NO: 20115 - protein, 518 aa, Nostoc punctiforme
LLRRLFVTLLALIVFWWGLLPEIALAQTQVAPPQETKTQTPPVQNSIQPYLDRVIKQLTEFRLDNGLKFLVLERHQAPVVSFLTYANVGGVDEPDGKTGVAHFLEHLAFKGTTRIGTQDYKAEKPLLERLQQLDTQIKAAKADGKKDEVAQLETEFKQVESQAGKLVKQNELGQIVEQAGGVGLNANTSTEATRYFYSFPANKLELWMSLESERFLDPVIRREFYKEKDVILEERRLRVENSPIGQMVEKFIDTAYKVHPYKRPVIGYDQDIRNLTPDDVQNFFDTHYVPSNLAIAIVGDVNPAEVKKLAQTYFGRYKAKTKAVEQIPVEPPQKQTQEVTLQLPSQPWYLEGYHRPAVTHPDNATYEIIGSLLSDGRTSRLYKSLVEKQRLALNAQGFSGFPGDKYPNLMLFYALTAPGHTVDELAVALRQEIDKLKTEPVAAIDLERVKTQARAGLLRTLDSNMGMAQQLLEYEVKTGSWRNLFKQLDDISAVTTADIQRVAKETFTPGNRTIGKLL

SEQ ID NO: 20116 - protein, 257 aa, Nostoc punctiforme
MQVIRLEALSDNYIFLLYDDKRNIAAVVDPAEAQPVLKKLAELKADLVAIFNTHHHNDHVGGNKQLIEKFPQLIVYGGAEDRGRIPGQKVFLQQGDRVEFADRIAEVIFVPGHTRAHIAYYFPPQEASETGDLFCGDTLFSGGCGRLFEGTPTQMVDSLSKLRSLPDNTRIWCAHEYTLKNLQFALTVDGDNADLQRRFNEVKAYRSRGEATIPSLLGVEKHTNPFLRWDQASLQSTVKSSDGVQTFARIREMKNNF

SEQ ID NO: 20117 - protein, 875 aa, Nostoc punctiforme
MSKSYFDTDNNGHKPFELPGARPHYNPDRPGQVEHIFLDLSLDIPKKSYQGICSIRLLPIRNGIDRLTLDAVNLNIESVQVDDVPQNFDYDGEQLSIKLSEVTQIGKRLLIAIAYSVAKPQRGIYFIQPDKHYPNKPTQVWTQGEDEDSRFWFPCFDYPGQLSTSEIRVRVPNPLVAISNGELIDTTEDGDYKIYHWLQQQVHPTYLMTLAVGDFAEIQDEWKGKPVTYYVEKGREEDAKRSMGKTPRMIEFLSQKYGYPYPFPKYAQVCVDDFIFGGMENTSTTLLTDRCLLDERAALDNRNTESLVVHELAHQWFGDLVVIKHWSHAWIKEGMASYSEVMWTEQEYSLEEAAYYRFLEARRYISEDSSRYRRPMVTHVYREAIELYDRHIYEKGSCVYHMIRAQLGDELFWQAIQTFVQDNAHKTVETIDLLRAIEKATGHNLLFLFDQYVYRGGHPDFKVAYSWDGDAKLAKITVTQTQAAEDKNGSKDLFDLKIPIGFGYTQQEGKSEELGVKNNSKLTTPNSQLKTFVVRVNEREQSFYFPLENKPQYISFDVENNYLKTVALEYPIAELKAQLESDPNPISRIYAAEALTKKGGLEATKALSASLKNDPLWGVRVEVAKQLAKINLDQAFDGLVLGLKDKNAYVRRSVVEALAQIKTAESYKVVRGLLQKGDPSYYVEATASRVIGAIASANLEEKPKEDKVIKQLKGILEEKAGWNEVVRSGAIAGLAEFKTSEAALNLLLEYTKIGVPQPLRLATIRALGKISVGQSPVNLERILEKLAELAKETFFLTQVAVAAALGQMETPKAVGILRSLAEQTADGRVRRNAEEEISRVQKNIGSEKTLRQLREDFDQLKQQNQELRSRLENLE

SEQ ID NO: 20118 - protein, 135 aa, Nostoc punctiforme
IGNAMEAYLTISTHFSAAHRLAHPHLSNEENTEIYGKCARPHGHGHNYHLEVTVKGEIDPRTGMIVDLGGLNQVIEDYVVEPFDHTFLNKDIPYFAEIVPTAENIALYISNLLRSPIQELGAKLHKVKLIESPNN

SEQ ID NO: 20119 - protein, 120 aa, Nostoc punctiforme
VNRRAQFSASHRYWLPELSEAENIEKFGACSKFPGHGHNYVLFISLAGELDKYGMVLNLSDVKHVIKREVTSQLDFSYINDAWTEFQQTLPTTENIARIIWQRLAPHLPLVRVQLFEHPE

SEQ ID NO: 20120 - protein, 311 aa, Nostoc punctiforme
AICTRGLTKQFDRHVAVNDVDLEIQAGEVYGLIGPNGAGKTTLIRMLATAEEPTTGEIYINGDRLLRDKSNPKLKRRLGYLPDDYPLYEDLTVWDYLDYFARLYRLREPRRTQRLHEVLELIQLGNKRHSQISTLSRGMKQRLSLARTIIHEPILLLLDEPVSGLDPIARMHFREIIKALQEAGMTVIISSHVLSDLAELCTSVGIMELGFLVESTSLQQLYERLSHQQIVISTLGNLETLLRELKHHHLVEEWEVISGKNSVRVNFSGKDEDSAELLRSLIKAGIPLTDFHCTQEDLETIFLKLGHKQAS

SEQ ID NO: 20121 - protein, 407 aa, Nostoc punctiforme
  unsure (1)..(407): unsure at all Xaa locations
SQKLEIHRLALLGKDEEIVGKIASSLANHLLHQSRFREAIHLCKSTLEITKNHSVLKEMAYSKHQMGEVDQALSYYQQALNFCPAEDERELASIYQHLCMLKDDKGDVDEALALCNQSLEIFERIGNVQCKAEALGCLGNIYAGKGEVDEALALYNQSLEISERIGDVQSKAVTLSCLGNIYAGKGEVDEAIALFNQSLEINERIGNVQSKAATLIQLGNIYADKGEVDEALALYNQSLEIFERIGNVXGKAVTLQELGSIYANKGEVEQAIALFNQSLEINERIGNVQGKAATLHCLGLIYVNKGEVDEAIALYNQSLEIEERIGDVQGKAATLNNLAGIYANKGEVEQAIALFNQSLEINERIGDVQGKAITLWCLGDLAEQQGEYTKAISYLQPALKILQRLKS

SEQ ID NO: 20122 - protein, 1216 aa, Nostoc punctiforme
MVHIKRVELTNFKSFGGTTSVPLLPGCTVISGPNGSGKSNILDALLFCLGLSSSKGMRADRLPDLVNNTQTSKGRASIEASVTVTFDLSDEISHKDTKAQKEEVEEAGDAGDAGEAEEEPKSKIVRLSEAEVQKPKSAEWSVTRRLRVTHQGSYTSNYYINGEACTLTELHQQLSNLRVYPEGYNVVLQGDVTSIISMNARERREIIDELAGVAAFDRKIIQAKSTLDEVKEKEDSCRIIETELTAQRDRLSQDRAKAERYQKLRTEFLAKQSWEAVLSWRSLQAQQEKLVHEIQTGDRNSSELSTQLTNLNSEIVQKTAELEQLNAHVKALGEDELLAVQSTLATQEAERKQLQRQLTELQTASQETAKRLTQTQQEIQKHRHSLEEIDETQIVETRFIASSQHQRNEAHQSLETSREAAAEIASASEAWVQQQTAFNRQIETLLQTLEPQRTEKAQLTERNNQLQQLISEQTQLIERDEPLLAQKQTDCNQVETEFNASSEPIQNLAQNLSATEQELQIQQETQKRLLFEQREKQRQLDKIEAQTQAQQEVQGTQASKVILQSGMPGLCGLVVQLGKVEPRHQLALEMAAGGRLGHIVVEDDGVAAAGIELLKQKRAGRATFLPLNKIHAPKFTQDATLRFASGFVNYAVNLVDCDRRYKDVFSYVFGNTVVFANLEAARKNLGLYRIVTLDGELLETSGAMTGGSNSNRSALRFGTGEAAESDEAIALKTRLVDIERVLERCTEAIATLSARSKKLTQELTETRQARREQQLQLEQLQKDIKNLTAQLEGTRSQLAQNSEKLATAQSRLEILERELPGKENELQQLRHALAELEASQTPSEWQQIQATIKIQEQHLQQRETALREAEQRLKNLENQQQRLQEKIQEAETRITEYETQQISCKDAIHHVFSQITTINEQITQTRLSLAQMEQNLGEEKQKRDATELEVRSHLLRQQQLQWEIEKLKETQEKRREELIALQSQLRDMGAELPNPLPEVPDKVDLEELQKELRSLTKRLQAMEPVNMLALEEYERTQNRLQELTQKLETLEGERTELLLRIENFTTLRQLAFKEAFDAVNENFQSIFAILSDGDGYLQLENPEDPFSSGLNLVAHPKGKPVQRLASMSGGEKSLTALSFIFALQRYRPSPFYAFDEVDMFLDGANVERLAKMIKQQSQQAQFIVVSLRRPMIESAERTIGVTQARGAYTQVLGIKL

SEQ ID NO: 20123 - protein, 360 aa, Nostoc punctiforme
MTSLINVNLPEQSYEIAIAPSNLDQLGQQMANLKLGKKVLLVSNPTIFKHYGERAITSLKSAGFEVASCTLPPGERYKNLNSIQKLYDVALENRLERSATMVALGGGVIGDMTGFAAATWLRGINVVQVPTTLLAMVDSAIGGKTGVNHPHGKNLIGAFHQPRLVLIDPDVLKTLPMREFRAGMAEVIKYGVIWDAELFAQLEASKRLDQLRYVKPELIDSILTRSCQAKADVVGKDEKEGGLRAILNYGHTIGHAVESLTGYRLVNHGEAVAIGMVAAGQIAVELGMWQKEDTERQNALIQKTGLPTQLPSGVDIEAIIDALQLDKKVKAGKVRFVLPTEIGVVTVTDEVPSDIIRQVL

SEQ ID NO: 20124 - protein, 333 aa, Nostoc punctiforme
RLDTNESPYDLPPELKEKLAWTYQQVIETNRYPDGGHETLKDAIAEYVNESAAFPLSNTAANISVGNGSDELIRSLLIATCLGREGSILVANPTFSMYGILAQTLGIPVVTVGRDETNFEIDLKAAQSAIEQTQNPPIRVVFVVHPNSPTANSLTTAELAWLRSLSEHILVVIDEAYFEFSQTTLVGELAQRPNWVILRTFSKAFRLASLRVGYCVAHPEAIAILEKVRLPYNLPSFSIAAALVALQNRTLLLESIPQTLSERSKLIEILSQQPELQITASAANFIYLRLKPNGLNSQDAVLKTFHQKLRKLGTLVRHISGGLRITVGTIEEN

SEQ ID NO: 20125 - protein, 263 aa, Nostoc punctiforme
SPAWLFEHLEDPQVVIVDCRFSLADPQLGQQQYQTSHIKGSYYLDLNQDLSSPVGKHGGRHPLPEPNDIANKFAAIGVNYQKTLVVAYDDSRFAFASRLWWLLRYLGHEQVAVLDGGFTGWQKAGYPVTDVVPQPQIGTFVAELQPEKVVDINVVKTRKDNHEVVLVDSRESDRYRGEREPIDKIAGHIPGAVNYPWQEVTDSSGYLLPQEEQRCRWEQLETAEEILVYCGSGVTACVNLLSLELAGINKGKLYAGSWSDWIS

SEQ ID NO: 20126 - protein, 291 aa, Nostoc punctiforme
IWSNLGFGFAELGTVTFHAQPGNPRPRLFRLPLDKAALNRMGFNNLGAAAMATRLVQEKQESTNLIPIGINLGKSKVTPLEEAAQDYLDSFRLLKDLGDYFVVNVSSPNTPGLRSLQDASMLSAILNLLQQENTTHKPIFVKIAPDLDWVAIAEIISLAKTYNLAGIIATNTTIRRDGLKTQVINQTGKSPQEEAGGISGEPLRDRSTEVIRFIWQQTQGEIPIIGVGGIFSPEDAWEKITAGASLIQVYTGWIYEGPLMVRRILEGLLSKLEQNGFNSIREAVGLEIKSK

SEQ ID NO: 20127 - protein, 275 aa, Nostoc punctiforme
AQQQKIIILEKLERLETEFVSQLSELQLDAEERKDLILQELTEITPESILEAVNYEVKEEKEVEEPPQQPELTAEEYVKEGDELFSKRRYEDAIAAYNQAVKIQPDEPVAWLKRGLTLGRLKRYKDAIASYERAIQIQPDYHQAWCDRGVAFGKLQQHQQAFASFEKATQIKPDDAVAWLNCGLSLVALEKYEEAIVSFDKALEFQPNSPKIWDKRGYTLVRLGRDDEAIASFNKTLEIKPDYASAYYNKAACYALQRQVELSLATLKQAIELDP

SEQ ID NO: 20128 - protein, 385 aa, Nostoc punctiforme
PRCIVCKTTFLQGHGFYTGLCVECGNLNFSKRQQSADLRGMIAVVTGARVKIGHGVALRLLRDGATVIVTSRFPHDAAKRYAAEPDFREWQHRLQIYGLDLRHLHSVEQFTQHICKFYQRLDIIINNAAQTVRRPPAFYHHLIEFESLPFGELPPEIQVLVGHNHAVNTENSALLASTEEKEATFTKNSAFLSQIPLIPEDIGDNSAYFPLEGYTDDEQQLDLRPFNSWLMKDDEVSILELLEVHIINAIAPFVINSRLKRLMSNYKETNKYIINVSSMEGRFNDVDKPWRHPHTNMAKAALNQMTRTCAKEYAKHRIFMNAVDPGWISFQHPYHQAKSMQERGVYPPFDVNDAAARICDPIYLGINQGKTPFARLFKDYTEIDW

SEQ ID NO: 20129 - protein, 252 aa, Nostoc punctiforme
VVVRYQGGVNAGHTIVVKGQTFKLHLIPSGILYPNTDCIIGCGTVIDPQILIAEIDQLKELNISTDHLLISETAHVTMPYHRLIDQASEERRGSYKIGTTGRGIGPTYADKSERTGIRVLDLMDPDGLREQLEWTINYKNVILEKLYNLPPLDPQEVIEQYLGYAERLRPHVVDTSLKISDAIQRRRNILFEGAQGTLLDLDHGTYPYVTSSNPVAGGACVGTGVGPTMIDRVIGVSKAYTTRVGEGPYTTE

SEQ ID NO: 20130 - protein, 663 aa, Nostoc punctiforme
FPLTAVVGQEAIKLALLLAAVDPGLGGVAIAGRRGTAKSVMARAIHALLPPIEVVKGSISNCDPNHPEEWDDQLLAEYADKDIQDVPVEIIPAPFLQIPLGITEDRLLGSVDVEKSVKQGDTIFQPGLLATANRGVLYVDEINLLDDQISNQLLTVLSEGRNQIEREGISFQHPCKSLFIATYNPEEGGLREHLLDRIAIALSADGVLGLDQRVAAVEQAIAYSKSPQDFLKQYNEDLDSLKTQIILAREWLKEVIITHEQIAYLVDESIRGGVQGHRAELFATRVAKAAAALEGRTTVNAEDLRRAVELVIVPRATVVQTPPPDQAPPPPPPPPQQNQEEPQDESEEEQEEQEEQENQEQEPPSIPEEFIFDPEGVILDDNVLYFTQMAKRQGKSGSRSVIFSDDRGRYIKPMLPKGKARRIAVDATLRAAAPYQKARRERQPDRKVIVEQSDIRSKRLVRKAGALVVFVVDASGSMALNRMQSAKGAVMQLLTEAYQNRDQIALIPFRGEQAEVLLPPTRSIALARNRLERLPCGGGSPLAHGLTQAVRVGLNAQMSGDIGQVVLVAITDGRGNIPLARSLGEQIEPGEKPDIKGELLEIAARIRALGMQLLVIDTESKFVSTGFAKELSQTAGGKYYHLPKATDQAIAAMTKGAIADLKS

SEQ ID NO: 20131 - protein, 411 aa, Nostoc punctiforme
VDATVEIPGSKSLTNRALLVAALAQGDSILENALFSEDSEYFAKCLEQLGIPITLNPHLAQIQLAGRGGEIPAKQADLFVGLSGTTARFISALVALGNGEYRLDGVPRMRERPMGDMLTVLETGGATVNFEGNSGFMPYTVYSQGFAGGNFCLKANQTSQQLSALLMIAPYAQQDTIFEVEGTLVSLSYIKMTCRLMADFGVEVIQIGDNQFQIKAGQRYQAQHYTVEPDASNASYFFAAAAVTGGRVRVKHLTKQSCQGDILWLNVLEQMGCQIKDSDDYTEVTGPKQLQGIDIDMNDISDLVQTLAAIAPFASSPITIRNVEHIRYKETDRIKAVVTELRRLGVQVEEFPDRLKIEPGPITPAEIETYHDHRMAMAFAVTGLKVPGIVIKDPGCTAKTFPDYFTRFFQM

SEQ ID NO: 20132 - protein, 244 aa, Nostoc punctiforme
MLNVENKVIAIAGASSGIGEATAKLLAKNGAKVVLGARRTQKLEKIIEEIRNQGYIAEFKAVDVTNREDMKAFIHFAKDKFGRVDVIFNNAGVMPLSPMNALKVEEWDNMINVNIHGVLNGIAAGLPIMEAQGSGQFINTASIAAHMVGPTSAVYSATKFAVWAISDGLRQESKNIRVTIISPGVVETELGSDITDESATGFLKELRKIALTPDAIARAVLYAVSQPDDVDINEVIVRPTASAF

SEQ ID NO: 20133 - protein, 252 aa, Nostoc punctiforme
  unsure (1)..(252): unsure at all Xaa locations
VTVXVFPSIDIEQSLSTKTMXTMXIKLTIIYILPKNMLAAILFDLDGTIVNTDPIHYRAWREMLLNYSLEIDETFYKSRISGRLNPEIVKDILPQLSTTEGQKFADEKEALFRKLASNLKPLNGFSELLAWTETHELKRALVTNAPRLNAEFMLEVLGIKEAFHTVVVADDCVAGKPDPAPYQVALNKLAISAEEAIALEDSPSGIRAAVSADIRTIGIASTHDPQFLQEVGAFMAIPDFTDLQLWTLLNSL

SEQ ID NO: 20134 - protein, 328 aa, Nostoc punctiforme
KTLRNRFEIIKHLGSGGSGDTYLAVDLDLPGQPHCVVKHFQPKDSNPAVLPIAKKLFDREAEVLYQLGNDHDQIPRLFAHFDEDGDFYLVQEFIDGHALTQEIVSGQRLSESVVLSLLKDILEVLAFVHQNNIIHRDIKPQNLMRRRSDRKIVLIDFGSIKKIGALGAGLTIAVGTPGYMPSEQAKGKPKLCSDIYAVGMIGIQALTGLIPEQIKEDPNTGEVLWRDQVQVSDALANILDTMVRDRYNQRYQSATEALQALNSALLLPQSSESAGINQNSDDTYLLNYRNFVLLLGIGLGATTSFIVLILIYTFINTSASSPNKPTQL

SEQ ID NO: 20135 - protein, 399 aa, Nostoc punctiforme
MGRAKKVVLAYSGGVDTSVCIPYLKQEWGVEEVITLAADLGQGDELEPIREKALKSGASESLVADVKDSFVKDYAFGAIQANALYENRYPLGTALARPLIAKILVETAEKYGADAIAHGCTGKGNDQVRFDVSVTALNPNLKILAPAREWGMSREETIAYGEKFGIPSPVKKSSPYSIDKNLLGRSIEAGLLEDPSFEPPEEIYEMTKAIADTPNEPEYIKIGFHGGIPTTLNGIAKQPVELIEELNQLVGNHGVGRIDMIENRLVGIKSREIYESPAMLVLIQAHRDLESLTLTADVTHYKRGIEETYSQIVYNGLWYSPLKVALDAFIQKTQERVSGTVRVKLFKGNSTIVGRSSDSSLYTPDLATYGADDQFDHKAAEGFIYVWGLPTRIWSRQIK

SEQ ID NO: 20136 - protein, 342 aa, Nostoc punctiforme
MVQERTLPTFNPATTQITKEEGLWLYEDMVLGRLFEDKCAEMYYRGKMFGFVHLYNGQEAVCTGVVQSMRPGEDYVCSTYRDHVHALSAGVPAREVMAELFGKATGCSKGRGGSMHMFSAEHRLLGGYAFVAEGIPVAAGAAFQSKYRREVLGDKNADQVTACFFGDGAANNGQFFETLNMAALWKLPILFVVENNKWAIGMSHERATSQPEIYKKASAFNMVGVEVDGMDVLAVRAVAQEAVARARAGEGPTLIEALTYRFRGHSLADPDEMRSKAEKEFWFARDPIKKLAAYLLEQNLANEGEIKAIDRKIQDVIDEAVKFAESSPEPDPSELYRFVFAE

SEQ ID NO: 20137 - protein, 305 aa, Nostoc punctiforme
LGVNKMKNEKWNTENILSQKGRVAIVTGSSSGIGYETARVLANKQASVIIAVRNLDKGNKALAKILQQNKDADVKVMELDLANLASVKNFAENFQKNYVRLDLLINNAGVMIPPYSKTTDGFELQFGTNHLGHFALTGQLLERLIDTEDSRIVNVSSGAHSIGKIDFDDLNWEKRSYAKWKAYGDSKLANLYFTYELDRKLKDKGIDTLVTASHPGWTATELQRTAGGVVKYLNGILAQDITMGALPTLRAATEAGLKGAEYFGPNGFMEMRGYPIKVESNELSKDQAIAKKLWEVSEKLTNVKF

SEQ ID NO: 20138 - protein, 359 aa, Nostoc punctiforme
MALVPLRLLLDHAAENGYGIPAFNVNNLEQIQAILKAAVETDSPVILQASRGARNYAGENFLRHLILAAVETYPHIPIVMHQDHGNAPATCYSAIKNNFTSVMMDGSLEADAKTPASFEYNVNVTREVVNVAHALGVSVEGELGCLGSLETGAGEAEDGHGFEGTLDHSQLLTDPDEAVDFVEATQVDALAVAIGTSHGAYKFTRKPTGEILAISRIEEIHRRLPNTHLVMHGSSSVPEDLLALINQYGGAIPETYGVPVEEIQKGIKSGVRKVNIDTDNRLAITAAVREALAKKPEEFDPRHFLKPSITYMQKVCAERYQQFGTAGNASKIKQISLEDFAAKYAKGELNVVTKSAAKV

SEQ ID NO: 20139 - protein, 225 aa, Nostoc punctiforme
LEKLNEQFETATPKEILAWSIENIPTGLVQTSAFNVDDMIITHILYSELKHPVPVIFLDTLHHFPESLELVAKAKEIYNLDLQTFKTPDVETREAFEAKYGDKLWDTDIAKFHHITKIEPLLRGLDELNSVAWITGRRRDQAVTRANMPIFEFDGKGRLKVNPIATWTRQDTWVYVAEHGVIYNPLHDKGYPSIGDQPITTKVGEGEDERAGRWRGSDKTECGIH

SEQ ID NO: 20140 - protein, 510 aa, Nostoc punctiforme
IFGSLYPDIPIPKQPLTEFVLQRAINLADKPALIEGLTNRIITYKQLVESIRKIACSLAARGFSKGDVLAIYSPNIPEYAIAFHAVATLGGIITTVNPSYTAEELAYQLNDAGAKHLITIPDLVGQALEAIGHSKVEEVFVFGEAAGATRFSVLLEGEGEIPKVQINPQEDLVALLYSSGTTGMPKGVMHTHHSFVANFHQFQNCEPVSKADAIIGVLPFFHAYGLVMLNYSLACGATVVTMPRFDLEAFVSLIEKHKITRIHIVPPILLALAKQPIVDKYDLSSLRVLTSGAAPLSHQLIEECEQRLTNCVVKQAYGTTETFVTTYTPDERDKIKPGSVGQCLPHVECQIVNVDTQQPLGFNQSGELWVRGPQIMKGYLNNPDATASTINRDGWYHTGDIVYIDEDDYFYIVDRIKELIKCNGYSIAPAELEAVLLSHPAVADACVVKSPHPSSGEVPKAFVVLKAAATAQEIMEFVAGQVAPHKMIRRLEFVDKIPKSPSGKILRRIL

SEQ ID NO: 20141 - protein, 280 aa, Nostoc punctiforme
KLLQGRYQIVQSLGAGVFGQTYIAVDVDFPQNPKCVIKQIKVSSSEPGYLEMLRLMFLTETETLKLLGSHQQIPEFIACFEENSQFYLVQELIEGHALTAELPIAQQWGCLWNEREVVQFLIDVLSILEFVHSQGVIHCDIKPENLIRRNSDGKLVLIDFGSIQSIDFGIGAELPIYRIPVTSLGYIPPEQFIGQTQPNSDIYALGMIAIQALTGLEPLQLKVDPHTNEIFWRSQNTPVNDYLAAVLSQMIRYDSQNRFQSATEVLRVLKQITWDQPPEI

SEQ ID NO: 20142 - protein, 465 aa, Nostoc punctiforme
QAFEQRELKKSKAAADTANHAKSEFLANMSHELRTPLNGILGCAQILLRSPALPKQELYHVNIIEQCGSHLLTLINDILDLSKIEAKKLELYPDDVHFPSFLQGIVEICHIRAKQKGILFVYKPGINLPTGIHVDVKRLRQVLLNLLGNAIKFTDEGQVTFNIEVIDRAPNDVQIIKHRLRFTVEDTGIGITPVELSQIFLPFEQVGEKKRQAEGTGLGLAITRQLVQMMGSDIHVHSQIGQGSSFLFELEIPEATDWVQSAIATSEKQIIGFEGGPYTILMVDDRWENRTVITNLLQPLGFNVVEASNGKEGLEKAIALKPNLIVTDLLMPEMDGFELIKHLRHTPEIQDVLIIVSSASVFEADRNRSLQAGGNAFLSKPIQVDELLHQLEQYLNLVWIYKQSQPDGEKAKDGTTATAQLILPSPQVLQELVILASRGNFNGIIKWADQLEETDTTFAHLLTNY

SEQ ID NO: 20143 - protein, 265 aa, Nostoc punctiforme
LVGRYQIISNLGGGGFGETFVAYDTQLPGSPQCVVKKLKPQANDPVTLETARRLFDTEAQVLYKLGTHDRIPQLLAYFEENAEFYLVQELIEGHDLSQELIPGKTLSQEQVISLLQELLTILEFVHQQNVIHRDVNPRNILRRHPDGKLILIDFGAVKQITTQVITPEGSTKGTVAIGTPGYIPGEQAHGTPKLSSDIYAAGIIAIQALTGLLPEEIVKDAETNEIMWRDKATVTPEFAQFLDKMVCYDFRQRYSSATVALKALK

SEQ ID NO: 20144 - protein, 984 aa, Nostoc punctiforme
  unsure (1)..(984): unsure at all Xaa locations
SFXEFNGWNMLTNEKSQGNKIQLPYQGLTLEEVKLNRQKYGANVLTPPEREPLWKLFLEKFEDPVIRILMIAAAIAISVGIFEGEYAEGLGIVAAILLATTLAFFNEYKASQEFDILNQVYDEVFIKVIRDSSFTTVKRKDLVFGDVVYVEQGEEIPTDGQILEEISLEIDQSKITGEAEPVKKLTQADAENQGIEEGTYPAYKIYRSTIVEQGQGYFEVTAVGDNTEIGKLATAIASIENTEDTPLNHQLEKLSKLIGVVGLGFAGFTFISLLVRGFVTKELSLSSQQWYVVGLSIISVLVTLSRVWLPVIYDGLELAGSKLIAPKWLENNSLPSWLKTVGIGLVFFTIGLALGYPLGLIPGSINNWVPSTVAKALLHYFMVAVTIIVVAVPEGLAMSVTLSLAYSMKKMAASNNLVRRMHACETIGSATVICSDKTGTLTQNQMRVYEVNFPSLNSQLLPALKDVKGLIAEAIAVNSTADLEKKPLQTPRPIGNATEGALLLWLDSQDTDYISYRGNFQIKSRMPFCGQKKYMGTIGISSVTGKDVLYVKGAPEVILERCSQILTQQGLESLKNKAAIASAIKEYQRRGMRALGFAYHEVSQHSSETNLDEIAHDMTWLGFVAILDPLRPEVPDAIQACLNAGIQVKVVTGDNSETAKEIARQIGLWQEEDDFNSGYLHLTGQQFDQLSDEEASQAVLQLKVLSRARPLDKLRLVKLLQENGEVVGVTGDGTNDAAALKQAQVGLAMGSGTAIAKEASDIILLDDSFRSIVNAVVWGRSLYQNIQRFILFQLTINVVALGIALVGPFIGVALPLTVTQMLWVNLIMDTFAALALATEPPHRSVMQHSPRNPEALIVTKAMAQNIFTVGLAFLLFLVGFLRYIRRDGEITPYELSVFFGVFVMLQFWNLFNARCLGLKQSAFKGLSKNKGFVAIAITIFVGQILIIQFGGSVFRTVPLSLVDWISVIVVTSTVLWIGELWRFI

SEQ ID NO: 20145 - protein, 403 aa, Nostoc punctiforme
LTQTVPRQREILEVFLRNGWDYMRRLLTGGKADEPQLPTPAVLKNILVDLGPVYVKLGQLMSTRPDLLNAAYIEELSTLQDEVPPVPWSEIEIILRKELKRPLAETFKTVNPIPVAAGSIAQTHRATLADGREVALKVQRPGIDLTIAQDIALIQGIADLVARTEFGQTYEIKSIAEEFTKALEAELDFTREAGFTDQLRRNLSKSRWFDPTQIVVAEINWELTTEKLLVMEWLDGVPFLSADLNNNNNGKDPAVERKEITTLLFRVFFQQLYIDGFFHADPHPGNLFYLTDGRVALLDCGMVGRLDPRTQQILTEMLLAIVDLDAQRCAQLTLQLSDSAQPVILSRLENDYDRMLRKYHNVSLTQINFSQIIYEVLQVARNNKIRLPSNMGLYAKTLANLEG

SEQ ID NO: 20146 - protein, 470 aa, Nostoc punctiforme
IKFGTDGWRGVIGDEFTFERLALVAPVAAKVLYDTYFSTVGSRTIIVGYDRRFMAEDFARAVADTVSAVGFDVLLSEDYAPTPAYSWAAKELNALGALVITASHNPGKYLGLKVKGYFGGSVPSEVTKKIEEQLSVGVPLAATPGKQEKFDPWPSYTQALERKVDIAKLREAIASGKLTLFADVMHGAAAGGLARLLGNQVKEINSQRDPLFGGGAPEPLPKYLSKLFEVIKTHRETDKSGLTVGLVFDGDCDRIAAVDGEANFLSSQVLIPILIDHLTLRRNFSGEIVKTVSGSDLMPLVAALHNLSVFETAVGYKYIADRMLVAKVLLGGEESGGIGYGSHIPERDALLSALYVLEAIVESGLDLGEYNRYLQKQTGFTSAYDRIDLPLASMEVRSRLLQQLQTKPLTEIAGLAVIDCQTIDGYKYRLADQSWLMIRFSGTEPVLRLYCEASTIEQVHQTLAWAKQWA

SEQ ID NO: 20147 - protein, 306 aa, Nostoc punctiforme
MAALLGRDLLSLADISSTELQELLQLATQLKSQQLKLQCNKVLGLLFSKASTRTRVSFTVAMYQLGGQVIDLNPNVTQVSRGEPLQDTARVLDRYLDILAIRTFAQQDLETFAHYAKIPVINALTDAEHPCQVLADLLTIQESFNTLAGLTLTYVGDGNNMANSLMLGCALVGMNVRIATPDGYEPDSQIVEQARAIANNKTEVLLTHDPELAAKGSTVLYTDVWASMGQETEADNRMPIFQPYQISEQLLSLAAPEAIVLHCLPAHRGEEITEAVIEGSQSRVWEQAENRLHAQKALLASILGAE

SEQ ID NO: 20148 - protein, 691 aa, Nostoc punctiforme
  unsure (1)..(691): unsure at all Xaa locations
MKLTSIKLCNFRSFYGTTPEMIIAGGDAQNTTIIHGNNGSGKTSLLNAFTWVLYDKFSAAFASIEQLVNKRAIAETQKGQAVECWVEIGWEHEGKRYRVKRACRGYKNEGDFDAGKTQLTMWVGGDDGKWNIPIQQPDDIINQILPATLHQYFFFDGERIEEIVRSDKKAEIAEATKIFLGVEVINRSIRHLGDAKKTLENDLKAIGDSEIKQLLRQQEKIERERERITKRQTEIKEELEYQQTFKKETSNRLRELSAAKELQERWQDLESQKAANQEEYKKTKEALKKVISARGYTVLLSETTSQFRGIINDLKQRGELTSGISREFVNDLLNSQRCICGAELHEGNHSHTHVSTWLNKAGSSAVEETAIRMLAQVDEIDKQAIGFWEEVDREQTRINQLRQSISQIEGDLDNIQERLRKDANEEISSLQKRLDEIESKIDELNREQGANQQQIAQLTTEIEGLNKQIAKQKLNEDKQTLAQRRINATQDAIERLTEVRNRQEQQFRLQLEKRVQEIFTEISVTPYIPKISDKYELTLVENTTGVEAPVAASTGENQILSLSFIASIIDKVREWSEKRKMMMIPDSSTFPIVMDSPFGSLDENSRRHIAKTIPQLANQLIVLVTKTQWRGEVEAEITDRIGREYVLTYYSSKPDCEQDYIELSGERYPLVKQSPNEFEYTEIMEVERDRX

SEQ ID NO: 20149 - protein, 662 aa, Nostoc punctiforme
  unsure (1)..(662): unsure at all Xaa locations
MIFLELVLQNFGPYSGKQVINLNPKIDEETSHPIILLGGMNGGGKTTLMDAIRLALYGARAQCSTRGNLSYSDFLNQCVNNKIDPVADTRIELLFEHIENDKPIKYRVVRSWTKNPKDGKDTLGILGDSDTWPDALVNIWDEYIENLLPLGISNLFLFDGEQVKELAEQETPPPVVVDAIRGLLGLELADRLAVDLDILVNRKLKEVGNSKDLANLEEIETRLTQQQEDYQTTGEKLETLKNQVEELEQKQQEAFDKFISEGGKIAAERNQLELQQDTKTAEIEQVRQSMCELAADVLPLALIPNLLNQVQTQGEKEFRHQQVQISKDLLLKRDQRLLAWLNQVEISPIQVEKIQSFLIQDVDSLYAKTIQIEAAWLLADDESLSQLDNLIYHLQNSKISAKEKLAILKNKGEEIHTLERQVQTAAAPEDYTKLRQALETAQNQVVEAKANYETIRRRLAELETVIAKSKRELSDYTVENIKHKNSEHIITSAAKVQETLKTFREKLTLRKLNKLEEEVKNCFLYLLHKSDLVHRITIDTKTFSLLLYDLNGKPVPKHRLSAGEKQLLAIAFLWGLAKVSGHRLPVAIDTPLGRLDSSHRSNLVERYFPSASHQVILLSTDTEIGKKEVETLRENEAIAREYLLKYDSTTRQTTIQPGYFWX

SEQ ID NO: 20150 - protein, 289 aa, Nostoc punctiforme
AVAISSSGQTLISAGRDDTIKFWNLRTGKLLRSLDAHSDGVTSIAISPDGKRIVTGGISTPTMKVWDLRSFLMLKGDSGHTQPVETVAISSDGKLIASGSDDYTIKLWDLHTLKLLDTITTHSGFVSKVAFSPDMQTLVSAGGGDDNTIRLIDLQTKKTRHILKGHKTGVDAIAITPDSKKLVTGSFGQLVSRNRAISTLKLWNLQTGKLLHEFADNFSSVESLVISPNGKILICGNYDGTIKMWSLETLKLLHTSRDGSSSVLGLALSLDGKTLVSSNEDSIIHIWQI

SEQ ID NO: 20151 - protein, 3250 aa, Nostoc punctiforme
  unsure (1)..(3250): unsure at all Xaa locations
LLQALAQVELPAVKLWLVTQGAQPVGEISKELAIAAAPLWGISRVIAMECAEIWGGIIDIDPASTLEEAANLLAAELSQSKSQENQLAFRQQQRYVARLTRTVAIVSTSPLSLRTDSTYLITGGLGALGLRVAHWLVERGARHLLLLSRRPPGEQAQAAIQEMEQEGAHIQVALADVTNQAELSTILHNLNYPLRGIIHAAGVLDDGILLRQTWERFAKVLAPKIDGAWNLHLLSRDCALDFFVMFSSVASLIGSPGQGNYAAANMYLDILAHYRRHQGLPALSINWGPWSDVGMAADLNHRNLWSTENGVSYITPEQGLRALEELLKQGKTQAGVVPIAWDKFSTAVQLPLLQQLTTKVSQSPSQPFLLRQLESTPVSDRRELLMSAVQDQVVRVLRLDNSRPIDPERPLQEMGMDSLMAVELRNTLGKLVDKTLPAALIFDYPSISNLTEYLGKELGIFATTALPPTVESRELSPTEAIAVVGMSCRFPGADDLESFWQLLCNGTDAIREVPGDRWDVDEFYDPDLSFPGTMNTRWGGFINNIDHFDPQFFGISASEARSMDPQQRLLLEVSWEALEHAGYSSEHLAGSQTGVFTGISTWDYFTLQLDPPPRGGTGMALSIAANRLSYLLDLRGPSMAVDTACSSSLVAVDLACQSLRNGKCDLALAGGVNIILSPLTTVACSQAGMMAADGHCKTFDQRADGYVRGEGCGVVVLKRLSDALRDDDHILALVRGSAVNQDGRSNGLTAPNGLAQQAVIRQALQNAAVTPDGISYVEAHGTGTALGDAIEVESLWTVLKEGRTDNQPCRISSVKTNIGHLEAAAGIAGFIKLVLLLHREQIPPHLNLQTINPVLNLEQTQLQIPTSLQLWKRGEQPRLAGISSFGFGGTNVHAIVEEAPLEKAGGAEEQRSRGEEIIIERPLHLLTLSAKSESALQNLIGRYHHYLQENTGDRLADICYTANMGRSHFAHRLAFVVNSQAQLRDTLAAFNVREKSPDVLYGKLDTQRQPKVAFIFAGEGSQYVGMGKQLYKTQPQFRSILEDCDRLLQHHLQQSLLAILEDESLLTQPRYASPAVFALGYALAQLWRSWGVQPSVVMGGGVGEYIAACVAGVFSLEDGLRLITQQESWAEFEPIAKQVKFQVPQIPMVSTFYGQLLAADYIPDIDYWRRCWQAPALFKGAMLALTQKGCNLFLEIGSDPQLSEIQQQGTWLQSIDDWTVLLHSMIAFYINGVAIDWQKFEQGYQRCRVVLPTYPFERKRYWLDPAVIRSFSKKEENLCNEXELRKLIYTLVVSVLMPWNXLIYKVKIWITCLNKXKXRHVLXFLPTKIQLPYRXMQPSASFPQKMRGISNCXLWQRNRLWILANLYLLGYIGIVIYLPIAVALNSNTPATGXQQPSKQQQCGCKEDLPLVKRHXLSAVTIAVLTLMTVIILLAVVQLLLCXLVPIPRYLKLTCIPQAFGLMKFLIPSVRLRELKLATIKPVFTLTXMLWKPLTPTTKNLWGEXIMTRISKNIFITHPFRECPYKRIGLCXVYXKLTTRKSMRRIIKKRYKKAFTSPSRXVVLMAHLHSYVCXVCYTMPRIYTQVIAFRFLPMVLVVKVNFIRGTVSPGAIEYIRSLDIDRHLQERLPLSLMEYELLEYAREKYIDAPDYQPKRDSFQNALXQTLCRTGTVGIKTGKKLLQAIRMELKLKAIEYQIDSGVAHITLSAPETGNALNGEMLGQFYQALQNAIANPTCRVIVISSIGADFCTGMDFNAIFANGSRPDLAPLHAFRDCLLLIYSSPRPVITCVTGNVTGGGVGIVAASDIVLAEENVLFMLSEVLVGMIPAVITPFLLCRLSSSQVKYLTLSSRGIDGNEAKNWGLVDEIASDGMNDTLNRQIQRLFYSSPEAIAEKQTIFXHIYRSRFATPNRIRHATPTEMVRTTPNYHSHPSVXXRLFTTLVSKIXEEXHXLSKISLQIXNXILTLLITNSELQISIMSEIVTLSCLEDGIYQINLNDLQNDNQLTDELVDIFLKKIAECAKNPHLKVLLITGLPKIFCGGASLDVLQKLLRGDTEVKDLLLPTELLRFPVPVIAAMEGHAVGGGLLIALCCDVIIAAQESRYGVNFAGLGFTPGMGTTSLLPSLVGPLFAHEMILTAKLYKGRELQGRGLFNDVVPKQQVIEVAMDIARNIAEKPKHVLEMVKDTLALPRQRALQEAMSREHLMAYCMFXSSRYSIYCQRYVYFLIITVDFISVXLFFLEIRRKIMVQQTVEQQVLNVVTKHMRLNIEGLENANIDPTKSMRDLGATSLDAVEIASASMRELKVKVPRTKLGSVKNIQELVDLLAEIKIQQGXKVLRRDXSRLYKKECXVKILVPSPQSPVPPVMKNTKQQYNKEAIAVIGMGCRFPGAKNPAAFWQMLRDGMNAITQVPANRWSMDDLYDPDLATPGTMNSRWGGFLQNVDQFDAKFFGISPGEAASTDPQQRLLLEVAWETLENAGLNPQQVSGSQTGVYIGIGSNDYANVCFEDLTQLNAYFVTGNALCTTVNRLSYFFGWQGPSLALDTGCSSSLVAIHLACQSLRTREIDQALVGAVNLILSPKANIGLSQAWMMTSDNCCKSFDAAADGYVRGEGCGLVLLKRLEDAIRDKDRILGIIRGSAVNQNGFGKNLTAPNQLAQQSVISQALANAGVEPQQISYIEAHGVGTPLADVTEASALKAVLRPEGDTLPCFLSSVKTNIGHLEPAAGIAALIKVLLCFQHQEIPPHLHFQTLNPDIGDDFPFIIPTTASPWELNNTPRLAGINSFGLGGTNAHLVLEEPPLERAEEQGSRGTEEQRSRGGENTIERPLHLLTLSANSEKALRELANLYNTHIAKSVNIYLPDICYSANIGRAALKHRLAILVDTFESLQQELSAFASEQEAGEWFYGQQNSIKVGFLFTGQGTQYIDMGRELYDTQPVFREVLERCDRLLTPHLNKSLLSILYPESGSKLLLHETAYTQPALFGLEFALAEMWRSWGIKPYCVMGYSLGEYVAACVAGVLSLEDALILVAKRGQLMQQLPQTGAMAWVYTSIDKVITVLLPYQHQVGIAAIHGQEEILIAGKSQAVQQILQQLKSEGIAFLKLKINQAFHSPAVEPILDAMEELAATFTYNPPQINWVSSVTGKLVEAIAPQHWRNHLRDTLQFSTAVDTLIAQGCNLFLELGPSSTLAEAGKRYRPQSEEIWLSSLKEGFEDWQQVLSTLSALYVQGANVNWAGFDHNYQHQRLELPTYPF

SEQ ID NO: 20152 - protein, 2785 aa, Nostoc punctiforme
  unsure (1)..(2785): unsure at all Xaa locations
TKLALLVQQMRAKTDGIELLNAEPIAIIGMGCRFPGGSDNPEAFWQNLRNGVDAISEIPPDRWDADAYYDPNPDAPGKMYSRYGGFIGQIDKFEPEFFGISPREAQSLDPQQRLMLEVSWEALENAGIPLNQLQRSKTGVFVGITTTDYLQLQTGLADDELINAYTNSGGAINFAAGRLSYFLGLQGPSLAVETACSSSLVAVHLACQSLRNQESDLAIAAGVNLIVIPEMNVRLCKAKMIATDGRCKTFDSSADGFGRSEGCGVLVLKRLSQALADGNNIVALIRGSAVNQDGSSSGLTVPNGLAQQAVVRQALANAGLEPHQVSYIETHGTGTSLGDPIEVNALGAVFGKEKTANQPLMLGSVKTNIGHTEAAAGVAGIIKVALALQHQEIPPHLHFQTPNPHIAWQDLPVAVPTKLTPWLPHEQRRIAGVSSFGASGTNAHIVLEEAPVKKVGGAGEQGSRGEEITERPLHLLTLSAKHPQALSEIAQRYIKYFSSHPDILLGNITHASQVGRTHFSHRLAIIAADNAHIQQQLQAYLDTTEVIGIYHGQASQQTKKIAFLFTGQGSQYRHMGRQLYQTQPSFRQTLDECDTLLQPLLGESILQVIFSDNLEDTRLDQTAYTQVALFVIEYALAQLWLSWGIRPHAVLGHSVGEYVAACIAGIFSLEDALKLIVQRAALMQGLPQGGGMAAVFTTVEQVTPLIADYPQQLSLAAINGEHSIVLSGELEILTTVLQKLESEGIETRRLQVSHAFHSPLMQPMLTEFAKVAASVKYQQPQLDIISNVTGKIVRHEEMSNATYWVEHILASVQFAASMQTLYQARYEVFIEVGSHPTLLGMARRECPEHLDMEGLWLASLRKGREDWQQLLDSVAQLYVAGVEVDWRRFEADYPRSQVILPNYPWQIQRYWVSDGKKKRSPLQKLLHPLLGQRLRSPLADTIIFERQLSTADVPFIDDHRIYGMVVVPTVAYLEMAWAAATEVIGKGVCVLEQVAIREAFVLAEGETRTTQLLLTPDDKGYTFQIFSLASPEKEDGTAWNLHASGKLRVEPIPEHQIIADFSPTALQERSLQELSGGVFYPCLHKRGLEFGSSFLGIETLWKLQNEVLAKIQMPVSIMAEAGNYNMHPAQFDACLQLFLADLPSEDDVFIPIGLDKLCFYGQPTTELWSYMRLHIGNTPNPETFDVDVCIVNPAGEVVAQVEKMHLKRAPRKALQRIAQKSLHDWLYEIKWQPKVLQSPIQATVTGHWLILADHSAIAVELAEFIEKSGQTCKLVFASQEYHRQDFEQLFENCAKDQELRGVIYLWGIDSTLTDKTSASFPALLQALVAAKLSQQPKLWLVTRGCVPVELKPGELSIAQTPLWGLGRTLAVEHPDLWGGLIDLDPGTSLVEQASSLRTEINHPTEEQVAFRAGQRYVPRLLRYQPSFSVEPLKIKSNATYLITGCFDDIHVNLASWLIEKGAEHLVLMGEGEPAPEICDRLKQMHAINPTVVLFNFSSSKSEQVANVFQYIEDKLPSLSGIIHTEGIHEDSILLHQTRDGFGRVLAAKVTGAWNLHILTQEIPLDFFVMFSSALCLLGSPGQGNYAAANAFVDALAHYRQSLGLPALSVNWAPWGHQDNPIVRRWATWGVDTIDWQQSLKILEQLLTDNVAQVAVMPVQWSKFTQAFPRGKKEAEGQRGWGAEGKEDGLLPTREGAYNENIFSALLVYPGSLLSSQPKSSPASQLYERLENAPPSRRKDLIFEAVQGEVAKVLRMKSAQVDGKKPFNTMGMDSLTAVELRNALMELLKVTLPATLVFEYPSLESLSEYLAELVDSQNPIVRNKGTTYCSQQDXLGCRANGTVFRRXARSPTSSRTGNSXXVMKMNTPERTDQLRRALVALKELRTKLDAIEQDRQEAIAIVGMGCRFPGGVNNLETYWQLLSQGIDASREIPSDRWSVDSFYTPHPDTPGKMYTRRGSFIDQVDGFDADFFGIAPREAVSIDPQQRLLLEVAWEALENAGQSTEKLEGSATGVFIGISTNDYARFHINSGDPNRIDAYSFIGCTPSVVSGRLSYVFGLQGPSLTIDTACSSSLTAIHLACESLRKCECNLALAGGVNLMLAPETTIYFCQVKALAADGRCKTFDAAADGYGRGEGCGVVVLKRLPDALADGDRIFGLIRGSAVNQDGRSNGMTAPNGSAQQAVIRQALAAAAVQPQEIGYVEAHGTGTVLGDPIEIRALASVLCADRSQDNALIVGSVKTNIGHLEAAAGIAGIMKVVLALQHRQIPPHLHFKQANPHIDWQELPLVIPTQLTPWISDRLLAGVSSFGMSGTNAHVVLEAAPVEEDKGTRGQGDKRNDESDRVYLLPLSARSPEALKEIAKAYRELLSGSLKLEDICYTASLRRVHYEYRLGLVGNSAEELANQLQDFLEDIPNSDVNWGYQGSSRRQQIAFVFSGQGSQWLGMGQELLTQEPVFREALEECDRIIQSHTYWSLIAELSAPPEKSRLDETEIAQPAILSLQVALVALWRAWGVEPSAVVGHSVGEITAAYVAGVLTLADALWIVIQRAKLMQQATGHGKMAMLHLPEKAVAELIAPYEDKIAIAAINSPFSTVISGAIEAIEIILEKVEQQGVFCRRLPVNYAFHCPQMDGYSRELERILEDIQPKSPYLQIFSTVSGQPEDSPLPLCASAPLPLFDAAYWGRNMRQSVRFAEAMDSLIQAGYNLFVEVAPHSVLAKDMLECLSQTQQQGTVLPTMRRGDSTVSLRSLAKLYTLGHKVNWDNFYPNGGKFVQLPTYPWQRKRYWI

SEQ ID NO: 20153 - protein, 331 aa, Nostoc punctiforme
RTERVVENLNRALHHIFAVDPQVFLIGEDILDPYGGAFKVGKGLSSNYPDRVLTTPISEEAIVGIGGGLALCGNKPIIEIMFGDFIALGFDQILNFASKSVSMYGTKLDLNMIVRCAVGGNRGYGPTHSQSLQKHFVGIPNLYLFELSPLHDNIAVFEKLVNLTFPCIFFEDKVLYTQRIYADGLIDDLFSYEFLDSAKNFARIYADSFEENNCLLISPGGLVPRCLAAARELFIDWEIETQIIVPSQLYPFELETIIDLLADSTHIFIVEDSVAGGTWGSEVAHQIYSRLWGKLKNPVKLIHSKNSIIPSSAHLEKQVIVQKEDICNSVK

SEQ ID NO: 20154 - protein, 230 aa, Nostoc punctiforme
IILMIRHFELSLLELFSSGKLNGTTHTCLGQEYIPVALKAVLTDSDFILSNHRGHGHYLARFEDPEGLLAEIMGKEGAVCHGVGGSQHIYRKNYLSTGIQGESLPVAAGIALHLRRQGNFGMAVVHIGDGTWGEGGVYEALNIAQLWGLPVLVIVENNKIAQSTPTQLQMAGTIAGRVQGFGINYLKVDSIDINEIRTLISSHIQSARTKSLPLVIEFDTNRVGPHSKGD

SEQ ID NO: 20155 - protein, 425 aa, Nostoc punctiforme
MTATSPRLKHEVKDLGLAALGRQRIEWAGREMPVLKQIRDRFAIEKPFAGLRLVACAHITTETAHLAIALKAGGADALLIASNPLSTQDDVAASLVVDHEIPVFAQKGEDNATYNRHVQIALDHRPNIIVDDGSDVVATLVQERQHQIADLIGSTEETTTGIVRLRAMFREGVLTFPAVNVNDADTKHFFDNRYGTGQSTLDGIIRATNILLAGKNIVVVGYGWCGKGTALRARGMGANVIVTEIDPIKAIEAVMDGFRVLPMAEAAPQGDIFITVTGNKHVVRGEHFDVMKDGAIVCNSGHFDLELDLKYLAAQAKEIKEVRPFTEEYKLKNGKSVVVLGQGRLINLAAAEGHPSAVMDMSFANQALACEFLVKNKGKLQPGLHSIPVEVDQEIARLKLQAIGITIDSLTADQIEYINSWTSGT

SEQ ID NO: 20156 - protein, 259 aa, Nostoc punctiforme
KLAAQSHPNHQTIVKISEKVAFGGEELVIIGGPCTVESLEQMEIVAQKLSTASIQGLRGGVYKPRTSPYAFQGMGEEGLRILARVRSHYNMPVVTEVMSISQIEVVAAHADMLQVGSRNMQNFDLLKALGQAGKPILLKRGLAATIEEFVMAAEYILSHGNPDVVLCERGIRSFDDYTRNVLDLAAVAALKQITHLPVIVDPSHAVGKRELVAPVARAAIACGADGLIIECHPQPEKSVSDARQALSLEDMVRLVDSLK

SEQ ID NO: 20157 - protein, 284 aa, Nostoc punctiforme
LNVIQWYPGHIAKAEKKLKEQLKRVDVVFEVRDARIPLATHHPQIGEWVEGKTRVLILNRVDMITPQMRSLWIDWFKRQGEVPYFTNAQHGKGIAEVARAAQAAGVELNQRRSDRGMLPRPVRAVVIGFPNVGKSALINRLLGRRVVESAARPGVTRQLRWVRISEHLELLDAPGVIPLRLEDQDAALKLAICDDIGEASYDNQLVAAALVDLFNYLEAVTTDLLPKKPLQSRYQLDSTSDTGDTYLHALAEHRYKGDVERAARQLLTDFRKGLLGEMSLELPP

SEQ ID NO: 20158 - protein, 259 aa, Nostoc punctiforme
  unsure (1)..(259): unsure at all Xaa locations
MAIATINPATGETLKTFEALNDTEILAKLDLANQAFEKYRQTDFSERSQWLQKAADILEQDKAEFAKLMTLEMGKPFKAAIAEVEKCAVVCRYYAEHAPSFLADVSVKTDASQSFVRYQPMGAILAVMPWNFPFWQVFRFAAPALMAGNVGLLKHASNVPQCALAIEDIIRRAGFPEGAFQTLLIGAAKVADLMADDRVKAATLTGSEPAGISLAVAAGKQIKKTVLELGGSDPFIVLESAALETAVVTATHKRXLXXG

SEQ ID NO: 20159 - protein, 276 aa, Nostoc punctiforme
IDLSGKRAIVTGAASGIGVETARALAHAGAEVTLAVHNVDAGAKTAADITAITGNQNIHVAKLDLTDRGAIAKFIAAWNEPLHILVNNAGVMALPEQHTPEGWEMQFATNHLGHFALTLGLHDALAADGAARIVSVSSSAHMLSPIVFDDIHFAFRPYDPWLAYGQSKTANVLFAVAGTGRWFRDGITANALMPGAIATNLQRHVGGIQTPAELQKTPEQGAATSILLATSPLVEGIGGRYFEDCNEATIVTQQTKDYSGVAPYALNTNNADRLWE

SEQ ID NO: 20160 - protein, 249 aa, Nostoc punctiforme
MKKLEGKIALVTGGNSGIGLATAKQFVAEGSYVYITGRRQVELDAAVEAIGKNVTAVQSDVSNLADLDRLFATIKQEQGHLDIIFANAGGGQIAPLGAITEEHFDKTFNVNVKGLLFTVQKALPLLPEGASIILNASITSIKGTPAFSVYSATKAAVRSFARNWILDLRERKIRVNAISPGVVPTPGYDYLGLNDQQLQEFVDSQASAIPLGRVGTPDEIAKAVVFLASDDSSFVNGIELFVDGGMAQI

SEQ ID NO: 20161 - protein, 460 aa, Nostoc punctiforme
YDDIIIGGGKAGKTLAPALVADGRKTALVERSLNMIGGGCINIACIPTKTMVASANVANTVRNSAAYGVKANTPIVDLAEVIQRKRAVVQSAREMNLHNLETALDKNLIIGEARFVAPKTIEVTTTEGKNRLLTAERLFINTGTRPLIPSIPGLTEVEFLTSESIMELEYLPEHLIVLGSGYIGLEFAQMFRRFGCGVTVIGQSEQILSQQDPDIAIAVQTLLERNGIEFLLKAKVLRVVRKASPLENRTGNETILQIQVGDREITLQGSHLLVAVGRAPNTDSLNLAAAGVATDTRGFIQVNDRLETNIPGIWALGDINGGPQYTHISLDDYRIIKANLIDGGDRSTGDRLVPSCLFIAPELAHVGLTETEAQQQGYAIRVAKIDASAVPRARTLGQTDGLLKAIMDTETGRILGCSLLCHEAGEVISTVQMVMQAQMPYTILRDGILTHPTMTEGLNI

SEQ ID NO: 20162 - protein, 310 aa, Nostoc punctiforme
KTSKVGIIGAGNVGADVANALVLLGRCVRVVLFDRTLSKAEGQVWDIEDSIPLLKEMEIIPSNQYEDLADSDIIIIVTAGVQPKLGQTRLDTLSDNAEIIRSTIKELDRVAPNSIVIIISNPVDVLTRIAQATSTRAENLIFGSGTVLDTARLRYQLGKQLNVAKQDIHAYVIGEHGDSQFVVWSSAFIGGILLTEFPIPQGATLEQIQQEYAQLTRKRGYNIFERKGYTSYGISTVVCQLVDTILRDEKQIFPVSTRADSNYGVGSEVVLGLPCIIGSTGIERQLLLSRNALEQRLLEESANKLNEAYN

SEQ ID NO: 20163 - protein, 236 aa, Nostoc punctiforme
KVVLVTGASSGFGQLTAKKLAAVGYWVFGTSRKSYPASGDVEMLKLDVTSDSSVQLCIKQLLTRTNRIDLLINNAGQIHASMLEETSLQQAKEIFETNFWGVVRLTNAVLPVMRQQRSGHIINISSVAGLIGAPGQGFYSASKFALEGYSEALSVELDPFNIKVSLIEPGYFKTNFNHAMLPPTFNYADYDNVRDVIRSTVTQAIAQGDDPTKVAQTIVFAACSRSPRLRYRVGNE

SEQ ID NO: 20164 - protein, 386 aa, Nostoc punctiforme
MKLAARVSQVTPSLTLAIAAKAKALKAEGIDVCSFSAGEPDFDTPAHIKAAAVKALDEGKTKYGAAAGEPKLREAIAHKLKNDNGLDYKSENVIVTNGGKHSLYNLIVALIDLGDEVIIPAPYWLSYPEMVTLVGGVAVIVPTDATTGYKITPEQLRKAITPKTKLFILNSPSNPTGMVYTPDEIKALAQVVVDADIFVVSDEIYEKILYDGAEHISIGSLGKEIFDRTLISNGFAKAYSMTGWRIGYLAGPVEIIKAASTIQGHSTSNVCTFAQYGAIAALQSSQDCVEEMRQAFAKRRQVMLDRLNAIPGLSTAKPDGAFYLFPDISKTGLKSLEFCDALLEKHQVAVIPGIAFGADDNIRLSYATDMATIEKGMDRLEKFVKS

SEQ ID NO: 20165 - protein, 339 aa, Nostoc punctiforme
METRFLGKSGLKISVLSFGTMTFGGSDFFQEIGATQVDEAQHLIDICLDAGVNIFDTADVYSNGLSEEILGKALGKRRSDVIIATKAYGRMGQGVNDTGLSRYHLIRACEDSLRRLDTDYIDLYQVHGFDALTPLEETLRALDSLVHSGKVRYIGCSNYSAWHLMKALSVSERLNLEHYVSQQVYYSLVARELEFELIPLSLDQGVGILVWSPLAFGFLSGKYRRGQSQPEGTRRAKIGDIGTVSDLEKGYDIVEVLHEVANNRGVSVAQVALNWLLRQSGITSVIVGARNEQQLRDNLGAAQWELTLEEVNRLNEASAITPIYPYWHQRKFGAERIPQ

SEQ ID NO: 20166 - protein, 1017 aa, Nostoc punctiforme
  unsure (1)..(1017): unsure at all Xaa locations
RFRXNFVFENKENCKFTTESYXKNQFRXKIMANIIGTNGNDTLVGSYEADTINGEAGNDTITGNEGDDTLTGGGGKDQFVYNYYTGIDIITDFGGIGKGVNPSAGVIAEVDTLQFQGAALTDRNMLLTQNGKNLEITFENVLDSKVILENFALENLENLSKSTGASVDLGNIEFDGQTSITDSFDVFNANSTQSTIFNKNTVTFLNDLSNNVSGFDNSDDVINGQGGNDRIDGLSGDDILRGGAGNDTLIGGAGNDTLIGYQGNNALIGDIGEDYLNVDTSTGDNTLNGGIGDDTLNARGTTGNNSLSGGDGNDYLSTSSFPIYSGYSYIASSSNNTLDGGAGNDTLNAESPSGDNLLSGGDGNDYLSTSGTKSDNGQLNFTSEGNNTLDGGAGDDRLYADISTGNNLLSGGDGNDTLSTSGTYTRNSFIVPSSGNNTLNGGAGDDYLYASASTGSNFFSGGDGNDSFSLSTISSDGSPSNSYLVTQTVDGGKGDDLLSFNLLPFHDSDSNVAGGIITTFNPTTNKGTITAGTYGVNYKNIEKLNISGTADDDLILGSNGNDTLSTGNGGKDTIDGGKGDDVISIDYSNATSKIITTFNATTNTGLITAGTYQISYKNIERLNITGTAYDDNILGNNGNDTLSTGSGGNDTINGGQGDDILSVDYYTNTTGITTTYNTTTNAGVITAGSNRVSYKNIERLDISGTVSDDYIIGNNGNDTLSGGYDGNDTIIGGAGNDVVIGGKGNDILTGGVGNDKFVYDLLESNYDTGTDIITDFGGIGKDSNPSQAVIASLDTLEFIDNSGFRLFSAQNLQLTQNGNNLEITFEDLFNSSNSKVILQNFQLENLDGENILFPGQTTITNSIDVFDANSTQTSLLNKNTVTFLNDLNNNITGFDNSNDVVNGQGGDDIINGLSGNDLLRGNAGNDTLIGGAGNDTLYGGAGNDLLYGGAGSDILTGDNGNDIFAFAAGEGTDTITDFTKNNDLIGLYGGLSFGQLSFSGNNILVTSTNEILATLTG

SEQ ID NO: 20167 - protein, 236 aa, Nostoc punctiforme
ISKSYGSHQAVNNLSLQITEGSFYALLGPNGAGKTTTLRMIAGLLRPDKGDVMILGHSIRRAPQKAKQTLAYLPDEPLIYNKLRPMEYLEFIAGLWGINPPKAQILAQEILKQLNLWNHRGDLSETFSRGMKQKLALAGALIHQPRILILDEPLTGLDAAAARLVKNMLAEYVNQGNTVILTTHIMEIAERMAQRIGIINHGRLIAEGTLDELRTQSGEAGASLETVFLELTQNHD

SEQ ID NO: 20168 - protein, 335 aa, Nostoc punctiforme
YDCIIVGAGPAGGTAAYHLAKQGRSVLVLEKESLPRYKPCGGGVSPAIAQWFDFDFSPAISVKADSFRFTWKLGDPVEAKIATEEPVWMVRRDIFDHFLVQQAQKQGAEVRDNTEVTGIEFKADHWQVNTANGPITGRYLIAADGAKGLMAKWLGFKERKRRLAAALEAEVSTTVKDKSTIHIELGLVKNGYIWNFPKADGYSIGVGTFGGGEPQDFKKILDEYARSFNLDITTSKKYGYPLCLWDGKQKLHTQNAVLAGEAACVVYPMTAEGIRPSIFSGLIAAGAINEALSGDINALEKYSEAINEEWGTEMAWAQKLAGAFYRFPGIGYKVG

SEQ ID NO: 20169 - protein, 212 aa, Nostoc punctiforme
MALRLGDTVPNFTQASTHGDIDFYQWAGDSWVVLFSHPADFTPVCTTELGTVAKLKPEFDKRNVKAIALSVDDVESHKGWVGDIEETQSTTLNYPILADADRKVADLYDMIHPNANAAVTVRSVFVIDPNKKLRLSFTYPPSTGRNFDELLRVIDSLQLTDNYSVATPADWKDGEDVVIVPSLKDPEVLKEKFPKGYEEIKPYLRMTPQPNK

SEQ ID NO: 20170 - protein, 359 aa, Nostoc punctiforme
RLSEQIDRTRTGNMVIQVVNSQQQPVSGVEVKLEQVAHEFEFGTALSTQMFAQGANPNDQAQYFNLSRQLFNGTVHENALKWYATEEQQGHVNYVDADRILSWSETHSLPLRGHALFWEVEKWNQPWLKSLSKQELRLAVERRATEICDRYRGRIREYDVLNEMLHGDFFRQRLGEDIVKTMFERCHAADPNAVLYVNDYDILNGRRLDDYVQQIRSLLAQGVPIGGIGIQAHILREKITPAQIQHSLDTLAQFNLPIKITEFSTLANTEQEQAKILLNLYQIAFAHPMVKGILMWGFCQKAHWVPQAAIFDRNFQPKLAAKVYEELVFQQWWTRASGITNQNGQFSTRAFFGQYQVTV

SEQ ID NO: 20171 - protein, 191 aa, Nostoc punctiforme
PDNSWIAELGRTIVLSIVLALGIRTFVAEARWIPSGSMEPTLHGTPNQWEADKIIVDKLKYKFADPQRGDIVVFSPTKELQKEQYQDAFIKRVIGLPGEKVQLKDGKVYINNKPLPEGNYLAPSQSTVINVCQSGPQPPFLEKPQTIPDDSYLVLGDNRNNSYDGRCWGVVPRQNIIGRAVVRFWPLNHIG

SEQ ID NO: 20172 - protein, 616 aa, Nostoc punctiforme
RSVTTVMQVVPKELRYVAILTLLGGAGPAIAIWLNKIIIDEITRLLSTGTTQNAIALILSQPVLLSSIAGSLLVNLVSDAIANINSFVYTSLRDRITGFIQGQVIEKVATFEDIALFETPDLLNLLQLTEKGMQRLPELCIRLVTMLEGIFIFIPAILLSVSLAWWIPLILFSCVTPAMYVERKYRKQVWRVEKTQASLLREMNLYKTVLTGETYAKEIRLFSLQPLLLERWYGLYRTIFRAMEQIRRRGTTAVISWSLLSGLGFALPYLYVVQGVLDRTHTLGDLALYTGVILEVRRSLDNLMSGGSELYDIALATTPIFQLLELEPQLSSSQSKSWGKIRESAANNQNFQRNGNRESLSGEALQTGIDIKNLSFTYPNSERPILKNINLKIHPNEMIVLVGENGAGKTTLTKLLCRLYDPSQGAIIWNGEDLRSLPLEDLRSRIDVVMQDYARFPTTVRENVAFGNLPKMQDDEAIKEAIAEAGLAKVIEKLDGGLETLLGKQLEGGIDLSGGQWQRLAIARALLRLSPAELLILDEPTANLDPKTEHEIYNILRTLAKGRIAVVVSHRLALAKLADRVVVLEHGQIIEVGTHDELIALGGQYHLMFTRQASSY

SEQ ID NO: 20173 - protein, 1117 aa, Nostoc punctiforme
  unsure (1)..(1117): unsure at all Xaa locations
GLFNFGQSYLAEAASQGVAYDLRNKIFSKIQNLSFSYHDQAQTSQLLTRVTSDIEQIRTFVGTSLIQVIGGVVTLVTIAVILLVMNWELALITLTAVPISAWLMARFVGRNNKLFRQVQEQLSDLNAVLQENLLGIRVVKAFVRESAERSRYTTLNDGLVRANMKTISAIHNTFPFIFLLSNFVTLAVFGYGGAQVIGRRFSIGELVAFNSYLALILQPILLIGFAAPAIAQSAASAERVYEVVDAEVEIRDRPGAVPFDTCVGRITFENVSFRYPGATTETLKEVSFETRPKELIAVLGMTGSGKSTIMNLLARFYDVTGGAVRIDGRDVKDFTLKSLRSRIGIVFQETTLFSGTIRENIAYAKPDATLEQVIEVAKTAQMHDFIISLPDGYETIVGERGVGLSGGQKQRIAIARTLLTDYSILILDDSTSAVDAKTAAHIQAELDGLMRQKACTTFVVAQRISTVKNADRIFLMDKGRLVAQGTHEELMETSPLYGVILESQVKAKEKNDTKLDKXCCLRFLXQPSNPKFKIAMRGTIPVVASEQASKQLSTLRRFLQYLLLYRKEIPIALTLVFIGAVTQAIGPFFLGWSIDRLIEKGNLQGLLLLLGLLALNYGLGIIAIRGQIIRVGWIMQRLLAQLRQDIFLKIQSLPLSFFDRSEAGDLMSRLLNDVNTVNQAFGLTIAQMLGNIFSLVGIIIAMLSINLQLGLLSNLVVPLMIFTTSLFARWARARFRVTRQTIGELSAKLEEDIGSVREAQAFNRVQTNIAQFDVLNAANRDANVEAVAITSAFLPSIDFLNTLATAGVLAYGGYLAVTGAVTVGVVTSFLLYVQQFFRPIQILSQFYTQAQSAFAGLERIFLLLDEPSELKDAPDATEMPPIQGEVRFENVKFGYNPDQLVLKGVNLHAYPGQMIALVGPTGSGKSTIINLILRFYDVFAGAVKIDDIDVRSVTQASLRRQIGIVLQDNILFSGTVAENIAFGAPHTTQADIEAAAQLANVHEFITSLPQGYTTQLGERGAPLSQGQRQLISIARAVLINPRILILDEATSSIDTRTEALVQSAIARLLQGRTSFVIAHRLSTVTQADQVLVIQQGQIVEQGTHAELIERQGVYANL

SEQ ID NO: 20174 - protein, 552 aa, Nostoc punctiforme
NMSEALFCIENLRVAYPQRSGEEASWAVDDVSFTLQPGERMGLVGESGCGKSTIGRAVMRLLPASSCVEGKVTFQGQSVLDLMPNQLRKFRGEAIALIFQDPMTRLDPLMTIGKHCIETLQAHSPQLSTREAKEKALATLAKVNIPASRWNQYPHEFSGGMRQRVAIALALLLNPKLIVADEPTTSLDVTVSAQILQELTRLCGEENMGLLLISHDLAMVAEYCDRIGVMYQGKMVEMGSTETVFRQPQHEYTRSLLKAALHIQAVNDDGELIIANDSEKQLPIINKQSPILSITELKQYYTIEPNFIERLFNTQAQTIKAVDGINLDIYPREILGLVGESGCGKSTLSRTILQLIRPTSGKVKFLGQDLTTLSPQEIRSSRRQIQMVFQDPHACLNPAMTVGQSIADPLFIHNLADLVKAKEQVLWMLEKVGLTPSEVYYERYPSDLSGGQQQRVAIARALITHPKLLICDEPVSMLDASVQSQVLDLMLQLKEEFELTYLFITHDLWLARFLCDRIAVMNGGKIVELGLTKTIFANPQHPYTKTLLAAAP

SEQ ID NO: 20175 - protein, 499 aa, Nostoc punctiforme
DFLYGGNENDTVIGFAGDDNLYGGLGNDYLYGDEDNDKLYGGLGDDYLYGGLGNDYLNGEEGNNSLYGEAGNDSFYAANSSGNNLLDGGAGNDELYVYSSTGNNTLKGGSGNDTLDISFSYGKNILDGGSEDDRLSARYAVGNNTLRGGTGNDYIAADLSAGNNVLDGGDGNDTLDINYQWKGKNTVSGGNGADTFYAYGVQGANTLNGDSGDDSFYISSPETVLYSLVTQTVDGGTGNDYLYIDYSNAIASITSTYNPTTNQGLITADTNQVRYKNIERLEVKGTAYDDNIVGSNGDDTLNGGNGGNDTLKGGAGNDILRINDNSRNTNTAYGGTGNDFLYAEATGGTSLLDGGDGNDYLSIANSYSSVFGRSNTLNGGVGNDTLNAKATYGGNFLNGGVGNDFIYADYSSGTNILDGGDRDDYLSAAGASFHFDNTFFTLKGGTGNDTLNANSSFSTNNLDGGTGNDRLTVENSYKNNLLNGGDGNDYLKGGQAPES

SEQ ID NO: 20176 - protein, 319 aa, Nostoc punctiforme
MMQAVCDQIAIAMERASLIAFLQKQTEQLQEANRMKDEFLGILSHELRSPLNAILGWAQLLQRSKLSESQMAKATETIERNAKAQTQLIEDLLDISRMIRGKLHLNVSTCNLVPMIESTLETVSLAAQSKEIDLRFSIISSKETRNTPLGILPVVTIAPNSDLGLEINHENVESREAESQSNQRSKDSSENSQFLVSGDFERLQQIIWNLLSNAIKFTPTGGQVELQLSVVTGEEKQHITEKYAQIQVIDTGIGISPDFLPYVFDRFRQADSSNTRSYGGLGLGLAIVLHLVELHGGTVQVDSPGKDQGATFTVKLPLL

SEQ ID NO: 20177 - protein, 226 aa, Nostoc punctiforme
KRIAVVTGSNRGLGYAISRQLSKIGNRVILTSRNETDGLAAKGQLTNKGFDVDYHTLDVTNDGSVQQFTEWLRETYGKVDILVNNAGVNPTTKPEESSLLTVQLETMRSTFETNVLAVLRISQALIPLMKVQNYGRIVNISTEMASLTSVPTDYYPLAPSYRLSKVGVNGLTVLLAKELQGTNILVNAYSPGWMKTDMGGDDAPFTAEEGAETAVYLATLPDGGAQ

SEQ ID NO: 20178 - protein, 783 aa, Nostoc punctiforme
IILDVGGMKCAGCVNAVERQLTQHPGVKSACVNLATEVAVVESETGAVDADALAQRLTAVGFPTQPRKARATVAGEISTLPDPAERQRREMRSSVRQLAIAAMLLLLSGSGHFGNLGSSVLPLLNNIWFHCGLATVALLIPGRPILVDGWLGWRRNAPNMNTLIGLGTLTAYIASLVALLFPQMGWECFFDEPVMMLGFILLGRTLEQQARGRAAAAFRKLLALQPQVARLIANPEKGGVGSSSVEIPAEQVRVGEWLQVLPGDKIPVDGEVVLGQTTVDESMLTGEAVPVIKQPGDSVTGGTLNQSGAIAIQTTRTGSDTTLAQIVALVEAAQTRKAPVQKLADTVAGYFTYGVLTASLLTFVFWYFFDTHLWTDIAMSGEMEMMSHAIHQAPRSPLLISLKLAIAVMVVACPCALGLATPTAILVGTAMGAERGLLIKGGDVLEKVHQLDTVVFDKTGTLTTGHPIVTDCLLISETGSGNPYSLIQLATAVESGTHHPLAKAIQQEAQRQKLSIPEAVDFHTEPGLGVSAVVEDTVVLLGNWDWLSWHGISISETAQQVAQDLATDGKTVVCVAVGGTLAGLIAVSDTLRPDAQSTVDKLRQMGLRVMLLSGDRLEAASAIAKQLGLDSADVIAGVPPAKKAAAIKNLQQAGTKGTPNSSLLTQHSVVAMVGDGINDAPALSQADVGIALHSGTDVAMETAEIVLMRDRLNDVVESIQLSRATFNKIRQNLFWAFAYNTVGIPLAAGVLFPSLGFVLNPSGAAALMAFSSVSVVTNSILLR

SEQ ID NO: 20179 - protein, 326 aa, Nostoc punctiforme
  unsure (1)..(326): unsure at all Xaa locations
MXEDVNNQLEXFRMSVIFFPPPIQQINSEIIRSAGVDLYVLRLDLMHPWVNGNKWFKLKYNLLEAKEKNFTTLLTFGGAYSNHIYATAAAGNLFGFRTIGVIRGEERLPLNPTLNFAVQQGMQLVYTNREMYRQRNTPVVEEYLQQRFGEVFIIPEGGSNLNGVRGCMEIIGDAMSTAVTERSRSAGYAYAFDRICVACGTATTLTGIALSLHQGQRAIAFPVLKNGSFLAQEIESLLTNYLASDLPTPSNSPAFWELVCDYHFGGYAKVNKELLLFSQQFREEHGIPLDYVYTAKMFYGVMDLLKQGFFSKGDSLLLVHTGGLQG

SEQ ID NO: 20180 - protein, 321 aa, Nostoc punctiforme
VVAVIDAGILKYQPELVKQLVAYTKFYGEVLAIAAEPMIISGGEAAKNDRTLVEQIQQLIETAGLCRHSYVLAIGGGAVLDLVGYAAATAHRGIRLIRVPTTVLAQNDSGVGVKNGINAFGKKNFLGTFAPPYAVINDSAFLTTLDDRDWRSGIAEAVKVALIKDANFFDFIHSHSKALGRRDMDAMQQVIYRCAQLHLEHIANSGDPFEMGSSRPLDFGHWAAHKLEHLTNYRLRHGEAVAIGIALDSTYSYLAGLLDCSEWQRILNTLSALGFTLYVPELAQKLSQQEHPDCLFRGLTEFREHLGGELTLTLLKNIGKA

SEQ ID NO: 20181 - protein, 335 aa, Nostoc punctiforme
  unsure (1)..(335): unsure at all Xaa locations
EITRISQYXETWKVTVEKSIGTHKVVLGLIGDTTSIDKLQIQEYSPWIEQVLRVQQPFKRVSREFRHGEASEVVVPTPNGDVYFGEHHPIVVVAGPCSVENEAMIVETAKRVKAAGAKFLRGGAYKPRTSPYAFQGYGESALDLLAAAREATGLGIVTELMDAADLSAVARTADIIQIGARNMHNFSLLKKVGAQDKPVLLKRGMSATIDEWLMAAEYILASGNPNVILCERGIRTFDGKYARNTLDLSVLPVLRSLTHLPIMIDPSHGTGRSEYVPSMAIAAIAAGTDSLMIEVHPNPAKALSDGPQSLTPDKFDRLVQEMSIIGKVVDRWSTP

SEQ ID NO: 20182 - protein, 258 aa, Nostoc punctiforme
KKTALITGAASGIGYQLTQIFARHGYNLVLVDKNEQKLTEIINEFPQKFGIFVKILAKDLSIPTSPEEIFRELQQESIKIDVLVNNAGFGTYGAFSETDLSIELQMLQVNMVTLTHLTKLFLKDMVEQDYGKILNVASAAAFQPGPLMAVYFATKAYVLSFSEAIANELEGTGVSVTVLCPGPTASEFQQTAAMEDSKIASVNRMMDTATVAKIGYQGLMKNKTVVVPGMRNKILTESVRFTPRNLVTKVVRSMHELK

SEQ ID NO: 20183 - protein, 377 aa, Nostoc punctiforme
RFCTHCGEPLPLAVGQVVDNRYQIIRHLGQGGFGRTYLAEDISQSHRTCVLKEFAPQVQEHQDLQKAKELFEREANVLKKLQHPQIPRFHASLQVKIGTKDFFFLVQDYVDGDNYYQLLEQRENEGKTFSEEEVITLLQQILPVLAYIHSQDVVHRDISPDNLIWRRSDNLPVLIDFGGVKQLPASQGFWQTKLVGNNTLLGKKGYAPEEQLRQGKAFFSSDLYSLAVTSLVLLTGQEPQKLYDSYQGIWGWGKQIRVSSKLEAVLKKMVAYKPSDRYQRAEQILKDLPSSSAAKSTGNSITTKIKTMVVAPGRQRASAIVSRFQNRTQAIAKPISFPLWIRPFMMSLGGTALVVLTGAGAWGVVNAVIRSVSSITI

SEQ ID NO: 20184 - protein, 551 aa, Nostoc punctiforme
MAKIIAFDEESRRALERGVNALADAVKITLGPKGRNVLLEKKFGAPQIVNDGITVAKEIELEDPLENTGARLIQEVASKTKDVAGDGTTTATVLAQALIREGLKNVAAGSNPVSLRRGIDKTIEALVLEIAKIAKPVEGSAIAQVATVSAGNDEEVGQMLAQAMEKVTKDGVITVEESKSLTTELEVVEGMQIDRGYISPYFVTNNERQIVEFENARILVTDKKISSIQDLVPILEKVARSGQPLLIIAEDVEGDALATLVVNKARGVLAVAAIKAPGFGDRRKALLEDIAILTDGQLISEEIGLSLDTAALEALGTARKITIDKESTTIVAGSVTKPEVQKRIGQIRRQLEETDSEYDQEKLQERIAKLAGGVAVIKVGAATETELKDRKLRIEDALNATKAAVEEGIVPGGGTTLIHLAKAVEAIKKTLQNDEERIGADIVERALEAPLRQIADNAGAEGSVIVSKVRDSEFNIGYNAATGEFEDLIAAGIIDPAKVVRSALQNAGSIAGLVLTTEAIVVEKPEKKSAAAAPDMGGMGGMGGMGGMGGM

SEQ ID NO: 20185 - protein, 610 aa, Nostoc punctiforme
TLGGHAKEVQGISFSPDGKMLASASDDNTVKLWDTTTGKEIKTLTGHTNSVLGISFSPDGKMLASASSDNTVKLWDTTTGKEIKTLTGHTNSVLGISFSPDGKMLASASADNTVKLWDTTTGKEIKTLTGHRNSVFGISFSPDGKMLASASADNTVKLWDTTTGKEIKTLTGHRNSVFGISFSPDGKMLASASFDNTVKLWDTTTGKEIKTLTGHRNSVNDISFSPDGKMLASASDDNTVKLWDTTTGKEIKTLTGHRNSVNDISFSPNGKMLASASFDNTVKLWDTTTGKEIKTLTGHTNSVNDISFSPDGKMLASASGDNTVKLWDTTTGKEIKTLTGHRNSVNDISFSPDGKMLASASGDNTVKLWDTTTGKEIKTLTGHTNSVNGISFSPDGKMLASASGDKTVKLWDTTTGKEIKTLTGHTNSVNGISFSPDGKMLASASGDKTVKLWDTTTGKEIKTLTGHTNSVNGISFSPDGKMLASASSDNTVKLWDTTTTGKKIKTLTGHTNSVNGISFSPDGKMLASASSDNTVKLWDTTTGKEIKTLTGHTNWVYGISFSPDGKMLASASTDNTVKLWRLDFDYLLQKGCSFMREYYKTNPPDNESDK

SEQ ID NO: 20186 - protein, 157 aa, Nostoc punctiforme
KLLLIGQGSVGKTSLIKRLIRNEYDEKQPQTDGLNVETWNVQVNSKDIRLNVWDFGGQEIYHATHQFFLTKRSLYLLVCNCRTSEEENRIEYWLKLIESFGGESPVIIVGNKKDEQPLDINRKALREKYPNIQEIIETSCQDNIGIDELRTAIFQQV

SEQ ID NO: 20187 - protein, 488 aa, Nostoc punctiforme
QKELLQLIDRAVAEGWRELDLSGQELTELPVEIGKLQQLESLILGKKVEGYERVGDHFLEKVSGNNLKTLPLELLGLPNLRKLDISGNPLESIPDVVTQILHLEELILIRVELTEIPDAIANLTNLTQLILSYNQITQIPEAIAKLSNLTVLIFSDNKITQIPEAIANLTNLTRLNLSSNQITQIPEVIAKLTNLTLLYLSGNQITEIPEAIAQLTNLTLLDLSDNKITEIPEAITQSTNLTVLDLSSNQITKIPEAIAQLTNLKLLYLSDNQITEIPEALANLTNLMQLHLSSNQITEIPEALANLTNLTQLYLSGNQITEIPEALANLPNLTRLYLYSNQITEIPEALANLTNLIQLVLFSNQIAEIPETLANLTNLIQLVLFSNQIAEIPETLAKLTNLTRLDLRFNQITQIPKVIANLTNLTELHLSSNQITQIPEALANLTNLTQLYFSSNQITQIPGAIAKLTNLTQLDLSGNQITEIPEAI

SEQ ID NO: 20188 - protein, 495 aa, Nostoc punctiforme
  unsure (1)..(495): unsure at all Xaa locations
LILLPVIRSIQKLQQGAAKIGDGNLEYRLNIQTEDEIQELAEAFNRMAGTLAESYRSLELKKELADTANRAKSEFLANMSHELRTPLNGILGYAQILQRDKTLTDKQQDGLRIIHQCGSHLLTLINDILDLSKIEAQRMELYKSDFHFPAFLQSVVEICRIRADQKGISFIYQPTSELPIGVWADEKRLRQVLINLLGNAIKFTEKGGVRFTISSVDQLLTNESNQKPIHKIRFQIIDTGIGMSQEQVAKIFLPFEQVGEVKKQSEGTGLGLAISQRIVQLMDSTIQVKSEIGQGSTFWIDLDLQESVDWMQSARVISAGKIVGIATGKRRILIVDDRWENRSVVMNLLDEIGFEIIEASDGQEGLDKAMQFLPDLIITDLTMPVMDGFELTRRLRQQQEFQDLTIIVSSASVFESDQHKSLGVGADDFLPKPVHADDLLQKLEKYLQLEWVYETVPEKSVNETQNTIHSPSSSVVTAESTNCWDYWQXAKNLDC

SEQ ID NO: 20189 - protein, 444 aa, Nostoc punctiforme
KPKMTNEELLQIIEQAVKDEVTELDLSYKGLTILPPEIGQLTNLQTLHLDSNQLSSLPPKIGQLTNLQTLHLRSNQLSSLPPEIGQLTNLQTLHLGNNQLSSLPPEIGQLTNLQSLHLWINQLSSLPPEIGQLTNLQSLDLDSNQLSSLPPEFGQLTNLQSLDLGSNQLSSLPPEIGQLTKLQSLDLSRNQLSSLPPEIVQLTKLQSLDLRSNQLSSLPPEFGQLTKLQSLDLGSNQLSSLPPEIVQLTKLQSLDLGSNQLSSLPPEIVQLTNLQSLDLSSNQLSSLPPEIVQLTKLQSLYLSSNQLSSLPPEIVQLTKLQSLDLGSNQLSSLPPEIVQLTKLQSLDLGSNQLSSLPPEIVQLTNLQSLDLSSNQLSSLPPEIVQLTKLQSLYLSSNQLSSLPPEIVQLTKLQSLDLGSNQLSSLPREIRQLSNLKKLDLRRNP

SEQ ID NO: 20190 - protein, 259 aa, Nostoc punctiforme
LELKLLGKTAIVTGGSAGIGLATAKALYSEGVNVAIAARNQERLENAVAAIQSLPTSGAKVIAISADLTKAEDVEKVVSTTLAQFNQIDILINNAGSARAGSFLESTDDLFLDAWNLKLLGYIRLVRAVVPHQKSRGDGRIVNIVGGAGRTPRPNFLAGGTSNAALLNFTKGISKELAEYKIRINAISPGATATERAETLALQNAQAQGITVEQVKAQNIQSIPLKRIAQPEEIAALALFLVSDLAASITGTEIIVDGG

SEQ ID NO: 20191 - protein, 193 aa, Nostoc punctiforme
PPGTSQPATGLIVTLHGWGANAEDVASLLPLLNLPDYQFILPNAPYPYPYSPIGRAWYDLRVENMYEGLVESRKLLIDFLQSLESTTGIPLSRTILSGFSQGGAMTLDVGSKLPLAGLVVMSGYLHPDALTAGQRDIPPTLISHGKYDEVVPLQAALKARDTLKSLGVAAEYHEFDMGHEINPQTLKVLRDFV

SEQ ID NO: 20192 - protein, 269 aa, Nostoc punctiforme
NAQVEKIAKNFKFTEGPLWHPDGFLLFSDIPANTIYKWQPNRKLQIFRRHSGNANGNAFDQQGRLVTAEHGNRRVSRTEENGKLVTLVSHYQGKRLNSPNDLVVKSDGSIYFTDPPYGIKPQQEELGFYGVYRLTSDRKLTLLVKDFVRPNGIAFSPDETKLYVNDSETGHIRVFDVNSNGLLKNGHIFAQQKYPGKEGVPDGMKVDIKGNVYSTGPGGVWVFSPAGNLLGIIEVPEVPANLAWGDNDYKTLYITARNSLYRIRLKNPG

SEQ ID NO: 20193 - protein, 395 aa, Nostoc punctiforme
YHTHDYYQVDPMLGGNEAFKELLDAAHQRNIKVVLDGVFNHSSRGFFFFHDVLENGPHSPWVNWFKIEGWPLSPYNGEFPANYVGWAGNRALPEFNHDNPEVREYIMEIAEYWLKFGIDGWRLDVPFEIKTPGFWQEFRDRTKAINPEAYIVGEVWGDSRQWLDGTQFDGVMNYLFAGPTIAFAAGDRVVLEQVQSRDYQPYPPLFAAEYATKIQEVLQLYPWEIQLTQLNLLASHDTARLMTIAGGDIASVELSTLLLLTFPGAPSIYYGDEVGLPGGIDPDSRRGFPLEANWNQEIFNTHRQLITIRQTYPALRTGDYQVLYAQGQLYLFARTLGTEELIIAINAGTSSATANVDVASLHTQPNKLLYGTAEAEWNGEEGTQQLSLTLPARSG

SEQ ID NO: 20194 - protein, 321 aa, Nostoc punctiforme
LLITGIDEFVGLRTAELAIAQGMKVRGLKSSTEQNKQLQNLGVEIIIGSITDSTIAQKACQGVDIVLHTDQLAEEAGAIKNFRDVNVGGTVNMAKAAKQAGVKTFVHLSSVMVYGFNYPNGVTESGPLSGENNPYCETKIEAETAVLELNNPPDFGIIVIRAGDVYGPGSIPWIVRPVLMMRQKLFACANDGKGVINHVYIDNLIDGIFLAIEKETYGEIFNITDGQETSWKEYFMRLAAMEGLSAPLSLPKDEIKLFLKLRVQGQKLFRKKVDILPESIDFMTRPYACSIVKAQSMLNYKPTIHLEEGMQRTHEWLQKTD

SEQ ID NO: 20195 - protein, 360 aa, Nostoc punctiforme
MGEPKRIGILTSGGDCSGLNAVIRAVVNCAVDTYGWEVLGIRQATLGLMARPPQFTKLEIDQVDSLLTAGGTMLGTTNKGDPFAFPMTDGSLCDRSEEIIAGYHELGLDALIGIGGDGSLAILRRLAQQGGINLVGIPKTIDNDIGVTEHAIGFDTAVNIATEALDRLHFTAASHSRVMILEVMGRDAGHIAIAAGIAGGANVILIPEIPYTVEHICHKIKERQEKGKNYCLIIVSEAVRTHDGENVTITNRLGQSRYGGIGEYLADKIIEHIGVETRVTVLGHIQRGGTASPLDRLVATAFGVAAVNLIAEDKYDRMVTWQNRQVLSVPITEAIAQYSAVDPNGTLVKTAHGMGIYLGD

SEQ ID NO: 20196 - protein, 234 aa, Nostoc punctiforme
MRPYHQIPIFECGEPLIEIPLELFAVESPHPYEKLGAPYGEQSPYYLRQSVIKNLSQAQNYLKLLHPNWHIQIFDAYRPIAVQQFMVDYSFTQAVQDRGLTNVELSPNQRQEVWEAVYAIWAAPSLDEKTPPPHSTGAAVDVTLVDDIGQIVNMGSPIDEMSERSHPDYYANNDDPEAQKYHAHRQLLQDVMLKEGFQRNPREWWHFSVGDQMWAWLNNQSNPANPVTARYGRI

SEQ ID NO: 20197 - protein, 496 aa, Nostoc punctiforme
TPLLDALKANAARPHAPFYTPGHKQGEGIPQPLADLLGKAVFRADLTELADLDNLFAPQGVIQEAQQLAAEAFGASQTWFLVNGSTCGIEAAILATCGTGDKIILPRNVHSSAIAGLILSGAIPIFLNPEYDPVLDIAHSITPNALESALQQHPDAKAVLTVYPTYYGVCGDLSAIANITHQYNIPLLVDEAHGAHFAFHPELPTPALAAGADLTVQSIHKVLGAMTQASMLHIQGDRIDCDRISKALQLVQSTSPSYLLLASLDAARQQMVLHGKMLMSRTLQLANEARTIISQIPGLSVLQILSPPYQGGLGGSSSLGGLVGSPGFVALDKTRLTVTVSGLGLTGFEADEILDEKFAVTAEFASLQHLTFIISLGNTPADIKQLVQGFTILAKEYRATNLNVTNPNLQNLLTTQGHTLHFSPREAFFALSETLPLAQTSDRICAEIICPYPPGIPVLMPGEIITKPVLDYLQQIQGMGGFISGCNDSSLKTLKV

SEQ ID NO: 20198 - protein, 316 aa, Nostoc punctiforme
AVLIQNLQKRYGTVVAVQDVSFQVEPGEIFGLLGPNGAGKTTTLRALCTLTTPDAGKIEVSGISVLDNPRVARQRLGYVAQEVAIDKVLTGKELLQLQAALYHLPRAVAKQRIETVLDLLGLQEYANKKTGTYSGGLRKRLDLAAGLLHAPDVLVLDEPTVGLDIETRFVVWDFLRKLRASGTTVVITSHYLEEIDALADRVAIIDRGVVIASGTPSQLKDKVGGDRITLRIREFSPIEEAEIAKNLLQPLPFVQEVIINSAQGNSLNLVVTPQNDVLINIQQALNTAGLPIFGIAQSRPSLDDVYLAATGRTLMD

SEQ ID NO: 20199 - protein, 377 aa, Nostoc punctiforme
IPALLVLADGTTYRGWSFGATGTAIGEVVFNTGMTGYQEVLTDPSYCGQIVIFTYPELGNTGINLEDEESDGPQVRGAIKKNICQRPSNWRSTQSLPDYLKQNQVPGIYGIDTRALTRKIRMFGAMNGGISTTILDEAELLEQVQAAPNMAGLNLVREVTTSTAYEWSDPTIPAWEFNCEAAENLGEAFTVVALDFGVKRNILRRLVSYGCRVIVVPADTPPEEILNYNPDGVFLSNGPGDPAAVTGGIATAKALLLSQKPIFGICMGHQILGHALGAETYKLKFGHRGLNQPAGLQQRVEITSQNHSFAIDPDSLPTAVVEISHLNLNDRTIAGVRHKSLPVFSVQYHPEASPGPHDADYLFEQFVQAMQAARQAA

SEQ ID NO: 20200 - protein, 753 aa, Nostoc punctiforme
IHIPGSIQPHGILLALSTQLEIVQVSNNTQVYLCKAPEDLLGRPLSYLLEPQPVEIVKQCLVKKVGSANAFKVLINTLYGEIYFDAIAHRTEEAVILELEPTDSEFEVSFLNFHSFASEAIAKMQRTSNLGEFLHLVAQEVQKIISFDRVMVYQFDESEAGSVVAEVKREDLSPYLGLHYPATDIPAQARELYTRCFLRFLPDLTAEPVKLVPTENPTTHQHLDLSYCLLRSFDWCCAEYHQNMGVKALLVISLIQEQKLWGLISCHHQTPKYISYEVRKMCEFLGQIVSSELAHKISSSEWDYKVKLKSLQSEFLESISQADNFIDALIKPEIRLLDFVSASGAAVCLDNEINLVGTTPNIDEVRALIEWADTQVTDNLFSTDSLPKLYPEALIFKDTASGLLLLRISKVRRYYILWFRPEVIQTVHWAGNPQESIKAEGDGSYTLSPRKSFEQWQETVRLTSLPWKGCELESAIALSNAIVGIVLSKADELAKINLELERSNQELASFAYAASHDLKEPLRGIYNFSTVLLEDYAQVLDDDGIECLQTVVSLSVRMETLINALLRLSQLGQAHLREQATDLNELLNQVIDVFRASRQDSGLVDIRIPRPLPTIQCDRVLVNEVFSNLLGNAFKYNDKAEQWVEIGYLSQEEGQGVGSRGQGAGGAGEAIIHQSPIPNAPCPIFYIRDNGIGIPQHHLETIFRLFKRLHSQEKYGGGAGAGLAIVKKIVELHNGQIWVESTLGVGSIFYFTL

SEQ ID NO: 20201 - protein, 565 aa, Nostoc punctiforme
LSGIAASAGVAIAPVVNYQPTHITITEYHVDNPESEWQRVQAAIHTAKQEIQAVFSQASLQIGDTEAAIFDAQLLFLEDPVLLEAAHQRILDHYINAEAAWQAVVDEVATSYRTLEDAYLQERVEDVVDVGQRVLRLLAGNAPANLHLSEPAILVATDLTPSDTARLDPRMVLGICTTSGSATSHSAIIARTLGIPAVLGVDSQVLHLADGTLMALDGESGKAWVEPESHILDLLEAKREAWQTAQEEARATAHQPAITLDGRQVSVFANIGSINDVQVAVASGAEGVGLLRTEFLYLDRTSAPTEEEQLEVYQAIAQVLDNRPLIIRTLDVGGDKPLPYLRVGFPEANPFLGWRGIRFCLDHLDLFKTQLRAILRASVGHQIKIMLPMIATVTEVRAAKVILGEVQAELNQAGIPFDAAMKVGIMVEVPSAVAIADQLAAEVDFFSIGTNDLSQYVMASDRTNPRVANLVDALHPAVLRMVQQTIQAAHAAGISVGLCGELAADTLATPILLGLGLDELSVNPQSIPGVKQAIARLSIVESEAIAASALQQDSAVHVREIISTS

SEQ ID NO: 20202 - protein, 288 aa, Nostoc punctiforme
QVRKAVIPVAGFGTRLFPATKVVKKELFPIIDRDGRAKPVILAIIEEAISAGIAEVGIVVQPDDREIFEDLLKNPPKKELFKKLSPQNQEYSRYLEDLGSKITFLLQEEQLGYGHAVFCAKDWVQDEPFLLMLGDHVYASDIQKSCASQLLDVYEQVNQSVVSLTTTPAEILHTAGCVTGVWQELNSILEVTQLYEKPTIEYAQQHLHVEGMAENEFLCIFGLYLLSPKIFDFLAEHINQNLRERGEFQLTSSLDRLRQEEGITGYVVKGKCFDTGLPDTYRQTMIDF

SEQ ID NO: 20203 - protein, 276 aa, Nostoc punctiforme
LNNRYKITQGLGSGGFSNTYLADDIQRPGNPQCVVKQLRPPRQDAEYLNVVRRLFDAEAQILETLGKHPQIPQLLAFFEENRQFSLVQEFVRGHAMDKEVTSGKRLKQAEVVEMLKEVLHVLVFVHSYGVIHRDIKPSNLIRRESDQHIVLIDFGAVKQIHPQQQEAQTISIGTPGYAPSEQMSGLPKLNSDIYALGIMGIQGLTGVDPREFRRDINTGEIIIQGEADGNQQTWQHWRELTDATNELVIILNRMAHFDFTQRYQSAAEVLKALESP

SEQ ID NO: 20204 - protein, 258 aa, Nostoc punctiforme
PLYGKRILVTAPRNYAYRLSEQIIKQGGLPVFMPTIETCYLSNYAKLDAALNHIAEFDWIVFTSRNGITAFFHRMNDLNIPVSVVEKCQLCALGKDAESLLSFCGKVDLIPTESSPAGIVAELAKIPQIHNKKVLIPAPEVVGLPEPDVVPNLITDLQQLGTEVIRVPTYITQGLNTSIYSIELNLIHQGMIDVIAFSSTAEVESFLTMVNSQSDYEGCIVACFGPYTTANARKLGVNVSIVSRDYSSFEGFAEAIAE

SEQ ID NO: 20205 - protein, 253 aa, Nostoc punctiforme
FLPKAFKGHSSDVNSVAFSPDGTTLGSASDDKTIKLWNLARGEEIHTLEGHSNWIWTVAFSPDSKTLASGSADKTIKLWNVETGKLVRTLEGNTDGVTSVAFSPDGKTLASGTASKDIRIKLWNVKTGKLIRTLEGHTDGVPSVAFSPDGKTLASGSWDKTIKLWNLNTGKEIRTLKGNAESILSVAFAPDGVTLASGSKDKTIKLWNLNTGKEIRTLKGHKDKVNSVAFLPSGTQNGLTLVSGSSDKTIKLW

SEQ ID NO: 20206 - protein, 395 aa, Nostoc punctiforme
RKRIEKELRQAEEVAQNSSQAKSEFLANMSHELRTPLNGILGYTQILQRTESLSEKGRKGLSVIYQCGSHLLTLINDVLDLSKIEARKLELYPVDFYLPAFIDSVTEICRIRAEQKVIAFNIEIDPNLPTGIHGDEKRLRQVLINLLSNAMKFTHQGSVTFKTQVINQESNANGKTNYKIRFEVVDTGTGITPEQAEKIFQPFEQVGSQKRQSEGTGLGLAISQKIVLLMGGQIKVQSEFGKGSTFWFEANLSESKDWAKVSRVVEQGTIIAYQGKRRTILIADDKWENRSVIVNLLEPVGFTVVEASNGQEAWVQSLAHKPDMIITDLVMPILDGFELIRRLRQSGAFKEIPIVASSASVFAVDQHKSIDVGADAFLPKPVEAENLLEMLRQFL

SEQ ID NO: 20207 - protein, 200 aa, Nostoc punctiforme
  unsure (1)..(200): unsure at all Xaa locations
MKLYEFAPTRSIRVRWVLQELGVEFEAISINMQAGEHRTPDFLTINPTGKLPVLIDGEHIITESVAIALYLGEKYPESNLVPTDLLLRAQLYRWLLFTATELEQPLWRIARHTFIYPEELRLPAEIPLARQDFTSMAVVLENHLLDRQFVLGEHVTVADFVLAYTLDXANEVQLLATFPTLVDYMEQMYKRPKASGRIAA

SEQ ID NO: 20208 - protein, 400 aa, Nostoc punctiforme
RSVSESASVILNFEFGAKRRDPYAWLEQSLATIHRADWYRSVQPINGRPGATVVLAGQEVINFASNDYLGLAGDKRLMAAATAAIAEFGTGSTGSRLLSGHRELHRELEKAIASTKQTEDALVFSSGYLANLGAITALVGKRDLILSDQYNHSSLKNGAILSGAAVVEYPHCDVAVLKTQLSQQRQNYRRCLILTDTVFSMDGDLCPLPALFDLADEFSCMLLVDEAHATGVLGKTGAGCVEYFGCTGKQLIQIGTLSKALGSLGGYVAGSSALIDFLRNRAPSWIYTTGLSPADTAAALAAIKIVQQEPQHLAQLWRNIHYLKTLLQQLPNLKLLPSESPILCFQLPNATDALKAGKQLRDAGIFAPAIRPPTVPTSRIRISVMATHKVAHIEKLVAAL

SEQ ID NO: 20209 - protein, 507 aa, Nostoc punctiforme
SEERYRCLAELIPQLVWTANPEGRLLDVNQRWLEFTGLTLEQAHTSGWREVVHPEDVLILVKEWSKAVQQGTSYQAEGRMRRADGVYRWHLHQAIPQKDRQGEIVKWFGSATDIEAQKQLEVERDRLFQLEQAARAEAERANRIKDEFLAILSHELRSPLNPILGWTKMLQSRKFNETKTAQALASIERNVKLQTQLIDDLLDIAKILRGKLSLDVTPVNLLFVIESAIDTVNTAAIAKSIQLHPVLPNIGQVSGDSNRLQQIVWNLLSNAIKFTPKGGRVEIRLERVDEQAHIIVSDTGKGINPEFLPHIFESFRQEDVSITRKYGGLGLGLAIVRQLVEAHGGTITADSPGEGLGATFTVQLPLLNLQPEIKQTDDLLQPGLELTGIRVLTVDDDPDARELLTVLLAEYGAQVLTVPSATEVLANLESFQPDVLVSDIGMPEVDGYNLIQQIRALTPEKGGQIPAIALTAYARVDDSQRAITSGYQRHVTKPLDPEELVQAVVAL

SEQ ID NO: 20210 - protein, 362 aa, Nostoc punctiforme
MGNIFGHLFRISTFGESHGGGVGVVIDGCPPQLEISAEEIQVELDRRRPGQSKITTPRKEADTCEIISGVFEGKTLGTPITILVRNQDTRPQDYDEMAQKYRPSHADATYDAKYGIRNWQGGGRSSARETIGRVAAGAIAKKILRQVANVEIIAYVKRIKDLEGVVDPNTVTLEQVESNIVRCPDAECGDRMIELIEQIGRQGDSIGGVVECVARNVPKGLGEPVFDKLEADIAKGVMSLPASKGFEIGSGFAGTLLTGIEHNDEFYIDQNDEIRTVTNRSGGIQGGISNGENIILRVAFKPTATIRKEQKTVTREGEETLLAAKGRHDPCVLPRAVPMVEAMVALVLCDHLLRHHGQCKVL

SEQ ID NO: 20211 - protein, 816 aa, Nostoc punctiforme
MFEHFTSEAIRVIMLAQEEARRLGHNFVGTEQILLGLMGEGTGVAAKVLAELGVTLKDARREVEKIIGRGSGFVPPEIPFTPKVKSLFEQSFKEAHSLGQNYINTEHLLLGLTEAGEGVAAKVLQNLGVDFKSVRSAIVRRLGENAPAFAGSGSQKRTQPLTMEEYGRNLTKLAQEGRLDPVVGREKEIERAIQILGRRTKNNPVLIGEPGVGKTAIAEGLAQRIINQDVPETLQDKQVISLDMGSLVAGTRFRGDFEERIKKVVEEVRTVGNIILVIDEIHTLVGAGGTEGGLDAANILKPALARGELQCIGATTLDEYRKHIERDAALERRFQPIMVGEPSVEETVQILYGLRGAYEQHHKVTILDSALVAAAELSDRYISDRFLPDKAIDLIDEAGSRVRLRNSQSSPNKELKRELAGVTKEKEAAVRVQDFDKAVTLRDQELKLAEQLQATFTPNEQPVNSTVVDEEDIAQIVASWTGVPVNKLTESESELLLHLEDTLHQRLIGQEQAVSAVSRGIRRARVGLKNPNRPIASFIFSGPTGVGKTELAKALASYFFGAEDSMIRLDMSEYMESHTVAKLIGSPPGYVGYDEGGQLTEAVRRKPYTVLLFDEIEKAHPDVFNMLLQILDDGHLTDAKGRKVDFKNTLIILTSNIGSKVIEKGGSGLGFDFDTQANASYNRIRTLVNEELKAYFRPEFLNRLDEIIVFTQLSRDEVKQIAEIMLREVSKRLTEKGITLEVSDRFKELVVQEGYNPSYGARPLRRAIMRLLEDSLAEAMLSGEITDGDTALIDVDDDSQVRVQKLEKRELLLANV

SEQ ID NO: 20212 - protein, 435 aa, Nostoc punctiforme
  unsure (1)..(435): unsure at all Xaa locations
MNFSTLGLSNEIIRAVTERGYTEPTPIQRQAIPAVLSGSDLLAGAQTGTGKTASFTLPLLHRLSSEKNVKVTSNGYRPIRALILTPTRELAAQVEESVREYGKYLQLNSMVMFGGVGINLQKQRLKNRVDILVATPGRLLDHVQQGTLNLSHIEVLVLDEADRMLDMGFLHDIRRILAIXPKQRQNLLFFATFSDKIKALAAGLLNNPKMIEVARRNVTAETIAQKIYQVDRDKKRQLLAHLIRRDNWYQVLVFTRTKYGADRLVKQLGEDRIQALAIHGNKSQPVRTNALAKFKNGSLQVLVATDIAARGLDISELPHVVNFDLPNVPEDYVHRIGRTGRAGASGEAVSLVCVDEYSLLTDIEKLIEQRLSREVVAGFGPNPDTTAEPIPNGRQHRPKSGGEKRSPRTPKPLPRTSAKRKAAPPATNGEKPGAR

SEQ ID NO: 20213 - protein, 168 aa, Nostoc punctiforme
LDQFMVIQKKICMIGAFATGKTSLVAMFVHSIFSEKYHTTVGVKIDKKAIEIQDKKINLILWDIYGEDEFQELQMSYLRGSAGYLLVVDGTRHNTLQKAFDLQIKIEDAIGQVPFILVINKLDITDEWEIESAEIDDVTQNGWTVIKTSAKHSIGVEEAFQTLAKKIL

SEQ ID NO: 20214 - protein, 238 aa, Nostoc punctiforme
STPKPLQLSNHSTTTIKVSNLHKHYGQLIAVRGIDFTVNQGEMFGLIGPDGAGKTTTFHILGGVMEATAGEVQVFGQPARDARLRTGYLTQQFSLYLDLSIDENLRYAAGLRQVSDDLLRERRQKYLKLMSLEQFGDRLAGQLSGGMKQKLALCCALVSQPDVLLLDEPTTGVDPVSRREFWDVLAELSADGMTIVVATPYLDEAERCDRVALMYSGQIHEIGTPAALRANLGLHRLE

SEQ ID NO: 20215 - protein, 205 aa, Nostoc punctiforme
AVKNVNVEVRYGEIFGLLGANGAGKTTTIKMLCGLLAASGGDISLGGETGNLRSRDLRRRIGYMSQKFTLYDDLTILQNLEFYSGIYSVPRKLRREKIDWVIATCGLEGQEQMLTGQLPGGWKQRVAFGASVMHEPDILFLDEPTSGVDPLARRQFWKLINDFARNGTAILVTTHYLEEAEQCNRMSFMVAGEIAAEGSPSSIKA

SEQ ID NO: 20216 - protein, 659 aa, Nostoc punctiforme
MLEQGTISIHTENIFPIIKKSLYSDHQIFLRELVSNAVDAIQKLKMVSRAGDYAGDIGEPEIEIAIDKDKKTLSISDNGIGMTADEVKKYINQVAFSSAEEFIHKYEGKSDQPIIGHFGLGFYSSFMVAQKVEIDTLSYQEGAQAVHWTCDGSPAFTLEDSSRTTRGTTITLSLQGEEEEFLESARIKNLVKTYCDFLPVPIKLEGEVLNKQKAPWRESPSNLTQEDYLEFYRYLYPFQEEPLLWVHLNTDYPFIINGILYFPKMRPDVDVTKGQIKLFCNQVFVSDNCEEIIPQFLMPMRGVIDSTDIPLNVSRSALQGDRTVKRIGDYIAKKVGDRLKELFRDNREQYISAWKDLGTFVKFGVLNDDKFKKQIEDIIVFRTTAKLTEKVAAETPVVEVQSSDGDAWQDVTPSPSAENSTPSAPYTTLKEYLERNKERNENRVFYSTDEATQSTYIELHKNQGLEVLFMDSFIDTHFINFLEREYQDVKFTRVDSDLDNTLLEQDKDKEIVDPKTNKTRSETIKELFEKSLNKPKLNIRTEALKSDDPQGTPPAMVLLPEILRRLREMNAMMQQGTAEFPEDHILLVNTAHPLIQNLANLNQGTIIQGDGQSSTDQLVNLICQHVYDLALMSQKGFDAEGMKSFVERSNEVLTKLTEQ

SEQ ID NO: 20217 - protein, 859 aa, Nostoc punctiforme
MQPTDPNKFTDKAWEAIVKSQDIVRAYQQQQLDVEHLIIALLEEPTSLAIRILARSEVDPIRFQQQLEAFIQRQPKVGKSDQLYLSRSLDVLLDKAEEARVRMKDSYISVEHILLAFAEDDRIGRKILKSFSADAAKLEATIKAVRGSQKVTDQSPESRYEALQKFGRDLTEQAKAGKLDPVIGRDDEIRRVIQVLSRRSKNNPVLIGEPGVGKTAIAEALAQRMVNGDVPESLKNRQLISLDIGSLIAGAKLRGEFEERLKAVLKEVMDSNGQIVLFIDELHTVVGTGSSQQGAMDAGNLLKPMLARGELRCIGATTLDEFRKHIEKDAALERRFQQVFVDQPSVENTISILRGLKERYEVHHNVKISDSALVAAATLSARYISDRFLPDKAIDLVDEAAAQLKMEITSKPAELETIDRRLMQLEMEKLSLAGEEKGTPQTKERLERIEQEIANLTEKQQIFNEQWQGEKQILEAISALKKEEDALRVQIEQAERAYDLNKAAQLKYGKLEGVQHEREAKEASLLEIQNQGSTLLREQVTEADIAEIVAKWTGIPVNRLLESERQKLLQLESHLHQRVIGQEEAVEAVAAAIRRARAGMKDPSRPIGSFLFMGPTGVGKTELARALAQFLFDSDDALVRLDMSEYMEKHSVSRLVGAPPGYVGYEEGGQLSEAVRRRPYSVVLLDEVEKAHPDVFNILLQVLDDGRITDSQGRTVDFRNSVIVMTSNIGSEHILDVSGDSQYETMRKRVMEGLRSHFRPEFLNRVDDIILFHTLNRTEMRQIIRIQLKRVENLLREQKIFFEISQAACDHLVESGYDPVYGARPLKRAIQREVENPLATKLLENTFISGDTILIDKNE

SEQ ID NO: 20218 - protein, 421 aa, Nostoc punctiforme
IEAIAAREILDSRGRPTIEAEVHLANGVVGLAQVPSGASTGSFEAHELRDGDKSRYGGKGVLKAVKNVKEALAPKLLGLDALNQELLDRTMIAIDGSPNKSSLGANAILGVSLAAAKAGAESLDIPLYRYLGGPLANLLPVPLMNVINGGAHASNNVDFQEFMIVPIGATSFREALRWGAEVFATLSQVLDEKGLLTGVGDEGGFAPNLESNQVALELLVAAIKKAGYKPGEEVALALDVAASEFYKNGQYVYDGKPHAPAEFIDYLGQLVDQYPIVSIEDGLHEEDWQSWQLLTQKLGSQVQLVGDDLFVTNATRLQRGIEEKAANAILIKLNQIGSLTETLETIDLATRNSIRSVISHRSGETEDTTIADLAVATRAGQIKTGSLCRSERVAKYNRLLRIEDELGDRAVYAGAVGLGPK

SEQ ID NO: 20219 - protein, 352 aa, Nostoc punctiforme
MGKFRRVPVGIIGASGYGEVQLVRLLMDHPEVELVYLGGESSIGKSFGDLYPHLAHTANLPIEAVEPEIIAHRCEVVFLSLPNGLACQIAPKLLEKGCKVLDLSADYRFSDLTTYTNWYGIERSDRTIAATAVYGLPELYRDRIAEAQLIGCPGSYPTASLLALSPLLKQGLILPETAIIDAKAGTSSGGRQPQTNLLLSEADNSIAAFNIGRHRHTPEIEQICSDLAGHELMIQFTPHLVPMVRGILATVYAKMSDPGLVRDDLITIFSAFYRNSPWVKVCGSGIYPQTKWANGSNLCYIGVEVDSRTGRVIVISAIDNLIKGQAGQAIQCLNLMMGWDETLGLPKLGFYP

SEQ ID NO: 20220 - protein, 359 aa, Nostoc punctiforme
MTQQKRALITGITGQDGSYLSEFLLEQGYEVHGIIRRTSTFNTDRIDHIYEDPHKQGVRLFLHYGDLTDGTTLRRILEEVKPVEIYNLGAQSHVRVSFDSPEYTVDAVGMGTLRLLEAIRDYQHRTGIQVRFYQAGSSEMYGLVQAIPQSETTPFYPRSPYACAKVYAHWQTVNYRESYDLFACNGILFNHESPRRGETFVTRKITRAVAGIVAGKQKKIYMGNLDSKRDWGYAKDYVKAMWLMLQQDQPDDYVIATGETHSVREFLELAFSYVNLNWQDYVEFDERYLRPSEVDLLIGDATKARQNLGWKTSVTFKELVSLMVEADLQALGHTSPNGNGSQFPLDIATVRQELGALHF

SEQ ID NO: 20221 - protein, 284 aa, Nostoc punctiforme
LHNVLEARARLGEGPIWDSTQNVIYWVDIYNHRVHQFNPATGKDLFFDVGDVVGAIATAGADRLIIALRHHLAFLNTRTGVITPILEIEGNLPDNRLNDGKCDPQGRFWFGSMCSLEKPQASLYRYDNDGSLHVMETGLTISNGLGWSPDRKIFYLTDSHQQKIYAYDFNSITGNITNRRIFVDLTHESFYPDGLTIDSEGHIWSAMWNGWCVIRFNPKGEEILRIKLPVQVPSSCTFGGEDLQTLYITTASVGLSQAEIEKSFYSGDLFALQTDVTGLPTYAF

SEQ ID NO: 20222 - protein, 279 aa, Nostoc punctiforme
QTLQPPQQQEVPGVESEMTPKPKADDAQYRGSGKLQDKVALITGADSGIGRAVAIAFAKEGADVAILYLNEHDDAKETKHLVEKQGRRAVTIAGDIGDETFCQQAIQQTVGEFGKLDILINNAAEQHPKQSIEEITKEQLERTFRTNIFSMFFMTKAALKHLQTGSAIINTTSVTAYKGSPQLLDYSSTKGAIVAFTRSLSQNLVSKGIRVNAVAPGPIWTPLIPSTFPEEKVESFGKQVPMQRAGQPEEVAPSYVFLASDDASYVSGQVLHVNGGEVV

SEQ ID NO: 20223 - protein, 564 aa, Nostoc punctiforme
TVVDILRDRSSTQPHTQAFTFLEDGETQESTLTYYELDRRSRAIASQLQALGLSGERAILLYPPGLDYLTAFFGCLYAGVVAVPAYPPRNQRNTPRIQAIIADAQAAIILTTTTLLPNVKSLLTKHTDQGSLCWLTTDNLAQGIEDSWQQPEIDAQILAFLQYTSGSTGTPKGVMLSHGNLLHNAAVTYQIMEHSPESQFVSWLPVYHDMGLIGGILQPLYGGFPCVLMSPTSFLQRPYRWLQAISQYRGTTSGGPNFAYELCIQRITPEQKSTLDLSSWSVAFNGAEPIRSETLERFSATFAECGFRPEGFYPCYGMAEATLMVSGGIKKALPPCKTVAKSALERHQVIEAATSEDIQTFVSCGQSVPQQQIVIAHPETLKPCQPDEVGEIWVSGPSIGQGYWNRPDETKQTFHASLKGPDSRLFLRTGDLGFLDKGELFITGRAKDLIIIRGRNLYPQDLELTVERSHSSLRSGSGAAFSVEAENEERLVVVQELEFRAKPNIEEVIAAIRQAVAEEYEIQVYAVVLIKPGTIPKTSSGKIQRRATKADFLANKLEVVGSSI

SEQ ID NO: 20224 - protein, 608 aa, Nostoc punctiforme
VNLHNVNFESSDLSQCVFAETFGMVFAGIAFSPDGTLLATGDAEGELRLWEVATGKLVVNFAGHLGWVWSLAFSPDGQLLASCSSDKTIRLWDVNTGKCLRTLSGHTSSIWSVAFSADGQMLASGGDEPTIRLWNVNTGDCHKIFSGHTDRILSLSFSSDGQTLASGSADFTIRLWKISGECDRILEGHSDRIWSISFSPDGQTLVSGSADFTIRLWEVSTGNCFNILQEHSDRVRSLAFSPNAQMLVSASDDKTVRIWEASTGECLNILPGHTNSIFSVAFNVDGRTIASGSTDQTVKLWDVNTGRCFKTLKGYSNSVFSVAFNLDGQTLASGSTDQTVRLWDVNTGTCLKKFAGHSGWVTSVAFHPDGDLLASSSADRTIRLWSVSTGQCLQILKDHVNWVQSVAFSPDRQILASGSDDQTIRLWSVSTGKCLNILQGHSSWIWCVTFSPNGEIVASSSEDQTIRLWSRSTGECLQILEGHTSRVQAIAFSPDGQILSSAEDETVRLWSVDTGECLNIFQGHSNSVWSVAFSPEGDILASSSLDQTVRIWDRHTGVCLKVLPVLPHAMRSAIAFGKSTEHYAIASGSQNGTIQIWDAQTGECLKIL

SEQ ID NO: 20225 - protein, 895 aa, Nostoc punctiforme
MKSTQGKINELLTETGCEHNQHKQAEKKNKSCAQQAQPGAAQGGCAFDGAMIALVPIADAAHLVHGPIACAGNSWGSRGSLSSGPQLYKMGFTTDLGENDVIFGGEKKLYKAILELKERYQPAAVFVYATCVTALIGDDMDAVCKAAAEKIGIPVVPVIAPGFIGSKNLGNRFGGEALLEYVVGTAEPEHTTPYDINLIGEYNIAGEMWGVTPLLEKLGIRILSKITGDARYNEIRYAHRAKLNVMICSRALLNMARKMEERYNIPYIEESFYGIDDMNRCLRNIAAKLGDPDLQERTEKLIAEETAALDLALAPYRARLKGKRVVLYTGGVKSWSIISAARDLGIEVVATSTRKSTEEDKAKIKKLIGNDGIMLEKGNAQELLQLVKDTRADMLIAGGRNQYTALKARIPFLDINQERHHPYAGYVGMIEMARELYEALYSPIWEQIRKPAPWEEEEESLMAIVTASNKALTVNPLKQSQALGATLAFLGLKGTMPLFHGSQGCTAFAKVVLVRHFREAIPLATTAMTEVTTILGGEENVEQAILTLVEKANPEIIGLCSTGLTETRGDDIEGFLKEIRDRHPELNDLAIVFAPTPDFKGALQDGFAVAVESIVKEIPRAGGLRTEQVTILAGSAFTPGDVQEIKEIVTSFGLVPIFVPDLGASLDGHLEDNYSAVTVSGTTLKQLREVGSSAFTLALGESMRGAAKILEERFGTPYEVFGELTGLEPVDEFIQALAILSGNSVPEKYRRQRRQLQDAMLDTHFYFGAKRVSLALEPDLLWSTVHFLQSMGSQIHAVVTTTRSHLLEKLPVKSITIGDLEDFESLAGGSDLLIGNSNVGAIAKRLSIPLYRLGLPIYDRLGNGQFTKVGYRGTMELLFGIGNLFLEAEEARVKQ

SEQ ID NO: 20226 - protein, 511 aa, Nostoc punctiforme
MPQNPEKIQDHVELFHQPEYQQLFENKKQFENGHDPEEVKRVSEWTKGWDYREKNFAREALTVNPAKGCQPLGAIFAAVGFEGTLPFVQGSQGCVAYFRTHLTRHYKEPFSGVSSSMTEDAAVFGGLQNMIDGLANSYQLYKPKMIAVCTTCMAEVIGDDLQAFINNSKQAGSVPQDFPVPYAHTPSFVGSHITGYDNMMKGILSNLTAGHKKETSNGKINFIPGFDTYVGNNREIKRIASLFGFDYTILADNSDYLDSPNTGEFDMYPGGTKLEDAADSINAKATIALQAHSTPKTREYIEKEWKQPTSVSRPWGIKGTDEFLMKLSELSGIPIPEELEIERGRAVDAMTDSHSWIHGKRFAIYGEPDLVYSVVGFMLEMGAEPVHILVHNSNEVFEAEMKELLASSPFGQHATVWPGKDLWHMRSLLFTEPVDFLVGNTYGKYLWRDTKIPLVRIGYPIMDRHHLHRYATIGYQGVINLLNWTVNTLFEEIDRNTNIPSKTDISYDLIR

SEQ ID NO: 20227 - protein, 136 aa, Nostoc punctiforme
ETYDRGAADYDAIMKRYWHIEREPLIASLQLQPGQIVLDAAVGTGLNLSAYPEGVNVVGIDFSEKMLNEARKKHVSADITFNISDLCNLDFPDNSFDAAASGFTLCVVEDPVLALKEILRVTKPGALIAILDYCKS

SEQ ID NO: 20228 - protein, 800 aa, Nostoc punctiforme
MYELVQAVFNGDEKTALHQLIYTLSASGKRYLLRNEILQAFADYCHESQKPAYFYHSSSIGKLIQYTHEIIIEEESTWFVIRPKIANQEVWRLTANLDSFEQMTQQALLDVRDRLVNRYQPGILEIDLHPFYEDSPRIDDPRNIGQGLAYLNRYLCNQLLTDPEYWVEMLFQALQGLQHDGIRLLLSDRIPSGIHLAKQIKLALKLVNERSPHEPYEKFSLDLQELGFEPGWGNTAARVSETLELLDRLIYSPEPGILEAFVARVPAVFRVVLISIHGWVGQEDVVGRDETLSQVIYVLEQARSLENELREQIKLAGLDQLGIKPHVIILTRLIPNCEGTFCYLPLEKVQDTENAWILRVPFGEFNPEITNNWISKFEIWPYLEQFAIDAEKELLTQFKGKPNLLVGNYSDGNLVASLLSRRMKVTQCNIAHSLEKPKYLFSNLYWQDLENQYHFSAQFTADLISMNAADFIITSSYQEIVGTPDTIGQYESYKCFTMPQLYHVVDGIDLFSPKFNLVPPGVNESIFFPYSQKENRDSNLCTEIHNLLFSREDPQILGHLDRPNKRPIFSVSSISSIKNLAGLAECFGQSQRLQEHCNLILLSSKLHPDEATNPEEAEEIQKLHNIIDRYHLHSKIRWLGMRIPSSSLGEAYRVVADCQGISVHFARFESFGRSILEAMISGLPTFATQFGGSLEIIENQEEEFNVNPTDLVETAKKILDFFEKCNTHPEHWQEVSEWMSQRVHNRYNWHLYSNQLLLLAKMFTFWNFVAPENNEARDRYMETLFHLIYKPRAEKILEKH

SEQ ID NO: 20229 - protein, 197 aa, Nostoc punctiforme
IQGFIFDLDGVLTDTAELHYLAWKKLADEEGIPFNSQDNEALRGVSRRASLMLIVGDRPYTEAQIQEMMERKNSYYMELIQNMTSKDLLPGAIAFLDELRQAGIKIGIGSASKNARTVIKRLGIADKVDAIADGYSVQQPKPAPDLFLYSAKQLGLEPAQSIVVEDAAAGIEAALAAGMWAVGLGPVERVGAAHVVL

SEQ ID NO: 20230 - protein, 423 aa, Nostoc punctiforme
VSLQTLVEQATIPPDSGSVASSPFDADSFNEAVMSTYGRFPLALERGAGCRVWDTQGREYLDFVAGIATCTLGHAHPVMVEAVTRQIQKLHHVSNLYYIPEQGELAKWLVEHSCADRVFFCNSGAEANEAAIKLARKYAHTVLDIEKPIILTANASFHGRTLATITATAQPKYQKYFDPLVPGFHYVNYNDINAVEVAISELDEGDYRVAAILIEPLQGEGGVRPGDVAYFKKLRQICDETGILLIFDEVQVGMGRSGKLWAYEHLGVEPDIFTSAKGLGGGIPIGAMMSKKFCDVFQPGEHASTFGGNPFVCGVALSVCQTLERENILQNVQDRGEQLRSGLRAIAAKYPQQIGEVRGWGLINGLELRADIQLTAADIVNAAINEGVLLVPAGPKVVRFVPPLIVTEAEVNTALEAVDKAMS

SEQ ID NO: 20231 - protein, 427 aa, Nostoc punctiforme
LRIITQQADVRAELQRICDRTHDEQVLHKEATVREVLQAVKRQGDKAVLHYTAEFDKQTLKAEELRVTGSELDAAYQQVSKELLGAVRLACRQIEAFHRQRVPKSWVHFGDDEVVLGKRYTPVDRAGLYVPGGRAAYPSTVLMNAIPAHVAAVPHIVMVTPPGPGGVINPAVLVAAQEAGVQEIYRIGGAQAIAALAYGTETIPKVNVITGPGNIYVTLAKKLVYGTVGIDSLAGPSEVLVIADESANAVHVAADLLAQAEHDPMAAAILLTTDAALAKNVQVALERQLVDHPRRIDTEKAIAHYGLIVLVESLQAAAELSNEFAPEHLELEVKDPWALLPEIRHAGAIFLGYSTPEAVGDYLAGPNHTLPTSGAARYASALGVETFLKHSSIIQYSQTALQNVAGAIDVLATAEGLPSHADSVRRR

SEQ ID NO: 20232 - protein, 952 aa, Nostoc punctiforme
KYSLPLLILSLWLVAVFLLSDQPANSQHTAISNKEKSQSTLLVKRIMPSTLTENVRKTVLENGLTVLTKEVHTAPVVTVQVWYKVGSRNEEPGVNGIAHQLEHLMFKGTKNRPIQFGRLFSALGSDSNAFTSYDQTAYYGTVERNKLKALLVLEADRMQNSQIEPEQLASEKRVVISELQGYENSPEYRLNRAVMQAVFPNHAYGLPVGGTKADVEKFEVEQVQKYYRNFYSPDNAVLVIVGDFQTANTLEIIKEVFGKLPKRQGAGGRRQEVEGRRQDSEAVASPRASAEGRRQGAEGRGQEVGVISSSSSSSPIVLREPGAGRLLQVVYPLPDANQPDVPALDVMDYIFTEGRNSRLYQALVESGLASEVTASVTSLRESGWYEILVTAGSKKDLKKIDSVLSRAIANVAEKGVTTEEVERAKTQLTADVILSNRDITSQAMRLGNDETTVGDYRYTDRYLAAVRLVKPTDVVAVINKYLTKKARRVGFFEPTQKQIAGVGDKPDSAQTTENFSPGVPVLPSEVVKYLPPVDLATDAIAQVLPQKFKLTNGLRILLLPDNSTPTVTLSGYIQAGTEFDPDDRAGLAAFVADNLLNGTKSKDVLNIAKILAERGASLNFEVHREGVHIEGDSLAGDLPIILEILADVLKNSTFPAQELELHRQQILTDLQLELDEPAEVARRIFVQSIYPKKHPLHTFPTEESLQQIQRQDAIDFKAKHYRPDTTVLALVGDFDLDKVRSLIQNEFGNWEVSGQAPTLKYPPVSMPERIVSVNTVLPGKAQAVTYMGYTGIKRYDPRFHAALVLNQILGGDTLSSRLGAEVRDRQGLSYGIYSYFQAGKSTGTFLIEMQTSPEDTSQAIASTRQILQQIHQQGVTALEVETAKRTLISNYNVSLANPEELTDRILMNEVYGLDKVELHTFTDKLQKVTFEQVNQAARELLHPDQIVVVTAG

SEQ ID NO: 20233 - protein, 423 aa, Nostoc punctiforme
LDIDSVIQPFQRFGVHLGLDRIINLLANLGNPHHQVPVIHVAGTNGKGSVCAYLSSILTEAGYRTGRYTSPHLVDWTERICLNEQPISSEELSQLLEKVQGVIRPEDESATQFEVITAAAWLYFAQQQVDVAVVEVGLGGRLDATNVCLEPIVTIITSISREHWQQLGPTVADIAREKAGILKPGCPVVVGQLPLDAEEVVRSRALELKCPIFTPQPARQIATGWAEYQTLQNSQLIKYPLPLAGQIQLANSALAIAALEILQEQGWHISEEAIIKGMAKTQWPGRMQWTTWNNHKILLDGAHNTAAAQVLRQYVDSLDAVNPKPITWVMGMFSDKDHADIFAALLRPGDRLFLVPIPVESWTGRTSADLDSLANLAYRLCPQLSDRQIHPDLFTALEVAISTTSTDDLIVLCGSLYLVGDFL

SEQ ID NO: 20234 - protein, 339 aa, Nostoc punctiforme
LAGCPPDAILDFSASISPLGPPNSAIAAILSQLGNLKHYPDPNYSELRLALSHFHQLPPEWILPGNGSAELLTLIGRELAQLAATTLITPAFGDYYRTLAAYNANVLECPLSLVTGHWSLFLDKGQKTKDKGLLLNNPHNPTGKIFSRDSILPYLEQFALVVVDEAFMDFVPPNEEQSLIPVVQEYTNLVILRSLTKFYSLPGLRLGYAIAHPDCLAKWQLWRDPWPVNTLAAAAAIAALQDAEFQQQTWAWLPPARNQLFQSLAEIPGLQPQVSAANFLLVESQESTSQLQHQLLKYHQILIRDCLSFKELGDRFFRVAVREESDNQRLLTALNSVLS

SEQ ID NO: 20235 - protein, 461 aa, Nostoc punctiforme
YDVVIIGGSLAGYYAALAATQLRATVALVEPKVDYGFTHHHALTEIGKLAQKLNDAASFGIHATKTDISEDCHISMAWQEAMLYAQCVAANLKEQHSPAILAALGVDVIVGSGQFQSSPQLAFAVNNRLLHARTYLLASGSRPEIPEIEGLQSTGYLTLSNIWQSLQGETLPKNWVIIGGIPQSIEIAQTLARFGCSVTLVVKHPYALSHIDHEIAILLQAQLEVEGVRVLTDKQVTQVRLIEAKKWIQAGDKAIETDEILVATGQQPNIESLNLAMVGVKWHRRSLVVNDKLQTTNHRIYACGDVIGGYDFANIANYEAKIALNNALFFPRLRVNYRSIPWAMFSVPMVAQVGLTEAQAKRLFSRDEVLVLRQYFKTVAAAQLRDETTGMCKLIVLHNGEILGASILGAEAGELINLIALAMSQKIKVKDLANLSPVYPSFSEILEQAAREWSKQKLNSD

SEQ ID NO: 20236 - protein, 240 aa, Nostoc punctiforme
VFSSHETILASAGADGTIRLWDTITGKCLRTLQVNGWILSLAMSPQGNALATANTDTMAKIWDIKTGECIKTLEGHTGWVFSVAWSPNGQFLATSSDRCIKLWDVKTWQCIKTLEAHSGWVYSLDWSPDGQTLLSGSFDLSLKLWDINTGNCQQTLHGHTKIVLGAKFHPQGNIIASTGQDGTIKLWNSNTGECLRTLIGHADWIWAIAFHPNGQTLASGSQDETIKLWDVETGECLQTL

SEQ ID NO: 20237 - protein, 276 aa, Nostoc punctiforme
FSPNGKVLATCSDDGVIKIWNINTGKCHHTLQDDSKRSWSISFSPDGKILASGSGDHTVKLWDINTGQLLKVLKGHINIVRPVIFSSDGKIIASGSEDQTIKIWDVDSGEYLQTLEGHLAQVWSVSLSEDGKILASGSADKTVKLWDVSTGECRTTLQGNQIDGVWSVSFSPSGESVVVAGEVPVISLWDIKTGECIQTFLGHIGRVWSVAFSPNGKTLASASEDQSVKLWDVTTGRCLKTLQGYSSRVWCVAVNANGQLLAANTNKTLRIWDIST

SEQ ID NO: 20238 - protein, 423 aa, Nostoc punctiforme
KSQEVFAAAQNLMPGGVSSPVRAFKSVGGQPIVFDRVKGAYIWDVDGNQYIDYVGTWGPAICGHAHPEVIAALHEALEKGTSFGAPSTLENVLAEMVIDAVPSIEMVRFVNSGTEACMGVLRLMRAFTNRDKIIKFEGCYHGHADTFLVKAGSGVATLGLPDSPGVPKAATSTTLTAPYNDLESVKALFEENRDEIAGVILEPVVGNAGFIAPDAGFLEGLRELTHEYGALLVFDEVMTGFRIAYGGAQEKFGVTPDLTTLGKVIGGGLPVGAYGGRRDIMSMVAPAGPVYQAGTLSGNPLAMTAGIKTLELLQKPGTYDYLERITKKLADGLLQIAKETGHTACGGQISAMFGLFFTSGPVHNYEDAKKSDTAKFGRFHRGMLERGVYLAPSQFEAGFTSFAHTEEDIDQTLAIARDVMSSL

SEQ ID NO: 20239 - protein, 216 aa, Nostoc punctiforme
MSSNDLRSLHYAIPVEKIRYDERGLVPAIVQDYLDGTVLMMAWMNQESLQKTLETEETWFWSRSRQELWHKGATSGHIQKVQSIRYDCDSDALLIGVEQLGDIACHTGERSCFHQIEGNIVSPPGDALSQLFQIICDRRDNPTESSYTCKLFAGGDNKILKKIGEETAEVVMAFKDDEADAIAGEVADLLYHTLVALAHHQVDLKSVYRKLQERRQ

SEQ ID NO: 20240 - protein, 352 aa, Nostoc punctiforme
MKIDRVHFYVEDAKIWRDWFVHHLGFQSVADRNSSFHTCTEVVKSGAVCFFLSSPLLPTSPVAEFLRKYPPGVADVAFAVEDVEAAIAQAQKHGATILQPIQERQIGTAFLKCGKIAAWGGLTHTLIERSSVICPSSSVTNTNDKGQMTNDNTFTAIDHIVLNVAVGELDRAVAWYENILDFQPQQAFKIKTNRSALHSQVMVSHNGSVQLPINEPASKNSQIQEFLDVNRGPGIQHIALRTTNLVSAIAKFRASGLPLLSVPQTYYSQLKQRSGLTLSPLELEAIAQQEILVDWQEYTPVGTQQTAPLLLQIFTQPIFEQPTFFFEFIERRFQAQGFGEGNFRALFEAIES

SEQ ID NO: 20241 - protein, 209 aa, Nostoc punctiforme
QGVILDVDGTLVLSNDAHAQAWVEAFSAFGYEVKFEQVRPLIGMGGDQIIPKFAPGLSDRQGKGKEIAEKRKELIINKFATNLSPATGARQLILKMLSVGLRLIIASSATSQELSVLLKAAQVDDLLSQDEATTSSDAEASKPDPDIVEAALSKLNIEPASVVMLGDTPYDVESANKAGVGVIAFRCGGFDDSQLKDAIAIYDDPSDLL

SEQ ID NO: 20242 - protein, 1005 aa, Nostoc punctiforme
RTVLIFDQFEEFFFVYTEPAQRKQFFEFLGECLNVLSVKVILSLRVDYIHYLLECNDLSSLKIIGNDILSNNVLYKLGNFSPTDTKSIIQRLTENTSFYLEPALVEQLVLDLAGELGEVRPIELQVVGAQLQTENITTLAEYRQRGTKDELVKRYLDEVVNDCGVENQQAADILLYLLTDEKGTRPLKTRAELERDLQGYFSEIPPTPLKKGGFILSTPFLRGSPQAGGSEARAKQASEINKLDLILEIFVQSGLVVLLPENPADRYQLVHDYIAAFIRQQQEPKLKQVMAELEKERKERKLSEAKLNSFLKRALFSTVAAGLGFAGLAAATFQWAVEANVNQISAINNSSEAFALSEKYPDALIAALKAGSKLKHTLWAQHRSDILMQTVVTLQQAVYLKPKEKKENRAIEVNTLEGHSDWVSSVAYSPNGYQLASASADKTIKIWDVSSGQLLKTLTGHSDRIRSIAYSPNGQQLVSASADKTIKIWDVSSGKLLKTLTGHTSAVSSVAYNPNGQQLASASDDNTIKIWDISSGKLLKTLPGHSSVVNSVAYNPNGQQLASASNDKTIKIWDINSGKLLKSLTGHSSEVNSVAYSPNGQQLASASFDNTIKIWDISSGKLLKTLTGHSNVVFSVAYSPNGQHLASASADKTIKIWDVSSGKPLKSLAGHSNVVFSVAYSPNGQQLASASDDKTIKVWDISNGKPLESMTDHSDRVNSVVYSPNGQHLASPSYDKTIKIWNVSSGKLLKTLTGHSSEVNSVAYSPNGQQLASASWDKTIKVWDVNSGKPLKTLIGHSSVVNSVAYSPNGQQLASASFDNTIKVWDVSSGKLLKTLTGHSNAVSSVAYSPNGQQLASASLDNTIKIWDVSSAKLLKTLTGHSDAVSSVAYSPNGQQLASASDDNTIKIWDVSSGKLLKSLSGHSNAVYSIAYSPNGQQLASASADNTIKIWDVSSGKLLKSLSGHSDWVMRVTYNPNGQQLASASVDKTIILWDLDFDNLLHSGC

SEQ ID NO: 20243 - protein, 266 aa, Nostoc punctiforme
LQIAFIGGGTMGEMIISRLLLTKIVPKADLIIVSDPVSARCLHLEREYGVRTTTSNIEAVLGASIVILAVKPQVLAEVLGMLKDKIPPNALVISIVSGANISSLCQGLNHPAVVRTMPNIAVQVGHGTTVWSASSSVTEIQRSHTQVILQALGKEFTTQNEHYLDMATALSSAGTGFVFLYIEAMIDAGVQMGLTRTQAQELTLHTIAGSVELMFQTHEHPAVLRNKVTSPGGVTAAGLYELEKGGMRTVISNAVLAALSRNQQLG

SEQ ID NO: 20244 - protein, 460 aa, Nostoc punctiforme
SDTNGTNVPIAIVSMGCLLPGADSPQAYWRNIQDGVTGIVDLGLIDPSLVPDFMSDGSVIPEKTYTLLSGRINQVEYEKGIPYSLEEFNNLTRGQQLLAKALAQCLNPIHQQVSATKKVHCLLGSTADGIKEYDEALFAESLKYFVEKLDEPEQLRTTFSNSLQTLLGRKSGEHEFLAPDLCYKRVVQKFLADGVKTLLLDAACASSLYTVDIGIKLLQNHESDLVLSGGVFAPGVAMNCLFAQFKGLSATGSRPFDATADGVVFSEGAAILALKRLPDAIAAGDRIHGIIRGVGTSSDGKSAAVNVPTKVGQVLACQRACENAQINPNTIQYIEAHATATPVGDGTEFKSLSEVFDKREANLPPIYLGSVKALIGHTGWVAGTASIIKVCQALKAQTIPRQYNYKSPNKDIELQGSCLSIPTTPLPWPNNIAGQPRRAAVNGFGFGGTNANLIIEAYDP

SEQ ID NO: 20245 - protein, 245 aa, Nostoc punctiforme
HKIALITGSGRGLGKVIAQHLAELGATVIVNSFHSTASGEETAAEIIANGGKAIHIWGSVANETQLHQLFDKIEAEFGRLDFFISNASNGMLAPLEEIKVEHLDKAFHTNVIGLHQGALRAAKLMKKQGGGKIITLSTNAAHRYIPYFGCMATVKAAVEALTRYLAMEFEPYNIQVNCISSGPVYGELINKWPDSEKLIPYWESISLGNKLCMPEDVADMVSYLLREEVKRINGSILLIDAGQSI

SEQ ID NO: 20246 - protein, 489 aa, Nostoc punctiforme
WQGIGGLADVLQEIRELVEIPLKRPDLLVKLGLEPPRGVLLVGPPGTGKTLTARVLAEELELNYIAINGPEVMSKYYGEAEARLRSIFEKATRSAPCLIFIDEIDSLAPDRSQVEGEVEKRLVAQLLGLMDGFAKTEGVLVLAATNRPDYLDPALRRPGRFDREVQFRVPDRDGRLEILTILTSAMPLETSVNLGAIADLAVGFVGADIKALCQKAAYIALRRQVPSLNSPVPENMTIVQQDFLEAIKEIKPSVLRDVAIEVPSVSWDDIGGLDDVKQKLQESVEGALLYPELYEQTKAKPPRGILLWGSPGTGKTLLAKAIASQARANFIAVNGPELLSRWVGAAEQAVRELFRKARQAAPCVVFIDEIDTLAPARGRFTGDSGVSDRVVGQLLTELDGLHECPKVLLVGATNRPEALDPALLRAGRLDLQIKIDLPDRASRLAILRVHNLDRPLVDVDLETWATVTEGWNGADLALLSNQAALSAIR

SEQ ID NO: 20247 - protein, 626 aa, Nostoc punctiforme
LAIQTMGENLEKYPNQLLAPVLGSLKEAMNTPTEANSLRGHEQEVNCVAFSPDGKFIASGSSDSTLCLWNIIGNPTAQFLCGHEQEVNCIAFSPDGKFIASGSIDGILCLWDLQGNLITQPWQGHEEGVISVAFSPNSDGCANPSGVSIVSVGFDGTVCLWDLQGNAITQPWRGHKEGVISVAFSPNGDCIISVGFDGTVCLWDLEGNTITQPWHKHEAKIICATFSPDRKFIVSGGSDSTVRLWDIQGNPIGQPWHGHEGHVNSVAFSPDGKFIISGSCDRTIRLWNINGNSITQTWRGHEGEVNSLAFSPDGKLIISGGDRTVRLWELHQILQDRVIGRSQRKYENWVNSVAFSPDGQWIVSASNDSTIRLWDSNGNPTGQPWQGHEKEVNSVAFSPDGQWIVSASNDSTIRLWDSNGNPIGQPWQGHEKEVNSVAFSPDGQWIVSASNDSTIRLWDSNGNPIGQPWQGHEKEVNSVAFSPDGQWIVSASNDSTVRLWDSNGNPTGQPWQGHEKEVNSVAFSPDGQWIISASNDSTIRLWDSNGNPIGQPWQGHEKEVNSVAFSPDGQWIISASNDSTIRLWDSNGNPIGQPWRGHEYWVNSAAFSPDGQWIASGSLDGTVRLW

SEQ ID NO: 20248 - protein, 540 aa, Nostoc punctiforme
LLRFRAFSQPDEIAYTFLLEGEKDTVNLTYAQLDKQAQTIAAYLQFKEQVLLLYPPGLEYIAAFFGCLYAGAIAVPAYPPRPNRSLQRLQSIVADAEASIVLTNTAVLSNLERQLAELPDLRALNWLTTDSTDNNLANKWQQPEIDSDSLAFLQYTSGSTGTPKGVMVSHGNLLHNQKMIQAGFQNTEKTIIVGWLPLYHDMGLIGNVLQPLYLGVRCILMSPVAFLQRPIRWLEAISRYQGTTSGGPNFAFDLCMRKVTPQQLSALDLSSWNVAFNGAEPVRVETIEKFSSTFASCGFRKEAFYPCYGMAETTLFVSGGIKTDAPVYITVREDELAQNRIVLAQGTEGTRTLVGCGQTYINQEIAIANPETLIRCAADEVGEIWVAGSSITQGYWNRLELTEQVFRANLADSKKQFFRTGDLGFLHNGELFITGRLKDLIIIHGRNHYPQDIEMTVADSHEALILGAGAAFTIDSKGEERLAIVQEIDRHYRNLDNDAVTEVIRTAIAQQHELQVHAIALIKMGSICKTSSGKIQRHAC

SEQ ID NO: 20249 - protein, 439 aa, Nostoc punctiforme
INPEVEVMLDKALLAQKEIQTWSEERIDALLLVIASSIAQHAESLATATVKATRVGDILDKVTKNKIASLGIYRSLVGKSGCGFISNNKINNVCEIASPMGIIFGMIPMTNPVATAVFKALICIKSRNALILSFPLSTKNVGTLVCEIIQEALIRQDAPVELIQWLKHRSSREQTEILMKHKNVSLILATGGASMVKAAYSSGTPAIGVGPANTPTLICADANIQHAARTIIVSKSFDNGLICGSEHNLIVDARVRKNFIKVLEQEGAAILTHEEKSYFSTVAFEDKSNRLQAKIIGQSAAKIAVMANIKRDYHIKLIIVPNEFLSLDNPYAYEKMAPILSLFTVQNEIEGIDLCRSILQIEGKGHTAIIHTKNKAVVRRFGLEMPASRILVNSPGVHGIIGLTSALDPSFTLGCGTFGGNSTTDNVTYSNLLNLKRVA

SEQ ID NO: 20250 - protein, 337 aa, Nostoc punctiforme
MELGMIGLGRMGANMAHRLTQAGHTVIGYTRQPQKAEVLVQEGAIARGVTSFVELIEALTPPRAVWLMLPAATVDATLHTLMPFLDADDIIIDGGNSHYIDDIRRADQLKVKGIEYIDCGTSGGIWGAERGYCLMIGGALAVVKYLDPIFAALAPGVSAAPRTPGRELMGGTAEQGYLHCGSHGAGHFVKMVHNGIEYGIMAAYAEGLNILHHANIGKQLHQIDAETAPLRNPEFYQYDFNLADIAEVWQRGSVISSWLLDLIAIALLKDPDLANFEGRVSDSGEGRWTLMAAIEEGVPVPVLSTALYTRFSSRGQSDFANKLISALRYEFGGHLEK

SEQ ID NO: 20251 - protein, 450 aa, Nostoc punctiforme
SDALVFFGITSDLAYKKIFPALQAMIQRGHFDIPIIGVGRRDWSIEQLQSYVRKSLEEQASVDEAAFQKLCSLLYYIFGDYSDRATYDKLCQVLQIAEAPLYYLAIPPSLFATVVEGLGQSSCVKNGRVMVEKPFGRDLESARMLNCILHSIFPESHIFRIDHYLGKEPVQNLLYTRFANSLLEPIWHRVSIASIQITMAEKFGIDARGQFYEETGAIRDVVQNHLLQVTACLMMDPPINEQHEAIRDERARLLKSIDPIEPSNVVRGQYKGYASEPGVAPDSKVETFAAVKLNIDTWRWASVPIYIRAGKCLPSTTTEVVVRLKRPPQDVFGERAFGLANYFYFRLSPNVLTAIGIRSKTPGDGMVGSEVGLVAQVEHGNEMNPYERLFEDAMKGDSMLFARQDEVEAQWQIVAPILDRATPVYEYAPHTWGPPLADHMIPPDGGWHNP

SEQ ID NO: 20252 - protein, 431 aa, Nostoc punctiforme
  unsure (1)..(431): unsure at all Xaa locations
PRIPHLITSLPGPLAQAIVQRDRAVTSPSYTRDYPLVVSRGQGCMVEDVDGNVFLDMTAGIAVTATGHAHPEVVKAIQEQSERLLHMSGTDFYYEPMVELAEQLAIRAPFPQPQGNSAFPAKVFFTNSGAESNEGALKLAKYYTKRSLIVAFLGAFHGRTYGAMSLTGSKAVQRANFGPLVPGVTHIPYGTHASLDYLEQQLFGTILPPQEVAAIVVEPIQGEGGYIVPEDGFLKRIRDICDRHGILMVVDEVQAGMGRTGRLFAIEHWGVMPDIITTAKGIASGLPLGAILAKPELMTWPPGSHATTFGGNPVACAAGIATLRLLESGLMANATQMGELLQASLSELHQRFPRVSPPRGKGLMVAVDLLDEQGNLDRELRDRIIQEAFLRGLLLLGCGKAAIRFCPPLVIDSDQIQIALQIISNILTSXK

SEQ ID NO: 20253 - protein, 369 aa, Nostoc punctiforme
LQVKAAVAYSAGKPLTIETVQLSGPQAGEVLVEVKASGICHTDAFTLSGDDPEGLFPAILGHEGAGVVVEVGAGVTSLKPGDRVIPLYTPECRQCEYCLSFKTNLCQAIRLTQGRGVMPDGTSRFSIDGQMIHHYMGTSTFANYTVLPEIAVAKIREDAPFEKVCYIGCGVTTGIGAVINTAKVEPGANVVVFGLGGIGLNVIQAARMVGANMIVGVDINPSKRALAEKFGMTHFVNPQEVEGDLVPYLVDLTKGGADYSFECIGNVKIMRQALECCHKGWGVSVIIGVAGAGQEISTRPFQLVTGRVWKGSAFGGARGRTDVPKIVDWYMQGKINIDDLITHVMPIEQINDAFELMHKGESIRSVVTF

SEQ ID NO: 20254 - protein, 416 aa, Nostoc punctiforme
LTQIGAQMSKLTGVRAIMKDIIETLRAGAGQQFINLSAGNPLILPEVEQLWRDCTAQLLASPEYGEVVCRYGSSQGYTPLVEAIANDFNKRYGLNLSERNILITPGSQTLYFYAVNSFGGYTPSGELKQIVLPLSPDYTGYGGICLVPKALIAYKPTLDIDEAAHRFKYRPDFSQLSITEDTGCVLFSRPCNPTGNVLTDDEVKKIAALAAPYNLPVLIDSAYAPPFPALNFTEMTPVFGDNILHCMSLSKAGLPGERVGIAIGDEKWIEVLECFQANIGLHSSRYGQAIAALAINSGALVEISHTVIRPFYQNKFSVLETSLEQAMPKDLPWFLHRGEGAIFAWLWLEDLPISDWEFYQQLKQVGVIIVPGSTFFPGLEEEWAHKHQCFRISLTGTDEEIATAMQRLAKVAEEAY

SEQ ID NO: 20255 - protein, 280 aa, Nostoc punctiforme
IPIIDLSQFQISNQVRRQNVVKNIYQACHEIGFMYIQNSGISPDLLEQVFSASKSFFDSPLAVKEQLAWNNEFINTGYVGLEREHLNPNQPGDLKEAFNIKNDIIINNFSSPILLTNNPVISTFYNACTELANTVLQAFALALELPEYFFTTRHNQKNHTLRLLHYPPLQTSPKPGQVRAGEHSDYGSLTLLFQHAVGGLEVQTTRKEWIAAPLIPGMVLVNTGDLMQRWTNHIFCSTKHRVMIPNDERVKKSRYSIAFFCHPNDDTEIACLESCSQRQS

SEQ ID NO: 20256 - protein, 416 aa, Nostoc punctiforme
  unsure (1)..(416): unsure at all Xaa locations
MIEDGEANEIKRDYLDILESLLKLIHAKAKEKGLDPTKDVHIYSSSSKVYQGTLGESPSKNLLTPTIVENLKKALSDPKNSQGAISIKIGNEKVFHIKNGEVLTDKLGLAPASQKNKVVSNERIYSVEALGKQVQVLQKKLSEQQKLVDSIKSEQLSPESLSQLAAQVAEMSKSLEKQQQLIENTQKALSQVNERFLPQVQNTVLQNWVGTVENKVKQTAKNVFERIKDVLTPEVTKLRKEIASLKSQINEQITSFQDEVKYQTDSVRNQLNQQVGNLTQEIRTQVDSVKNTVDQSLMGVQSAIDNTRTELRAAVEDAKSQAIEQSVKALLNILGKDNPDGSKSFKSRSFDFERLGDNVIVRAKNGEPVLTDGVLSPNVSDQQLQALDKVQSFVDMHHQIQQDSQQESQFRNMHRX

SEQ ID NO: 20257 - protein, 252 aa, Nostoc punctiforme
KLLKTLTESKGEVSEVSFSGDDNLIALFTSDDTVKIKKRDGTLIASYKSHHSKLTSGVFSPDGQTIAMAGVDKNVQISRRDRLWPGVAHRAATLQILKGHQAEVWHVVFSPDGKLVASASGDNTDKLWTLDGNLFRTLVGHSAAVWRVVFSQDSKMLATGSGDNTVKLWTLDGKLLNTFKGHKAGIWGIAFTPDGKIVASGSVDASIKLWKLDGTEVTTLTGHTAAIRVVAISPDGTLLVSGGDDNTLILWN

SEQ ID NO: 20258 - protein, 198 aa, Nostoc punctiforme
TVLITGASEGIGKATALLFARQGYDLVLAARHADRLEALAQEVQSIGCPAPLTITCDVTDSSQVNALVQKALGNYGYIDVLINNAGIFASGPVEQFSLSDWHQIIDTNLWGYIHTINALLPHFLQRRSGTIVNLSSIGGKVPSAYLVPYCTSKFGVTGLTESLQVELQPKGIHVCGIYPNLIKSTLMERAVFRGQDEQ

SEQ ID NO: 20259 - protein, 166 aa, Nostoc punctiforme
  unsure (1)..(166): unsure at all Xaa locations
SSLSGGMKRRLQIARALLHQPQILFLDEPTVELDPQTRRSLWEIIRDLNKQGRTMLLTTHYMDEVEFLCDAFCFTKLGCIGIMDGDRLICFGTLPQLHSVYEKGLVMKQLSVSEVGNDSVRSWKYLFFQSLEAVNVYLNEQPDKTGMVVRPSNLEDIFVELTGRXL

SEQ ID NO: 20260 - protein, 184 aa, Nostoc punctiforme
MTSQVAAAEVAQPYAQALLSIAQSKNLTEEFGEDARTFLGLLRADKQLHNFFSNPFIQAENKKALIKQILGEGSNPYLRNFLLILVDKRRIAFLESIFQQYLALLRQLNQTVLAEVISAVPLTEAQQQAIIQKVIAISNARQVELETKVDSELIGGVIIKVGSQVIDASIRGQLRRLSLRLTNS

SEQ ID NO: 20261 - protein, 503 aa, Nostoc punctiforme
ISIRPDEISSIIQQQIEQYDQEVKVANVGTVLQVGDGIARIYGLEKAMAGELLEFEDGTIGIAQNLEEDNVGAVLMGEGLEIQEGSSVTATGRIAQIPVGEALIGRVVDALGRPIDGKGDIKSSESRLIESPAPGIIARRSVHEPMQTGITAIDSMIPIGRGQRELIIGDRQTGKTAIAIDTIINQKEEDVICVYVAIGQKASTVANVVQTLQEKGAMDYTIVVAASASEPATLQYLAPYTGATIAEYFMYKGKATLVIYDDLSKQAQAYRQMSLLLRRPPGREAYPGDVFYIHSRLLERAAKLSDELGKGSMTALPIIETQAGDVSAYIPTNVISITDGQIFLSSDLFNAGIRPAVNPGISVSRVGSAAQTKAMKKVAGKIKLELAQFDDLQAFAQFASDLDKATQDQLARGQRLRELLKQPQNSPLSVYEQVAILYAGINGYLDDVPVDKVTSFTQGLREYLKTGKTQYAEGVRTSKALGDAEEAALKEALTEYKKTFKAA

SEQ ID NO: 20262 - protein, 315 aa, Nostoc punctiforme
MANLKAIRDRIQSVKNTKKITEAMRLVAAARVRRAQEQVLATRPFADRLAQVLYGLQSRLRFEEANLPLLRKREVKSVGLLVISGDRGLCGGYNNNVIRRAENRAKEIKAEGLNYQFVLVGRKSTQYFQRRDQPIDATYSGLEQIPTAAEANQIADQLLSLFLSEEVDRIELIYTRFLSLVSSRPVVQTLLPLDPQGLEAADDEIFRLTTRGGKFEVEREKVASQVRPLAPDMIFEQDPVQILDSLLPLYLSNQLLRALQESAASELAARMTAMSNASENAGELINTLTLSYNKARQAAITQELLEVVGGAEALT

SEQ ID NO: 20263 - protein, 406 aa, Nostoc punctiforme
WQRIPLTLQILIALVAAVSVGIALGAGNPNPSNATLINNLAIPAELVLKALRALATPLILVAVLHTLMTTNIPGTAGRRLAVLLLTNTTVAILVGLFVANVLRPGTWGNVATSTTTQITTQSLDPWGILKDAVPEAVLKPLVDNNVIQLIVIALSFGIVLRGLKSEQIAQGKKGYQPIEDVIGILFEAVVRVLNWVIALVPFAVFGIVAKTVAMQGFTPFKSLGAFILAVLLALALQACYYLTRVKFGSWVPPLKFLAGGSDAFLTAFSTSSSAAAMPVTFEVLQTKVGLRESSAALGALVGANFNNDGTALYEAMSALYISQLIGQHLTLGQQLIVILTSIFASVGAANIPNAGLVTMTLVFTSVGLPTQYIALLVTIDWFLDRCRTAINVMGDMTVSALLDGKK

SEQ ID NO: 20264 - protein, 609 aa, Nostoc punctiforme
NKRWRNAGLYALLFIVVIALGTAFFDKQPQSRETWRYSRFIQEVQQGRVEKVSLSADRSTALVTPKYDPAKRIVTLVNDPDLINTLTSKGVDISVLPQTDEGFWFKALSSLFFPVLLLVGLFFLLRRAQSGPGSQAMNFGKSKARVQMEPQTQVTFGDVAGIDQAKLELNEVVDFLKNADRFTAVGAKIPKGVLLVGPPGTGKTLLARAVAGEAGVPFFSISGSEFVEMFVGVGASRVRDLFEQAKTNAPCIVFIDEIDAVGRQRGAGLGGGNDEREQTLNQLLTEMDGFEGNTGIIIIAATNRPDVLDAALLRPGRFDRQVVVDRPDYAGRSEILKVHARGKTLAKDVDLDKIARRTPGFTGADLSNLLNEAAILAARRNLTEISMDEINDAIDRVLAGPEKKDRVMSEKRKTLVAYHEAGHALVGALMPDYDPVQKISIIPRGRAGGLTWFTPSEDRMDTGLYSRAYLENQMAVALGGRIAEELIFGEEEVTTGASNDLQQVARVARQMITRFGMSDRLGPVALGRQQGNMFLGRDIMSERDFSEETAAAIDEEVRKLVDVAYTRAKEVLVGNRHILDQIAQMLVEKETVDAEELQEILSNNDVTTA

SEQ ID NO: 20265 - protein, 316 aa, Nostoc punctiforme
MRSYSLIAPAKINLYLEIIGDRPDGYHELAMILQSIGLSDQIDVRSISTDSIRVHCNHPQVPTDKSNLAYRAAELMVRQFPEAFAKYGGVEITVNKQIPVAAGLAGGSTNAAAVLVGIDLLWKLGLTQSELEELGGTLGSDVPFCVAGGTAIATGRGEQLSPLPSLDNIYIVLGKYRSLEVSTPWAYKTYRQQFGHSYIIDTDNLAARASAVHSGAIVKAILHKDTREIAQKLHNDLERVVLPAYPQVLHLREVFANQEGVLGTMMSGSGPTVFALFESQQQAELVLQQVREAIIDEDLELFVTRTITHGIKVTSS

SEQ ID NO: 20266 - protein, 569 aa, Nostoc punctiforme
TLVDVLIYRAKHQPEQKAYTFLKNGEQEADSLTYQELHLRSRAIAGSLQALNLVGERALLFYQPGLDFIAAFFGCLYAGVVAVPAYPPRKNQNLSRLQAITADAQAQIVLTTTTLLNNRELFAEQELELGQLQWLTTDVLTNELTQSWQQLKLEENSLAFLQYTSGSTGNPKGVMVSHGNLLHNSRAIAQCFGHSSNSKGLIWLPPYHDMGLIGGILQPLYAGFPVVLMSPVDFLQKPIRWLQAISRYKATTSGGPNFAYELCLRKATPEHLESLDLSSWDLAFTGAEPIRAQTLEQFTKTFAPCGFNQKAFYPCYGMAETTLIVSGGEKTELPILCKVDPAALEQNRVVNVIDEQIDARTLVGCGQSCQDMSIVIVNPESLSVCSEKQIGEIWISGSSVTQGYWNQAELTEKNFYAYADMGEGPFLRTGDLGFLQDDELFVTGRIKDIIIIRGQNHYPQDIELTVEKSHPALRVGCLAAFAVESKGSERLVVVAEVERTYLKKLNIQEVVNKIRQTVVTEHGLDVFAVVLVKTGSIPKTSSGKIRRYVCRTAFLSGSLDVVQDWSESP

SEQ ID NO: 20267 - protein, 221 aa, Nostoc punctiforme
AIVTGASSGIGRAFAHDLAQRGMNLILVARQLAGLEEVAAECNSWETKTYLCAVDLTEPNGIHKLISLVGDREVGILVNNVGIVARGLFTKIELQRQLDMVTLHCTVPVALTHHYLAQMLKRNQGAIINISSVAAYHFQPLLTTYAATKEFDWKFSKSLAWELKDTDIDILTVVPGFTKTAAYEAADWKIDFDSIPALFKPQNPREVSKKSLDILGKQRSI

SEQ ID NO: 20268 - protein, 339 aa, Nostoc punctiforme
QMSNLQKVIVFGASGFLGEHIIKSLISENWDVYAAVRTKPESSTDGFNQTQVTYYEGDLEDQKYIQDAIAGMDAIIFSAGCTWKSDLEISEYYRRNVQITKNFFTALGDRPNVRIVYTSSMSVIAGSKSDYIFFEDSDRSQVSQNQLSPYDLAKIECEQIALDYAQRGNNLVILNPGNMLGPGVFNHSKITTSILVLWFCQKQFPFYINGGHSYCDVRDVAKAHVAALTRGRSGERYIVAGDNLDMASISSLLVKMTGFKMPQQLPASGVYLLSLLLESLSLLSFRLFKNPYHPDFVKSFALHYYANSQKAIKELAYNITPIETTLIDTIKYFGKRELL

SEQ ID NO: 20269 - protein, 699 aa, Nostoc punctiforme
DCGAACLVMVSRYWGKNFSVNRLRDIANVDRNGSSLRGLSAAAESIGFATRPVKASLDQLAKQKLPAIAHWEGKHYIVVYEITPKQVIVADPGIGQRTLSHQEFKANWTGYTLLLQPTAWLKDAKETITPFWQFFELMKPHALVMLEVFIASLFIQIFGLVTPLFTQLILDRVVVQRSELTLTAVGLGLLIFSLFRVAMTGLRQYLLDHTANKVDLALIVGFIRHTLRLPLSYFESRYVGDIISRVQENRKIQRFLSGEALSILLDLVTVFIYLGLMFWYSWKMALLVLVIIPPFFLLALIATPFLQKISREIFNAVAKESSYLIETLSGIRTVKSTAVEQTVRWHWEELLSKEVKTNFSGQIISNRLQIFSNTIEAVLTTVLLWFGAYQVIHNELTIGQLVAFNMLLGNIITPFQRLTVLWNQLQEVVIAVERINDVLDAEPEEDLQHQVRQSLPSIQGNIRFDNVTFRYHPESDVNVLENLSFEVQSGQMVALVGRSGSGKTTISKLVLGLYPPTDGKVLIDGQDITSLSLRSLREQVGVVDQDTFLFGGTIRENISLAHPGATLVEIIEAARLAGADQFIKNLPMGYETQIGEGGGMLSGGQRQRIAIAKALLGNPKLLILDEATSHLDAESERIIQTNLNTILQDRTTLVIAHRLSTVRNADLILVLDRGVLIESGTHKELMAKRGHYFYLNHQQ

SEQ ID NO: 20270 - protein, 640 aa, Nostoc punctiforme
VSQLQKQKSAQLRDLGRLPFPMMRQRGEKGFRRISWDEALGIISDRIRATTPDRLSFYITSRGTVNETYYATQKAVRAMGSNNIDNAARICHSPSTAGLKAALGAGATTCSYKDWIGTDLLIFIGSNVANNQPVTVKYLHYAKKAGTKIVVINTYREPGMERYWVPSIVESAVFGTKFAEDFFLINMGGDIAFLNGTIKHIIANNWVDQSFIDIHTVGFAELKTSLESQSWEELERLSGTCREQMYAFAKMVKEANKAVFVWSMGITQHECGEDNVRSIINLALTKGFVGREGCGLMPIRGHSGVQGGAEMGCYATVFPGGKPITPENAAQLSQHWGFDVPASKGLIAPEMINAAYQAELDVLFSVGGNFLEVLPEPDYVEAALKKIPLRVHTDIVLSSQMLVEPADIVVLLPATTRYEIPGGVTETNTERRVIFSPEIPGPRIGEARPEWEVFLELARRVQPDLADKLAFADTSAIRQEIAQVVPQYAGIQHLQQPGDQFQYGGSHLCFGWNFPTSDGKAHFGVLLPRQRELPEGYFLVATRRGKQFNSMVQERKDAITGAVREAVLINAADAALLDLKDGDKVILKNELGELFCEVYIAPIQSGNLQVHWPEGNVLLDKSKRSLEGAPDYNAIARLEK

SEQ ID NO: 20271 - protein, 407 aa, Nostoc punctiforme
KVVGYFENWSQYRQGGGKFLPAQIDPSLYTHINFAFGIFGYITKGIAPNNPRLTGDYRIQPIEWNDQTVLYPEIQKLKLKNPNLKTLLSIGGWGFNDPQDPIQIGTYTYNLFSQMAASAAGRQQFIYSALEYAQKYKFDGIDLDWEYPGYQGRGGRPEDFANFLALVREFRTAISGRNFLLTIASSAIVPSGVPDQYRSNPGSYFQWLAQCAQYLDWLNVMSYDYHGAFPDDKVTGMNAPLPQDSTPKGPFSVKNTIEAYLAAGIPNSKIVMGIPTYGRTFKVSSPLSLTDNGPGKSYSSVGPAGISTVTPGVLSYYEIQNRISSGSLTRRWHEPTLTPYAYNSQTSEWVSYDDTESIGYKTSYLIEKKLGGAMIWAIGLDQFQSGFPLIKRVKSILDNPALRPKLP

SEQ ID NO: 20272 - protein, 571 aa, Nostoc punctiforme
GLEVANFIEIIRFRSLSQAGKTAFLFLQDGETEAAKITYRELDQKAQAIAAQLQTLTTPGDRVLLLYPSGFEFIAAFVGCLYAGVVAVPAYPPRRNQKMLRLQAIAIDAQATLVVSTTSVLGNINSQAENPGFLGLKCVATDNLIPIEDFIPYRATPDTLAFLQYTSGSTGTPKGVMLNHGNLLHNQRLIQTAFEHTEQTIFVGWLPLFHDMGLIGNTLQPLYLGIPCIFMSPTAFLMRPLQWLMAISKYKATTSGGPNFAYDLCASKITSEERSTLDLSTWQVAFNGAEPIRAETIERFASTFADCGFRREAFYPCYGMAETTLIVSGGLVAPPPVLQTFQKAALEQHLVVPASNSDDATQTLVGCGQPLQDMRVVIVHPERMTRCNSDEIGEIWVSSASVTQGYWNQIDSTQRTFQAYLQDTGAGPFLRTGDLGFLKDGELFVTGRLKDLIIIRGRNYYPQDIESTVQKSHLSLRANCGAAFSVEIDGEERLVVIQEVERAYYRNLEVEEVVGAIRSAVSEEHELQVYAVVLLKPGGILKTSSGKVQHYACKAGFLANTLDAIGSSILE

SEQ ID NO: 20273 - protein, 276 aa, Nostoc punctiforme
AFENVDIVLASAGGSTSKTWAAVAVAKGAVVIDNSSAFRMNPEVPLIVPEVNPQAAANHQGIIANPNCTTILMTVAVWPLHKVKPVQRIVASTYQSASGAGARAIAEVKTQTSAILQGQPPVAEVLPYPLAFNLFPHNSPLNDLGYCEEEMKMVNETRKIFGTQQIRITATCIRVPVLRAHSEAINLEFETTFSAEEAREILNSSPGVKLVEDWETNHFPMPIEATGRDEVLVGRIRQDISHSCGLELWLCGDQIRKGAALNAIQIAELLVEKNLL

SEQ ID NO: 20274 - protein, 291 aa, Nostoc punctiforme
FGNVLTAMITPFKADGSVDYGVAAELAVHLANNGTDTLVMCGTTGESPTLSWDEEYQLFVEVLQSVAGKAKVIAGCGSNSTKEAIAATQKASKIGVHGSLQVVPYYNKPPQAGLEAHFQAIAQACPDLPLLLYNVPGRTGQNLQPETVARLAEVSNIVGIKESTGSIDQASEIRRLTPKEFHIYSGDDYMTLPLLAIGAKGVVSVASHLVGNQLQQMIQAFSAGKIEVARDIHLQLFPLFKALFLTSNPIPVKKALKLQGWEVGSTRPPLCEADLEVSQKLEGVLKELSLI

SEQ ID NO: 20275 - protein, 435 aa, Nostoc punctiforme
IQNQREFFETGKTKDVTFRIEQLKNLKQAIIEHEQAIVEALKADLHKPELEIYITEIGVIKEIDYAIKHINAWTKPKKAAVSFDFFSYSAKIYPEPLGVVLIIGPWNYPFQLIISPLVGAIAAGNCAIIKPSEIASHTSGVIAKIIAKHFDPAYIAVLEGDVEASQKLLVEKFDHIFFTGGTAIGKIIMAAAAKYLTPVTLELGGKSPCIVDTDINLEHTVRRITWGKFINAGQTCIAPDYLLVNKKIKKDLIDGLKKCLKEFYGDNPISSPDYARIISQKHFDRLVNFLKDGEVIIGGENQSSERYIAPTVIDNVSSEDSVMQEEIFGPILPIIEYTDVAEAIALINSRPKPLALYLFSQNKNLQKRVLQETSSGGVCINDTVIQVGVSSLPFGGVGDSGIGNYHGKASFDTFSHNKSVLQNSFWLDLKWRYAP

SEQ ID NO: 20276 - protein, 544 aa, Nostoc punctiforme
MAKRIIYNENARRALERGIDILAEAVAVTLGPKGRNVVLEKKFGAPQIVNDGVTIAKEIELEDHIENTGVALIRQAASKTNDAAGDGTTTATVLAHAIVKEGLRNVAAGANAISLKRGIDKATAFLVDKIKEHARPVEDSKAIAQVGAISAGNDEEVGQMIAQAMDKVGKEGVISLEEGKSMFTELEITEGMRFDKGYISPYFATDPERMEAVFDEPFILLTDKKIALVQDLVPVLEQVARAGRPLVIIAEDIEKEALATLVVNRLRGVLNVAAVKAPGFGDRRKALLEDIAVLTGGQLITEDAGLKLDNTKLDSLGKARRITITKDSTTIVAEGNEAAVKARVEQIRRQIDETESSYDKEKLQERLAKLSGGVAVVKVGAATETEMKDKKLRLEDAINATKAAVEEGIVPGGGTTLAHLAPELEVWAKSNLKDEELIGALIVVRALPAPLKRIAENAGQNGAVIAERVKEKEFNVGYNAATNEFVDLLAAGIVDPAKVTRSALQNAASIAGMVLTTECIIVDKPEPKDGAPAGAGAGGGDFDY

SEQ ID NO: 20277 - protein, 488 aa, Nostoc punctiforme
VIVIGAGIGGLTAGALLAHRGYSVLVLDQALVPGGCASTFKRQGFTFDVGATQVAGLEPGGIHHRIFSELSIDLPQATPCDPACAVYLPGESTPINVWRDQEKWQEERQRQFPGSEPFWQLMATLFDASWEFQGRDPVLPPRNLWDLWQLAQAVRPSTLITVPFTLFTVGDALRLCGLGNDQRLRTFLDLQLKLYSQVDAEQTALLYAATALSVSQLPQGLFHLQGSMQVLSDRLVQSLERDGGKLLMRHTVEEIKVESGKATAVVIRNQKTGEVWTEAANHIVSNVTVQNLVQLLGEQAPSGYKNRVEKLPQASGAFVVYLGVDASAIPPGCPPHLQFLYDVNGPIGENNSLFVSVSHPGDGRAPEGKATIIASSFVDPAQWWETEDYEGLKEKFTQEAIARLAQYFYLKPETIIHQEAATPRTFAHFTARDRGIVGGIGQRIPTFGPFGFANRTPIQHLWLVGDSTHPGEGTAGVSYSALTVVRQI

SEQ ID NO: 20278 - protein, 347 aa, Nostoc punctiforme
MGVSSTTPHLLRAARGEVVDRPPVWMMRQAGRYMKAYRDLREKYPSFRDRSEIPDVAIEVSLQPWKAFQPDGVILFSDIVTPLPGLGIDMDIAEGKGPIIHSPLRTQEQIDRLHPLEPEAALPFIKTILQALRSEVGDKSTVLGFVGAPWTLAAYAVEGKGSKTYSIIKNMAFSDPTILHQLLTKLADAIAIYARYQIDSGAQVVQMFDSWAGQLSPQDYDTFALPYQQRVFQQVKQTHPDTPLILLVSGSAGVLERMAQSGADIVSVDWAVDMADARARLGKQVKVQGNLDPGVLFGSKQFIRDRILDTVRKAGNWGHILNLGHGVLPETPEENVAFFFETAKELN

SEQ ID NO: 20279 - protein, 458 aa, Nostoc punctiforme
QFRIERDSMGDRQIASSFYYGIQTLRAIENFPISGIKPLATYVDAGLIIKKATAIVNGELNCIPEDISQAIVQATDEILAGKFRDQFVVDVYQAGAGTSHHMNVNEVLANRALEILGEEKGNYKRVSPNDHVNYGQSTNDVIPTAIRIGGLLALSKTLHPAIEGAIASLENKAVEFQDIVKSGRTHLQDAVPVRLGENFRAWAHILTEHQNRIYTASGDLMVLGLGGSAAGTGLNTHPLYRARVVEVLSELIDTPLEPAPHLMAAMQSMAPFVNVSGALRNLAQDLVKISHDLRLMDSGPKTGLKEIQLPPVQPGSSIMPGKYNPVMAEMTSMVCFQVMGYDSAITLAAQAGQLELNVMMPLIAYNLIHSIEILGNTIAALTERCIEGITANQERCLAYAEGSLALVTALNTHIGYLNAAAVAKESLETGKSLRQIVLERGLMSETDLATVLNLEHMS

SEQ ID NO: 20280 - protein, 463 aa, Pyrococcus horikoshii
MEMRVGIVGGGLAGLTAAIALAEKGFDVSIIGPRSTDSNSYLAQAGIALPLLEGDSIRIHVLDTIKAGKYINDEEIVWNVISKSSEAHDFLTSHGVTFTGNELEGGHSYPRIFTIKSETGKHIIPILEKHARELDVNFIRGFVEEIGINNGKLAGVFLQGELLKFDAVVIAAGGFSGLYRFTAGVKNNIGLLIGDVALKGVPLRDMEFVQFHPTGFIGKRTYLITEAVRGAGAKLVTGDGERFVNELETRDIVARAIYMKMLEGKGVFLDARGIENFKDRFPYIYSVLRGEGINPEKDLIPITPVAHYTIGGISVDAFYRTRIKGLYAIGESACNGFHGANRLASNSLLECVVSGLEVARTISREKPKREVNDAPYSFNELGDVDSIREVLWNHAGIVRDEWSLREGLRKLKEIEVDERLKLVAKAVIISALKREESRGAHYRKDYPFMRKEFEHSSFFYPNV

SEQ ID NO: 20281 - protein, 549 aa, Pyrococcus horikoshii; identical to SEQ ID NO: 1242

SEQ ID NO: 20282 - protein, 269 aa, Pyrococcus horikoshii
MRDVKLIGSDEVTAIGMGTWGIGGYEVPDYSRDRESIEVLRYGLELGINLIDTAEFYGAGHSEELVGKAIEGFNREEIFIISKVWPSHFGYEKAKKAAKASAKRLGTYIDLYLLHWPGDSWGKIEETLHALEDLVDEGLIRYIGVSNFDLELLKRSQEAMRRYEIVANEVKYSIRDRWPETSGLLDYMKREKIALIAYTPLEKGTLARDPCLTEIGRAYGKTAAQVALNYLIWEDNVIAIPKAGRKDHVDENFGAMGWRLSREDREKAR

SEQ ID NO: 20283 - protein, 328 aa, Pyrococcus horikoshii
VVNMHPKIFALLAKFPRVELIPWETPIQYLPNISREIGADVYIKRDDLTGLGIGGNKIRKLEYLLGDALSKGADVVITVGAVHSNHAFVTGLAAKKLGLDAILVLRGKEELKGNYLLDKIMGIETRVYDAKDSFELMKYAEEIAEELKREGRKPYVIPPGGASPIGTLGYVRAVGEIATQSEVKFDSIVVAAGSGGTLAGLSLGLSILNEDIRPVGIAVGRFGEVMTSKLDNLIKEAAELLGVKVEVRPELYDYSFGEYGKITGEVAQIIRKVGTREGIILDPVYTGKAFYGLVDLARKGELGEKILFIHTGGISGTFHYGDKLLSLL

SEQ ID NO: 20284 - protein, 456 aa, Pyrococcus horikoshii
VRMNSQWGFKMKILIMGFEYLPVKVGGLAEALTSIAEALASLGHEVLVFTPSHGRFQGSEIGIIKAFGGKVAIKVHLEENGNLRIYRIGGGLLDHQDVYGPGWEGLIRKTVIFGKASVLLLNELLKSEDLPDVLHFHDWHTVFAGALIKKYFRIPAVFTIHRLNKSKIPAFYFHEAGLPELAPYPDLDPEHTGGYIADIVTTVSRGYLLDEWDFFRNFNGKVTYVFNGIDCSFWNENYLKGSRKERRSSILAKFGMSDGITFMFIGRFDRRQKGVDTLLRAIELLSERPEFKEMRFIIIGMGDPELENWARELEKRYDNVRVLTEMLSREFVRELYGSVDFVIIPSYFEPFGLVSLEAMCLGAIPIASSVGGLRDVIVSIDEDHVDGTGLLVKPGDPWDLANAILRMHSIAMDNEFVEKLRDNCKKRAKSFSWENSAKRYLRAYKGNIDRIFDFAM

SEQ ID NO: 20285 - protein, 283 aa, Pyrococcus horikoshii
MLLYTYRSFDMELPTVDIKDADYIILGLPFDGTTSYKPGARFGPVLIRQATLNLESYILDYDIDIAELKIADAGDVALPVSIEDAIKVAVETIKEVRSINPRALPIFLGGEHSMTYPPVKVLEPKSYVVFDAHLDLRDSYQGSRFNHACVARRIHEMGVKVAIFGVRSGTREEVMFASQSGIEWVHARDYNFDAFVDLVSSLPEPVYVSIDVDVFDLPLVPETGTPEPGGLGFWEVIEALEWLTKRKKVAGFDIMEVSGDRLGNSTSITAAKLLFYVIGMSAR

SEQ ID NO: 20286 - protein, 821 aa, Pyrococcus horikoshii
VDKMAYKFIKWFEELRKDDVPLVGGKGANLGEMTNAGIPVPPGFCVTAEAYKYFVENVKVSKEDVKKILGEKANKGTIAEVLASAPDEPRTLQEWIMDIINRTNVDDSKQLQENTAIIRELIESLEMPNEIADEIKQAYKELSQRFGKDEIYVAVRSSATAEDLPEASFAGQQETYLDVLGADDVIDKVKKCWASLWTARATFYRAKQGFDHSKVYLSAVVQKMVNSEKSGVMFTANPVTNNRNEIMINASWGLGEAVVSGAVTPDEYIVEKGTWKIKEKVIAKKEVMVIRNPETGKGTVQVKVAEYLGPEWVEKQVLTDEQIIEVAKMGQKIEEHYGWPQDIEWAYDKDDGKLYIVQSRPITTLKETTTEEVEEVEEAEVILKGLGASPGIGAGRVVVIFDASEIDKVKEGDVLVTTMTNPDMVPAMKRASAIITDEGGRTSHAAIVSRELGIPAVVGTKEATKKLKTGDYVTVDGTRGLVYKGIVKSLVEKKKKEEAAAAPGAAVAAAPLVTGTLVKVNVSMPEVAERAAATGADGVGLLRAEHMILSIGQHPVKFIKEGKEDELVERLAEGIEKVAAAFYPRPVWYRTLDAPTNEFREMPGGEDEPEERNPMLGWRGIRRGLDQPELLRAEFKAIKKVVEKGYNNIGVMLPLVSHPEQIRKAKEIAREVGLEPHKDVAWGIMIEVPAAAIIIEDLIKEGIDFVSFGTNDLTQYTLAIDRDNERVAKLYDETHPAVLKLIKHVIKVCKKYGVETSICGQAGSDPKMARILVRLGIDSISANPDAVQLIRQVVAQEERKLMLEAARKKLLEEEEEEEDLF

SEQ ID NO: 20287 - protein, 855 aa, Pyrococcus horikoshii
VHNMEEVREVKVLEKPWVEKYRPQRLDEIVGQEHIVKRLKHYVKTGSMPHLLFAGPPGVGKCLTGDTKVIANGQLFELRELVEKISGGKFGPTPVKGLKVIGIDEDGKLREFEVQYVYKDKTERLIRIRTRLGRELKVTPYHPLLVNRRNGEIKWVKAEELKPGDKLAVPRFLPIVTGEDPLAEWLGYFLGGGYADSKENLIMFTNEDPLLRQRFMELTEKLFSDARIREITHENGTSKVYVNSKKALKLVNSLGNAHIPKECWRGIRSFLRAYFDCNGGVKGNAIVLATASKEMSQEIAYALAGFGIISRIQEYRVIISGSDNVKKFLNEIGFINRNKLEKALKLVKKDDPGHDGLEINYELISYVKDRLRLSFFNDKRSWSYREAKEISWELMKEIYYRLDELEKLKESLSRGILIDWNEVAKRIEEVAEETGIRADELLEYIEGKRKLSFKDYIKIAKVLGIDVEHTIEAMRVFARKYSSYAEIGRRLGTWNSSVKTILESNAVNVEILERIRKIELELIEEILSDEKLKEGIAYLIFLSQNELYWDEITKVEELRGEFIIYDLHVPGYHNFIAGNMPTVVHNTTAALALSRELFGENWRHNFLELNASDERGINVIREKVKEFARTKPIGGASFKIIFLDEADALTQDAQQALRRTMEMFSSNVRFILSCNYSSKIIEPIQSRCAIFRFRPLRDEDIAKRLRYIAENEGLELTEEGLQAILYIAEGDMRRAINILQAAAALDKKITDENVFMVASRARPEDIREMMLLALKGNFLKAREKLREILLKQGLSGEDVLIQMHKEVFNLPIDEPTKVYLADKIGEYNFRLVEGANEMIQLEALLAQFTLVGKKK

SEQ ID NO: 20288 - protein, 228 aa, Pyrococcus horikoshii
MKGSKSEVQGMVLTTGVKGLDELLGGGVARRVILQVYGPFATGKTTFAMQVGLLNEGKVAYVDTEGGFSPERLAQMARSRGLDPEKALSKFIIFEPMDLNEQRRVISKLKTIVDEKFSLVVVDSLTAHYRAEGSKNYGELAKQLQVLQWLARRKNVAVIVINQVYHDSNSNSLRPIAEHTLGYRTKDILRFEKLRVGVRLAVLERHRFRPEGGIVYFKITDKGLEDSK

SEQ ID NO: 20289 - protein, 435 aa, Pyrococcus horikoshii
KNLEIVKLDEKYIPRASGFKYYPMVIERSSGSRIWDKDGNEYIDFLTSAAVFNVGHTHPGVVKAVEEQIKKFFNYTMGYLYVEPPVRLAELLVEITPGNFEKKVTYGFSGSDAVDSSIKAARAYTKRVNIISFLHSYHGMTYGALSATGILDPKLKKLLHPMGNFHHVEFPDPYRNSWGIDGYEDPSELANRALDEIERKIKELNEDVAGIIIEPIQGDAGVVIPPEEFVRDLKKLTEEYGIVFIDEEVQTGMGRTGRWWGIEHFGVTPDLIVSAKALGGGMPISAVVGKAEIMDSVPVPFFVFTHIGHAVNASAAIATINVIKEEKLVERSEKLGEYMLKRLRELQETYPIIGDVRGKGLLIGVDIVKEGTREPDRSLAQKISWRAWEKGLIMITFGKHGNVLRIAPPLNIPQEDLDKGVEIIEESIKDAVEGK

SEQ ID NO: 20290 - protein, 393 aa, Pyrococcus horikoshii
MRYDVVVVGSGVAGPIVARNVAKAGFSVLLVDKKPAIGAPKQCAEGLTINAFKQFDIPYDKRFINREIYGAKIYSPSGYTAELRYKEVSGVILERKVFDKMLAYYAAKAGAEVLARTEVVDVIRREGKIVGVKAKHEGEPMEIEAKVIVAADGVESTIARKAGIDTYAPPHEFDSGYEYEMIIEGFDPDLIHLFFGNEVAPRGYVWVFPKDEDRANVGIGINSDNEKTAKYYLDKWLKENNIPRNKILEVNVGLIPVGGFVKELVKENVLVVGDAARQVNPIHGGGMAEAMKASTIASKWIIKALEEENLELLKNYKEEWWKTEGPRMEKLLRLRRAMEKLTDEDLDVFVQLVSGTDLEKIAGGNYIEVVKALMKHPKVLMSRRRLEILKALL

SEQ ID NO: 20291 - protein, 399 aa, Pyrococcus horikoshii
VSVMSGDEVQFQGDYDDYITYLKRRIRQLELQVRMLEADKERLERELSRLRSEMSRLRQPPAFAGTVIEVLDEDRAIVQNYNGPRFVVRIAPWIDRKKLRPGTRVALDQRTMAVVEILPTSKDPTVLGFEVIERPNVTYNDIGGLKKQLQELREAIELPLKHPELFEEVGIDPPKGVLLYGPPGCGKTLMAKALAHEVNATFIRVVGSELVRKYIGEGARLVHELFELAKEKAPTIIFIDEIDAIGAKRMDETTGGEREVNRTLMQLLAEMDGFDPRGNVKVIAATNRPDILDPALLRPGRFDRLIEVPLPDFEGRLEILKVHTRRMKLKGVDLRAIAEMTEGASGADLKAIATEAGMFAIRERRTYVTQEDFLKAVDKVLGNERKLLQQITSHEVIYG

SEQ ID NO: 20292 - protein, 407 aa, Pyrococcus horikoshii
MEENIKSMLGDVERFFSKKALEMRASEVRELLKLVETSDIISLAGGLPNPKTFPKEIIRDILVEIMEKYADKALQYGTTKGFTPLRETLMKWLGKRYGISQDNDIMITSGSQQALDLIGRVFLNPGDIVVVEAPTYLAALQAFNFYEPQYIQIPLDDEGMKVEILEEKLKELKSQGKKVKVVYTVPTFQNPAGVTMNEDRRKYLLELASEYDFIVVEDDPYGELRYSGNPEKKIKALDNEGRVIYLGTFSKILAPGFRIGWMVGDPGIIRKMEIAKQSTDLCTNVFGQVVAWRYVDGGYLEKHIPEIRKFYKPRRDAMLEALEEFMPEGVKWTKPEGGMFIWVTLPDGIDSKKMLERAIKKGVAYVPGEAFYAHRDVKNTMRLNFTYVDEDKIMEGIKRLAETIKEE

SEQ ID NO: 20293 - protein, 601 aa, Pyrococcus horikoshii
VENVCGIIGYIGPRKASDVIVEGLKRLEYRGYDSAGIATCYEGKIFIKKGAGKIDELVKKLNFLELPGNIGIGHTRWATHGIPNDTNAHPHTDCTGKIVVVHNGIIENFQELKRELLKRGHVFRSDTDTEVIAHLIEENLRITGNFEDAFRMSLLRLRGSYALVVLFADDPERLYIARKDSPLIIGIGKGEMFMASDIPAFLAYTRRAVFLDDGEYGIVSKDWFTIKDIITGAVKTKEIHEIQWTLEMAEKGGYEHFMLKEIFEQPKAIKDAIYGNVKEAPKVAELLMKYDRIIITGMGTSYHAALVGKYLIQRFGKVPVIVEEASELRYEYEDILDNRSLLIAITQSGETADTVAAMKLAKSKGVEVVGIVNVVGSLATRIADETLYTHAGPEIGVAATKTYTTQLVVLTLLAKELGKLVGIDVSQIEGTIPRLPELVDSSLKINDKIREIAVKLNDKRDFFYIGRGINYPTALEGALKIKEIAYVHAEGLSAGELKHGPLALIEDGIPVVGIAPTGKTFEKMLSNIEEAKARGGFIISLGDDVRLHQVSDIFIRLPKVPEELAPITYIVPLQLLAYHLAVLKGHNPDRPRNLAKSVTVE

SEQ ID NO: 20294 - protein, 167 aa, Pyrococcus horikoshii
MVETLNIRKIIPITDRIAITTAGSVGDVQMIARILEAEARYYYFAWGRPMTTKAMANLLSNILNENKWFPYLVQIIIGGYVDEPTIANLDPYGGLIFDNYTATGSGTPFAIAILEEGYKENLGIEEAKELAIKAIKAAGSRDVYTGSKKVQVVTITKEGMQEEFIKL

SEQ ID NO: 20295 - protein, 529 aa, Pyrococcus horikoshii
VMIMVKKGSDPEVVEIDEIEGLGLELEEESTTSKKKKKEKEIKSIEDLPGVGPATAEKLREAGFDTLEAIAVASPIELKEVAGISEGAALKIIQAARKAANLGTFMRADEYLKKRESIGRISTGSKSLDKLLGGGIETQAITEVFGEFGSGKCFARDTEVYYENDTVPHMESIEEMYSKYASMNGELPFDNGYAVPLDNVFVYTLDIASGEIKKTRASYIYREKVEKLIEIKLSSGYSLKVTPSHPVLLFRDGLQWVPAAEVKPGDVVVGVREEVLRRRIISKGELEFHEVSSVRIIDYNNWVYDLVIPETHNFIAPNGLVLHNTQLAHTLAVMVQLPPEEGGLNGSVIWIDTENTFRPERIREIAKNRGLDPDEVLKHIYVARAFNSNHQMLLVQQAEDKIKELLNTDKPVKLLIVDSLTSHFRSEYIGRGALAERQQKLAKHLADLHRLANLYEIAVFVTNQVQARPDAFFGDPTRPIGGHILAHSATLRVYLRKGKGGKRVARLIDAPHLPEGEAVFRITEKGIED

SEQ ID NO: 20296 - protein, 398 aa, Pyrococcus horikoshii
VVLMGKLDWIKEELEELKKKGLYVTIRVLQSAQGPWIVVNGKRVLNMCSNNYLGLAAHPKIKEAAIRAILDYGVGAGAVRTIAGTMELHVELEEKLAKFKKREAAILFQSGYNANLGAISALLRKGEDGVFLSEELNHASIIDGMRLSGAPKVIYKHLDVDDLKKKLEENKDKKKKIIVTDGVFSMDGDLAPLPEIVEVAEQYDAIVYVDDAHGEGVLGSHGRGIVDHFNLHDKVDFEMGTLSKAFGVIGGYVAGPEEAIEYLKQRARPFLFSSAMNPPDVAAAIAAVEILQKSDDLVKKLWDNTHFLQKGLRDLGYDLGNTKHPITPVMLYDEKLAQEFSRRLYEEYNIFAQAIVYPTVPLGTARIRLEPSAAHTKEDLKLVIDAFEDLGKKTGFLK

SEQ ID NO: 20297 - protein, 486 aa, Pyrococcus horikoshii
MGKFVEKLEKAIKGYTFDDVLLIPQATEVEPKDVDVSTRITPNVKLNIPILSAAMDTVTEWEMAVAMAREGGLGVIHRNMGIEEQVEQVKRVKRAERLIVEDVITIAPDETVDFALFLMEKHGIDGLPVVEDEKVVGIITKKDIAAREGKLVKELMTKEVITVPESIEVEEALKIMIENRIDRLPVVDERGKLVGLITMSDLVARKKYKNAVRDENGELLVAAAVSPFDIKRAIELDKAGVDVIVVDTAHAHNLKAIKSMKEMRQKVDADFIVGNIANPKAVDDLTFADAVKVGIGPGSICTTRIVAGVGVPQITAVAMVADRAQEYGLYVIADGGIRYSGDIVKAIAAGADAVMLGNLLAGTKEAPGKEVIINGRKYKQYRGMGSLGAMMKGGAERYYQGGYMKTRKFVPEGVEGVVPYRGTVSEVLYQLVGGLKAGMGYVGARNIRELKEKGEFVIITHAGIKESHPHDIIITNEAPNYPLEKF

SEQ ID NO: 20298 - protein, 621 aa, Pyrococcus horikoshii
MEKLRELLPKDQYEKIAAINNPYLHEFLAEWIEWLEPSKVFVCTDSPEDEEYVRWKALYYGEEKMLEIPKHTVHYDNYYDQARDKTNTKLLVPKGVELPFLNTMNREEGLKEIREIMKGIMRGKELFICFFVLGPTNSIFTIPAVQLTDSAYVAHSEFLLYRKGYEEFKRLGPTKNFFKFVHSAGELDERKTSKNLDKRRIYIDLLDETVYSANTQYGGNTIGLKKLAFRLTIQRAVKEGWLSEHMFLMRVNGPNGRKTYFTGAYPSMCGKTSTAMIPWENIVGDDLVFIKNVDGIARAVNVEIGVFGIIEGVNQKDDPIIWKVLHSPVEIIFSNVLVKDGKPYWNGMGIEIPDEGENHSGKWWRGKRDAEGKEIPPSHKNARFTVRLEAFPNLDREALNNPCGVEVGGMIFGGRDPDTWPPVREAFDWEHGVITMGASLESETTAATLGKEGVRAFNPMSILDFLSVHIGDYIRNYLEFGRKLKKTPKIFAVNYFLRENGRWLNEKLDKAVWLKWMELRVHNDVDAIETPIGYIPRYEDLKVLFKQVLNKDYSREDYEKQFKIRVPELLAKIERIWKIYEPIDNIPEELFKQLKDERERLLKAKAEFGDYISPFTLEKRI

SEQ ID NO: 20299 - protein, 433 aa, Pyrococcus horikoshii
VVVMIKLRDELGTATTDSAQKILLLGSGELGKEIAIEAQRLGVEVVAVDRYANAPAMQVAHRSYVGNMMDKDFLWSVVEREKPDAIIPEIEAINLDALFEFEKDGYFVVPNARATWIAMHRERLRETLVKEAKVPTSRYMYATTLDELYEACEKIGYPCHTKAIMSSSGKGSYFVKGPEDIPKAWEEAKTKARGSAEKIIVEEHIDFDVEVTELAVRHFDENGEIVTTFPKPVGHYQIDGDYHASWQPAEISEKAEREVYRIAKRITDVLGGLGIFGVEMFVKGDKVWANEVSPRPHDTGMVTLASHPPGFSEFALHLRAVLGLPIPGEWVDGYRLFPMLIPAATHVIKAKVSGYSPRFRGLVKALSVPNATVRLFGKPEAYVGRRLGIALAWDKDVEVAKRKAEMVAHMIELRTRSSDWHDQNYEKRKHLLR

SEQ ID NO: 20300 - protein, 370 aa, Pyrococcus horikoshii
MRYDVLIIGGGPVGNYLASLLAGKVNVGVIEKKGAFGGKACTGIVGAENYESLGLPEKAILNAFNGAFFISREKVFEIHRSLPQAYLIDRKVLERELAKRAMRKGAEYYLSTNFLGFKNGKAILQHLDSRLEIEAKYYVGADGVNSSVAKEIQARTEGEVLKGWEIEVLGNFKRDHVEVWVNKNINPEFFFWVAPINEEEARVGTFGEIDSLAKFLKIRRLNPFKTVEIKSGAVILGWRKPWVKGNVALVGDAALQIKPTTAGGIVFGAYCAKSLAKAILNDNLEIYERECSWVREQVSFGLKIRKVFKNLTQEKIEEIFEVLSSEEVRKIIVERADFDDHVKTVKALLKNPRVLAKLIRISPIILRALL

SEQ ID NO: 20301 - protein, 1291 aa, Pyrococcus horikoshii
MKCRGVIMVVEKVMKRDGRIVPFDESRIRWAVQRAMWEVGVRDEKKLDEVVKAIVQRINELYDGKIPHIENIQDIVELELMRAGLFEVAKAYILYRKKKAEIREEKKRILNKKELDEIDKRFSINALRVLASRYLKRDENGNIIESPRELFERVAILAVIPDLLYDERVFDKDGNYSQDLKRVEYYLEHFEEFDGKYSIGKYKLNKYHFERMVNLYKELAEKGKMKVSIDEFLGMLERGEFNKYEKEIDEYFRLMTNQIFMPNTPALINSGRPLGMLSACFVVPIEDDMESIMKAAHDVALIQKAGGGTGINFSKLRPEGDIVGTTTGAASGPVSFMHLIDAVSDVIKQGGVRRGANMGILEIWHPDIEKFIHAKEKNIGTNVLSNFNISVGIWEDFLEALKEGKKYPLINPRTGEVVREVDPKSLFEELAYMAWAKADPGVIFFDIINRRNVLKEAKGGPIRATNPCVVGDTRILTPEGYLKIEDLFRMAKERNNGEKVVAVEGIAEGGEEFAYPVAILLPNEEEKEVIYETVHGKQLAIADPIEVKAYVWKVGKKKVARIKTKEGYEIIATLDHKIMTKDGWKAVEDLKEGDLIVLPRFEVEDNFGSESIGEDLAFVLGWLIGDGYINTDDKRVWFYFNAEKEEEIAQKISEILKKRFNSKAEPHRYGSEIKLGVRGEAYKFFEKIVKTNDKRVPEIVYHLKPNEIRAFLRGLFTADGYVDNDGAIRLTSKSRELLRDVQDLLLLFGIISKIYERPYKGTFEYTTKEGEKKVYTAQGYYELVIANYSRKLFAEKIGFEGEKQKKIKLNKTKIDEPYARVESVEIIGEEIVYDLTVPGIHSYISNGFISHNCGEEPLYEYESCNLASINLAKFVKYDENGKPYFDWDEYAYVIQKVTKYLDNAIDVNKFPLPEIDHNTKLTRRIGVGMMGLADALFKLGIPYNSEEGFKFMRKVTEYLTFYAYKYSVEAAKRRGTFPLYEKTEYPKGKLPVEGFYHPEIWNLPWDKLVEEIKKYGLRNAMVTTCPPTGSVSMIADTSSGIEPIYALVYKKSVTVGEFYYVDPVFEAELKKRGLYSEELLKKISDNYGSIQGLEEIPEDMKRVFVTALDIHWLDHLLAQASIQMWLTDSASKTINMINEATVEDVKAAYLIAHFLGCKGVTVYRDGSLSVQVYSVEGEKKKRKYKPKPSEYAKKVFLEIVEKEPWIKNFINVDEILNGKRESNLTFSLSIKKEHQEKPQENKGIPEEKIKELLGVVYCPVCYEREGKLVELRMESGCATCPVCGWSKCVIS

SEQ ID NO: 20302 - protein, 327 aa, Pyrococcus horikoshii
MRELRYNPLTGQWIMVSAVRKNRPWRPRNFCPFCPGSEETGYGWEVLLLPNRFPMLSFDAPKPKNEDFYKKARAMGQCSVIVETPKHELRDLDELPREQMVKIVRMWIKITETLKENRNVAYLAIFRNKGEEIGVSLKHPHGQLYALPYIPLKVRLKIENSRRYYKRTGECIFCRIIKEEEKNGERTIYENDNFIVFMPFFASWPFEVHIYPKRHIQYLTDLKVNEIEDLAEVIQVTTATLNAVLDRQMPYAMMIFQAPFKGNYPFYHLHIEFYPILRDNGKVKYTAGIELGTWEFTYDGIPEENARKLKEACKKVSQRMSLKGKCI

SEQ ID NO: 20303 - protein, 423 aa, Pyrococcus horikoshii
MPLKFPEMFLFGTATSSHQIEGNNRWNDWWYYEQIGKLPYRSGKACNHWELYRDDIQLMTSLGYNAYRFSIEWSRLFPEENKFNEDAFMKYREIIDLLLTRGITPLVTLHHFTSPLWFMKKGGFLREENLKHWEKYIEKVAELLEKVKLVATFNEPMVYVMMGYLTAYWPPFIRSPFKAFKVAANLLKAHAIAYELLHGKFKVGIVKNIPIILPASDKERDRKAAEKADNLFNWHFLDAIWSGKYRGVFKTYRIPQSDADFIGVNYYTASEVRHTWNPLKFFFEVKLADISERKTQMGWSVYPKGIYMALKKASRYGRPLYITENGIATLDDEWRVEFIIQHLQYVHKAIEDGLDVRGYFYWSFMDNYEWKEGFGPRFGLVEVDYQTFERRPRKSAYVYGEIARSKEIKDELLKRYGLPELQL

SEQ ID NO: 20304 - protein, 349 aa, Pyrococcus horikoshii
MIKVKSPGRVNLIGEHTDYTYGYVMPMAINLYTKIEAEKHGEVILYSEHFGEERKFSLNDLRKENSWIDYVKGIFWVLKESDYEVGGIKGRVSGNLPLGAGLSSSASFEVGILETLDKLYNLKLDSLSKVLLAKKAENEFVGVPCGILDQFAVVFGREGNVIFLDTHTLDYEYIPFPKDVSILVFYTGVRRELASSEYAERKHIAEESLKILGKGSSKEVREGELSKLPPLHRKFFGYIVRENARVLEVRDALKEGNVEEVGKILTTAHWDLAKNYEVSCKELDFFVERALKLGAYGARLTGAGFGGSAIALVDKEDAETIGEEILREYLKRFPWKARHFIVEPSDGVG

SEQ ID NO: 20305 - protein, 328 aa, Pyrococcus horikoshii
VDIIVALGGDLMRPLNFKVIHGGARKEGLIDFSASVNPYPPEWLSEVFERAKDLSSRYIYYEELEEEFESLIGEPITITAGITEALYLLGILTLRNKRVIIPNHTYGEYERIARMFGAKVIKGPNDPSKLAELVERESVVLFCNPNNPDGKYYTPKELKSLIDAVTDTNSLLILDEAFIDFVKKAKSPSGENLIKLRTFTKSYGVPGIRIGYVIGFSEAFRSVRMPWNIGAVGVAFLEKVIEDEFAHLRRTLPLIWREKERIERRLGVKSDANFFIMNVGDARAVVEKLKKKGILVRDCSSFGLPNYIRFSVRKPEENDKLIEALTSL

SEQ ID NO: 20306 - protein, 327 aa, Pyrococcus horikoshii
VKVLIMAGGYATRLWPITKDNPKALLPLGNKTILEYILEKVRELDVDVYISTNRFFAEKFRKYDVELIVEDTVHEEEKLGTIAAMRNALNILGEDDYLIVAGDNVFSFSLKDFVDNFSGKTLIAVYDVGDFELAKRYGVVVLEKDRVIDFEEKPANPKSTLISTGVYLFPRDVMKLLNEYLEDGNKDSPGYFLQWLLKRGEEIRAYRFDGYWYDIGSADSYLEAMKTLLKESYIEEIQISPYAKIIPPVVIKKGTKIMGRSIIGPYAYIGEECIIENSDISDSIIFPRTVIRNSTIWRSIIDEKCEIRNLELRKSLVGGHAKIQRGD

SEQ ID NO: 20307 - protein, 356 aa, Pyrococcus horikoshii
MVDTMKALILSGGYGTRLRPLTYSQQKQLIPVANKPVLFYAIEDVIEAGIHEIGIVVGPNADLVKKTVMSVDWDANIEFIYQGEPKGLAHAILVARDYLGDEDFVMYLGDNILREGIVRHKEHFEKSDYDASILLCEVPNPQQFGVAELSEDGKTIKRLVEKPKHPPSNLALVGIYFFRPIIHEAVRHIKPSWRNELEITDAIQWLIDNGYKVGWTKVTGWWKDTGKPEDLLEANRLVLDEIEKEVKVETRAKIIGRVKIEEGAQIDENSVIKGPAVIGKNAVIRNAYIGPYTSVGNNVVIEDTEVEDSIVMDDSIIVGAGRIVESIIGRGVKIIKGNSHPMGRRLIIGDNSQIVL

SEQ ID NO: 20308 - protein, 336 aa, Pyrococcus horikoshii
MRILMIGHYPPHRGGVARHVKDLVDYLSREHEVHVITYGTVKGKGENVSYVKVPNIFGLRGTSFTLLASKLGVKLHKKLNFDLIHAHYVGTTSYAGVLIKERTGLPLVVTAHGSDLDFTSKLPLGSYYVKKSLIKANAVIAVSHYLGVKAKMLGAENVKVIPNWVTKTGKSRGEYIAFIGRLTEYKGVEDFIELAKLFPQEKFVVAGEGPLLKKLMKESPKNVKFLGYKPSEDVLSKAKVLILPSKREGFGLVILEANSFKVPSLGRRVGGIREIIRDGKNGYTFSALDEAYEYLKELLNPKKGRKAGAISYRISRFYSMEESCKRILKVYEEVVG

SEQ ID NO: 20309 - protein, 339 aa, Pyrococcus horikoshii
MPSVIVVGGQWGDEGKGSIVAYLSLHDEPEIIARGGVGTNAGHSVVINGKKYAVRQIPTGFMQTKARLLIGAGVLVDPEVFFHELEQLKDFNVKDRVGIDYRCAIIEEKHKQLDRTNGYLHGKIGTTGSGCGPANADRVMRKAKQAKDVKELEPYLTDVAQEINDALDEGSLVLVEGTQGFGLSLYYGTYPYVTSKDVTASSVAADVGIGPTRVDEVIVVFKSFPTRVGAGPFPTEMPMEEADRLGLVEYGTVTGRRRRVGWFDFEMARYSARINGATMLAVTMLDKYDKEAFGVTDYDKLPRKAKEFIEEIEERVGVPVGLIKTGPELEHIIDRRDTI

SEQ ID NO: 20310 - protein, 493 aa, Pyrococcus horikoshii
  unsure (1)..(493): unsure at all Xaa locations
KFYWGVVQSAFQFEMGDPYRRNIDPRSDWWYWVRDPYNIKNDLVSGDLPEEGINNYELYEIDHRLAKELGLNAYQLTIEWSRIFPCPTFNVEVEFERDGYGLIKKVKIEKEHLEELDKLANQKEVRHYLNVLRNLKKLGFTTFVTLNHQTNPIWIHDPIETRGNFQKARARGWVDERTIIEFAKYAAYVAWKFDNYVDYWSTFDEPMVTAELGYLAPYVGWPPGILNPSAAKKVIINQIVAHARAYDSIKKFSSKPVGVILNIIPAYPLDPNDSKSVRAAENYDLFHNRLFLEAVNRGNVDLDITGEYTKIPHIKRNDWIGNNYYTREVVKYVEPKYEELPLITFVGVEGYGYSGNPNSLSPDNNPTSDFGWEVFPQGLYDSTLEAAEYNKEVFITENGIADSKDILRPRYIIDHVNEVKKLIENGIKVGGYFHWALTDNYEWAMGFKIRFGLYEVDLITKERIPRRRSVEIYKKIVMEGIEXRRXQLMKLPG

SEQ ID NO: 20311 - protein, 323 aa, Pyrococcus horikoshii
MKTLIEIKQTPDGIIKADKVFNKVKDKISLPNRILYLGCGSSHFLSKLLAMVTNMHGGLGIALPCSEFLYSKETYPIGEVELAVGISRSGETTEILLALEKINVKKLGITTRESSLTRMCDYSLVVPAIEESVVMTHSFTSFYFAYLQLLRYSYGLPPLNAGEISKATEKSLEYERYIREIVESFDFQNIIFLGSGLLYPVALEASLKMKEMSIFWSEAYPTFEVRHGFKAIADEKTLVVLMVEEPFEWHEKLVKEFKNQGAKVLVISNSPQDLGQDYSIELPRLSKDANPIPYLPIVQLLSYYKAVSRGLNPDNPRFLDKVV

SEQ ID NO: 20312 - protein, 425 aa, Pyrococcus horikoshii; identical to SEQ ID NO: 1245

SEQ ID NO: 20313 - protein, 478 aa, Pyrococcus horikoshii
VRRMKLPSHKTKIVATIGPATNSKKMIKKLIEAGMNVARINFSHGTFEEHAKIIEMVREQSQKLDRRVAILADLPGLKIRVGEIKGGYVELERGEKVTLTTKDIEGDETTIPVEYKDFPKLVSKGDVIYLSDGYIVLRVEDVKENEVEAVVISGGKLFSRKGINIPKAYLPVEAITPRDIEIMKFAIEHGVDAIGLSFVGNVYDVLKAKSFLERNGAGDTFVIAKIERPDAVRNFNEILNAADGIMIARGDLGVEMPIEQLPILQKRLIRKANMEGKPVITATQMLVSMTMEKVPTRAEVTDVANAILDGTDAVMLSEETAVGKFPIEAVEMMARIAKVTEEYRESFGITRMREFLEGTKRGTIKEAITRSIIDAICTIGIKFILTPTKTGRTARLISRFKPKQWILAFSTREKVCNNLMFSYGVYPFCMEEGFNENDIVRLIKGLGLVGSDDIVLMTEGKPIEKTVGTNSIKIFQIA

SEQ ID NO: 20314 - protein, 1108 aa, Pyrococcus horikoshii; identical to SEQ ID NO: 1247

SEQ ID NO: 20315 - protein, 686 aa, Pyrococcus horikoshii; identical to SEQ ID NO: 1248

SEQ ID NO: 20316 - protein, 348 aa, Pyrococcus horikoshii; identical to SEQ ID NO: 1249

SEQ ID NO: 20317 - protein, 110 aa, Pyrococcus horikoshii; identical to SEQ ID NO: 1250

SEQ ID NO: 20318 - protein, 249 aa, Pyrococcus horikoshii; identical to SEQ ID NO: 1251

SEQ ID NO: 20319 - protein, 389 aa, Pyrococcus horikoshii; identical to SEQ ID NO: 1252

SEQ ID NO: 20320 - protein, 840 aa, Pyrococcus horikoshii; identical to SEQ ID NO: 1253

SEQ ID NO: 20321 - protein, 641 aa, Pyrococcus horikoshii; identical to SEQ ID NO: 1254

SEQ ID NO: 20322 - protein, 160 aa, Pyrococcus horikoshii
VFQMSETERTLVIIKPDAVVRGLIGEIISRFEKKGLKIVGMKMIWIDRELAEKHYEEHREKPFFKALIDYITKTPVVVMVLEGRYAVEVVRKMAGATDPKDAAPGTIRGDFGLEVSDAICNVIHASDSKESAEREISLFFKPEELFEYPRAADWFYKKGI

SEQ ID NO: 20323 - protein, 308 aa, Pyrococcus horikoshii; identical to SEQ ID NO: 1256

SEQ ID NO: 20324 - protein, 150 aa, Pyrococcus horikoshii
MPELKVSAIKEGTVIDHIPAGKGLKVIEILGLSKLSNGGSVLLAMNVPSKKLGRKDIVKVEGKFLSEEEVNKIALVAPTATVNIIRNYKVVEKFKVEVPEVIEGILKCGNPNCITNYEYVTTKFYVISKNPLKVRCHYCERTMEEEEILA

SEQ ID NO: 20325 - protein, 317 aa, Pyrococcus horikoshii; identical to SEQ ID NO: 1258

SEQ ID NO: 20326 - protein, 375 aa, Pyrococcus horikoshii; identical to SEQ ID NO: 1259

SEQ ID NO: 20327 - protein, 387 aa, Pyrococcus horikoshii
MREKRKYFIAERVLLIKRSKIRELFERASKMEDVISLGIGEPDFDTPKNIKEAAKRALDEGWTHYTPNAGIPELREAVVEYYKKFYGIDIEVENVIITAGAYEGTYLAFESLLERGDEVIIPDPAFVSYAEDAKVAEAKPVRIPLREENNFLPDPNELLEKISKNTRMIVINYPNNPTGATLDKELAKTIADIAEDYNIYILSDEPYEHFIYEDAKHYPMIKFAPENTILANSFSKTFAMTGWRLGFVVAPSQVIKEMTKLHAYVIGNVASFVQIAGIEALRSEESWKAVEEMKKEYNERRKIVVKRLKNMPGIKVKEPKGAFYVFPNISGTGMSSEKFSEWLLEKARVVVIPGTAFGRMGEGYVRISYATSKEKLIEAMNRIEKAL

SEQ ID NO: 20328 - protein, 474 aa, Pyrococcus horikoshii; identical to SEQ ID NO: 1261

SEQ ID NO: 20329 - protein, 571 aa, Pyrococcus horikoshii; identical to SEQ ID NO: 1263

SEQ ID NO: 20330 - protein, 856 aa, Pyrococcus horikoshii; identical to SEQ ID NO: 1264

SEQ ID NO: 20331 - protein, 287 aa, Pyrococcus horikoshii; identical to SEQ ID NO: 1265

SEQ ID NO: 20332 - protein, 450 aa, Pyrococcus horikoshii; identical to SEQ ID NO: 1266

SEQ ID NO: 20333 - protein, 359 aa, Pyrococcus horikoshii
VVEKPVVIKFGGTSVRYAFEEALELVAKLHENMKIIVVVSALAGVTDCLLRLAKGDKSALLEIDEIHEELSQELNVQLEHLIHQLKKTINSKSSFPSEKAFIDEIASFGERFSAKLFSEGLKILGITARPVDSKDVLFVKGEFGNAEVEFKKSAQGVDVLYRMLRRGIVPVVTGYYGNLNGFRATFGRGGSDYSATSIASLVNAKAVLIMSDVEGIYTADPKLVPPARLIHYISYKEAKTAAKLGMKVLHPRAIDPVEGKIPVILGKTRDLKFGTLISHESQGIPIVTHKLLENHAEISVVSVKTNIPLPYEVYEEGDLYFKIKTSKDQFLEVLRDVHRRVVENENLHSSHDGELWTWV

SEQ ID NO: 20334 - protein, 648 aa, Pyrococcus horikoshii
MNIKSFINRLKELVEIEKEAEIEAMRLEMKRLSGVERERLGRAILNLNGKIAGEELGYFLVKYGRNREIKTEISVGDLVVISKRDPLKSDLLGTVVEKGKRFIVVALETVPEWALRDVRIDLYANDITFRRWLENLDRVKKAGKRALEFYLGLDEPSQGEEVSFEPFDKSLNSSQRKAIAKGLGSEDFFLIHGPFGTGKTRTLVELIRQEVKRGNKVLATAESNVAVDNLVERLAKDGVKIVRVGHPSRVSRHLHETTLAYLITQHELYGELRELRVIGQSLAEKRDTYTKPTPKFRRGLSDAEIIKLAERRRGIRGLSARLIKEMAEWIKLNRQVQKAFEDARKLEERIARDIIREADVILTTNSSAALEVVDATDYDVAIIDEATQATIPSILIPLNKVDRFILAGDHKQLPPTILSLEAQELSHTLFEGLIERYPWKSEMLTIQYRMNERIMEFPSKEFYDGRIVADERVKNITLGDLGIKVNATGIWRDILDPSNVLVFIDTCMLDNRFERQRRGSESRENPLEAKIVSKIVEKLLESGVKAEMIGVITPYDDQRDLISLNVPEEVEVKTVDGYQGREKEVIILSFVRSNKVGEIGFLKDLRRLNVSLTRAKRKLIMIGDSSTLSSHETYKRLIEHVREKGLYV

SEQ ID NO: 20335 - protein, 324 aa, Pyrococcus horikoshii
VNKVEAIIVENLVKKYGDFEAVRGISFKVRRGEIFAFLGPNGAGKTTTVHMLTTLLKPTSGRAIVAGHDVVKESREVRKKIGVVFQDPSVDRELTAWENMYIHGRIYGLKGQELKKKIEELLKFVELWEFKDRQVKYFSGGMQRRLEIARALIHEPEVLFLDEPTIGLDPQTRAHIWEYIKTMKEEHDMTIFLTTHYMDEAEQLADRIAIIDHGKIIAEGTAEELKKLVGNDIIYVKFEKPTCIQAEFIRGCKVLNNGRVALEVKNAAEALPLVFEKAREMELKILEVTYHRPTLNDVFLHLTGREIRDEASEKPTMPIRRWRR

SEQ ID NO: 20336 - protein, 455 aa, Pyrococcus horikoshii; identical to SEQ ID NO: 1270

SEQ ID NO: 20337 - protein, 879 aa, Pyrococcus horikoshii; identical to SEQ ID NO: 1271

SEQ ID NO: 20338 - protein, 275 aa, Pyrococcus horikoshii; identical to SEQ ID NO: 1272

SEQ ID NO: 20339 - protein, 191 aa, Pyrococcus horikoshii; identical to SEQ ID NO: 1273

SEQ ID NO: 20340 - protein, 416 aa, Pyrococcus horikoshii
VNKMKAVILAGGFGTRLRPISSTRPKPMVPVLGKPNLQYILEALEKVKEIDEIILSVHYMRGEIREFIQEKMRDYPKDIRFVNDPMPLETGGALKNVEEYVSDDFLVIYGDVFTNFDYSELIEAHKKNDGLITVALTKVYDPERFGVVITDEEGKIVEFEEKPRKPKTNLVDAGIYMVNKDVLKEIPKNKEIYFEREILPKFVNQGLVYGYKMPKQYYWVDLGTPEDFFYAHQIALDELSKENGYMILGENVEIPDDVEVQGPVYIDDNAKIGHGVKIKAYTYIGPNTIIEDKAYFKRSILLGNDIIKERAELKDAILGEGVVVGKDVIIKENAVIGDYAKIYDNLVIYGAKVLPWKKVEEYEAYIKIKLDPTKVRPGQYPDHCPLGLPECIYKKFKAIAGEKPPCDECIENQWLF

SEQ ID NO: 20341 - protein, 320 aa, Pyrococcus horikoshii
VKSLSKEWGEKMIFDAHSDLPTYVYEEREKGRTRVLESNFEKFFTGISARVMSVWSRPEKKPIILRYALEAYNRLFKDVSESEKLVIVGTVKEMEDAIKDGKVALWLGMEGGEPIESLDILEIFHSIGLRVLTLTWSLRNQIGDGVFERTRGGLTNFGAEVVGKCEELGIIIDLSHINEQGFWDVLDITGFPVIASHSNAKSLCDNPRNLTDEQIKAIAERDGVIGAVAIPAFVDKDNPTLEKYVKHIEYMVDLVGYKHVGIGFDFVYYLPGWSGKSVEGLEDESKIPDLIKALEENFSEKEVKGITFENFKRVFERVVG

SEQ ID NO: 20342 - protein, 342 aa, Pyrococcus horikoshii; identical to SEQ ID NO: 1276

SEQ ID NO: 20343 - protein, 319 aa, Pyrococcus horikoshii; identical to SEQ ID NO: 1277

SEQ ID NO: 20344 - protein, 334 aa, Pyrococcus horikoshii; identical to SEQ ID NO: 1278

SEQ ID NO: 20345 - protein, 1044 aa, Pyrococcus horikoshii
VSYVKRIRQPIIAVLGHVDHGKCLLPEERVILPDYGPITLEELFNMTKETVFKDEEKEVRKLGIRMPVAGVDGRVRLLEGPYVWKVRYKGKMLRVKLKDWHSVAVTPEHPFLTTRGWVRADQLKPGDYVAVPKILPGKDDKEKFLQYVHEKLKGKVHIKLPSSDEEWETFFYFAGTIFGRENSVNPEGLTHEVKALLELFKVLFEYPREVLRVLFMAPVRYVANFLRGFFDINGYVNGEELRVEVRGAPHEVLEELSLILLRLGIVSKIYPTSLAISGRRNLELFRRYIGFSEKQKAKELEGIIRRSENSESYPIFEELRRIRLLFGFTRAELSSTIPLYSKYESKEAPSYEILMKILNTIEKGSKDLNKKITILEGRVRDHEYIEEFKREGLIKDGKLTELGKELLEVWRNREFDSRDVNYLRNIIENFVFLPVEKIEEFEYDGYVYDVTTETHNFIANGILVHNTTLLDKIRKTNVAAKEAGGITQHIGATEVPIDVVKKIAGPLIKLWKAEIRLPGLLFIDTPGHEAFTSLRARGGSLADLAVLVIDVNEGFQPQTIESIEILRRYRTPFVVAANKIDRIRGWVIEEDEPFLMNIKRQDQRAIQELETKLWELIGKFYEFGFQANRFDRVQNFTRELAIVPISAKYGIGIAELLVLIAGLSQKYLEEKLKIEVEGPARGTILEVREEPGLGHTIDVIIYDGTLHKDDTIVVGGKDKAIVTKVRALLKPKPLDEIRDPRFRFDYVDEVTAAAGVKIAAPGLEEALAGSPVIAAPTPEDVERAKEEIMRQIESVVISTDKVGVIVKADTLGSLEALSKELQEKEIPIRKADVGNISKTDVMEALSVKEENPKYGVILGFNVKVNEDAKEVAKAKEVPIFVGNIIYKLIEDYEAWIKEEEEKRKRELLAKVTFPGVIKLYPDERYVFRRSNPAIVGIEVLEGRIKPGVTLIKQNGQKVGTIRSIKSRDEFLQEARKGQAVAIAIEGAIVGRHIHPGETLYVDLSRDDAIILLKHLRDVLEDTDIKALKMIAQVKAKEDPFWRAV

SEQ ID NO: 20346 - protein, 186 aa, Pyrococcus horikoshii; identical to SEQ ID NO: 1280

SEQ ID NO: 20347 - protein, 458 aa, Pyrococcus horikoshii; identical to SEQ ID NO: 1281

SEQ ID NO: 20348 - protein, 453 aa, Pyrococcus horikoshii
VRMGRYFGTSGIREVVNEKLTPELALKVGLALGTYLQEGKVVIGCDTRTSSVMLKNAVISGLLATGIDVIDIGLAPTPLTGFAIRLYNAEAGVTITASHNPPQYNGIKVWDRDGMAYTPDKEHELEKIIESGNFRRVPWNEVGTLKTANPRKEYIEAILREINLKGSYTVVIDAGNGAGSIVSPYLHRELGNRVITLNSDPSGFFVRELEPNKESLSMLEKTVKVLNADIGIAHDGDADRVGVVDENGEFVEYEVMLSLIAGYMLKKYGKGKIVTTVDAGFALDDYIRELGGEVVRTRVGDVAVAEELVKHGGVFGGEPSGTWIMPQWNLTPDGIFASALVLEMIDRLGPIGELAKDVPKYVTLRKKIPCSNELKNKVMNKIADLIPREFSYERIITIDGIRIENDDWWILFRPSGTEPIMRITLEAHTEEMAERLMKKAENLVKSVIKDLSS

SEQ ID NO: 20349 - protein, 216 aa, Pyrococcus horikoshii; identical to SEQ ID NO: 1283

SEQ ID NO: 20350 - protein, 409 aa, Pyrococcus horikoshii
MFRLEDFNFHNKTVFLRVDLNSPMKDGKIISDARFKAVLPTIRYLIESGAKVVIGTHQGKPYSEDYTTTEEHARVLSELLDQHVEYIEDIFGRYAREKIKELKSGEVAILENLRFSAEEVKNKPIEECEKTFLVKKLSKVIDYVVNDAFATAHRSQPSLVGFARIKPMIMGFLMEKEIEALMRAYYSKDSPKIYVLGGAKVEDSLKVVENVLRRERADLVLTGGLVANVFTLAKGFDLGRKNVEFMKKKGLLDYVKHAEEILDEFYPYIRTPVDFAVDYKGERVEIDLLSENRGLLHQYQIMDIGKRTAEKYREILMKARIIVANGPMGVFEREEFAIGTVEVFKAIADSPAFSVLGGGHSIASIQKYGITGITHISTGGGAMLSFFAGEELPVLRALQISYEKFKEVV

SEQ ID NO: 20351 - protein, 249 aa, Pyrococcus horikoshii
MIIVENLRKKFGSKEVLKGINFTVNDGEIYGLLGPNGSGKSTTMRILSGIITDFEGKVMVAGVDVSRDPMKVKEIVGYVPETPALYESLTPAEFFSFIGGVRRIPQDILEERVKRLVDAFGIGKYMNQLIGTLSFGTKQKISLISALLHDPQVLILDEAMNGLDPKSARIFRELLFEFKEEGKSIVFSTHILALAEVMCDRIGIIYEGRIVAEGTIDELREIAREEKLEDIFLKLTQAKEEVSQIVSAL

SEQ ID NO: 20352 - protein, 178 aa, Pyrococcus horikoshii
MLIAITGTPGVGKTTVAKLLAKKLNYEYVSLKDFALEKGCGRRVNDEVEVEIDELAYFIERELKGKNAVLDGHLSHLMPVDLVVVLRAHPKLIGERLRERGYDREKIGENVEAELVDAVLIEAIEEHENVIEVDTTNKSPEDVVEEIVSLINSGIKKRVGIVDWSEVYDEIIPYLRLG

SEQ ID NO: 20353 - protein, 192 aa, Pyrococcus horikoshii; identical to SEQ ID NO: 1287

SEQ ID NO: 20354 - protein, 359 aa, Pyrococcus horikoshii
MFEKGYVDENYIRVPKDRLFSFIVRVLTKLGVPEEDAKIVADNLVMADLRGVESHGVQRLKRYVDGIISGGVNLHPKIRVIREGPSYALIDGDEGLGQVVGYRSMKLAIKKAKDTGIGIVIARNSNHYGIAGYYALMAAEEGMIGISMTNSRPLVAPTGGIERILGTNPIALAAPTKDKPFLLDMATSVVPIGKLEVYRRKGKDIPEGWAINREGNITTKVEEVFNGGALLPLGGFGELLGGHKGYGLSLMVDILSGILSGGTWSKYVKNTSEKGSNVCHFFMVIDIEHFIPLEEFKEKISQMIEEIKSSRKHPEFERIWIHGEKGFLTMETRLKLGIPIYRKVLEELNEIAKRVGVEG

SEQ ID NO: 20355 - protein, 363 aa, Pyrococcus horikoshii; identical to SEQ ID NO: 1289

SEQ ID NO: 20356 - protein, 314 aa, Pyrococcus horikoshii
VPERVVIALGGNALQQRGQKGTYDEMMENVRKTAKQIAEIIARGYEVVITHGNGPQVGTILLHMDAGQSLHGIPAQPMDVAGAMSQGWIGYMIQQALRNELRKRGIEKEVVTIITQTIVDKKDPAFQNPTKPVGPFYDEKTAKKLAKEKGWVVKEDAGRGWRRVVPSPDPKGHVEAETIRRLVESGIIVIASGGGGVPVIEENGEIKGVEAVIDKDLAGEKLAEEVNADILMILTDVNGAALYYGTEKETWLRNVKVEELEKYYQEGHFKAGSMGPKVLAAIRFIKNGGKRAIIAHLEKAVEALEGKTGTQVTP

SEQ ID NO: 20357 - protein, 425 aa, Pyrococcus horikoshii; identical to SEQ ID NO: 1291

SEQ ID NO: 20358 - protein, 386 aa, Pyrococcus horikoshii
VEIMEFEEAFKEVYEMVKPKYKLFTAGPVACFPEVLEIMKVQMFSHRSKEYRKVHMDTVERLREFLEVEKGEVLLVPSSGTGIMEASIRNGVSKGGKVLVTIIGAFGKRYKEVVESNGRKAVVLEYEPGKAVKPEDLDDALRKNPDVEAVTITYNETSTGVLNPLPELAKVAKEHDKLVFVDAVSAMGGADIKFDKWGLDVVFSSSQKAFGVPPGLAIGAFSERFLEIAEKMPERGWYFDIPLYVKYLKEKESTPSTPPMPQVFGINVALRIIEKMGGKEKWLEMYEKRAKMVREGVREIGLDILAEPGHESPTITAVLTPPGIKGDEVYEAMRKRGFELAKGYGSVKEKTFRIGHMGYMKFEDIQEMLDNLREVINELKKQKGIN

SEQ ID NO: 20359 - protein, 138 aa, Pyrococcus horikoshii
VVVVMIEVGEYKVKEGLYYTKDHEWAQVLEDGTVLVGITDYAQKELGDLAYVELPEVGKEVSKGDVLCEVESVKAVSEVYAPVSGEVIEVNEELSDSPEKINEDPYGAWIAKIKPKNLEEELKELMDAEKYAEYLKTL

SEQ ID NO: 20360 - protein, 401 aa, Pyrococcus horikoshii
VTLMIRASKRALSIEYAIRDVVLPARELEKKGIKVIRLNIGDPVKFDFQPPEHMKEAYCRAIQEGHNYYGDSEGLIELREAIVKREKEKNGVDITPDDVRVTAAVTEALQLIFGALLDPGDEILIPGPSYPPYTGLVKFYGGKPVEYRTIEEEGWQPDIDDLRKKISERTKAIAVINPNNPTGALYDKKTIEEIINVAGEHDLVVLSDEIYDLMTYEGKHISPGSLTKDVPVIVMNGLSKVYFATGWRLGYMYFVDPEGKLSEVREAIDKLARIRICPNTPGQFAAIAGLTGSMDYLKEYMKKLKERRDFIYKRLNEIPGISTTKPQGAFYIFPRIEEGPWKSDKEFVLDVLHNAHVLFVHGSGFGEYGKGHFRIVFLPPIEILEEAMDRFEKFMRERLSS

SEQ ID NO: 20361 - protein, 648 aa, Pyrococcus horikoshii
MLNGIGMGVRVVCPYCGFGCNLLIDPKSRRVKPYPGEPNRGKLCPKGLYALEHVFSKDRLKHPLKKEGESFRRISWEKAISEISTKLKEIIEDYGPGSIAFIASSKVTNEENYLIQKIARLLGTNNVDNCARLCHESSVHALKLTLGDGVQTNPYSDLERFGAIMIWGYNPAETHPVVMQYILGAKRRGGKIIVIDIRETLTMRFADYRLVIKPGTDITLANAIMNVIIEGNLYNKEFVESRTTGFSEIRMGVKKYTPEYAEKVTGVPAELIREVAEVFAKAGSGAIMWGMGITQQISGVENVLALVDIALLLGYFGEKGGLYPMRGQNNVQGAAYMGTLSEFLPGYIPLSDSKFRRKVAKMWGVEDLPTERGFYLTEYWDAILKGDLKALYIVGENPAVSDANALKVRKALTKLDLLVVQDLFLTKTARFAHYILPAAAFCEKEGSYMNSERRIQWSFKVCDPPGESKPDWEILVMLARALGLKGFDYSKVEDITREYFKLFPALRNRSIEELKARGIIIPAPRLYVDSFNTHDGKARFVAVEQIMPWEEPNGEYPLILTTVRLINHYNTGEMTRRSPSLAKMSGESVVFISREDAREYGIEDGDYVIVETRRGSLRLKAKIAKIQKGVIAIPFHFDANLLTNDALN

SEQ ID NO: 20362 - protein, 639 aa, Pyrococcus horikoshii
VKYMFSACMRDCYDTCSIMSEIKNGKLIVRGNPDHPITQGFLCPKGALLPRWFHSNERLKSPLVREGKRGDEDFKEVSWGEALTLIKEKLQETIKEYGSESILVYKYAGDRGIVNYYFPMRLFHYLNASTIDSGICDRAGQEALKDIYGTAVGMDPEKIKEHKLLVYWGINAFWTNLHGFMLAKKGNVEIWTVDVVRTETAKRSDKFFQIRPDTDVLFALGVAKVIIEEELYDKDFVTKNVYGFEEFKNYVTRLSLNYVSQETGIKPERIKEFAREFTEKRGIIHIGYGFQRSLAGGEAVRAVAILPVLVGHKFGFIYDMKTIDKSYAEGKFLRTKPENKIPQMELTKVIESDDIKFLYIYNSNPLASYPNQNRLRRALKKSDVFVVTHDIFLTDTALFSDVVLPANTFFERLDIVDSYYHRYVLLNEPVAKGPGKSNSEVTRLIAKSLGIRVPYLYESDEDVIRKVLEANGISFEELKRRGFIKVPEGPRNWKTPSGKIEFYSQRAVSRGLGPFPEYKKFKGKYPLRLLTPTHRMTITSQYHTTHGIIDPNLYMNPEDAKVRGIKDGDKVGVFNENGRVITKVKITEDVPKGVVILYKAFWPKLLGWNANFLTTDEKVEKYGKGSAFHSTWVEVNPYG

SEQ ID NO: 20363 - protein, 306 aa, Pyrococcus horikoshii
AIEVEKLTKSYGKFKAIDNLSFVVDEGIVFGFLGPNGAGKTTTILSMLGIIIPDSGDVRILGYDIFKEPLKAKERLGFLPENATIYEELTAWRNLDFFASFYRMSKQEKEKRIEELLKLVGLWDVRYRKAKTFSKGMRQRLLLAQALINDPELLILDEPTSGLDPEGARLVKDIIREQRKQGKTVFFSSHILSEVEELADKVGIIVKGKLRTVGTLEEIKKQYMELEGYEIKIETKQPLPELEIPDIIRIEKTTENKAIIFAKSDIRESISEELAKKGITIISLEIEEPSLEDVFLKTIYRREGNE

SEQ ID NO: 20364 - protein, 389 aa, Pyrococcus horikoshii; identical to SEQ ID NO: 1298

SEQ ID NO: 20365 - protein, 521 aa, Pyrococcus horikoshii; identical to SEQ ID NO: 1299

SEQ ID NO: 20366 - protein, 207 aa, Pyrococcus horikoshii
VLQLTEKFKGTTTVGIVCKDGVVLAADRRASLGNIIYARNVTKIHKIDEHLAIAGAGDVGDILNLVRLLRAEAKLYYSQSGKRMSVKALATLLANIMNGAKYFPYLAWFLVGGYDEKPKLYSVDMVGGITEDKYATAGSGMEFAYSILDSEYKDNLTLEEGIKLAVKAINTAIKRDVFSGDGILVVTITKEGYKELSDSELEATLKQ

SEQ ID NO: 20367 - protein, 338 aa, Pyrococcus horikoshii
MGVPIGDLVPRKEIDLENLYGKKIAIDALNAIYQFLSTIRQRDGTPLMDSKGRITSHLSGLFYRTINLMEAGIKPAYVFDGKPPEFKRKELEKRREAREEAELKWKEALAKGNLEEARKYAQRATKVNEMLIEDAKKLLQLMGIPIIQAPSEGEAQAAYMASKGDVYASASQDYDSLLFGAPRLIRNLTITGKRKMPGKDVYVEIKPELVVLDEVLKELKITREKLIELAILVGTDYNPGGVKGIGPKKALEIVRYSRDPLAKFQRQSDVDLYAIKEFFLNPPVTNEYSLSWKEPDEEGILKFLCDEHNFSEERVKNGIERLKKAIKAGRQSTLESWF

SEQ ID NO: 20368 - protein, 442 aa, Pyrococcus horikoshii
VKEIPGPKARKVIEEHHKYMATTTNDPNEYFLVIERAEGVYWIDVDGNVLLDFSSGIGVMNVGLRNPKVIEAIKKQLDLVLHAAGTDYYNPYQVELAKKLVEIAPGDIERKVFLSNSGTEANEAALKIAKWSTNRKMFIAFIGAFHGRTHGTMSLTASKPVQRSRMFPTMPGVVHVPYPNPYRNPWGIDGYENPDELINRVIDYIEEYLFEHYVPAEEVAGIFFEPIQGEGGYVVPPKNFFKELKKLADKHGILLIDDEVQMGMGRTGRMWAIEHFDIVPDIVTVAKALGGGIPIGATIFRADLDFGVSGVHSNTFGGNTVAAAAALAVIEELQNGLIENAQKLEPLFRERLEEMKEKYEIIGDVRGLGLAWGVEFVKDRKTKEYATKERGEIVVEALKRGLALLGCGKSAIRLIPPLIISEEEAKMGLDIFEEAIKVVSER

SEQ ID NO: 20369 - protein, 310 aa, Pyrococcus horikoshii; identical to SEQ ID NO: 1303

SEQ ID NO: 20370 - protein, 351 aa, Pyrococcus horikoshii; identical to SEQ ID NO: 1304

SEQ ID NO: 20371 - protein, 300 aa, Pyrococcus horikoshii
VTKQKVCPVCGSTEFIYDPERGEIVCARCGYVIEENIIDMGPEWRAFDASQREKRSRTGAPESILLHDKGLSTDIGIDRSLTGLMREKMYRLRKWQSRLRVSDAAERNLAFALSELDRITAQLKLPKHVEEEAARLYREAVRKGLIRGRSIESVIAACVYAACRLLKVPRTLDEISDIARVEKKEIGRSYRFIARNLNLTPKKLFVKPTDYVNKFADELGLSEKVRRRAIEILEEAYRRGLTSGKSPAGLVAAALYIASLLEGEKRTQREVAEVARVTEVTVRNRYKELVEKLGIKVPIT

SEQ ID NO: 20372 - protein, 424 aa, Pyrococcus horikoshii
MPKEKPHVNIVFIGHVDHGKSTTIGRLLYDTGNIPETIIKKFEEMGEKGKSFKFAWVMDRLKEERERGITIDVAHTKFETPHRYITIIDAPGHRDFVKNMITGASQADAAVLVVAATDGVMPQTKEHAFLARTLGIKHIIVTINKMDMVNYDQKVFEKVKAQVEKLLKTLGYKDFPVIPTSAWNGDNVVKKSDKMPWYNGPTLIEALDQIPEPEKPIDKPLRIPIQDVYSIKGVGTVPVGRVETGKLKVGDVVIFEPASTIFHKPIQGEVKSIEMHHEPLQEALPGDNIGFNVRGVSKNDIKRGDVAGHTDKPPTVVRTKDTFKAQIIVLNHPTAITVGYSPVLHAHTAQIPVRFEQILAKVDPRTGNIVEENPQFIKTGDSAIVVLRPMKPVVLEPVKEIPQLGRFAIRDMGMTIAAGMVISI

SEQ ID NO: 20373 - protein, 429 aa, Pyrococcus horikoshii
MKANDIIKRYSKVIAQANKMHYFPLVPVKAENAKVWDINGKEYIDFLSDAAVQNVGHNNPRVVKAVKEQVDKLMHASYIYAYPIEPLLLAEKLAEIAPIDNPKVSFGLTGGDANDAAIKFARAYTKRQTILSYMKSFYGSTYGAMSLTGLDFRVRAIVGELSGVHYLPYPYCYRCPFGKEPGSCKMECVEYIKEKFEGEVYAEGVAALFAEPIQGDSGIVVPPKNYFKKVTKILREHGILLVVDEIQSGMGRTGKWFAIEHFGVKPDIITVGKALGGGLPISATIGKAEIMDSLPPLSHAFTLSGNPTTSRAALAVIEEIEEKNLLRRAEKLGNYAMKRLREMMDKHELIGDVRGIGLMIGVELVKDRETKERAIEETSKVIERAFDLGLIVTHFSGNVLRIEPPLTIERETLDEGLDVLEKAIEDVEE

SEQ ID NO: 20374 - protein, 303 aa, Pyrococcus horikoshii; identical to SEQ ID NO: 1309

SEQ ID NO: 20375 - protein, 1117 aa, Pyrococcus horikoshii; identical to SEQ ID NO: 1310

SEQ ID NO: 20376 - protein, 260 aa, Pyrococcus horikoshii; identical to SEQ ID NO: 1311

SEQ ID NO: 20377 - protein, 422 aa, Pyrococcus horikoshii
VDMVEQDPFEIAVKQLERAAQHMKISEEALEFLKRPQRIVEVTIPVEMDDGSVKVFTGFRVQYNWARGPTKGGIRWHPEETLSTVKALAAWMTWKTAVMDLPYGGGKGGIIVDPKKLSDREKERLARGYIRAVYDIISPYEDIPAPDVYTNPQIMAWMMDEYETIARRKTPAFGIITGKPLSIGGSLGRNEATARGASYTIREAAKVLGWDGLKGKTIAIQGYGNAGYYLAKIMSEDYGMKVVAVSDSKGGIYNPDGLNADEVLKWKREHGSVKDFPGATNISNEELLELDVDVLAPAAIEEVITKKNADNIKAKIVAEVANGPVTPEADEILFEKGILQIPDFLCNAGGVTVSYFEWVQNITGYYWTLEEVRERLDKKMTKAFYDVYNTAKEKNIHMRDAAYVVAVQRVYQAMLDRGWVKH

SEQ ID NO: 20378 - protein, 418 aa, Pyrococcus horikoshii; identical to SEQ ID NO: 1313

SEQ ID NO: 20379 - protein, 559 aa, Pyrococcus horikoshii; identical to SEQ ID NO: 1314

SEQ ID NO: 20380 - protein, 335 aa, Pyrococcus horikoshii; identical to SEQ ID NO: 1315

SEQ ID NO: 20381 - protein, 341 aa, Pyrococcus horikoshii; identical to SEQ ID NO: 1316

SEQ ID NO: 20382 - protein, 212 aa, Pyrococcus horikoshii
KVAGVDEAGRGPVIGPLVIGVAVIDEKNIERLRDIGVKDSKQLTPGQREKLFSKLIDILDDYYVLLVTPKEIDERHHSMNELEAEKFVVALNSLRIKPQKIYVDSADVDPKRFASLIKAGLKYEATVIAEHKADAKYEIVSAASIIAKVTRDREIEKLKQKYGEFGSGYPSDPRTKEWLEEYYKQYGDFPPIVRRTWETARKIEERFRKNQL

SEQ ID NO: 20383 - protein, 387 aa, Pyrococcus horikoshii; identical to SEQ ID NO: 1318

SEQ ID NO: 20384 - protein, 570 aa, Pyrococcus horikoshii; identical to SEQ ID NO: 1319

SEQ ID NO: 20385 - protein, 205 aa, Pyrococcus horikoshii [sequence omitted]

SEQ ID NO: 20386 - protein, 361 aa, Pyrococcus horikoshii; identical to SEQ ID NO: 1321

SEQ ID NO: 20387 - protein, 411 aa, Pyrococcus horikoshii; identical to SEQ ID NO: 1322

SEQ ID NO: 20388 - protein, 366 aa, Pyrococcus horikoshii; identical to SEQ ID NO: 1323

SEQ ID NO: 20389 - protein, 248 aa, Pyrococcus horikoshii
RWVSMRVIKVGGSVLENLEKVFKPEIFRDAVVVHGGSRYVDELAKKLGLNVEKLTSPSGVTFRRTTRKVLDVYIAAVMKANRELVSFLRRQGIEAIGVSGVKEVIIGRRKKLIKAVINGKIMAIRDDYSGIIKEVNVEMIRNYMKVGVPVIAPIAYDPVENVPLNVDGDKVAYHVALALKSRELYFLSDTAFLINGEVIDKIPRNRIEEYFPYSSGGMRKKLLMAKKAIESGVERVIIEGLNGRTVIS

SEQ ID NO: 20390 - protein, 330 aa, Pyrococcus horikoshii; identical to SEQ ID NO: 1325

SEQ ID NO: 20391 - protein, 323 aa, Pyrococcus horikoshii
VVKSVTDKIKFYEFEGGLSVFKKYGVPIREEDLEEIRKMDAILFGATTTPFDVPRYKSLIITLRKELDLYANLRIIPNFKLRKEIIIVRENSEGLYSGEGAYDSNKVVDFRIITRKGAERIAKFAVKLAKDRSTFLTFVHKANILESDRFFRKIVLDIARKEDVKVREEIVDSFTIKLVKDPWNLGIILSENMFGDILSDLATIHAGSIGIVPSGNYGEDIALFEPIHGSAPDIAGKGIANPIGAILSAAMMLDYLGLDGSIIWKAVGRYVRRGNLTPDMEGRATTLEVTNGIISEIYRLDEYEIDEVWRDEVRLGRILLEIS

SEQ ID NO: 20392 - protein, 1066 aa, Pyrococcus horikoshii
  unsure (1)..(1066): unsure at all Xaa locations
SAQHAVYYIRMDAFKAIQRHRMEFFDKTFSGQLISRITNDTERITRFLSFRIRMFVYSIFLIAVSLYYMIRMNVFLSLVALGTIAVVVLLNTTYATKVRPIYDKIRHQTGVIASIATGTIAGIKTIKSLSVEENIQEKFSKENENLYSLNIDAIKITALYGNAPFLILGLAMSAMLYYGGKAIIAKTLTVGELVAFLTYMLTMMWPLRALGFTIGDIQRSLAAAARLFEVIDSAPKAIDAPDAVEINDPKGEVEFRDVWLTYHTGRTVLRGVNLKVSPGEKVLIVGPPGSGKSSILKLIARFYVPDKGEVLIDGVNVKKIKTESLRRIVAYVPQEPFIFNRSIRENIALAKPDAKMDEIIRAAKIAKIHDFISSLPNGYDTIVGEKGVTLSGGQRQRIALARALLLDPKIILLDDPVSNLDAETEKRLVEDLKEILKGRTALIVSQRLSLVKLTDRVIVIKDGRIIEEGKPSELVKKGGAFSEMIELXVRNMRNNESSFSLLIRFIREALSEKKTLVVVIISIVGSAIANLASPYVLHIAIDNYIVPGKYGELWFVTLLYLLSLIGQWFFMTLQTYYTEVFGQGVLKRLRSKLHEKILISNLDFFKEKSTGDLVSRIINDTNIVNDVLVSGLLGGLGSLLSLAGIIIAMFLLDVKLTLVTLASVPLMVLVAYYFGGKMRRAYRETRQKIAKISSVVEESVAGIETIRAFGKERDVEREFSKVSLETIKAYLRVAVYMGVFWPLMNITSLLSVIAVIAYGGYLAYKGAVSIGVVVAFIQYAQRFRGPINNVVSMYDSLQSALAALERIYEILDDENVEDYNGINVERLNGEIEFRNVWFEYERGRPVLKDINLLIPSGSKVAIVGKTGAGKTTLANLIMRFYDPTKGDIFYDGIEGRKISRKSLRRRIGYVPQETYLFPGTIMENILMANPEAREEDVIRVCKELGIHEFIMKLPNGYKTSAGEAGKLLSLGERQLISLARALLKDPDIVILDEALSSVDPKTEQLVQNAMLKLMEGRTSIIIAHRLSITRFADKVIVVKDGRIIEEGPPKLLLEKKGYFYRLYTSQ

SEQ ID NO: 20393 - protein, 301 aa, Pyrococcus horikoshii
MKNKLIVITGGAGFIGSHLAEALKDENDVIIIDNLYSGRIENIPEGVKFIRADVRDYESIAEVISEADYVFHEAAQISVKESIEDPVFTEEVNVIGTINVLRALSQGDGKLIFASSAAVYGEPKELPITEDTLTNPISPYGITKLAAEHYCRVYQSLYGIPVVILRYFNVYGPRQSSAYAGVISIFLERAIKGEPLIIFGDGKQTRDFIYVKDVVEANILVAKKRSANGRIFNVATGKETTILELAMKIIDMTSSSSSILFYPPRPGDIRRSVAKIERIKKLGFKPRYSLEEGLKETFKWF

SEQ ID NO: 20394 - protein, 1179 aa, Pyrococcus horikoshii; identical to SEQ ID NO: 1330

SEQ ID NO: 20395 - protein, 408 aa, Pyrococcus horikoshii
LNIEEIIEKVANGEIKFYQVEKYVNGDKRLATEIRRKALEKRLGIKLHHIGYYSIDPNELIGRNIENMIGVVQIPMGVAGPLKINGEYAKGEFYIPLATTEGALVASVNRGCSALTEAGGVVTTLIDDKMTRAPLIRCPNARRAREVAKWVEENLDYLQEKAVSKVTRHGKLRGVKPFIVGNNLYLRFEFETGDAMGMNMVTIASEEIMKVIEEEFPDVRYLALSGNLCVDKKPNAVNFILGRGKTVIAEAVVPRKIVEKKLKTTPELIAEVNYFKNLVGSAQAGSYGFNAHFANIVGAIFLATGQDEAQITEGAHGITIAEVTPDGDLYISITMPSLEIGTVGGGTRVPSQREALEIMGVAGGGDPPGINAKKFAEIVAGAVLAGELSLLAAIAAKHLARAHKMLGR

SEQ ID NO: 20396 - protein, 222 aa, Pyrococcus horikoshii
ENAYKELRELGTVHYFQADLSSKEDIKRMVKDAWDAMGRIEALIWNAPNVKCEPCMVHEARYRDWLEAALLHLVSPGYITTLLIQAWLEKKIKGVLIYLSSASVLEPMPPLLLADTARAGLVQLTKGITRAYGGKGIRAYVVLLGSFDTPGARENLAKIAEERGMSLEEIWRKEVIERTPLKRTGKWSELGALIDFLLSENAEYMMGSTILFDGAMTRGVNL

SEQ ID NO: 20397 - protein, 798 aa, Pyrococcus horikoshii
VMLMVEKKEIKLKVASAYQRDVGRGIVRIDRRSMRELGVSPGDVVEIIGTKNTAAIVWPAYPEDEGLGIIRMDGTIRKNAGVGLGDEVTIRKADVKEARKVVLAPTEPIRFGRDFVEWLHERLVGRPVVRGDYIKIGVLGQELTFVVTTTQPSGVVQITEYTDFDISEKPVKEVEKRMTTGVTYEDIGGLKDVIEKIREMIELPLKHPELFEKLGIEPPKGVLLYGPPGTGKTLLAKAVANEANAYFIAINGPEIMSKYYGESEERLREVFKEAEENAPSIIFIDEIDAIAPKRSEVTGEVEKRVVAQLLALMDGLKGRGKVIVIGATNRPDALDPALRRPGRFDREIEVGVPDKQGRKEILQIHTRGMPIEPDFRKEDVLKILEGLKKEGKFRDVIDKAIDRVMKVSEDDIPKVLKELNGELYEEVRTRLVDLLLEELAEVTHGFVGADLAALAREAAMAALRRLIKEGKIDFEAETIPREVLDELKVTRKDFYEALKMVEPSALREVLIEVPNVHWDDIGGLEEVKQELREAVEWPLKYPEAFRAYGITPPKGVLLYGPPGTGKTLLAKAVATESEANFIAVRGPEVLSKWVGESEKNIREIFRKARQAAPTVIFIDEIDAIAPRRGTDVNRVTDRLINQLLTEMDGIQENTGVVVIAATNRPDILDPALLRPGRFDRLILVPAPDEEARFEIFKVHTRSMPLADDVDLRELARRTEGYTGADIAAVCREAAMIAMRKALEKGIIKPGMKADEIKQKAKVTMKDFEEALKKIGPSVSKETMEYYRKIQEQFKQARG

SEQ ID NO: 20398 - protein, 371 aa, Pyrococcus horikoshii
MKIALVSDWYYPKIGGVATHMHNLAIKLRERGHEVGIVTNNRPTGKEEELKRYGIELIKIPGIISPFLDVNLTYGLKSSEELNEFLKDFDIIHSHHAFTPLSLKALKAGKNMEKGTLLTTHSISFAHESKLWDTLGFTIPLFKSYLKYSHRIIAVSKAAKSFIEHFTSVPVLIVPNGVDDERFFPARDKEKIKAKFGLEGNVVLYVSRMSYRKGPHVLLNAFSKIEDATLVMVGNGEMLPFLKAQTKFLGIENKVVFMGYVPDDILPEVFRMADVFVLPSISSEAFGIVILEAMASGVPIIATDVGGIPEVIKENSAGLLVPPGNELKLREAIEKLLKNEELRKWYGNNGRRSVEEKYSWNKIVVKIERIY

SEQ ID NO: 20399 - protein, 296 aa, Pyrococcus horikoshii; identical to SEQ ID NO: 1335

SEQ ID NO: 20400 - protein, 272 aa, Pyrococcus horikoshii; identical to SEQ ID NO: 1337

SEQ ID NO: 20401 - protein, 650 aa, Pyrococcus horikoshii
VNLMYIRKDLLQPRLYQELIYAKCKERNCLIVLPTGLGKTIIAMMIADYRLDKYGGKVLMLAPTKPLVLQHAETFRKFFTLPPEKIVALTGEISPNERVRAWARAKVVIATPQTIENDLLVGRISLEDVTLIIFDEAHRAVGNYAYVYIAKEYLKQAKNPHVIGLTASPGSTPEKIMEVLRNLGIEHIEYRSENSPDVKPYVQGIKFEWVKVELPELYKEVRKLLRDMLRDSLKPLAEAGLLDSTSADIPKKEILRAGQIINEEMAKGNHDLRKLLLFHAMALKLHHAIELLETQGLSALRVYLKRLYEEAKAGSTRASKELFLDKRMKKALALLIQAKELGIDHPKMEVLKGLIREQLKRKENSKIIVFTNYRETAKKVVEELMKDGIKARRFVGQASRENDRGMSQKEQKLILDAFARSEFNVLVATSVGEEGLDVPEVDLVIFYEPVPSAIRSVQRRGRTGRQKPGRVVILMAQGTRDEAYYWSSRQKEKIMRETIRMVSQMVRKERQLSLESYVKREVNEEIKEEKKETGGIKVVIDSRELRSEVVKKLKTLGIKIEVRTLDVGDYIVSEDVAIERKSANDFIQSIIDGRLFDQVKRLKEAYPRPVIIIEGQLYGIRNVHPNAIRGAIASIVLDFGVPVIFSSSSD

SEQ ID NO: 20402 - protein, 263 aa, Pyrococcus horikoshii
MLRIDLSGKLAFTTASSKGIGFGVARVLARAGADVIILSRNEENLKRAKEKIKSESNVEVHYIVADLTKMEDLERTIKELKDIGDPDIFFFSTGGPKPGYFMEMSMEDWEGAVKLLLYPAVYLTKALVPGMERKGFGRIVYSTSVAIKEPIPNIALSNVVRIAMAGLVRTLAKELGPKGITVNGIMPGIIRTDRVIQLAQDRAKREGKSVEEALKEYAKPIPLGRLGEPEEIGYLVAFLASELGSYINGAMIPVDGGRLNSVF

SEQ ID NO: 20403 - protein, 286 aa, Pyrococcus horikoshii
VNKVFVIGSGAKHLEEEISKNAKILKTEIKKFPDGEKYVRILEHGEEVIVVQSTYRPQDEHLIETIIIGDALKEAGFEKLKLVVPYLAYSRQDRVTKEGEPISVRAIMKMLGLYYDELYVFDIHNPKTLDFFPGKAVNIYPAKVIAEYFRDKLENGLVLAPDRGALERAKEVANILGLEYSHFEKERISPTEVKMTPVDVNVKGRNVLIVDDIISTGGTMIRAAEILKDLGAEKVFVVATHGVFAEGAIERVSKAVDELAVTNTIPTKVSKISIVPEIMRSILEVK

SEQ ID NO: 20404 - protein, 215 aa, Pyrococcus horikoshii
KAVLFDIDGTLLSEKPLIMFILPQVYDELANKLNISRMEARRIFLSEIEKRKGKYEWHDWNFFFRLFSLPFKYEDFIMKYPTKIEVFPGVVEVLKYLKERGYRLGIVTSGPRYQVLKLKVSGIYRYFDVVVTRDDVGSIKPEPRIFLAALEKLKISPKDAVMVGDSLEQDILGAKGVGMKSVWINVGGENGYNLPDFEISSILQLPEVIEDESDI

SEQ ID NO: 20405 - protein, 428 aa, Pyrococcus horikoshii; identical to SEQ ID NO: 1342

SEQ ID NO: 20406 - protein, 1235 aa, Pyrococcus horikoshii; identical to SEQ ID NO: 1343

SEQ ID NO: 20407 - protein, 317 aa, Pyrococcus horikoshii
  unsure (1)..(317): unsure at all Xaa locations
ILEVKNLKMYYFTSRGPVKAVDDVTFDLEKGEVLGLAGESGCGKSSIGFTLMGMPQPPGRIVGGSIKIDGREIVGLPEDVLRREIRWQKISMIFQGAMNALNPVYTVGYQMIEPLIYHKGMDREDALDRAMKYLELVGLDPEIVYRYPHELSGGMKQRVVIAMALLLEPDIVIADEPTTALDVVVQAQIINLMKRLKKKLGLSMIFITHDLSILAEISDRVAVMYAGKLVEIGPSEKIYYEPAHPYTQKLLAAIPRLHEDVEKLEFIPGSPPNLINPPSGCRFHPRCPYAMDKCKEEEPKMVEVDKDHYAACWLLXG

SEQ ID NO: 20408 - protein, 214 aa, Pyrococcus horikoshii; identical to SEQ ID NO: 1345

SEQ ID NO: 20409 - protein, 457 aa, Pyrococcus horikoshii
EYSTISKIYGPLMIVEGVKGVAYGEVVEIETESGEKRKGQVLDARENMAIVQVFEGTRDLDIKTTSVRFTGETLKVPVSMDMLGRIFNGIGKPIDGGPEIIPEDRRDVHGAPLNPVARAYPRDFIQTGISAIDGMNTLVRGQKLPIFSGSGLPHNQLAAQIARQAKVLGEEESFAVVFAAMGITYEEANFFKKSFEETGAIERAVLFLNLADDPAIERIITPRMALTVAEYLAFDYDMHVLVILTDMTNYCEALREISAAREEVPGRRGYPGYMYTDLATIYERAGRIRGRKGSITQMPILTMPDDDITHPIPDLTGYITEGQIVLSRELHRKGIYPPIDVLPSLSRLMKDGIGKGKTREDHPQLAQQLYAAYAEGRSLRDLVAVVGEEALSETDKKYLEFADRFEREFVAQGYYEDRSIEETLDLGWELLSILPESELKRVKKEMIMKYHPKYRKR

SEQ ID NO: 20410 - protein, 943 aa, Pyrococcus horikoshii
  unsure (1)..(943): unsure at all Xaa locations
VKRXVKMVAKGRIIRVTGPLVVADGMKGAKMYEVVRVGELGLIGEIIRLEGDKAVIQVYEETAGVRPGEPVVGTGASLSVELGPGLLTSIYDGIQRPLEVIREKTGDFIARGVTAPALPRDKKWHFIPKAKVGDKVVGGDIIGEVPETSIIVHKIMVPPGIEGEIVEIAEEGDYTIEEVIAKVKTPSGEIKELKMYQRWPVRVKRPYKEKLPPEVPLITGQRVIDTFFPQAKGGTAAIPGPFGSGKCVDGDTLVLTKEFGLIKIKELYEKLDGKGRKIVEGNEEWTELEKPITVYGYKDGKIVEIKATHVYKGVSSGMVEIRTRTGRKIKVTPIHRLFTGRVTKDGLILKEVMAMHVKPGDRIAVVKKIDGGEYIKLDSSNVGEIKVPEILNEELAEFLGYLMANGTLKSGIIEIYCDDESLLERVNSLSLKLFGVGGRIVQKVDGKALVIQSKPLVDVLRRLGVPEDKKVENWKVPRELLLSPSNVVRAFVNAYIKGKEEVEITLASEEGAYELSYLFAKLGIYVTISKSGEYYKVRVSRRGNLDTIPVEVNGMPKVLPYEDFRKFAKSIGLEEVAENHLQHIIFDEVIDVRYIPEPQEVYDVTTETHNFVGGNMPTLLHNTVTQHQLAKWSDAQVVIYIGCGERGNEMTDVLEEFPKLKDPKTGKPLMERTVLIANTSNMPVAAREASIYTGITIAEYFRDMGYDVALMADSTSRWAEALREISGRLEEMPGEEGYPAYLASKLAEFYERAGRVVTLGSDYRVGSVSVIGAVSPPGGDFSEPVVQNTLRVVKVFWALDADLARRRHFPAINWLTSYSLYVDAVKDWWHKNIDPEWKAMRDKAMALLQKESELQEIVRIVGPDALPERERAILLVARMLREDYLQQDAFDEVDTYCPPEKQVTMMRVLLNFYDKTMEAINRGVPLEEIAKLPVREEIGRMKF

SEQ ID NO: 20411 - protein, 99 aa, Pyrococcus horikoshii
KVVIMGDSDTVVGFRLAGIHEAYEFDLSELSIERARNKLKELVERDDVGIILITERLAQKIGELPQVNLPIILQIPDKFGSIYGEELLREIVRRAVGIE

SEQ ID NO: 20412 - protein, 198 aa, Pyrococcus horikoshii; identical to SEQ ID NO: 1349

SEQ ID NO: 20413 - protein, 518 aa, Rhodopseudomonas palustris
  unsure (1)..(518): unsure at all Xaa locations
DVLIIGAGHNGLTCAAYLARAGLKVKVVERRNVVGGAAVTQEFHPGFRNSVAAYTVSLLNPKVIADLKLHEHGLRIVERKAQNFLPAPDGQYLLTGSNTTAASLARLSAHDAAAFGGFAAELETIADVLRHFVLRAPPNLVVQFGLPAIRESLNALETANRLRALTMEQQRLLLDLFTCSAGEMLDARFEHDLVKALFGFDAIVGNYASPYAAGSAYVMLHHAFGEVNGKKGVWGHAIGGMGAITSAMAAAARAAGAEIETSAGVREVLVEKDRVVGVTLDDGRNVRARFVASNVNPKLLYTRLLPQDALPDDVRRRMQNWKTGSGTFRMNVALSRLPSFTALPGDGDHLTAGIIIAPSLGYMDRAYQDARAHGWSREPVVEMLIPSTLDDSLAPKGQHVASLFCQHVAPELPDGASWDDHRDEVADLMIATVDRYAPGFAASVLGRQILSPLDLEREFGLVGGGIFHGALSLNQLFAARPLPGQADYPGALKGLYHAGSGAQPNESVSGAPGXNAAV

SEQ ID NO: 20414 - protein, 304 aa, Rhodopseudomonas palustris
MAPIISVKNLSKTYGTGRKALNGVSLDIMGGEIFALLGPNGAGKTTLIGTICGLVNPTGGTVTVDGHDIITDYRAARELIGLVPQELHTDAFESVWDTVSFSRGLFGKPKNPAHIEKVLRDLSLWDRKDSKIITLSGGMKRRVMIAKALSHEPQILFLDEPTAGVDVELRKGMWEVVRALKATGVTIILTTHYIEEAEEMADRVGVINHGELILVDEKSALMQKLGKKQLKLHLDAPIDTVPPQLSAYDLALSDDHNKLIYTYDTRAEHTGITALLGDIRAAGIRFHDLDTSQSSLEEIFVSLV

SEQ ID NO: 20415 - protein, 459 aa, Rhodopseudomonas palustris
QAVASAIEALAARFGNRLVTSLAVREQHGHTTTWLPNQPPDAVVMAQETADIQDTVRICAQHNVPVIAFGTGTSLEGHVNAPAGGICIDLRDMNKILEVHAEDLDCVIQPGVTRKALNENLRDQGLFFPIDPGADASIGGMAATRASGTNAVRYGTMRDNILALKVVRGDGEIITTGTRAKKSAAGYDLTHLFVGSEGTLGIISELTIKLRGIPETIAAASCSFPSVSDACQAVILAIQTGIPLARIELMSESQVKAVNAYSKLTLPETPLLLLEFHGSEVEVGEQSKNFGAIAKDCGGGDFTWTTRPEDRNKLWQARHDAYWSVRALRQGDGVGVVATDVCVPISRLADCVGETEADLNRLGLLAPIVGHVGDGNFHCSLLCDVNDAEELARADEFMHRLVERAQSMDGTCTGEHGIGQGKQKYLQAELGLEALQAMRAIKQALDPQNIFNPGKILPQ

SEQ ID NO: 20416 - protein, 477 aa, Rhodopseudomonas palustris
MIMARTPRSPRPARSAATRSETDSFGPIDVAADRYWGAQTERSRQNFRIGTERMPIGIIRALAIVKLAAAETNKELGLLDNRRAGAIVRAAREVIDGTHDDHFPLVVWQTGSGTQTNMNLNEVIANRANELLGGERGSKKPVHPNDHVNMSQSSNDSFPTAMHIAAAQAITADLIPALTLLHDALRKKEKAFAKIVKIGRTHTQDATPLTLGQEFSGYAAQLASGIARIKSALKELYPLAQGGTAVGTGLNTHPKFAKAFAKRAAAITKLPFVTAPNKFEALAANDAYVFVHGALNAAATALFKIANDIRLLGSGPRSGLGELILPENEPGSSIMPGKVNPTQCEAMTMVCCQVFGNQTTLTVAGSQGHFELNVYKPVMAQAMLQSIGLLADAARSFTTNCVDGIRADEQRIGELMQRSLMLVTALAPSIGYDNAAKIAKAAHQRGTTLKDEAVRSELISAAEFDRLVRPDKMTHPG

SEQ ID NO: 20417 - protein, 164 aa, Rhodopseudomonas palustris
IVLVVAVADNGVIGQGNAIPWRLKSDLQRFKQLTLNKPVIMGRKTYQSIGRPLPGRTNIVITRDAAFTAPGVVVAPSFAAAEQVARGDALRRFATEIAVIGGAEIYAQWLPLAARIELTEVHAQPAGDTSFPPIDPELWREVARERHTAGPHDSADFSYVTYRR

SEQ ID NO: 20418 - protein, 112 aa, Rhodopseudomonas palustris
FRFEAAHYLPNVPETHRCKRMHGHSYRVELQLSGPINPVTGFVLDFFEIEAAFGPLLKRLDHYCLNEVEGLENPTAENIAIWIWRRTKPELPQLCGVRVYETSDCWADYAGE

SEQ ID NO: 20419 - protein, 436 aa, Rhodopseudomonas palustris
MKALAEQIGDIDSVNTYGRVVGVRGLMVEIAGPIHAMSVGARIVVETGANREIPCEVIGFTGNNAIVMPFAGLEGVRRGCRAIIANSAAQVRPSPHWLGRVVNALGEPIDGKGPLVQGPSPMQFRNQPPPAHSRKRVGMPLDLGVRALNTFLTCCRGQRMGIFAGSGVGKSVLLSMLARNVDAAVSVIGLIGERGREVQEFLQDDLGEEGLARSVVVVATSDEPALMRRQAAYLTLAIAEYFRDNDKDVLCLMDSVTRFAMAQREIGLSAGEPPTAKGYTPTVFTELPKLLERAGPGLGEGTITGIFTVLVDGDDHNEPVADAVRGILDGHIVMQRSIAERGRYPAINVLKSVSRTMPKSADPVYLPMIKRARQIMATYADMEELIRLGAYRPGSSAEVDEAVRLHEPLEDFLRQGKDEATSLQSGYVQLEQILSN

SEQ ID NO: 20420 - protein, 283 aa, Rhodopseudomonas palustris
TLMHALFIGQTYIDVTFITDHLPTGDEKHVASDYAVSFGGNAVTAAFCCAKLGIVPDLIATVANDWLGRMFQDMSAKYGIEIHPRKVASSSLSFIMPKDGKRAIVRCRDDEHIHPFPLLNLGPCRALHVDGHQPDAAIHYAKLCREAGILTSLDGGGLRTNTHELLEFIDVAIVAERLCEQMDMTPEKMLDYLKSRGCRVGGVTLGERGLYWYDEAGTVRTLSALPIPRERVIDTNGAGDVFHGAYVFSYLNNPAQSWQHHFEFARAASTFKIQKLGNEAGLP

SEQ ID NO: 20421 - protein, 298 aa, Rhodopseudomonas palustris
IAIDVRGLTKSFNGREVVHDLSMQVKRGSIYGFLGPNGSGKTTTIRMLCGLLTPDRGEGTCLGFDIRTDAAKIKRRVGYMTQRFSLYQDLSVRENLEFVARLYGVPDARGAAREMIKRLGLSGREEQLAGELSGGWKQRLALGACTLPNPQLLLLDEPTAGVDPKARRDFWNEIHALAAEGLTVLVSTHYMDEAERCHEIAYIAYGHLLAHGTVDQVIAGSKLTTWVATGEGLGTLAHELAGKPGVDMVAPFGTSLHVSGRDQAALDQTLAPYRNDPRQTWQHGAPSLEDVFIELMSR

SEQ ID NO: 20422 - protein, 247 aa, Rhodopseudomonas palustris
VEVDRQGAVGIVTLNLPEARNALSREMIRALAAALDELERDAAIAAIVLSGREVFCAGADIAEMRGIDLATVLAEDFSGCCDRLATCAKPLIAAVEGYAIGGGCELIEMCDLVIAGIGAKFGHPEIAFGTLSGGGGTQRLARAVGRARAMDLILTGRLISAIEAERIGLISRVVEDGEAHQAAREAAKLIAAHPVRAVRFAKQAVDRAVSAGLADGLALERRLFHLSFATGELPPRLDRFLTRRSPR

SEQ ID NO: 20423 - protein, 402 aa, Rhodopseudomonas palustris
MAKIKVKNPVVELDGDEMTRIIWQMIKDKLITPFLDVELMYFDLGMEHRDKTDDQVTIDAANAIKQVGVGVKCATITPDEARVKEFGLKSMWKSPNGTIRNILGGVIFREPIICKNVPRLVPGWTKPIVIGRHAYGDQYRATDIKFPGPGTLTMKFVGEDGSVIEREVFKAPGAGVAMSMYNLDESIKDFARASLNYGLMRNYPVYLSTKNTIMKVYDGRFKDIFQEIFDAEFKKEYDAKGLTYEHRLIDDMVASALKWSGGYVWACKNYDGDVQSDTVAQGYGSLGLMTSVLMTPDGKTVEAEAAHGTVTRHYREHQKGKATSTNSIASIFAWTRGLAHRAKLDSNEELARFADLLEKVCVDTVEAGAMTKDLALLVGADQRWLSTEGFLDKVAQNLNKAM

SEQ ID NO: 20424 - protein, 500 aa, Rhodopseudomonas palustris
SRRPVMLVILDGWGWREDPADNAVLQAKTPTFDALWTNGPHAFLRTSGKSVGLPNGQMGNSEVGHLNIGAGRVVMQDLPRISDAIANGEIERAPGLVAFIDKLKASGGTCHLMGLVSPGGVHSLQDHACALAKILAKAGVKTVLHAFTDGRDTPPKSAVDDIVRLRAELPPNVPIATVSGRYYAMDRDNRWERVSKAYGVIADADGPRFADANAVIADGYAAGVNDEFIVPAVIGDYQGMRDGDGVLCFNFRADRVREILAALLDSAFAGFPRKQVKQIAAAAGMTQYSTALDALMGTIFPPQSLVNGLGQVVADAGLHQLRMAETEKYPHVTYFLNGGEEVPYPGEDRIMVPSPKVATYDLQPEMSAPELGDKAVAAIESGKYDLIVLNFANPDMVGHTGSLPAAIKAVETVDTQLGHIVAAIRKAGGALLVTADHGNCEMMRDPETGGPHTAHTTNPVPVLLVGDNGPLADGQLSDLAPTLLKLMELPQPAEMTGKSL

SEQ ID NO: 20425 - protein, 537 aa, Rhodopseudomonas palustris
VQETGVHNGAYGTDKFGLKNLKGVYWNFGAPQLYEHALKNGEAVLSSDGALVADTGVFTGRSPKDKFTVRDATTENTMWWGGNQSITAEQFEALYQDFLKHAEGMTLFAQDLYGGADPTFRIKTRVYTELAWHSLFIRTLLRRPERAELENFVPELTLIDLPSFRADPKRHGCRSENVVAIDFARKIVLIGGTQYAGEMKKSVFTTLNYYLPEKGVLPMHCSANVGPNGDTAIFFGLSGTGKTTLSADPNRTLIGDDEHGWGKDGVFNFEGGCYAKCIKLSSENEPEIYAASTRFGAVLENVVLGELDRKPDFDDGSKTENTRSAYPLESIPNASLTGRAGQPKNVVMLAADAFGVMPPIAKLTPAQAMYHFLSGYTAKVAGTERGVTEPTPEFSTCFGSPFLPRDPSVYGNMLRELIAKHNVDCWLVNTGWTGGIYGTGHRMPIKVTRALLTAALDGSLRNVEFRTDPYFGFAVPTALPGVPSEILDPVKTWADKAAFDTTARKLVGMFQKNFAKFEAQVDAEVRAAAPDVKMAVE

SEQ ID NO: 20426 - protein, 397 aa, Rhodopseudomonas palustris
  unsure (1)..(397): unsure at all Xaa locations
MTESSHSPGFATTAIHHGYDPLAHHGALNPPLFLTSTYAFASAAEGAARFAGEAEGFVYSRVGNPTVAVLESRLAALEGGEAALATASGVGALTALIWTLLKTGDGIIADQMLYGCTFGLFEHHLPRFDIEVVFADLTDPANLQAALRPNTRLVFTETPTNPNMRLVDIAACAEICRRADARLVVDNTYCTPYLQRPLDLGADLVTHSATKYLGGHGDLLAGAVVGPKEIIDQVRFVGVKELNGACISAFDAFLILRGLKTLNLRMDRHSATAVKLAHDLEAHPAVAAVYYPGLDSHKQRNLAQRQMRQPGGMIALELRGGLAAGRSFMDKVKLATRAVSLGDAETLIQHPASMTHATYDPAERARHGFTDGLIRISVGLEDYEDLKQDLLGALXTT

SEQ ID NO: 20427 - protein, 333 aa, Rhodopseudomonas palustris
SPTQEPAMDAMVLTAPGTSLQWQSRDTPQPGDGEVLVTVSACGVCRTDLHVVDGELPNIRYPIIPGHEIVGRVAAVGAGVTTHQIGDRVGIPWLGHTCGLCRYCRGGMENLCDAPLFTGYTRDGGFASHAIADARYAFPLGEAGDDVAIAPLLCAGLIGWRSLAIAGDAERLGIYGFGAAGHIVAQVARWQGRQVYAFTRGGDVAAQDFARSLGAVWAGASEEQPPQPLDAAIIYAPVGSLVPAALKAVRKGGRVVCAGIHMSDIPSFPYDLLWEERQLVSVANLTRQDGVDFLEVAQQASIRTETHAFPLREANTVLNKLRAGELLGAAVLV

SEQ ID NO: 20428 - protein, 208 aa, Rhodopseudomonas palustris
RELMVERQIAARGVHDPRVLAAMRKVPREAFLPEPMRDLAYEDAPVPIAAEQTMSQPYIVALMVEALLLQGSDNVLEIGAGSGYAAAVLGEIAGHVTTVERIATLADAAAAKLAELGYGDVDVHRSDGTRGWPAAAPYDAIVVAAGGPQVPESLKAQLKIGGRLVMPVGADQQAQELVRLTRLGEADFKREHLGDVRFVPLLGAEGWQ

SEQ ID NO: 20429 - protein, 406 aa, Rhodopseudomonas palustris
KIVFLGASSASFGLSMFRDLFASPVLAGSTLTLVGRNPETLGRMTELAKLMNARSGAGLIIEQTTDRRAALDGAGFVINATAIDRNRLWKQDFEVPKKHGIRHTLGENGGPGGLFFTLRTLPLVFDFIRDIEELCPTALFLNYSNPESRIILALGRYTKVRHIGLCHGIFMGRDAVAYIMQMPREEIEVWGAGLNHFQCLTEIRHRDTGEDLYPRFRAAEQSFDPDAWRFTRRLYRAFGYWLTCSDDHLGEYLPYGWEAGEKGYDFDQDERWRGEFLTQLNGVLGGTMPIPQWWTEPSGERGAAVIAAMLHNQKRFIESGIVINRGVIPNLPAELAVEVPVTVDAAGVHPVSLGPLPDPIAKLMLMQASVQQLAVEAAVHASKELALQALLIDPVVNSAVAAEKIL

SEQ ID NO: 20430 - protein, 411 aa, Rhodopseudomonas palustris
PLRFARHAMAYVLAGGRGSRLMELTDWRAKPAVYFGGKSRIIDFALSNALNSGIRRIAVATQYKAHSLIRHLQRGWNFFRPERNESFDILPASQRVSEEMWYRGTADAVFQNIDIIESYDPKFIVLLAGDHVYKMDYEKMLQQHVEQGADVTVGCLEVPRAEATAFGVMHTDTTDRIISFLEKPADPPAMPGKADKSLVSMGIYVFETKFLLDELRRDAADPNSSHDFGKDIIPYIVKHGKAVAHHFDKSCRRSSSEAVSYWRDVGTVDAYWAANIDLTDIVPELDLYDREWPIWTYGEITPPAKFVHDKEGRRGEAVSSLVSGGCIISGASLRHSLLFTGVRVHSFSHVENTVVLPYADIGRSCRLKNVVIDAEVKLPAGLVVGEDPEFDAKRFRRTENGICLITRAMIE

SEQ ID NO: 20431 - protein, 476 aa, Rhodopseudomonas palustris
VLSVASELFPLIKTGGLADVAGALPAALRANDVAVTSLLPGYPAVLGGIEDPQQVHSFNELFGGTARLLAARCGDLDLFVLDAPHLYVRPGNPYVGPDGKDWPDNGLRFAALAQVGAALGQGLLPHYKPDVLHAHDWQTGLLPAYLKYSGRPGPKTVFTIHNLAFQGRFPYELLGRLGLPERAFGLDGIEYYGGIGYLKAGLQLADRITTVSPTYAAEIQGSEAGMGLDGLLRLRADRLSGILNGIDTDVWNPASDALISATYDVESIAARARNKKVLQARFGLKPEPGALLYGVISRLSWQKGLDLLLEALPQLIGGGAQLALLGSGDAELEQGYAAAARKYPGQVGAVIGYDEALAHQIQAGADALLVPSRFEPCGLTQLCALRYGAVPVVARVGGLADTVVDANEMATATGVATGVQFAPVTTDALIKAFGKTRALFADVVAWRNLQINGMTTDVSWKNPAQHYAKLYRDLVA

SEQ ID NO: 20432 - protein, 438 aa, Rhodopseudomonas palustris
TILKSLPKGENVGIAFSGGLDTSAALLWMKQKGAKVFAYTANLGQPDEADYDAIPRKAMEFGAEKARLVDCRTQLVHEGIAAIQAGAFHVSTGGIAYFNTTPLGRAVTGTMLVSAMKEDGVNIWGDGSTYKGNDIERFYRYGLLTNPALRIYKPWLDQQFIDELGGRAEMSAFMTSHGFAYKMSAEKAYSTDSNLLGATHEAKDLEHLDSGIKIVNPIMGVPFWRDDCAVKAEAVTVRFEEGQPVALNGQTFTDPVAMFYEANAIGGRHGLGMSDQIENRIIEAKSRGIYEAPGMALLHIAYERLVTGIHNEDTIEQYRINGMKLGRLLYQGRWFDSQALMLRETAQRWVARAVTGEVTLELRRGNDYSILNTVSPNLTYAPERLSMEKVEDAPFTPADRIGQLTMRNLDITDTRAKLGLYAKTGLLSSGEGTPIPQL

SEQ ID NO: 20433 - protein, 246 aa, Rhodopseudomonas palustris
LANRRILITGGGSGLGAAMAARFAELGASLVLCGRRAEVLQETAEQLRSHGSQVDTIVCDVRDPQAVEAMLDEIWRVAPLDVLVNNAAATFIAQTERLSARAADAILAPTLHGAMYCTLGAGRRWIDGEHAGVVLSILSTSTITGRAFTVPSAMAKSAVLAMTKSLAVEWGPKQIRLVAIAPGAFPTAGATAQLRPDGRSADPADRVPLGRVGRHDELANLASFLISDQAGYITGEMVVQDGGTHL

SEQ ID NO: 20434 - protein, 316 aa, Rhodopseudomonas palustris
VRIGTRKSVMALAQTEDIAKQLSAAASELDPQIIKFETVGDSDQISKLLPHGGKGGAFVAEIRAAMLRGELHCAMHSLKDMPANEETPGLIVAATLARDPACDSLVLRKGLTLEELKKSRGKGYTIGTNAVRRAAYAKRLFPEVEVIHFRGAADSRMRKLDNREKQRMPDGSEVGPADALIMARAGIERVGFVDRIAHDFTPEEMLPAAGQGIVAVECPVHEWKTRQYLALIDNHQSRLCCDAEREVLWVLNGHCNSPIAAHSVITGDEMTLRASVLDLEGGMFIEAARTGPANRPRELGRTVGLELLDKGAAAVI

SEQ ID NO: 20435 - protein, 340 aa, Rhodopseudomonas palustris
  unsure (1)..(340): unsure at all Xaa locations
VFPFSAIVGQEEMKLALLIAAVDQKVGGVLAFGDRGAGKSTAVRALAALLPKMKTVVGCRYNCDPDQPDRYCEECKEKVKHGKVKTAQVPVPVVDLPLGATEDRVVGALDLERALAKGEKAFEPGLLARAHRGFLYIDEANLLEDHLVDLLLDVAASGENVVEREGLSIRHPARFVLVGTGNPEEGELRPQLLDRFGMSVEVKTPDTLPERIEVVRRRDAFENDPAAFVADWSKEEAKLRRKISQAKERLPEVTVSDAALERAAKLCMTLGTDGLRGELTLMRAARALAALEHDKTVTDEHLKRIAPSALRHRLRRNPLDDAGSSVRVDRALAEIFGXAS

SEQ ID NO: 20436 - protein, 518 aa, Rhodopseudomonas palustris
DAVTAAQLFAVDPVGTGGVLLRSRAGPVRDRWLAMMRAALPPEQPYKHLPLHIADGRLLGGLDLSATLLAGRPVAERGLLSEADGGVMVVAMAERLQSSTNVYLTAAMDAHETAVERDGLSLRMPARFGVVALDEGLEDEFSPAGLRDRLGFHLDLDQFAWRETDDFPISLDDIRAARARLADIKVESEQIEAVCTAAAALGIISLRAPLLAIRAAKASAALFDRTKIEQDDITLAARLVLAPRATIFPQQEQPDQADEPPPPEPPPPEDDNQDNNDQEQQTPDIDKALDEVILAAVKAAMPPGVLEAMRASAGRARARSAGKAGELQKSKKRGRPAGSIRGELRDGSKLNVIETLRAAAPWQPLRRRQAEGRNGSAPRILVEKDDFRIARFKQRTETITIFVVDASGSAALHRLAEAKGAVELLLADCYVRRDQVAMISFRGTIAEILLPPTRSLARAKRSLAGLPGGGGTPLSAGLDCAFMLADSIKRKGQTPTVIVLTDGRANIARDGAPGRPQA

SEQ ID NO: 20437 - protein, 340 aa, Rhodopseudomonas palustris
LVTKPFMEVLSGNRQASPPMWMMRQAGRYLPEYRATRAQAGSFLDLCFNAELAAEVTLQPIRRFGFDAAIIFSDILVVPYALGRSVRFEVGEGPRLDPLNSPDLVGTLNNAIDLSKLEPVFEALRIVRRELKPETTLIGFCGSPFTVATYMVAGQGTSDQHPARLMAYQHPGAFAKIIDVLVESSIQYLLKQLDAGADVLQIFDTWAGILPPREFEKWCIEPTRRIVEGIRKVKPGTKIIGFPRGAGALLPAFVERTGVDAVSIDWTAEPAFVREKVQTKVAIQGNLDPLLLIAGGSALDQGVDDVLNNFSSGRHIFNLGHGITPDAPIAHVEQMIKRVR

SEQ ID NO: 20438 - protein, 498 aa, Rhodopseudomonas palustris
PAPRPSRDRAPHAVVIGSGFGGLAAAVRLGAKGYRVTVLEKLDKAGGRAYVHKQDGFSFDAGPTIVTAPYLFEELWKLCGKRMSDDITLKPMSPFYRIRFDDGTHFDYSDDRDAVLDQIAKFCPDDVPAYDRFMAASHEIFKVGFEQLGDQPFSHFTDMLKIAPAMIKLESYRSVYGLVAKHFKDPKLRQVFSFHPLLIGGNPFMSSSVYCLITYLEKQWGVHSAMGGTGALVTGLVNLIEGQGNTIRYNQDVRQIVVENGTACGVKLADGEVIKADIVVSNADSASTYRYLLPPETRKRWTDAKIEKSRYSMSLFVWYFGTKRRYEDVKHHTILLGPRYKELISDIFSRKVVAEDFSLYLHRPTATDPSLAPQGCDTFYVLSPVPNLLGDTDWHTKAETYRASIAKMLGATVLPDLENQIATSKITTPIDFQDRLSSFRGAAFGLEPVLWQSAWFRPHNQSEDVKRLYLVGAGTHPGAGLPGVLSSARVLDALVPEA

SEQ ID NO: 20439 - protein, 275 aa, Rhodopseudomonas palustris
WFEGLRDRICAEIETLEREAPAELFPGEPATFTYKPWQRKTGAGGGVGGFLSNGRLFEKIGIHTSSANGKLTPEMAKNVPGDGSLDYVSTSISLIMHPRSPRVPTVHMNTRFLSTSQGWFGGGADLTPMLPEQRSQDAEDAVIFHTAMKHACDAHDPAYYDKFKPWADTYFFLPHRGVARGVGGIFFDYLNSGDFDRDFAFTRAVGSALLDVYPKIVRKRMIEPWTDAERAQQLACRGLYVEFNLLYDRGTMFGLQTGGNTETIMSSMPPLVSWS

SEQ ID NO: 20440 - protein, 496 aa, Rhodopseudomonas palustris
NRVVVIGAGVAGLTSALTLAARGFDVTVLERAAAPGGKMREVAIGPARIDSGPTVFTMRWVFEELFAGIGLNFSDHVRLRPLSVLARHAWDDTQHLDLFADEARSADAIGAFAGAAEAKRYRQFCADSRRIYEILEKPFLRATAPSLPKLATAGGLSGLLELRKIRPFTTMWKALGDYFHDPRMRQLFGRYATYCGSSPFDAPATLMLVAHVEHEGVWIIEGGMHALAQALADCATSFGATIRYEQSVREVMVSGGRAAGVVLESGERIEAHSVIVNADVGALPAGLFGEAVRSAAAPLAPRLRSLSAMTWSMVAKTEGFPLSRHSVFFSRDYPREFTEIFGRGEVPSEPTVYVCAQDRIDDEARLAAGGEEELLVLINAPPVGDRKSFDQAEVARAAERAFGVLQRCGLRIDADPGKTQVTTPADFNRLFPATGGALYGRASHGWSASFERPGAGTKIAGLYLAGGSTHPGPGVPMAALSGRAAAATLFADLGFT

SEQ ID NO: 20441 - protein, 281 aa, Rhodopseudomonas palustris
MDVTNRIERALTEALNQADMAGCPPRLAAAMRSAVFPRGARVRPRLCHSVALACGEDNPGITEAAGAALELMHCASLIHDDLPCFDGADLRRGRPSVHKAFGEPLAVLAGDAMIVLAFQTIARAEGQADRLLKLTQIIGGAVGVPFGIVAGQAWECETEINLAHYHRSKTGALFVAATAMGAASAGSDPEPWRMVGEKIGEAYQVADDLRDAAADVEEIGKPVGQDVAHDRPSAVREMGIDGAIYHLKSLVRGAVEAMPECTNGNELRSLIMSEATRLVPA

SEQ ID NO: 20442 - protein, 481 aa, Rhodopseudomonas palustris
MLVLDHDRAGGYWGAVYAFTAVKGLQVIIDGPVGCENLPVTSVLHYTDALPPHELPIVVTGLGEEELGKLGTEGAMHRAHKALDPYLPAVVVTGSIAEMIGGGVTPEGTGIKRFLPRTIDEDQWQSADRAISWLWKEYGPKKIPERKRKDGEKPRVNIIGPIYGTFNMPSDLAEIRRLIEGIGAEVNMVFPLGTHLADIPKLVNADVNVCMYREFGRLLCESLERPYLQAPIGLHSTTRFLRKLGELTGLDPEPFIEREKNTTIKPLWDLWRSVTQDFFGTASFAVVATDTYARGVRHFLEDEMGLPCTFAVSRCVGKKTDNEAVRAAIRQTPPLIMFGSYNERMYLAETGGRAVYIPASFPGAVIRRHTGTPFMGYSGATYLVQEVCNALFDALFNILPLGSDLDRVDPTPARRHEELLWSDEAKALLDEVLEQHPVLVRISAAKRLRDAAENSARRAGQEKVTTEFVSKARAALLDGQS

SEQ ID NO: 20443 - protein, 283 aa, Rhodopseudomonas palustris
PAPSAVLEVLHPITWFPPMWAFGCGVVSSGVPISSRWVEVIAGIVLCGPLLVATSQVVNDWFDRDVDAINEPNRPIPSGRIPGRWGLYLSFLWTAASLLVASQLGAWVFGAAVLGLVLAWMYSMPPFRLKQNGWLGNGACAITYEGFAWFTGAAVMLGGLPPWWIVTLALLYSAGAHGIMTLNDFKSIEGDIKTGVGSLPVKLGVDNAARVLCAVMAIPQVIVVALLLSWDRPIQAGIVGFVLAVQLALMVRFLRSPVERATWFSGLGVALYVSGMMASAVAV

SEQ ID NO: 20444 - protein, 393 aa, Rhodopseudomonas palustris
YDVVVVGGGPAGATAACDLARAGKRVVLLDRAGRIKPCGGAIPPRAIRDFAIPDSMLVAKINAARMVSPSNVEVDMPIDGGFVGMVDREHFDEWLRQRAATVGAERRTGLFKRFSRDESGVNTVHYEGRGPDGSMIDQTVRCRAIIGADGAVSGVARQFLKDADRVPFVFAYHEIIKAPTAEQKAAYESRRCDVYYQGHVSPDFYGWVFPHGNTVSVGTGSMHKGFSLRDSVAELRKQTGLDEVETIRKEGAPIPLHPLPRWDDGHSVLLAGDAAGVVAPASGEGIYYALLGGRLAAEAVEEFLQTADAKALKLARKRFMRGNGSVFRILGLMQWYWYANDKRREQFVSICRDRDVQKLTWDAYMNKKLVRAKPIAHVRIFFKNLAHMTGLAS

SEQ ID NO: 20445 - protein, 416 aa, Rhodopseudomonas palustris
TADQLVSREIRTESGQREVFCGLTGIVWLHRKIQDAFFLVVGSRTCAHLVQSAAGVMIFAEPRFGTAIMEEKDLAGLTDANDELDRVVTQLLARRPDIKLLFLVGSCPSEVIKLDLSRAALRLSQRFSPGVRILNYSGSGIETTFTQGEDACLASLVPELPAQTDTKPSLLVVGSLADVVEDQFARMFEALGVGNVAFFPPRKSTALPSVGPNTKILMAQPFLPDTVRALEERGAKRLAAPFPLGVEGTTGWLRAAADAFGVDPAKFEQVTAPNRARAERALSAFKSELGGRRIFFFPDSQLEIPLARFLSRELDMQLVEVATPYLHREHLAEELKLLPIEVALTEGQDVDDQLDRCRIARPDIVVCGLGLANPLEAEGITTKWSIELVFTPIQGYEQAADLAELFARPLVRRAKL

SEQ ID NO: 20446 - protein, 531 aa, Rhodopseudomonas palustris
MQLTVWTYEGPPHVGAMRVATGMEKLHYVLHAPQGDTYADLLFTMIERRNKRPPVTYTTFAARDLGKDTAELFMSAARNAYARFKPQAMIVGASCTGSLIQDDPGGLAKSLGFSIPVIPIDLPAYQRKENWGASETFYQLVRAIAGPKAPAPGTKRPERAAGQRAKCNLLGPTALGFRHRDDITEITRLLGQLGIDVNVVAPMGATPADLTRLGEADFNVVLYPEVASQAASWLQRIFHQPFTKTIPIGVSATREFVREVAGLAGVDPEPVLAAASTRLPWYSHSVDSTYLTNKRVFIFGDATHAIASARIASEELGFKVVGLGTYSREFGRDVREAAAKYGVEALITDDYLEVEAKVAELHPELVLGTQMERHIAKRLGVPCAVISAPVHVQDFPARYAPQMGFEGANVIFDTWVHPLMMGLEEHLLAMFKDDFEFKDGALPSHLGTGHAPASAPAAAEVAVALPQSAPVLDGAASNPAPVATAPTGAVWAPEAEKELLKIPFFVRGKARRNTERFANENGVATITVETL

SEQ ID NO: 20447 - protein, 1245 aa, Rhodopseudomonas palustris
TMPKRTSPADKTPVRVVIVTLDSHLSGAAARARNVLRKDYPGIELTVHSADEWGSDGHALQRCLADIATGDIIIATMLFMDDHVRAVMPALQARRTECDAMVCCMSASEVVKLTHIGKFDMSAEALGMINWLKKLRGKKHEGSAGKGEMKMLRQLPKLLRFVPGTAQDMRAYFLTLQYWLAGCEQNIANMVRLLIDRYASGPRKGLRGVAKVEPPLEYPDIGVYHPKMKGRIAESVDKLPTGPSEAKGTVGVLLLRSYLLAGNAGHYDGMLETFEAKGLRVIPVFASGLDQRPAIEQFFIKNGRPTVDAVVSLTGFSLVGGPAYNDSKAAEDILAALDVPYLSAHPVEFQTLEQWATSDRGLMPVESTIMVAIPELDGCSNPMVYGGRSDGGDVACPGCEKFCKFERNESGGDMHVCSERAEMLASRTAKLVALRRSERKDRKVAAVLFNFPPNAGNTGTAAFLGVFESLFNTLKAMKAEGYTVEVPESVDALREAIINGNAARFGANANVHARVMAGDHVKNERYLREIEAQWGPAPGKQQSDGSSIFILGERFGNVFVGVQPAFGYEGDPMRLLFEKGFAPTHAFSAFYRWIKQDFGAHAVLHFGTHGALEFMPGKQTGLSGTCWPDRMIGDLPNMYLYASNNPSEGAIAKRRSAATLVSYLTPPVAHAGLYRGLLELKSSLERWRGLTPEEETERANLATLVQAQAAGLDLAPAEPAWTAEEAGATIAKLADSVLEMEYALIPHGLHVVGNVPSEEERVETLEAVADAMHGKRPDKSLLEALVRGGHPEHLSGNGPEAQANLDMLKELAGIDKLLAEDHELAAILRALDGKFIRPAPGGDLLRTPAVLPTGRNLHGFDPFRIPSAYALQDGAKQAQRLIDKHIAEGNPLPETVAIVLWGTDNLKNEGAPIGQALALMGARPRFDGYGRLAGADLIPLEELGRPRIDVIITMSGIFRDLLPLQIKLLAEAAFMAASAEEPAEQNFIRKHSLAYQAEHKCDMETASLRVFGNADGAYGSNVNHLVENSRWEDEDELAETYTKRKSFAYGLKGQPVQHAELLKSALADVDLAYQNLDSVELGVTTVDHYFDTLGGISRAVRKAKGGQAAPVYIGDQTRGAGTVRTLSEQVALETRTRMLNPKWYEGMLKHGYEGVRQIEEHVTNTMGWSATTGEVAPWVYKQLTETFVLDPEMRARLAALNPVASAKVANRLIEAHERNYWSPDPEMLETLRKAGEELEDRLEGV

SEQ ID NO: 20448 - protein, 403 aa, Rhodopseudomonas palustris
MNYEAYFKRQIEGLHREGRYRVFADLERHAGSFPRATHHRPEGTNEVTVWCSNDYLGMGQHPAVLSAMHEALDSCGAGAGGTRNIAGTNHYHVLLEQELAALHGKEAGLLFASGYVSNWATLSTLASRMPGCVILSDELNHASMIEGIRHSRSETRIFAHNDPRDLERKLADLDPHAPKLVAFESVYSMDGDIAPIAEICDVADAANAMTYLDEVHGVGLYGPNGGGIADREGLSHRLTVIEGTLAKAFGIVGGYITGSAALCDFVRSFASGFIFSTSLPPAVAAGALASVRHIRSSSAERERHQDRVARLRMRLDQVGVAHMPNPSHIVPVMVGDAVLCKQISDELINRYGIYVQPINYPTVPRGTERLRITPSPQHTDADIEHLVQALSEIWARVGLAKAA

SEQ ID NO: 20449 - protein, 547 aa, Rhodopseudomonas palustris
MAASMRDITDLVQAEREVHDLNAALERQVAERTCQLEKTLTLQTAILERAAYAVIATDVTGTITLFNPAAERMLGYKAEDLIGRASAMLFHDSDELAARAEAMRKEGISVSSNLGVLQARLARNDPDTAMWTYIDAMGNRIPTRLTLSRLRTKTGVNLGVLGIAVDLTEQLKYEDELKAARASAEQASAAKADFLANMSHEIRTPLNGIIGYADLVLEDETLAPDTRRQVMRIFEASDSLRVIIDDILDFSKIEACGLTLESKPLYINELIANCASIIEPKADEKGLKLIATAQATPPVLIGDAGRLRQVLLNLMNNAVKFTTAGSVELIVSCIGRVDHLVRLRISVADTGIGISPEAQKGLFKRFSQADETISRKFGGTGLGLAISQRIVQAMHGELKIDSQPGVGSTFYFEVELPVAERLDIERLDAQVHCSRSVKILVVDDVEMNRDLCKTMLTRAGHDVDLADSGATAIAMVASRTYDLVFMDVQMGEMDGLEATRRIRALGHAYRDVPIIALTANVLPEQVERYKAAGVDGHLGKPINRAEL

SEQ ID NO: 20450 - protein, 537 aa, Rhodopseudomonas palustris
FQQARAFLLQHRTDYDKAVAGFRWPDPAPFNWALDWFDAELAVHPDSRDRAALWIVDGASGSEVKPTFAQLSKRSNQVANYLRAKGLKRGDHLLLLLGNVVPLWETMLAAIKLGLVTIPATTLLTPEELRDRLDRGRAKAVVAAPDQVAKFAGLGGDDLLRIVVGDAQDGWLAYAETAQQPDAFTPDGPTKADDPMLLYFTSGTTAKPKLVRHSQRSYPVGALSTMFWLGLQPGDVHLNISSPGWAKHAWSCFFAPWNAGATVFVVNQPRFDAKSLLATIGRCGVTTLCAPPTVWRMFIQEKLADYHVSLREVCGAGEPLNPEVIDQVKAAWGLTIRDGYGQTETTAMVGNSPGQKVKIGSMGRPLPGYVVKITDADGHPAKEGEITLALGDARPAGLMQGYQGEGGKLTGADGEVYRSGDVAFADEDGYLTFVGRTDDVFKSSDYRISPFELESVLLEHDLVAEAAVVPSPDPIKLAIPKAYVLLTANAERSRDTALSIFKHMQGRLAPFKRIRKLEIVSELPKTISGKIRRVQLR

SEQ ID NO: 20451 - protein, 387 aa, Rhodopseudomonas palustris
QDGHALTAIDQFSLNEDQRAIRDMARDFAAEKIAPHALQWDEDKHLPLDVIREAAALGIGGIYIRDDVGGSAMTRFDAALIFEALATGCPSVSAFISIHNMAAWMIDSYGSDAQRQRWLPKLCSMEQVASYCLTEPGSGSDAAALRTRAVRDGDHYILNGQKQFISGAGANDLYVVMVRTGSDGPGGISTLVVEKDTPGLSFGANERKMGWNAQPTRTVIFENARVPVANRLGDEGIGFKIAMAGLDGGRLNIGACSLGGAQAALDKTLAYMKERKAFGKRLDEFQALQFRLADMATELEAARTLLWRAAAALDRKDADATKLCAMAKRFATDAGFGVANEALQLHGGYGYLAEYGIEKLVRDLRVHQILEGTNEIMRLIVSRKLLE

SEQ ID NO: 20452 - protein, 494 aa, Rhodopseudomonas palustris
VGHFIGGKEVEGKSGRFADVFEPMTGEVKAKVALATKAELRAAVENAKAAQPEWGATNPQRRARVLMKFLELVQRDYDKLAELLAREHGKTIPDAKGDIQRGLEVAEFACGIPHLMKGEYTEGAGPGIDIYSMRQPLGVVAGITPFNFPAMIPMWKFAPAIACGNAFILKPSERDPGVPMALAALMLEAGLPPGILNVVNGDKEAVDAILDDPDIKAVGFVGSSPIAQYIYERAAQTGKRAQCFGGAKNHAIIMPDADIDQTVDALIGAGYGSAGERCMAISVAVPVGKATADALMSKLIPRVEALKIGPSTDPTADYGPLVTKEALERVKNYVDIGVKEGATLAVDGRGFKMQGYENGFYMGGCLFDNVTKDMRIYKEEIFGPVLSVVRAHDYAEALSLPSDHDYGNGVAIFTRDGDAARDFAAKVNVGMVGINVPIPVPIAYYTFGGWKKSGFGDLNQHGPDSIRFYTKTKTVTSRWPSGVKEGAEFSIPLM

SEQ ID NO: 20453 - protein, 502 aa, Rhodopseudomonas palustris
WRNGLLRSARLRPGAPALLTGTTVDADYATFASRAASFGAALARDYGIAPGDRVALFAHNCTRYLEALYGIWWAGAVAIPINAKLHGKEVAWICSNAEARLALICDDTADTFNEASYDLPPGLAVLAIDSDGFDRARSGAGSKAPVARDDDDLAWLFYTSGTTGRPKGVMLSHGNLVAMSLSYLADVDAVTPEDAALYAAPISHGAGLYNMIHVRFGARHVVPESGGFDPDEVLSLGKQLGNVAMFAAPTMIKRLVEAAKRRGETGEGLRTIVYGGGPMYLADIREALSVMGQRFVQIYGQGESPMTITSLKRALHADVDHPRYLQRLASVGTAQSVVSVRITGANGEVLPPGETGEIEVKGSTVMLGYWNNPQANAETLKDGWLRTGDVGRLDDDGFLTLSDRSKDVIISGGTNIYPREVEEALLTHPAVREVSAIGVADPEWGENVVACVVLTDGAAADDATLDAHCLATIARFKRPKRYVYLDALPKNNYGKVLKTELR

SEQ ID NO: 20454 - protein, 383 aa, Rhodopseudomonas palustris
ASIVGWAHMPFGKFDAETVESMIVRVATEAIADAGIAASDVDEIVLGHFNAGFSPQDFTAALVLQADPALRFKPATRVENACATGSAAVHQGIRAIEAGAAKIVLVVGVEQMTRTPGPEIGKNLLRASYLPEDGDTPAGFAGVFGIIAQKYFQKYGDQSDALAMIAAKNHHNGVANPYAQMRKDFGFEFCRAEGEKNPFVAGPLKRTDCSLVSDGAAALVLTSAENAKAMGKAVNIRARAHAQDFLPMSKRDILQFEGCTVAWQRALEQAGVTLNDLSFVETHDCFTIAELIEYEAMGLTPKGQGARAIKEGWTQKDGKLPINPSGGLKAKGHPIGATGVSMHVLSAMQLLGQAPEGMQIKDAKLAGIFNMGGAAVANYVSVL

SEQ ID NO: 20455 - protein, 354 aa, Rhodopseudomonas palustris
MASVQIHDVRKSFGGFEVLHGVTVPIEDGEFVVLVGPSGCGKSTLLRMLAGLEKITAGTISIGERVVNDVQPKERDIAMVFQNYALYPHMTVAQNMGFSLKLRGADQKAIDSKVQRAADILDLGKLLDRYPRQLSGGQRQRVAMGRAIVRDPQVFLFDEPLSNLDAKLRVAMRTEIKELHQRLKTTTVYVTHDQIEAMTMADKIVVMQDGIVEQIGAPLDLYDRPDNKFVAGFIGSPAMNFLDGTLKVNGGQPYVETASGAKLPIAAAPANGNGRAVSYGIRPEHLDFADSGIPAEVAVVEPTGSETQIVARVGNQEVIAVFRERHPVGPGDLIHLQPRADVAHLFDKESGRRI

SEQ ID NO: 20456 - protein, 241 aa, Rhodopseudomonas palustris
RLTGKRAFVTAAAAGIGRASAIAFAREGAEVFATDIDEAGLASLAEHGIARTAKLDVRDTAAVEAIAREAGTVDILLNAAGFVHHGTVLDCSDTDWDFSFDLNVKSMHRTIRAFLPAMLEAGRGSIVNISSAAGVFKAAPNRYVYGATKAAVAALTRAVAVDFITRGIRCNAICPGTIETPSMLGRAAALGPQGREMFVSRQPMGRLGNAEEIAALAVYLASDESAFTTGVAHIIDGGWTL

SEQ ID NO: 20457 - protein, 240 aa, Rhodopseudomonas palustris
LNHRCAVVTGGAQGIGRAIAERFVASGAKVALWDHDVALAERTAKEIGDDATIAVAVDVTDPAAVDRARDATLQAFGKIDILVNNAGIAGVNKTVWETDYAEWQRVLKLNLDGPFLCCKSVVPSMIAHKYGRIVNIASIAGKEGNPNAAHYSASKAGVIALTKSLGKELAAYDIAVNAVTPAAARTAIFDQMTQQHIDFMLSKIPKGRFVLVEEVAALVAWLASEDCAFSTGAVFDISGG

SEQ ID NO: 20458 - protein, 269 aa, Rhodopseudomonas palustris
GYIPDLPTPFNEAGDIDLVSLARLIARAISSGASAVVICGTAGEASTLTPAEQTAVISEAVGIAGRRIRVIAGAGSNATSQAIELAARAQSAGADAVLSVVPYYNKPTQDGIRAHFDAIGRAIELPVLLHDVPSRTARPLADDTIVRLARSGRFTGLVDGSGDVLRPLRLRPRLPAGFQMLSGDDTTSFGFLASGGDGAVSEVANIASDLCRTIHTYCRQGRLQSARYLQKRLLPLASSLDQDSPASLKYALNLLGLIRPDTRLPIVPL

SEQ ID NO: 20459 - protein, 741 aa, Rhodopseudomonas palustris
PDLSTCDDEPIHIPGAIQPHGLLLALAADMTIVAGSDNLPELTGLAIGALIGRSAADVFDSETHNRLTIALAEPGAAVGAPIAVGFTMRKDAGFVGSWHRHDQLVFLELEPPQRDVAEPQAFFRRTNSAIRRLQAAETLESACAAAAQEVREITGFDRVMIYRFASDFSGEVIAEDRCAEVESYLGLHFPASDIPAQARRLYTINPVRIIPDINYRPVPVTPDLNPVTGRPIDLSFAILRSVSPVHLEYMRNIGMHGTMSISILRGERLWGLIACHHRKPNYVDLDGRQACELVAQVLAWQIGVMEEQAITRQTLKGQAIQRSLINDIEQLHDHRAGLARNSEALLELMGASGLCLHSREGVITIGQTPPGPIIDQLAQLAGRSGGSELFQTDRLSTIIPEAGAFAEVASGVLAVPLSRTPPRRVMLWFRPEVAQTVYWAGNPDKSVTAESGRLRPRTSFAAWTEQTHGRAIAWQPHEVAAAVEIRDLIIDVILRNTEKLERINTQLARSNEELESFAHVASHDIKEPLRHIEAFAGLLADNIREMGDERLGVMVSGIEKSSRRLRNLINDLAEFSQLGRRSKPLSWVSLETVLNEVLADLQPRITEARAEIQADRLPFARCDHNQIRQVLQNLIANSLKYRDPARPCRIRIFAQPDDNGGRAEIGSAPAIRICVTDNGIGFDKKYIDQVFEPFQRLHGPDDYEGSGIGLAICRKIVQRHGGRVGVDTVPGQGSTFWFTLP

SEQ ID NO: 20460 - protein, 557 aa, Rhodopseudomonas palustris
  unsure (1)..(557): unsure at all Xaa locations
RKHGLTYADSGVDIDAGNRLVDLIKPMVRATARAGADSEIGGFGGLFDLKAAGFKDPVLVAATDGVGTKIKVAIDAGLHTGIGIDLVAMSVNDLVVQGAEPLFFLDYFACGKLDPEAAAEIVAGVAEACRESGCALIGGETAEMPGLYKDGDYDLAGFSVGAAERGTLLPSKDIAEGDAVIGLASSGVHSNGFSLVRKIVEKSGLPYDAPAPFSPVMTLGGALLAPTKLYVKSCLQAIRDTGAVKGLAHITGGGFTENIPRVLPKHLGVGIDLPRIPVLPVFKWLAEQGEIAELELLRTFNCGIGMVIIVKADAVDQVTESLTASGESVHLLGQVIAAKGEQRVVYDGHLDLAWXARPMKPRVAILISGRGSNMAALIEAAAEDGFPAEIAVVISNVATAGGLAIAERSGIATVVIESKPFGKDRAGFEAKLQAELDARGIELICLGGFMRLFTAEFAQHWYGRMLNIHPSLLPSFPGLDPHGQALRAGVKISGATVHFVTPDTDAGPIIMQGAVPVQDDDTPDTLAARVLAVEHRIYPEALRLLAAGLLRFDGDLC

SEQ ID NO: 20461 - protein, 140 aa, Rhodopseudomonas palustris
MAIERTFSILKPDATERNITGAINALIEKAGLRIVAQKRIRMTRDQAETFYAVHKERPFFGELVDFMISGPVVVQVLEGEGAIAKYRDVMGATDPSKAADGTIRKLHAKSIGENSVHGSDAAETAKIEIAQFFSGNEIVG

SEQ ID NO: 20462 - protein, 347 aa, Rhodopseudomonas palustris
MRRQSLVKFDAPLCETIIDAPKPQGREVLVKIERCGLCHSDLHIQDGYADLGGGKKLDTTRGMTLPFTLGHEIAGVVAEVGPDAPQDLIGTKKAVFPWIGCGKCRDCLAGDENLCAKNRFLGVSIDGGFATHVLVPDAKYLLDYDPLPTNVAATLMCSGITAYGALKRLVDRPRQRNLLLIGLGGVGMMGLSLAQAMFKQPIAVADLSPAAREAALKNGAAVAYDPSEPDVAKRIFKETDGGFDGVVDFAGNDKSMNFAVSTVARGGKIVVSGLMGGQFSLPMVQWIYKRMTVEGFMVGTLEETKELLALARAGKVKPTPMKEEPMQDAQKWIDQLRAGKVVGRIML

SEQ ID NO: 20463 - protein, 418 aa, Rhodopseudomonas palustris
RRVVVTGLGMVSPLGCGVEPTWSRVLAGESGARKIDTFDVSDLASQIACVIPRGDGTNGTFNPDQWMEPKDQRKVDDFIVYAMAAARQALDDAGWHPSTEEERCASGVLIGSGIGGLQGIAETALLLEQRGPRRISPFFIPGRLINLASGYVSIEFGLKGPNHSVVTACSTGAHAIGDASRLIALGDADVMVAGGTESPISRLAMAGFAAARALSTGFNDAPTKASRPYDKDRDGFVMGEGAGVVVLEEYEHAKARGARIYAEVIGYGLSGDAYHITAPSSDGDGAFRCMSAAIKRGGIAVSDIDYINAHGTSTPLGDEIELGAAQRLLGNAASRVSMSSTKSSIGHLLGAAGAVEAIFCVLAIRDNVAPPTINLDSPSVETAIDLVPWKPRAREINVALSNSFGFGGTNASLVLQRV

SEQ ID NO: 20464 - protein, 77 aa, Rhodopseudomonas palustris
MSEIGERVKKIVVEHLGVEPEKVVDSASFIDDLGADSLDTVELVMAFEEEFGCEIPDDAAETILTVGDATKFLEKNA

SEQ ID NO: 20465 - protein, 245 aa, Rhodopseudomonas palustris
MFDLTGRTALVTGATGGIGGAIAQALHGQGATVAISGTRREALDALAAKLGERVHVLPCNLSDAADVEALVPAAAEAMGGLDILVCNAGITRDNLFVQLRDEDWDEVIKVNLTATFRLTRAATKLMMRKKFGRIIAITSVVGVTGNPGQGNYTASKAGLIGMIKTIGAEYAKRNVTANCIAPGFIATPMTDVLNDKQREAILGKVPAGRLGTPDDIAAAAVYLSSNEAAYVTGQTIHVNGGMAMI

SEQ ID NO: 20466 - protein, 306 aa, Rhodopseudomonas palustris
AFTFPGQGSQAVGMGKALAEAFPAARAVFDEVDAALGEKLTSIIWEGPAETLQLTENAQPALMAVSLATMRVLETEAGVSVGKDAAFVAGHSLGEYSALAAAGSLSVSDTARLLRIRGQAMQKAVPVGVGAMAALLGLDYDTAVAVAAEAAQGQVCQAANDNGGGQVVVSGHKDAVERAVEIAKGKGAKRAMLLPVSAPFHCSLMQPAAEAMAEALAGVTIKAPAAPLVANVLASPITDPHEIRRRLVEQVTGTVRWRESVAFMASQGVNQFLEIGAGKVLSGLVKRIADGAIGISVGGPNDIVSA

SEQ ID NO: 20467 - protein, 243 aa, Rhodopseudomonas palustris
RHAIVTGASRGIGRAIALGLAQRGYDLALTDIAAQESVLRETVEEVKQLGRKCIPILADVSKIEDCQRSVTEAVAGLGHVDVLVNNAGILRLAMIDETTPEHWDQTFAVNVRGVFQMTQAVVVHMKERRYGRIVNIASLAARTGGPGQSHYAASKSAVVGFTRVSSMEFGGHGITVNAVCPGIIQTEMGRNNLRDPERVTYFEKITDLHRLGEPEDVVGPVAFFASDDSAFVTGQALNVDGGI

SEQ ID NO: 20468 - protein, 290 aa, Rhodopseudomonas palustris
DVSVCGTYILDILGVPVTEIPAGGGRALIDEIRLTVAGTAGGTVVPCARLGLKALAVGAVGTDEKADWVLDAMVREGIDISVMEKIAGAPTSATILPIRPDGSRPVLHARGASARWKISPEAQKVACGSKVLHLGGVGSLLAMDGEPTVSLLRDAKAAGCITTVDLIQARGETLPLLEPLMPYTDFFMPSIDETHALIGSGDPATCARYFIGKGAGACAISLGEHGSFVMTRDGRQLTVPAFDITVRDTSGCGDSYTGGFIAGLVRDWDLQDCARLATATAAIVATGLGS

SEQ ID NO: 20469 - protein, 776 aa, Rhodopseudomonas palustris
AAAACVLSRPATIPRRRRVSEIKRIPHCSHWGAYTLLVQDGSIVGVEPFAHDPAPSPIIHSVPEWANPKRQVPSPLVRAGWLEKREHSDRRKRGAEKFVPVSWDEATTLVADEIRRVSTTYGNASIFAGSYGWTNSGRLHHASSLLKRMLNLVGGFTRHVDTYSIAAGPVILRHTLGSSDACDGRANTLDTIAEHTETLVVFGALSPRTAQTEAGGIGVHRVESYLRKIADRGIRIVHVSPLKDDLPEWVDAEWWPIRPNTDAALMLGLAGEIVLAGRHARDFLDRCTSGADQLIAYLDGSADGIRKDATWAAEICGLDAESIRQLARRLVDTRSMLTVSWSLQRAHHGEQPFWSALGLASIIGQIGLPGGGVGYGYASLGGVGSPFNIGKSPAISQLTRPIDSFIPVARISDMLLNPGGTFTYEGKTHTYPDTRLVYWAGGNPYHHHQDLNRLAEAWTRPETIIVQDPMFTATAQRADIVLPATTSIERNDLAGNRRSDFVIAMKQAIAPVGESLPDFEIFNRIAAKLGVADGFNEGRDEMGWVRQLYEEVRQDAVERLGFEMPDFDTFWERGYARCPVRAEHTFLADFRTDPAAHPLNTESGRIVLGSRTLAGLGYDDCPPHPAWLEPAEWLGRGDASDLHLISHQPIGRLHSQIETGVASVAAKRNGREQAKLNPRDAAARGIDDGQTIRVWNGRGACLATATVTDSVRPGVLVLPTGAWFTPRDENGLEVAGNPNVLTLDIGTSQFGQGCSAHTCLVRAEAHIADQRDAFDE

SEQ ID NO: 20470 - protein, 291 aa, Rhodopseudomonas palustris
AAHGGSNADGDVQKDLDVKAEQIIVKSLKDVPYAALASEESDTLLDGDPNAPISIAYDPLDGSSNIDTNMTVGTIFSIIPNQPGVKPFTAAGSCQIAAGFVVYGPQTSLVLTLGDGVNIFTLDRKAKVYRLIRERVKVPADTAEYAVNASNHRHWEQPIRDFVDECIAGADGPRAKDFNMRWIGSLVAEVYRILTRGGVFLYPGDNRPGYGNGRLRLLYETHPMSFVMEQAGGAASTGRERVLDLTAKTIHQRSPLIMGSIDKVKRIELLHTDPSAASRSAPLFARRGLFR

SEQ ID NO: 20471 - protein, 334 aa, Rhodopseudomonas palustris
MARITLRQLLDHAAEHGYGVPAFNINNMEQGLAIMEAAALVDAPVIIQASRGARSYANDIMLAKMIDALAEMYPDIPLCMHQDHGNDEATCATAIRYGFTSVMMDGSLKADAKTAADYQYNVDITRRVVDMAHWVGASVEGELGVLGSLEHGGGEQEDGHGVEGKVSREQLLTDPDQAVEFVRATKVDALAIAMGTSHGAYKFSRKPDGDVLAMKVVEEIHRRLPNTHLVMHGSSSVPQDLQDIFNEFGGAMPQTFGVPVEEIVRGIKHGVRKVNIDTDCRLAMTGVFRKVATQNKAEFDPRKFLKPAMDAMRDICKLRFEQFGTAGNASKIKV

SEQ ID NO: 20472 - protein, 519 aa, Rhodopseudomonas palustris
MTETAEKIRDHFELFREPQYEELMENKRKNFENYVGDAEVTRVADWTKTKEYQDKNFAREALVINPAKACQPLGAVFAAVGFEKTLPFVHGSQGCVAYYRSHFTRHFKEPTSCVSSSMTEDAAVFGGLNNMIDGLANAYALYKPKMIAVSTTCMAEVIGDDLNAFIKNAKEKGSVPQEFDVTYAHTPAFVGSHITGYDNTMKGIVEHFWDGKSGTVEKLERKPNESINFLGGFDGYTVGNIREIKRIFELMGVDYTIFGDNSDVWDTPADGEFRMYDGGTTLEQAANAVHAKATISMQEFCTEKTLATIADHGQEVVAFNHPVGIAGTDRFLQAVSRITGKAIPEALTKERGRLVDAIGDSSAHIHGKKFAIYGDPDLCYGLAEFILELGGEPVHILATNGNKAWEAKVQALLDSSPFGAGCKVYAGKDLWHLRSLLFTEPVDFMIGNTYGKYLERDTGTPLIRLGFPVFDRHHHHRSPVWGYQGSMNVLVKILDKIFDEMDKATNTAGKTDVSFDIIR

SEQ ID NO: 20473 - protein, 236 aa, Rhodopseudomonas palustris
VVTGGSRGIGLAIARRLAAAGYGVIAVARRESEELTAAIAEASQGPGTISFKAYDLGDIDGLAGFAKSLRQEFGKIYGLVNNAGIGTEGVLATMHNSQIETLLRINVTSPIVLTKYIVRHMMADGAGRVINMSSIIGSTGYNGLSVYGATKAAAIGFTRSLAREVGRLGITVNAIAPGFIDTELTAGLAGEGRQKIAGRSALRRLAEADDVARMVEFLLGDGGRNITGTVQTIDAG

SEQ ID NO: 20474 - protein, 529 aa, Rhodopseudomonas palustris
DGYARWALAQGIGKGVTVALLMPNRPDYLAIWLGITKVGGVVALLNTQLTGSSLAHCIDVAAPNHIIVAKELSGAYDSSTQHLATAPRLWLHGDDDAEVGLSDALAIANDDPLTAAERPAVTVDDTALLIYTSGTTGLPKAARVSHRRVMSWAGWFTGLIGATSDDRIYDCLPIYHSVGGVVATGSLLMAGGSVVIAEKFSARRFWDDIVRYDCTLFQYIGELCRYLVQAPSGSNETRHRLRLACGNGLRGDVWEAFQARFAIPRILEFYASTEGNFSLYNVEGEPGAIGRLPSFLAHRFPAALVKFDFETGLPVRDEQGRCIRCARGEAGEAIGRIGEAERGGGRFEGYTRDGESERKMLRDVFAPGDAWFRTGDLMLQDAKGFFRFVDRIGDTFRWKGENVAASEVADTLAACPGVIDASVYGVSVPNHDGRAGMAALVTEETFDLAALHRYLATRLPAYARPLFLRLRQALDLTGTFKQAKQTLIAEGFDPSVVGDPLYVADITTGGYVALDAPLFSRIARGAFRL

SEQ ID NO: 20475 - protein, 419 aa, Rhodopseudomonas palustris
TLAIHAGYEPDPTTHAVAVPIYQTASYAFDSADHGAALFNLETEGYRYSRIANPTTSVLEKRVAELEGGVGALAVASGQAALHFAFVNLADHGGNIVSVPQLYGTTHTLLSHILPRQGITGRFAASDKPDDIAKLIDEGTRAVFCETIGNPAGNVCDIEAIADVAHRAGVPLIVDNTVATPILFKPIAYGADVVVHSLTKFLGGHGTTLGGAIVDSGRFDWAKQPERFPAFNQPDHSYHGMVYAERFGPTAYVERARSIYQRTMGSVLSPFNAFLLLQGIETVALRMERHVENARKVAEFLRDDPRVAWVNYTGFPDSPYYPLVQKYLDGRASSLFTFGIKGGMEAGKAFYDSLKLITRLVNIGDAKSLACHPASTTHRQMSAEQQRQAGVLPETIRLSIGIEHIADIIEDLDQALAQA

SEQ ID NO: 20476 - protein, 251 aa, Rhodopseudomonas palustris
LQGKKGLVVGIANDQSIAFGCARAFRDAGAELAVTYLNDKAAPHVVPLAEQLGCPIVVPCDVREPGQLEAVFERISQQWGRLDFLLHSIAFAPKEDLHGRVVDCSQAGFAMAMDVSCHSFIRMAKLAEPLMPDGGCLLTVSFYGSEKVVEDYNLMGPVKAALESSVRYIAAELAPKKIRVHALSPGPLMTRAASGIARFDELLERTRARLPAHQLVSIEDVGAVAAFLVGDSARSLTGNIEYIDAGYHVIG

SEQ ID NO: 20477 - protein, 390 aa, Rhodopseudomonas palustris
  unsure (1)..(390): unsure at all Xaa locations
MDFALTDQQEAIRDAIAKICEGFDDAYWLKKDREGGFPHDFHKALADAGWLGICVPEAYGGSGLGITEAAIMMRAISESGAGMSGASAVHINVFGLNPVVVFGTEEQRQRMLPPMVEGRDKACFAVTEPNTGLNTTQLKTRAVRKGDRYVVNGQKVWISTAQVANKILLLARTTPLEEVRSPTHGLSLFYADFDRTRIKVHEIEKMGRKIVDSNELFFEDFEIPVEDRIGEEGKGFHYILEGMNPERILIAAEAVGLGKLALSRAADYAKTRIVFNRPIGQNQGIQHPLAKNWVELEAAWLMVMSAAWQYDQGMPCGAAANAAKYLAGEAGFSACEQAVMTHGGFGYAKEYHVERYLREVMIPRIAPVSPQLALSFIAEKVLGLAKSYXS

SEQ ID NO: 20478 - protein, 429 aa, Rhodopseudomonas palustris
MDRIKIIGGNELRGTIPISGAKNAALPLMIAALLTDETLILDNVPRLADVALLQRILGNHGVDIMAAGKRPGDHEYQGQTLHISAKTIVDTTAPYDLVSKMRASFWVIAPLVARMHEAKVSLPGGCAIGTRPVDLLIMALEKLGAEITIDGGYVIAKAPGGLKGATIAFPKVTVSGTHVAVMAAALAKGTTIIDNAACEPEIVDVADCLNKMGAKITGAGTPRITIEGVAKLHGARHTVLPDRIETGTYAMAVAMAGGEVQLSGARPELLQAALDVLTQAGATITVNNDGIKVARNGAGISPVTVTTAPFPGFPTDLQAQLMALMTRAKGASHITETIFENRFMHVQELARFGAKISLDGETATIDGVERLRGAPVMATDLRASVSLVIAALAAEGETMVNRIYHLDRGFERLEEKLSACGANIERISG

SEQ ID NO: 20479 - protein, 408 aa, Rhodopseudomonas palustris
LAMKREVAADIEAATRAIVDDVAHRGDAALLEATEKFDRLTLDAAGMRVGEAEVEAAVKACDSETVDALKLARDRIEFFHRRQLPKDDRFTDPLGVELGWRWSAIEAVGLYVPGGTAAYPSSVLMNAIPAKVAGVERVVMVVPSPGGTLNPLVLAAAQLAGATEIYRIGGAQAVAALAYGTATIAPVAKIVGPGNAYVAAAKRLVFGRVGIDMIAGPSEVVVVADKTANPDWIAADLLAQAEHDANAQSILITDSAVLAADVERALAAQLTTLPRVKIARASWDEFGAIIKVAKLEDAVPLANAIAAEHLEIMTADPEAFADKIRNAGAIFLGGHTPEAIGDYVGGSNHVLPTARSARFSSGLGVLDFMKRTSILKCGPEQLAVLGPAAMALGKAEGLDAHARSVGLR

SEQ ID NO: 20480 - protein, 214 aa, Rhodopseudomonas palustris
ALIFDVDGTLAETEELHRQAFNATFAAEQLPWHWDATLYRKLLDVTGGKERIAHFLKSEPDGAERAADRIPELHRAKTDRYTALVAAGTALRPGVARLIREAKAAGVKLGIATTTSLPNVEALLESSLGPDAMALFDAVGAGDVVPAKKPAPDIYLYVLDALKLPAADCVAFEDSTNGVRAARAAGLPTIVTPGLYTEGDDFPGALAVLSDLGE

SEQ ID NO: 20481 - protein, 261 aa, Rhodopseudomonas palustris
RLEGKTALVVGAGSIGPGWGNGKATAVTFAREGAQVFCVDRNLAAAEETVDIIKAEGGRGIAFAADVSRAADVEAMVAACVKAWDGIDVLDNNVGIAETGGVVEVTEADWDRVFAINLKSAYLAMKYVVPVMQRQGGGSIINISSIASIRYLGISYVSYAASKAAMNALTRNTAVEYAKDHVRVNAILPGLMKTPMVAHSAGLAASYSGGDVDAMWRARDAQVPMGHMGEAWDVANAATFLASDESKYITGIELVVDGGLT

SEQ ID NO: 20482 - protein, 626 aa, Rhodopseudomonas palustris
RYREVHARSLADPEGFWGEVAKEIDWITPPTKVFDPSLGLYGRWFPGAKVNTCYNALDRHVANGRADQLALIHDSPLTGTVSKYTYAEMLREVQTLAAIMQDFGVQKGDRVILYMPMVPESMVAMLACARIGAVHSVVFGGFAAKELATRIEDAKPKLILSASCGIEPGRIVKYKPLLDEAIELASVKPEACIILKRPQQDCELKAGRDHDWASLREQALAAGKKADCVAVDATDPLYILYTSGTTGKPKGVVRDNGGHLVALKWTMENLYGIKPGEVWWCASDIGWVVGHSYIIYGPLIHGATSIMYEGKPVGTPDAGAFWRVISEHGAVALFTAPTAFRAIRKEDGDGSFIRKYDLSKFRTLFLAGERADPPTVEWAEQQLQVPVIDHWWQTETGWCIAGNPVGLGLLPVKHGSPTVPMPGYKLEVVDEGAKPVPAGTMGSIVIKLPLPPGNLPTLWQQDERCRESYFADFPGYYKTSDAGYVDEDGYVFVMGRTDDIINVAGHRLSTGGMEEILASHPDVAECAVLGINDPIKGEVPCGLIVLKSGVTRDPAEIEKEIVKLVRDKLGPVAAFKLAITVPRLPKTRSGKILRGTIKKIADGDTWTMPATIEDPTALDDISSALK

SEQ ID NO: 20483 - protein, 205 aa, Rhodopseudomonas palustris
AELPDCASRLPMTNCAIRNERPAPMTPEFANDLKASVRAIPDYPKPGIIFRDITTLLGEPRAFRRAIDELVQPWAGSKIDKVAGIEARGFIIGGAIAHQVSSGFVPIRKKGKLPHTCVSMEYALEYGTDKIEVHVDAITPGERVILVDDLIATGGTAEGAIKLLRQIGAEVVAACFVIDLPELGGAAKIRAMGVPVRTLVAFEGH

SEQ ID NO: 20484 - protein, 1145 aa, Rhodopseudomonas palustris
MKLTRLRLHGFKSFVEPTDFMIEPGLTGVVGPNGCGKSNLVEALRWAMGETSHKSLRATDMDAVIFAGSGNRPARNHAEVVMSIDNSDRTAPAALNDADTLDISRRIEREAGSVYRINGREVRARDVQLLFADAATGARSPALVHQGKIGEIIQAKPEQRRRVLEDAAGVAGLHARRHEAELRLKAAETNLTRVEDVIGQLSTQVDGLKKQARQAIRFREVAAKVRKTEAMLYHLRWRDAQAEVGAAAEVHDLGVRQLAECTRVQAEASRIQADRASTLPSLREAEARAAAGLQRLINAREQLDREEARAKERVVELERRLTQFSSDVAREQQQAIDADAALERLDTEDVELREEILERVEKRSGVDERVAEADASLGEAEQLFAELTTQLAELTARRNQFEQSVRTHRDRLARLDTEIKNVESEIDRLSAETSGAGDLTELAEAVEIAQELLAEQEGAVQEAEAAQIAARQTLDGSRAPLVDAEKKVQRLETEAKTISKILNGETKNLWPPIIDGITVAKGYEKAIGAVLGDDLDAPVDPSAPMRWTDVGVQPEDPALPEGVEALAQHVTAPPELARRLAQIGVVTKERGNELCEQLKTGQRLVSLDGDVWRWDGFVASAHAPTGAARRLAERARLTDIENELEQARIEATAKRQALETAEADLKMAAAAETASRESLRGARREVDAARERFAAAEREVNRHAARKSALAEAQSRLATDRAEAEAALENAEAQIADLEPNTEAEARLAAVRGDIDGRRRIAAQIRAEAQALAREAELADKRLQAIAAERMDWQKRKAGAASQIATVEERVAELTAERAELENAPEVFAEKRSAVITEIEFAEADRRAAADALAAAEQAMSETDRLAKASLEQLSSAREACARAEERMEAARRRLEDVEREIRDMLEVEPQAAAQLAEIVEGAELPPLAEIEESLDKLRRDRERLGAVNLRAEEELNEVETQHGTLAAERDDLVEAIKKLRTGIQSLNKEARERLLASFDVVNGHFKRLFTTLFGGGEAELKLIESDDPLEAGLDIIAKPPGKKPQSLSLLSGGEQALTAMALIFAVFLTNPSPICVLDEVDAPLDDHNVERFCDLLTDMAKTTETRFITITHNPITMARMNRLFGVTMAERGVSQLVSVDLQGA

SEQ ID NO: 20485 - protein, 406 aa, Rhodopseudomonas palustris
LRADAHRMLDDMLDYIADVRDRPVWQPIPPAVRAGFAEPLPRQGTPLPEVYRRFTEEIAPYATGNVHPGFMGWVHGGGTAVGMLAEMLAAGLNANCGGRDHIGIEVERQIVRWLRELFGFPQTASGVFVTGSSMANFMALLVARTAAVGPQVREGGLPGERLTAYASAAAHGCVVQAADLAGLGRGALRRIPFGKDHRIDIDALKRRIAEDRAAGCQPFLVTGSAGTVDVGAIDDLAALAELCRDEGLWFHVDGAYGSLGMLSDEIAPKLKGLSEADSIALDFHKWGQVNYDAGFLIVRDGEQHRDTFAAPAAYLRRETRGLAGGSPWPCDYGPDLSRGFRALKTWFTLKTFGADRMGAMIAQTCKVARYLEARVEREPQLEMLAPVTLNIVCFRYRAAPNVMDSL

SEQ ID NO: 20486 - protein, 532 aa, Rhodopseudomonas palustris
MLGLMQDWPLLCHRIIEHAARIHGNQEVVTRSVEGPIVRTTYAQIHQRALKVSQMLDRAGIKLGDRVATIAWNTARHLECWYGIMGIGAICHTVNPRLFPDQIAWIVNHAQDRVMITDLTFIPVLEKIADQIPSVERFVVLTDAEHMPQTTLKNAIAYEEWLKEADGDFEWKTFDENTAAAMCYTSGTTGDPKGVLYSHRSNVLHALMANNPDALGTRAADTMLPVVPLFHANSWGIAFSAPSMGTKLVMPGAKLDGASVYELLSTEKVTHTAGVPTVWLMLLQYMQKEKLTLPHLKMVVCGGSAMPRSMIKAFVDMGAEARHAWGMTEMSPLGTLATLKPPFDQTTGDARLDVLATQGYPPFGVQMKITDDAGKDVDWDGKTFGRLKVSGPAIAKAYYRVDKEILDDAGFFDTGDVATIDQDGYMRITDRSKDVIKSGGEWISSIDLENLAVGHPKVAEAAVIGVYHPKWDERPLLICQLKPDVTCTRDEILQYMDGKIAKWWMPDDIVFVEAIPHTATGKILKTALRDQF

SEQ ID NO: 20487 - protein, 359 aa, Rhodopseudomonas palustris
PNPGILDIAPYTPGKSPVAEPGRKVFKLSANETPFGPSPHAIAAYKSAADHLEDYPEGTSRILREAIGKAYGLDPDRIICGAGSDEILNLLAHTYLAPGDEAISSQHGFLVYPIATLANGAKNVVAPEKNLTTDVDAMLAAVTPNTKLVWLANPNNPTGTYIPFDEVKRLRAGLPSHVVLVLDAAYADYVMKNDYELGIELVSTTENTVLTHTFSKVHGLAALRIGWMFGPANIVDAVNRIRGPFNVSVPAQLAAVAAIQDTGHVERSRAHTDKWRNTLAEELPKLGLTVTRSVCNFVLIHFPTTKGKTAAEADAFLTQRGLVLRALNNYGLPHALRMTIGTDEATRWCWKTCASSWDS

SEQ ID NO: 20488 - protein, 857 aa, Rhodopseudomonas palustris
MNVEKYTERVRGFIQSAQSLAMREGHQQFSPLHILKVLLDDSEGLAGGLIDRAGGNSRAILKATEEALGKMPKVSGSGAGQVYLAPATARAFDAAEKAAEKAGDSFVTVERLLLALSLDKDSEAGQLLTKGGVTPQNLNAAINALRKGRTADSATAENAYDALKKYARDLTQAARDGKLDPVIGRDEEIRRTIQVLSRRTKNNPVLIGEPGVGKTAIVEGLALRILNGDVPESLKDKKLLALDMGALIAGAKYRGEFEERLKAVLNEVTAAEGGIILFIDEMHTLVGAGKADGAMDASNLLKPALARGELHCIGATTLDEYRKHVEKDAALARRFQPVFVSEPTVEDTVSILRGLKDKYEQHHGVRIADSALVAAVTLSNRYITDRFLPDKAIDLMDEAAARLKMQVDSKPEELDSMDREIVRLKIEQEALKKETDPGSKARLVTLEKELADLEEKSAALTQRWSAEKNKLSDAQKLKSELDALRIELANAQRRGEYQRAGELAYGRIPELEKKIAEIEANENSGAMVEEAVTANHIAQVVSRWTGVPVDKMLEGEKEKLLRMEEQLGQRVVGQFEAVHAVSTAVRRARAGLQDPNRPMGSFMFLGPTGVGKTELTKALAEYLFDDETAMVRIDMSEFMEKHSVARLIGAPPGYVGYDEGGVLTEAVRRRPYQVILFDEIEKAHPDVFNVLLQVLDDGRLTDGQGRTVDFRNTLIVMTSNLGSEYLVNQPEGEDTGAVREQVMGMVRAHFRPEFLNRVDEIILFHRLQKSEMGRIVDIQFARLTKLLEDRKIVLDLDAAARDWLAEKGWDPAYGARPLKRVIQRSVQDPLAEMILEGSVKDGDHVAISAEGGVLTFN

SEQ ID NO: 20489 - protein, 246 aa, Rhodopseudomonas palustris
LTGKRALVTGASRGIGAAIAKDLAAKGADVAITYERSADRAAEVVRAIAAKGRRGVAIQADSADPAALKSAVNEAAAKLGGLDILVNNAGIGRVGPITELSLADIDALLNINVRAVVLASQAAIPHLGQGGRIISIGSTLAERVPFAGSTVYAMTKSALHAFTRGLSRELGPQGVTVNLVQPGSIDTDMNPASGEQADQLRALTALGRYGKPEEIAAVVAFLASPAAGLITGTMITADPASRPDPG

SEQ ID NO: 20490 - protein, 575 aa, Rhodopseudomonas palustris
VRSTTTLTDYPVRITDRLHHFAETAPDRVFMAERNGEGGWRRISYAEMLRAAQTIASALIARGLSAERPVMILSGNSIDHAMVMFGALYAGVAMCPVSPPYSLVSKDYGKLRHIVGLLTPGLIFADDITAFAPAILATVPEDVELAATRGEVKGRKVTSLAELLATPEHPELAAKHEAIGHDTIAKFLLTSGSTGNPKAVINTQRMICANQVMIREAMAFLKDEPPVIVDWLPWNHTFGGNHNIGLTLFNGGSMYIDDGKPTPAGIASTIRNLREIAPTVYFNVPKGYESLLPVLREDQQLRKLFFSRLHAMFFSGASLAAHVWNGLDEVAVAETGARVPMLTGLGATETAPFFMSVTPQTSRSGHVGLPVPGNEAKLVPNNGKLEVRAKGPNITPGYWRAPELTDKAFDEEGFYKLNDALKPVDANDLSRGFDFDGRISEDFKLASGTWVSVGPLRAKFIAACASLVRDVVIAGLDRDYVTALAILDPDGCKLINATLPLEDLAGMAADHLIREAFRERFATLLTQATGSSNRVTRAVLLGEPLSIDKGEITDKGSVNQRAVLEYRASLIADLY

SEQ ID NO: 20491 - protein, 936 aa, Rhodopseudomonas palustris
MSSLNLSAGPEPVSERPDDAAAIEAETRLRNDIRLLGRILGDTVREQEGQSVFDLVENIRQTSIRFHRDDDKTARAELAAILDGMSIQDTMRIVRAFSYFSHLANIAEDQNNIRQMRAGSTAGSAPRAGLLAKTLAHARQEGISAAELRKFFATALVSPVLTAHPTEVRRKSTMDREMQIAGLLDQRDRVQLTADEWTDNEERLRRAVETLWKTNLLRRTKLTVLDEVTNGLSFYDYTFLREVPRLHSALEDRLADAAKAEGANAEGELASFLRMGSWIGGDRDGNPFVTAEVLHGTLKLQSTRVLRYYLEELHELGSELSLASHLAGTTDTVKALAETSPDTSPHRKYEPYRLAVSGIYARLAATALKLEVENLRAPVGEAEPYASAQDFKADLDAIHLSLTTHHSGVIARGRLRQLRRAIDCFGFHLASLDMRQNSAVHERTIGELMDAARPGTSYAVLDEDARIALLISELRSTRPLTSMFVKYSDETVGELAVFREAAKAHATYGAAAIPQCIISMTKGVSDLLELAVLLKEVGLIDPSGRSAINVVPLFETIEDLQACAKIMDRLLSIPEYRRLVDSRGSVQEVMLGYSDSNKDGGFVTSGWELYKAEIGLIEIFEHHGVRLRLFHGRGGSVGRGGGPSYDAIVAQPGGAVNGQIRITEQGEIITSKYSNVEVGRNNLEILAAATLEASLLQPKRVAPHRDYLEAMEQLSALAFKAYRGLVYETDGFVDYFWASTVINEISTLNIGSRPASRKKTRAIEDLRAIPWVFSWAQCRLMLPGWYGFGSAVSAWVTEHPEKGIAFLQAMYQEWPFFRTLLSNMDMVLSKSSIGIASRYAELVEDTAIRDRIFSRIRAEWHSSIDYLLAIMQQDHLLQSNPLLERSIRHRFPYLDPLNHVQVQLLREHRTHDPDEQVLRGVQLTINGISAGLRNSG

SEQ ID NO: 20492 - protein, 437 aa, Rhodopseudomonas palustris
SFDEVNARVATIAGGLQALGVRPGDCVCVLMRNDIAFMEAVYGVMTLGAYAVPVNWHFKPEEVGYIIGDSATRVLIGHADLLHSVASAIPADLTVLSVPTPPEVIANYKIAPDHLSPPNNAIDFDGWLAQQKPYDGPAQPQPQNMIYTSGTTGHPKGVKRFAPTPEQAAHAEKMRATIYGLKPQVRALCPGPLYHSAPNSFGIRAGKLGGVLVLMPRFHPEEFLQLVQEHKIDTVFMVPTMFIRLMKLPAEVRAKYDVSSLRHVIHAAAPCPADVKRAMIEWWGPVIYEFYGSTESGAVTFATSEDALNKPGTVGKIAHGAELKFIDDDGNEVPQGEIGEIFSRIAGNPDFTYHNKPEKRAEIDRGGFITSGDMGYLDDDGYVFICDRKRDMVISGGVNIYPAEIEAALHAVTGVHDCAVFGIPDAEFGEALMAMLE

SEQ ID NO: 20493 - protein, 307 aa, Rhodopseudomonas palustris
  unsure (1)..(307): unsure at all Xaa locations
QRRYRKALSGFSQSPNXRPTSTFPGGFLMFTDQLLAGRRILVTGGGTGLGKAMAARFLQLGAEVHICGRRKGVCDETATELMDQYGGKVMTYGVDIRDAAAVDHMVETIFESGPLTDLINNAAGNFISRSEDLSPRGFDAVANIVMHGTFYVTHAVGKRWIAGGHRGNVVSITTTWVRNGSPYVVPSAMSKSAIHAMTMSLATEWGKYGIRLNTIAPGEIPTEGMSKRIKPGDEAGARTIKMNPMGRVGTMEELQNLATFLISGGCDWISGETIAMDGAQGLAMGGNFYQLRDWSNADWDQAKASIK

SEQ ID NO: 20494 - protein, 491 aa, Rhodopseudomonas palustris
TFADFDRHTNQVARALQASGVQPNERIAYLGKNSDIYFELWSGAIKAKAVMAPVNWRLAGPEIAYIVEDCKAAILFVGPEFVDQVCGLKDQIPSVRHIITTEGGAPEWQDFTKWRDAQSSDDPQVAIAPSDIAIQLYTSGTTGKPKGAMLSHANFLSLVRAGQDNKPEWNRWSPDDVSLVAMPVFHIGGSGWGMMGIYHGAKGVIAREFDPTKVLDFFEQSGITKLFMVPAAMQFVVRQPRAREVDFSRLKYMLYGASPIPAALLKECIDVFKCGFVQMYGMTETTGTIVALPPEDHVEGLERMRSAGKALPGVEIAILDPDGKPLPPRQVGEIATRSGSNMVGYWNLPDATKKTIDGDNWLRTGDAGYMDEDGYVYIHDRIKDMIISGGENIYPAEVESAICDHPDVAEVAVVGVPDDQWGESVKAVVVMKPGKEATAQDIIGFTRTRIAGYKTPKSIDFIPALPRNASGKILRRQLRDPYWSGKDRQVN

SEQ ID NO: 20495 - protein, 391 aa, Rhodopseudomonas palustris
LEQADDNIRFFDHRREWARTDFEHGGLPRHEWEDLLRKAKNLADDAGHLRFAIPKRYGGQDGTNLWMAVIREHFAAKGLGLHNDLQNEHSIVGNFPIVKMLDLYGSPEQKAMIDGSITGKYRITFGLTEPDHGSDATHMETRAEEAVRDGKKGWVINGEKMWTTGMHVATHCALFARTAGKDGDARGITCFLVPADAPGVKVEEYLWTFNMPTDHPRVSFKDVFVTEDAVFGEVGRGLSLAQCFVHENRIRQAASSLGAAVFCINESVKYARERKPFGEELARNQAIQFPLVELATQAEMLRLLIRKTAWEMDQMTQAQVEHTLSDKVSMCNYWANRLCGQAADRAIQVHGGIGYSRHKQFEHIYRHHRRYRITEGSEEIQMRKVAGFLFG

SEQ ID NO: 20496 - protein, 252 aa, Rhodopseudomonas palustris
LSGRVAVVTGGNGGIGLGMAQALAAAGCNVSIWGRNAVKNHAALATMANAPGKVEAQICDVTDPASVKAAMDATLKAFGRVDGCFANAGIGGGGRQAFIDRTEEQWRSMFATNLDGVFHAFQAAARHMTERAADGDPFGRLVATSSLASIFGTARNEHYAATKAAINALVRALAVELARYGVTANAILPGWIKSDMTAGIMGNDKFVANVMPRIPVRRFGEPEDFGGIAVYLMSKASSYHTADTFVIDGGYT

SEQ ID NO: 20497 - protein, 349 aa, Rhodopseudomonas palustris
YRIAVIAGDGIGKEVMPEGLRVLEAAAKKHRVKLVFDHFDFASYDYYEKHGQMMPDDWKEKIGGHDAIFFGAVGWPAKIPDHISLWGSLIKFRREFDQYVNLRPVRLMPGVPSPLAGRKPGDIDFWVVRENTEGEYSSVGGRMFPDTEREFVTQQSVMTRVGVDRILKFAFELAQSRPKRHLTSATKSNGISITMPYWDERVEAVAKSYPEVKWDKYHIDILTAHFVLHPDWFDVVVGSNLFGDILSDLGPACTGTIGIAPSGNINPEGDFPSVFEPVHGSAPDIAGQGIANPIGMIWSGAMMLEHLGEKQAADSIVKAIERTLEERTLRTRDLGGQADTSACGKGVAE

SEQ ID NO: 20498 - protein, 439 aa, Rhodopseudomonas palustris
LSPWPVCRCCRTFAKTFIWGVSTASFQIEGAANEDGRGQSIWDVYCRSGYVANNDTGDVACDHYHRYQEDVALMKTLGIQAYRFSIAWPRIFPQGTGAINEPGLAFYDRLIDALEAAGIEPWICLYHWDLPQALEERGGWMNRDIVGWFADYAWVIGERYGKRVKRFATFNEPGIFSLFSRSFGARDRSADEKLHRWIHHVNLAHGAAVDVLRETVADAKIGLVTNYQPVYPSSDKPEDVAEAKLISDYWNRAFADPQYRGEYPDLIRDAIKPYIQPGDMERIHRPLDWFGLNHYSPVYINSDPNAIVGLGWGPKPEGIPRSPIDWTIEPDAFRDTLIEISRRYGKPVYVTENGYGSNIEKPDANGEVVDPGRIGFLRDYITALDQAVAAGADVRGYMVWSLLDNFEWESGYSVRFGLIYIDYATLRRIPKASFKWFAD

SEQ ID NO: 20499 - protein, 271 aa, Rhodopseudomonas palustris
LERLPLSRRGPSEVLIEVKAAAVNPSDVKAATGLMPYAVFPRTPGRDFAGRVIDGPAEWLGRDVFGSSGDLGIRRDGTHATHLVVEADALVEKPGSVSWEEAAGIGVPFVTATEGLRRAALAAGETLVIMGINGKVGQAAAQIASWRGARVIGVVRKAEPYAGHATAPVEIIDSSSTDVAAKVRELTGGKGADVVFNTVGDPYFKAANQCLALRGRQILIAAVHRIVEFDILAFYRGQHTYVGIDTLAFSSIATGEVLRSLGDGFAGGHLK

SEQ ID NO: 20500 - protein, 354 aa, Rhodopseudomonas palustris
KKKAEGGWACLTWPSEYGGRGATPIEKVIWQQEEGVYGKLTQPFQIGEGMCGPTVMAYGAEEHKRRYLPKLASGEEIWCQLFSEPAGGSDVAGLRTRAEKDGDDWIINGQKIWTSGAHYSDYGLLITRTDPNVPKHKGLTMFFLDMKSPGVEVKPIKQANGMQEFNEVFFTNVRIPDSQRLGAVGDGWNVSLTTLMNERMSIGARLATGFPEIFAFCNDLVTENGPAIDDPAVRSKLANWAVKASGLKYTSYRSISALSKGQRPGPENSIGKLVAGPMLQDIAAFAMDLEGAAGVFTDPAEAEAGGSFQAMLLGSPSMRIAGGTDEILRNIIAERVLGLPGDIRVDKDVPFNKI

SEQ ID NO: 20501 - protein, 783 aa, Rhodopseudomonas palustris
  unsure (1)..(783): unsure at all Xaa locations
EGKADYDRDLWKGLAEMGFLGVAIPEEYGGTGAGHLELCVIAEELGRVLAPVPFSSTVYLAAEALLLAGSEEQKQKWLPKISSGEAIGTLALFEGTGNPSSAAVKLAVSNGTLTGTKKPVADGAIADFAIVAARTGNSGRETDVSLFLVDLKAGGVTAKPLHNVDPSRQQAELTFAGAKAEPLGAANEGWSILSRVMDRAAVLIAFEQVGGADRALEMGRDYALDRIAFGRQIGSFQAIKHILADMYVSATLARSNSYYGAWALSTDAAELPEAAAAARISATQAFQHCAKQNIQVHGGMGFTWEFDCHLYYRRSNALALSLGSQSYWEDQLIDRMRQKNAAXLTXTSSXGARRSRASRRMRMNSSWFETRARARSSPXGPVRTKVRIDELRRYPAGSRIPRQGAAWIDANAPKQYEEELRKASLGRVVLKGANILEVAKAWQKKKADAGWAVPHWPKEYGGRGASPIERVIWQQEEGVFGKLTAMFIIGQGMCGPTMMAYASEEQKRHYLPPLGSGEKIWCQLFSEPAGGSDVAGLRTRAEKDGDDWIINGQKIWTSGAHYSDYGILITRTDPTVPKHKGLTMFFLDMKSEGVEVRPIKQANGNSDFNEVYFTNVRIPDSQRLGAVGDGWNVSLTTLMNERMSIGANVATGFPELFDYCSSLTLDGAPALDDRAVRSKLANWAVKASGLRYTSFRSISALSKGQRPGPENSIGKLVAGSMIQEVAMYALDLQGAAGVLSGPEDAEVAGRFQAMLLRSPATRVEGGTDEILRNIIAERVLGLP

SEQ ID NO: 20502 - protein, 252 aa, Rhodopseudomonas palustris
MQLKDVSVLITGGGSGLGAATARAMAAKGAKVAVLDMNKDNAEKVAAEIGGVACVGDVSQEAPVKEAIAKAEAAHGIVRVLVNCAGIGGAVKTVSKNGAYPLDHFSRIINVNLIGSFNCIRLVAERMQSAPTIGEERGVCINTASVAAFDGQIGQAAYSASKGGIVGMTLPVARDLASMNIRVMTIAPGLFLTPLLMGLSEDARKSLGSQVPHPARLGDPSEYASLAVQIVENPMLNGETIRLDGAIRMAPR

SEQ ID NO: 20503 - protein, 389 aa, Rhodopseudomonas palustris
MAEAYIVAAARTAGGRKGGRLAGWHPVDLAASVINALVDRSGAAPDQIEDVIMGCVGQGGEQAVNVGRNAVLASKLPESVPGTSVDRQCGSSQQALHFAAQAVMAGTMDIVIAAGVESMTRVPMGSPSILAAKAGLGNYKSPKMEERYPNIQFSQFVGAEMVANKYNLSKDELDEFAFNSHQRAIAATQGGKFKDEIIPLEITRADGSTDIHHIDEGIRFDATLDGIKGVKLINENGGKLTAATASQICDGASGVVVVNEKGLKQLGVQPLARVHHMTMRGGDPVIMLEAPLPATEYALKKAGMKIDDIDLFEVNEAFASIPAAWLKATGADPARLNVNGGAIALGHPLGGSGTKLMTTLIHALKQQNKRYGLQTMCEGGGMANVTIVE

SEQ ID NO: 20504 - protein, 494 aa, Rhodopseudomonas palustris
DKVAYRMASTGQALTYRQLDERSNQGAHLFRSLGLKAGDHIALLMENRLAFMEICWAAQRAGLYYTAISRYLTKDEIGYIVQDCGAKVVITSAQGSETMKSLLSDGPGAPLYYMVDPPTAGFRSWEQETAAQPTTPIADEVAGYDMLYSSGTTGRPKGIKREFEGNAIDVPSPFLRLLCEKMCGMNAESIYLSPAPLYHAAPLRFNMMATTLGGTSIIMEHFDAEQFLALVEKYKVTQSQLVPTMFVRMLKLPDEVRSRYDVSTLKGAIHAAAPCPVDVKAKMIEWWGPILIEYYAGSEGNGVTVSTSQQWLAHRGTVGKAVVGTIKILDDEGEEQPVGEIGTVYFADAPSFSYHNDPDKTKKAYNEKGWSTLGDVGYLDDEGFLYLTDRKSYMIISGGVNIYPQETEDVLLTHPDVADVAVFGVPNPEMGEEVKAVVQLRDGAAPSSERAAELIAFCRERLSPIKCPRSVDFEAELPRTPTGKLVKRHLKDRY

SEQ ID NO: 20505 - protein, 394 aa, Rhodopseudomonas palustris
ILIGASVLLSLAMGMRQSFGLFQPSVIRDVGITSADFSFATALQNIIWGVTQPMVGLIADRYGTRWVMAGGVIVYAAGLVLMMVADSALMFTLGCGVCVGIALSCTASSMTMTVTSRTVSPAKRSVAMGAVSAAGSLGLVLASPLAQTLISTAGWQMALIGFLGLAAAMLPSALFAGRADKLDIDKSDDVQQSAGEVVQTALGHSGFLVMAIAFFVCGLQLVFITTHLPNYLAICGLDPSLGASALAVIGLFNVFGSYAFGWLGGKFPKQYLLGGIYIVRSLTVAAYFYFPASATSTIVFAAIMGSLWLGVIPLVNGLVAQLFGLRYMATLTGIAFLSHQVGSFLGAWGGGVIYDHLGSYDRAWQAAVLIGLIAGCAQMLMNVRPPRRRDELAV

SEQ ID NO: 20506 - protein, 442 aa, Rhodopseudomonas palustris
TLEQRQDRLARLRALIKDNEKRFEQAISADFGHRSSTETLIAETLSLLGDIKHTSRHLKRWMAPRKVSTQLQFLPGKNRLLPQPLGVVGVIAPWNYPLQLTVAPAIGAIAAGNRVMIKPSELSPHFAALLQETVAAKFDASEMMVTGIEAGVAEAFARLPFDHLMFTGSTRVGRIVAAEAGKNLTPVTLELGGKSPTIVDRSADLDEVAPRIAYAKLMNAGQTCIAPDYVLAPQDRVEALAGKIWGAMQQMWGTDPANPDYTSIIAEHHYARLKSLVDDAVARGARLLQPASADDAAWAGKRKFPPTLVLGATHEMKIMQEEIFGPLLPILGYSEPTEPINFINGRDRPLALYWFGTDDTARDQVLERTVSGGVTINDCLVHFAQANQPMGGVGASGTGAYHGEWGFNTFTKMKPIFYRSPYNRFADLYPPYGAKIARLSKV

SEQ ID NO: 20507 - protein, 522 aa, Rhodopseudomonas palustris
DFVVVGGGSGGCAVAGRLSEDTNTSVALLEAGGTADNWVVKTPYALSLMVPSKLNNWHFETVPQPGLNGRVGYQPRGKGLGGSSAINAMVYIRGHKWDYDHWAELGNAGWSYADVLPYFKRSENNSDFNGAYHGQSGPLHVNKLRTDNPAHEIFLQAAREAQFRIRDDFNGEEQEGLGLYQLTQHDGERWSAARAYVHPHIGTRCNLRVETDAQATRILIEGGRAVGVAYRQNDQIREIRARREVILASGAFQSPQLLMLSGIGDAAALKAHGIDVVHHLPGVGQNLQDHPDFIFAYQSDSPYFTGTSFTGIARLLSTIGQYRREGRGPLTTNFAECGGFLKTRPDVDVPDIQLHFGMAMVDDHGRKRHWGTGFSCHFCLLRPKSRGSVGLASADPLAPPRIDPNFFGDPDDLETMVAGYKTTQRLMETPALRALQQKDLFTANVRTDDDIRAILRARVDTVYHPVGTCKMGSDATAVVDPRLNVHGIGALRIVDASVMPTLIGGNTNAPTIMIGEKAADMI

SEQ ID NO: 20508 - protein, 246 aa, Rhodopseudomonas palustris
VSNEVILVTGASQGLGRQFARVLAARGAAIVLAARQIDKLQSLEQEIEGGGGRAVAVRMDVTDLGGMAAALDQAEAALGPITVLINNAGVATEKLAIDTSEADWDKVIGANLKGAYFLATEVARRMIARQQGGNIVNIASVLGQSVLKFVSPYAISKAGIIQATKAMALELASSRIRVNALAPGYIDTDINRDLWSTPAGEKLLKSIPQRRVGHESDLDGAILLLASNASRYMTGSVVTVDGGFLL

SEQ ID NO: 20509 - protein, 250 aa, Rhodopseudomonas palustris
IKGRRALVCASSKGLGRGCAAALAAEGVHVTMTARGAEALAQAAAELRKAYPDVEIIEVAGDITTPEGRAAALAACPEPDILINNAGGPPPGDFRNWTRDDWIKALNANMLTPIELIKATVDKMIERKFGRIVNITSAAVKAPIDVLGLSNGARSGLTGFVAGLSRKTVRHNVTINALLPGPFDTDRLRGVAAGQAKASGKPAEQILEARKNENPAGRFGTPDEFGAACAFLCSVHAGYITGQNLLLDGG

SEQ ID NO: 20510 - protein, 378 aa, Rhodopseudomonas palustris
AEAASAAKSSFVAMMSHEIRTPMNAVIGLATNLLETRLDAEQRQAVTSIHDAGDNLLQILDDILDFSKLEAGRLSLEPIPFAPRNIVDNTLSVIGPRAIAKGLVIRLEARGDIPEALTGDAGRIRQVLLNLISNAVKFTTAGEIVITTECISRDTTNARMRWIVTDTGIGIAADKIDSLFKDFVQADSSISRRFGGSGLGLAISKRLIEQMGGKIGVSSAPGRGSEFHFSLTLPIADHAAPPEQDDQDVYAQFRARIEAAGRPLRILVVDDNPTNRAIATQMLGEFRVQTNTACDGTEAVTAATRFGYDVVLMDVRMPEMDGLDATRAIRSHGGALANVPIIAFTANAFAEDAAACRAAGMNDHVAKPVRKKALIEAI

SEQ ID NO: 20511 - protein, 399 aa, Rhodopseudomonas palustris
  unsure (1)..(399): unsure at all Xaa locations
TLRGVAXAERAPSMMSNAQSLFNFDLGETADAIRETVRDFAANEIAPRAEAIDKTNTFPRDLWPKLGALGLHGITVEEDYGGAGLGYLEHCIAMEEISRASASVGLSYGAHSNLCINQIRRNGNEAQKQKYLPKLISGEHVGALAMSEPGAGSDVVSMKTRADKKGDRFVLNGNKMWITNGPIAETLVVYAKTDPNAGPRGITAFLIEKGFKGFSTAQKLDKLGMRGSDTGELLFEDCEVPEENVLGEVGRGVNVLMSGLDYERAVLAAGPVGIMQACMDVVLPYVHERKQFGEPIGTFQLVQGKVADMYVTMNASRAYVYAVAKACDRGETTREDAAGAILYAAERATQCALDAIQLLGGNGYINDYPTGRLLRDAKLYEIGAGTSEIRRMLIGRELF

SEQ ID NO: 20512 - protein, 366 aa, Rhodopseudomonas palustris
DEYHDIRDAVAKLCAQFPGEYWRKLDREMAYPKAFVDALTEAGYLSVLIPEEYGGAGLKLSAAAAILEEIQRAGCNGGGCHAQMYTMGTLLRHGSDEQKAKWLPKIASGELRLQAFGVTEPTSGTDTTSLKTFAKKDANGDYVVNGQKIWTSRAEYSDLMILLARTTPKDQVTKKTEGLSVFLVDMREARGHGLEIRPIRTMMNHATTEVFFTDMKVPKENLIGEEGKGFRYILSGMNAERILIASECVGDAKWFIAKASAYAKDRAVFGRPIGQNQGIQFPIAKAYANMRAAELMVKEATRKYEAGMDCGAEANMAKMLAADASFEAANACIQTHGGFGFAEEYDVERKFRETRLYQVAPISTNL

SEQ ID NO: 20513 - protein, 516 aa, Rhodopseudomonas palustris
VTTVKSATLDLLRAFKIDKVFGNPGSTELPFLSDWPDDIDYVLALQEASAVAMADGYAQATRNAGFVNLHSAAGVGNALGNIYSAFKNQTPLVITAGQQARSLLPLQAFLGAERASEFPRPYVKYSVEPARAEDVPAAIARAYYVAMQPPCGPTFVSVPIDDWARPAAPVPPRTITREIGPDRSAMQVLADTLANAKKPALVVGPAIDRAAAVGLMARLAERAKAPVWVSPFSARCSFPERHPLFAGFLPASPGQLSETLGAYDVIVLIGAPVFTFHVEGHAAIFDGASQLFQITDDAEAASVTPLGASIIATMTPALTLLLELLPETKRAAPPARAVPPAPRPAEPMPVEYLLHTLRAAMPESAMLVEEAPSHRPAMQTYMPMPGQDSFATMASGGLGWSLPASVGFALAHPNRRTVCLIGDGSAMYSIQALWTAAQRKLPLTVVVLNNGGYGAMRSFSQVMQVRNVPGLELPGIDFTALAQSLGCDAVRVTRSEELAPALTRALAWDGVSLVEV

SEQ ID NO: 20514 - protein, 980 aa, Rhodopseudomonas palustris
PTAMPSDPPLAEFTAAYAPDDAALAAELLTTATLTPDREAQIDAIATDLITAIRGSEHGLRGVEAMLREFALSTKEGLALMVLAEALLRVPDAATADAFIEDKLGQGDFAHHRIKSDAVLVNASAWALGLSARLVHAGETPQGTLAALTRRIGAPAVRAATRQAMRLIGNHFVLGETIDAALARAQPYAREGSRYSYDMLGEGARTAADAERYYQSYADAITAIGRRAGNAALPARPGISVKLSALHPRFEAISRDRVMRELTPRLLELAQLAKSHDLAFTVDAEEADRLELSLEVFAACFADPSLKGWDGYGLAVQAYQKRAATVIDHVAELARAFDRRMMLRLVKGAYWDTEIKRTQERGLADYPVFTRKAMTDLNYLHCARKLLALRPLLFPQFASHNALTVATILAEAGDGDGYEFQRLHGMGEALYGRLLADHPQAVCRIYAPVGGHRDLLAYLVRRLLENGANSSFVAQAGDDSVPITELLARPATLIGHPENARNSAIPLPRDLYQPQRINSRGIEFGDRSALAALLGDIEGARRPLPTVASTSPEQAAATVTAARKGFESWSRTSGDHRAAILQRAGDLLEQRRGELIALLQDEGGKTLDDGVAEVREAVDYCRYYASEGRRLFGEPQALPGPTGERNTLALRGRGVFVAISPWNFPLAIFLGQITAGLMAGNAVVAKPAEQTPVIAEVAVRLLHEAGVPPAALHLVQGDGRIGAALVEQRDIAGVVFTGSTEVARAINRTLAAKDGPIVPLIAETGGINAMIVDATALPEQVADDVIASAFRSAGQRCSALRLLCVQDDVADRVIAMIAGAARELTIGDPRDPATHVGPVIDAEAKTRLDTHIATMKRQAQLHFAGTAPASGNFVAPHIFELNRASELTEEVFGPILHVVRYKAAQFDDLLDDIATTGYALTLGVQSRIDDTIARVIARLPTGNVYVNRNIIGAVVGVQPFGGSGLSGTGPKAGGPHYLPR

SEQ ID NO: 20515 - protein, 211 aa, Rhodopseudomonas palustris
  unsure (1)..(211): unsure at all Xaa locations
MKLYDSIGPNPRLVRMFIAEKGLTIPTQTLDIRAGENRKPEHLARNPHGQTPTLELDNGSFLAEVTAICEYLEEKHPQPPLIGTTPEERAECRMWTRRIDLYICEPLTNGFRFAEGLKMFQDRVVCVPEAAPGLKKIAADRIRWMNEQMKGKEYVCGARLTLADLLLYGWLDFGAQVGQPLAPANTTIAEWFKRIAARPSAKAXGAFVSKA

SEQ ID NO: 20516 - protein, 285 aa, Rhodopseudomonas palustris
FHGVFPYLVSPVDAEGRVRADVMGRLCDDLIQAGVHGLTPLGSTGEFAYLGTAQREAVVRATIEAAQRRVPVVAGVASTSVADAVAQAKLYEKLGADGILAILEAYFPLKDAQIESYFRAIADAVEIPVVIYTNPQFQRSDLTLDVIARLAEHPRIRYIKDASTNTGRLLSIINRCGDALQVFSASAHIPAAVMLIGGVGWMAGPACIAPRQSVALYELCKAQRWDEALMLQRKLWRVNEAFAKFNLAACIKAGLALQGYDVGDPIPPQAALTAEERKAVEKVLA

SEQ ID NO: 20517 - protein, 420 aa, Rhodopseudomonas palustris
FETLSLHAGQHPDPLTGSRAVPIYQTTSYVFQDTDHAAALFNMERPGHLYTRISNPTIAVLEERIAALENGVGAVATASGMAALHLAIATLLNAGDHIVASSSLYGGTINLLAHTLPRFGITTTFVAPRDHAGLAAAIQPNTRLVIGETIGNPGLEVLDIPKVAAIAHEAKIPLLIDNTFATPYLSKPIELGADIVMHSVTKWLGGHGIAIGGVLVDGGRFDWRGSGKFPTLTEPYAGYHDVVFDEQFGPPAFVIRARMEGLRDFGACLSPTNAFQLLQGIETLPVRMDRHVANTKAVLDFLQANKAVDWVLHPTLENHPDYELAKTLLPNGAGSIISFGIKGGRAAGRKFIEALRLTSHLANVGDAKTLVIHPASTTHQQMSAEQLEAAGIGEELIRLSVGIETADDIIADLAQALRVS

SEQ ID NO: 20518 - protein, 235 aa, Rhodopseudomonas palustris
LASRIALVTGASRGIGYATAKALAKAGAHVIAVARTQGGLEELDDEVRKDGGHPLTLVPLDLTDYQAIGRLGGTIYERHGKLDVLVGNAGIGGPSSPLGHIELKPWLDVIGINLNVNFQLVRCMEPLLRASDAGRAVFLTSRAGGKAPGYRGPYAASKAALETLVQVWAKEVVNTTPIRINLFDPGPTRTKLRASVMPGEDPETLPTPDQAAELLLPLCLPSFTETGKLFDGPSR

SEQ ID NO: 20519 - protein, 533 aa, Rhodopseudomonas palustris
LATALLDALKDHGAREIFGIPGDFVLPFFKVIEESGTLPYFTMSHEPAVGFAADAASRYRGSIGVAVVTYGAGAFNLVNSIAGAYAERSPVVVIAGAPGARERTSGYLLHHQVRTVDSQLAVFKEVTCDQAVLSDPATAPAEIARVLRSALELSLPVYIEFPRDMVDAKVDPVPKLPRREADIGARDECAEEILDRIARAKSPVMVVDVEIRRYGVEQQVAALARKLGLPVVTTFMGRGLLEGDDDVVAGTYLGAAGDPDLSALVEGADLVLMFGVILSDTNFALSSNMTDPRRTVLATGREVQIGHHVYRDLPLADLIAGLDAHASQHPPRPRNVGKGMAYPRGLTLDASPIAPSDIATAINDLFDRHGKMPMTADIGDCLFTAMEIDNTALAAPGYYAGMGFGVPAGVGVAATGLRPLVLVGDGAFQMTGWELGNCKRYGLDPIVVLFNNCSWEMLRVFQPESKFNDLDDWHFADIAHSIGGFGERVTTRAELAAALQRAVERRGVFSLIEVMLPRGVTSHTLARFVTGFK

SEQ ID NO: 20520 - protein, 313 aa, Rhodopseudomonas palustris
  unsure (1)..(313): unsure at all Xaa locations
RHLLGIEGLSAADISGLLDLSEEYVELNRQVDKKRTSLRGRTQVNLFFEASTRTQSSFEIAGKRLGADVMNMSVSSSSMRKGETLMDTAVTLNAMHPDILVVRHHASGAVELLARKVDGSVINAGDGAHEHPTQALLDALTIRRNKGRLEGLVVAICGDVMHSRVARSNILLLNTMGARVRVVAPSTLLPAGIERMGVEVARDMREGLDGADIVMMLRLQRERMNGSFVPSSAEYFNYFGLDQKKLSYAKPDALVMHPGPMNRGVEIDSIVADGAQSVIREQVEMGVAVRMAVLEALARNLPNAXCRNGKQHA

SEQ ID NO: 20521 - protein, 750 aa, Rhodopseudomonas palustris
EMPTFSQSLEQSLHRALAIANERHHQYATLEHLLLSLVDDSDAAAVMRACSVDLDKLRTSLVNYLETEFENLVTDGSEDAKPTAGFQRVIQRAVIHVQSSGREEVTGANVLVAIFAERESHAAYFLQEQDMTRYDAVNYISHGIAKRPGVSEARPVRGVDEETETKGGDDSKKKGDALETYCVNLNKKARDGKIDPVIGRNAEISRAIQVLCRRQKNNPLFVGEAGVGKTAIAEGLAKRIVDGEVPEVLSAATVFSLDMGTLLAGTRYRGDFEERLKQVLKELEAHPNAILFIDEIHTVIGAGATSGGAMDASNLLKPALASGTIRCMGSTTYKEYRQHFEKDRALVRRFQKIDVNEPTVEDAIAILKGLKPYFEDYHKLKYTNEAIESAVQLSSRYIHDRKLPDKAIDVIDESGAAQMLLSENKRKKTIGIKEIEATVATMARIPPKSVSKDDAEVLKHLEQTLKRVVFGQDKAIEALSASIKLARAGLREPEKPIGCYLFSGPTGVGKTEVAKQLASTLGVELLRFDMSEYMERHTVSRLIGAPPGYVGFDQGGLLTDGVDQHPHCVVLLDEIEKAHPDLYNVLLQIMDHGRLTDHNGKQVNFRNVILIMTTNAGAADLARQAFGFTRNKREGDDHEAINRQFAPEFRNRLDAIVSFAHLNADVIGMVVEKFVLQLEAQLADRDVTIELSEPAKAWLVQHGYDEQMGARPMARVIQEHIKKPLADEVLFGKLKGGGHVKVVLVKDDAV

SEQ ID NO: 20522 - protein, 246 aa, Rhodopseudomonas palustris
HGAKIPALGLGTWELSGHSCSRIVEQALRLGYRHIDTAQIYDNEREVGEGIRNSHIRRDQLFVTTKVWTTHFAPNDLVRSAKESLVKLRLSEVDLLLLHWPNAHVPLAETLGALAQARALGLTRHIGVSNFTVALLAEAVAVCPAPLVCNQVEYHPFLDQQKVLAACALYGMALVAYSPIARGNAKKSEVLTRIGNVHGKTAAQVCLRWLIQQNVAAIPRSSRLERLAQNIDVFDFELSDAEMQEI

SEQ ID NO: 20523 - protein, 669 aa, Rhodopseudomonas palustris
FKRILIANRGEIACRVIKTARRMGIETVAVYSEADRDALHVEMADEAVLIGPPAAAESYLVIEKIVEACKKTGAEAVHPGYGFLSEREAFPRALAEAGIVFIGPNPGAIAAMGDKIESKKAAAQAKVSTVPGFLGVIEDAKHAVKIADEIGYPVMIKASAGGGGKGMRIAHSTAEVAEGFNLAKAEAKASFGDDRVFIEKFIVDPRHIEIQVLGDKHGNVIYLGERECSIQRRNQKVIEEAPSPLLDEVTRRKMGEQAVALAKAVNYDSAGTVEFVAGQDKSFYFLEMNTRLQVEHPVTEMVTGIDLVEQMIRVAAGEKLALAQKDVTLKGWAIESRVYAEDPFRNFLPSIGRLVKYRPPAESAASGITVRNDTGVQEGGEISMFYDPMIAKLVTHGPSRAAAIEAQTHALDAFYVDGIRHNIPFLSALMTHPRWREGNLSTGFIAEEFPQGFHPRVPEGEVARRIAAVGAAIDRVIGERKRKISGQMIGRAVIRERRRCVWLERSEVPLDVIREGEAFVVRFANPDGSLGQPHQLLSSWMPGDPVWEGTIDGHPVAVQVRAIPNGFKLAHHGYEVSVNVFTEREAASARWMKEADKADTGKKVLCPMPGLIVSIAVTEGQEVKAGETLAVVEAMKMQNVLRAERDGTVKKIHASAGATLAVDAMILEF

SEQ ID NO: 20524 - protein, 692 aa, Rhodopseudomonas palustris
LMAALLTPAVAAAQDSKGSAAHIRAVTGAVDSAAIVANVKTTKDWPSYGLDYAETRFSKLDQINTENVKQLGLQWSYSLGSERGVEATPVVVDGIMYVTASWSVVHAIDTRTGKKLWTFDPKVDHSKGYRGCCDVVNRGVALYKGKVFVGAYDGRLIALDAATGSKAWEIDTLIDHEHSYTITGAPRVFNGKVVIGNGGAEYGARGYVTAYDAETGKQAWRWFTVPGDPSKPFEDESMEKAAKTWDPAGKWWLNGGGGTAWDTITFDPDLNLIYVGTGNGSPWNRHLRSPAGGDNLYLASIVALNADTGKYVWHYQETPGDNWDYTSTQPMILADIAIDGKPRKVILHAPKNGFFFVIDRTDGKFISAKNFVDVNWATGYDSNGRPIEVPEARSADKSFDAIPGPYGAHNWHPMSFNPQTGLVYLPAQGVPVNLTGEKALTQNKMEPFKFGSTTGWNVGFTLNAVPPKNLPFGRLVAWDPVQQKEVWRAEYVSPWNGGTLTTAGNLVFQGTADGRFVAYNAKTGEKLWESPLGTGAVAAPATYMVDGVQYVSIAVGWGGVFGISARATETEAPGTVYTFAVGGKAKMPEFAKYQMGNLLTGIEYDPKDVAEGTAIYVAACATCHGVPGVDRGGNVKNLGYSTTDRIAHLKDIVFKGPFRDKGMPDFTGKLTEADVVKIQAFIQGTADAIRPK

SEQ ID NO: 20525 - protein, 278 aa, Rhodopseudomonas palustris
MGLLDGKVALITGAGGGLGEAYAKLFAREGAAVVVNDLGGPRDGSGSDAGMAQQVVDAIKAAGGRAVANTADISTMAGGQSVFDDAIKHFGRADILVNNAGILLDQTFAKASEASWDKVMKVHLKGTFCVTQPVFKWMKDNGGGVIVNTSSTSGLLGNFGQSNYGAAKGGIWGLSNVLAIEGRKYNIRIWTLAPGALTRMTEDLPRYRENPGAALTPEGIAPAVLYMVSSLSGDQTGKVLGVSGPRGVREMKLMEMDGWKPPHNGWSAEDIVSHAGEI

SEQ ID NO: 20526 - protein, 363 aa, Rhodopseudomonas palustris
AGIYEHPTRHAPDKSIAQLHAEVAKGALDDAGLTKADIDGYFCAGDAPGGVMAMVDYLGLKVRHFDSTDTGGCSYLVHLGHAAEAIAAGRCSVALITLAGKPRTGALPPRPVGAEGDFELAYGATTHNVYAMCAARHMHQYGTTSEQLAWIKVAASHHAQYNEHAMLRDVVTVEDVLNSPLIADPLHRMDCCVVTDGGGALIVTTEEIARSLKKPLVRMIGAGEAIKGPRGGHNLDLTYSAGVWSAPPAFEMAGVTPKDIKYASIYDSFTITVLMQLEDLGFCEKGQGGKFVADGNLISGVGKLPFNTDGGGLCSNHPVNRGGMTKLLEAVRQLRGEAHPKVQVPNCDLAIAHGTGGMLGIRH

SEQ ID NO: 20527 - protein, 271 aa, Rhodopseudomonas palustris
YRIIRELHGSSRSHIYLASDLATGELVVLKIPSADLRDDPEYRKRFMLEEWAARRIDSPHVLKPCVVQRPRSYLYVTFEYIEGQTLAQWMIDHPRAELETVRGLIEQIAKGLYAFHRKEMVHQDLRPANVLIDRSGTVKIIDFGSVRVAGVAELGPAGGDELLGTVQYMAPEYFAGQGGSALSDQFSLGVIAYQMLTGRLPYGAELARANQALKSRKLRYSAAADHNAKVPVWVDRALQRAVSLDPAKRYPALSEFVHDLRHPRADYLDAR

SEQ ID NO: 20528 - protein, 263 aa, Rhodopseudomonas palustris
MHIDLSGKTALVTGSTAGIGHAIAKGFAATGANVVINGRGQAKVDAAVAAVSKVAKGGKVTGVAADVSTADGCAKLVAAQPDVDILINNTGIFEPKPFFEIPDEDWQRFFDVNVMSGVRLSRAYMPAMLERNWGRIVFIASESALMIPKEMIHYGMTKTAQLSVSRGLAELTRGTAVTVNAVMPGPTMSEGVQTFVADLAKQNGQSESEAAANFIKQHRPGSLIQRFATVEEIANMVVYVSSKEAAATNGAALRAEGGLLQTI

SEQ ID NO: 20529 - protein, 275 aa, Rhodopseudomonas palustris
MALKTFNPTTPGQRQLVMVDRSALYKGKPVKRLTEGKNSNGGRNNTGRITVRFRGGGHKQAYRLVDFKRTKVDVPAKVERLEYDPNRTAFIALIKYEDGEQAYILAPQRLAVGDTVIAGAYVDVKPGNVMPLGNMPIGTIVHNVELKIGKGGQLARSAGTYAQIVGRDHDYVILRMNSGEQRLIHGRCIAAIGAVSNPDHMNISIGKAGRKRWLGRRPHNRGVVMNPIDHPHGGGEGRTSGGRHPVTPWGKPTKGKKTRSNKSTDKFILISRHKR

SEQ ID NO: 20530 - protein, 738 aa, Rhodopseudomonas palustris
RDPQSRDGPPACLDPVAATGCIWGATTLCRGDAMATDAYRIRVEGMDCASCALKIETAMQRLSGVADVRVSYSAGTLALRFDQDRISPSTIDDELCSLGFRPQAIASSPSSIATERKRLPWWQDAKLQSVMIAAAVFALAFALSQLFPAFERWLYSAAAAICLIPIARRALIGARSGSPFSIETLMSVAAVGAVMIGEAEEAAVVIVLFGVGEWLETFAAGRARAGIESLIDVVPRTARRLRDGSDEVEEIPAADLMIGDVVVVRPGDRIPSDGKVIDGHSDVNEAPITGESVPVAKAVGDHVYAGSINANGELRIETTNAAADNTIARIIHLVEQAQETKAPTERMIDRLSRWYTPAAMLVALLVIIVPPLGFGEDWATWIYRGLATLLIACPCALVISTPAAIASGLAAGARKGLLIKGGAVLETLGKVKTVAFDKTGTLTLGQPQVTDVVSVIGQDDAVLARAAAVEGNTSHPIGQAIVRAAKARALQTPIVFGGSQAVPGKAISARLKDGFAFVGSPHFAAERTTIPPELATTISGLEHEGKTVVVLISGKTCEGVIALRDEPRPDAAGALRQLTSKGIAVVMLTGDNARTAQAIAGQLGIEARAELLPDAKLAEIRRLKAVSPVAMVGDGINDAPALAAASVGIAMGGGTDVALETADAALLNDRAHGVAELIALSQATLGNIWQNISIALGLKAVFLATSLLGVTTLWMAILADTGATVLVTANALRLLRWR

SEQ ID NO: 20531 - protein, 386 aa, Rhodopseudomonas palustris
YRWVIVAAGGVLGCVAAGAMFSLPVLIRPMSQDTGWSVTGISTAMTIGFLAMAAASMVWGNLSDRFGPRPVVLTGSVVLAASLALGSRATSLIEFQLLFGALVGAATAAVFAPMMACVTGWFDTGRGLAVSLVSAGMGMAPLTMAPLAAWLVTIHDWRGAMLIISAITAALMIPAALLVRRPPALEPGGAEGAWADAQDDMTLRQAVRSPQFVTLLLANFFCCATHSGPIFHTVSYAVTCGIPMIAATSIYSVEGLSGMFGRLGFGLAGDRFGAQRVLVIGLLAQAFGVLAYAFVGGLGGFYAVAVAVGFIYAGTMPLYAVIIRENFPLRMMGTIVGGTAMAGSLGMSTGPVLGGLIYDAYDSYAPMYVASCGMGLAAMLILATFR

SEQ ID NO: 20532 - protein, 266 aa, Rhodopseudomonas palustris
  unsure (1)..(266): unsure at all Xaa locations
MNLFDLSGKVAVITGSSRGIGKAIAERMAEHGAKVVISSRKQDACDAVAKSINDTYGAGTALALAANISSKDDLKRLAQEATQTFGKIDALVCNAASNPYYGPQAGINDDQFRKILDNNIVANHWLISEVVPQMIARKDGSITIVSSIGGLKGSTVIGAYCISKAADMQLARNLACEYGEHNIRVNCIAPGLIKTDFARALWENPETLKASTARSPLQRIGEPDEIAGAAIFLASKAGTFTTGQTIVIDGGATISXPLGSFRGARS

SEQ ID NO: 20533 - protein, 247 aa, Rhodopseudomonas palustris
LEGKSIIITGAGSGIGRAASLLFTKEGAQLIAVDRTEGVQETVEQVRKAGGTAEAVMADAGSEDDVKGFVAKAIAVYGKLDGIWANAGISGGLLPLPEQTPEHWQEILRVNLIGPFLAIKHATPHLIKQGHGAIVCTASVAGLKSGASGHPYAASKAGVISLVQTTAYSLSGTGVRINAVCPGLIETGMTKPVFDGARARGTDHKIGQLNPLKRAGQPHELATMGLFLLSDEASYVNGQAFPVDGGL

SEQ ID NO: 20534 - protein, 399 aa, Rhodopseudomonas palustris
MSDRQREWLDRVTKFMNDHVRPAVPIYKQQDAEGERWKVIPVLEELKAKAKAEGLWNLFLPPSSHDDDEFHGAGLSNLEYALLSEQMGHISWASEVFNCSAPDTGNMEVLFRYGTKEQKQKWLRPLMAGEIRSAFLMTEPAVASSDATNIETRIEKDGDHYVINGRKWWSSGVGDPRCKIAIVMGKTDPNAARHQQQSQILVPLDTPGITIEKMLPVFGFDDAPHGHGMVKLENVRVPASNLLLGEGRGFEIAQGRLGPGRIHHCMRTIGKAEEALEKMVKRLQSRVAFGKRIIEFSVWEQRIAEARIDIEMNRLLCLKAADMMDKVGNKTAQLEIAMIKVAAPRMAQRIIDEAIQAFGGAGVSDDAGLAKDYANIRTLRLADGPDEVHNRAIARLEMK

SEQ ID NO: 20535 - protein, 522 aa, Rhodopseudomonas palustris
NITHGLRRALQINPEELATVCAGRRRNWREVGDRVARLAAGLRASGVGEGERVAILSLNSDRYLEMYLAAGWCGGVIVPLNIRWSALENEDALKDCRAVALVVDKAFAATGGALAQAMPSMALIYADDGDVPPGMQSYEDLIATHAPIPDAMRKAEDLAGIFYTGGTTGRSKGVMLSHGNLMANALNALGEGLFPGTSVYLHAAPMFHLANGAAMYSLLLSGGSNVMIPSFTPEGVMQAMQNDRVTDVLLVPTMIQMFVDHPALKNYDLSSLKNIVYGASPISEAVLARASAALPNVQFTQAYGMTELSPIATLLHWKEHIGEGKAKGRQRAAGRATLGCEVRIVDADDRTVPYGTVGEICVRGDNVMMGYWERPEETARALAGGWMHTGDGGYMDEHGFVYVVDRVKDMIISGGENVYSVEVENAVAQHPAVAQCAVIGIPHEAWGEQVHAVVVTKAGATVTAEELIAHCKALIAGYKCPRSVEITETPLPLSGAGKILKRELRQRIGRAANVASADAPAG

SEQ ID NO: 20536 - protein, 387 aa, Rhodopseudomonas palustris
VHVAGVGMIPFVKPGANEPYHLMGAEAARLALRDAGLGYDAIQQAFVGYVYGDSTCGQRALYQVGMTGIPIVNVNNNCSTGSTALYLARQAIASGAADCVLALGFEQMKPGALGSVFVDRPSAFEDFDAAADQLIDAPGVPLALRYFGGAGLSHMQKYGTPLSSFAKVRAKASRHAAKNPLALFRKEVSADDVLNDQVIWPGVMTRLMACPPTCGGAAAVLVSEAFARKHGLNTDVRIAAQAMTTDTPSTFEAHDMMRVVGYDMARAAATKVYEDAGVGPDDIDVVELHDCFAHNELITYEALGLCPEGGAEKFIADGDNTYGGQFVTNPSGGLLSKGHPLGATGLAQCYELTRQLRGTAEATQVGGAKRALQHNLGLGGACVVTLY

SEQ ID NO: 20537 - protein, 273 aa, Rhodopseudomonas palustris
KLQGKVALVTGSGRGIGRAIALKLASEGARVIVNDLDAEPGDAVAAEIKAMGSDAIAINGSVSEAGFADRFVGAAVEKFGGLDIIVNNAGYTWDSTIQKMTDEQFQAMLDVHLVAPFRILRAAAEPIRIFAKKEAEAGQEVFRKVVNISSIAGLYGNAGQASYSSAKASLVGLTRTLCKEWGRYKVNVNCVAFGLINTRLTQPIEAQQKTIDVAGRDIKVGVQPQMLEAMARMIPLGRGGTPEEAADAVYLFCSPESNYVSGQVLVCGGGLIL

SEQ ID NO: 20538 - protein, 253 aa, Rhodopseudomonas palustris
VKIATFNVNNVNKRLPILLAWLKTARPDIVCLQELKAAEADFPEAALRKAGYAAAWVGQKSWNGVAVLARRREIVVTRRRLPGAPHDKQSRYIEAAVAGIIVGCLYAPNGNPQPGPKFDDKLAWLKRLNRHAATLLKSGAPVVLAGDFNVVPTPADIYPGKSWDKDALVQPAPRKLFAALLRQGWTDALRHCHPEDAPYTFWSYWRNRFERDAGLRIDHLLLDPSLAARLKRAGVDRKVREAPEASDHAPAWI

SEQ ID NO: 20539 - protein, 684 aa, Rhodopseudomonas palustris
SRGEGGELHQTAEDLGTEVMTTAQGGPISDDQNTLKIGPRGPALIEDFHFREKIFHFDHERIPERVVHARGYGAHGFFETTHSLAKFSRADLFQRVGERTPAFVRFSTVAGSKGSVDLARDVRGFAVKIYTKEGNWDLVGNNIPVFFIQDAIKFPDLIHSVKEEPDRAFPQAQSAHDNFWDFISLTPESMHMVMWVMSDRAIPRSFRFMEGFGVHTFRLVNADGESTFVKFHWKPKLGMQSVLWNEAVKINGADPDFHRRDLWTAISTGNFPEWELRVQLFDQEFADKFDFDILDATKIIPEEIIPPVPVGRLVLDRMPDNFFAETEQVAFMTQNVPPGIDFSNDPLLQGRNFSYLDTQLKRLGSPNFAHLPINAPKCPFAHFQQDGHMAMHNPVGRANYQPNSHGLGPRESPQRGFVPFPEAEEGAKAKFRAESFADHYSQARQFYLSQTRTEQHHIVSALTFELSKVEISVIRERVLSHLLLIDETLATNVANRLGIKAMPKPADAAVPTRQDLPPSPALSIIENGPERFGGRKLGILITDGTDAALLKSLQKAVEKAGATFELIAPRVGGVIASDGSEIAAHQMIDGGPSVLYDAVALLPGDDEIDDLLQESTARDFVADAFAHCKFIGYVAAARPLFAKAGIGDDLDEGCIELAARKDAGAFVDQLGKLRVWARESVVKM

SEQ ID NO: 20540 - protein, 693 aa, Rhodopseudomonas palustris
VREGLPYPLGSCWDGHGTNFALFSANATKVEVCLFDGDTERRIELPEYTDEVFHGYIPDIGPGTFYGYRVYGPYEPENGHRFNPNKLLLDPYARAHAGLLTWDPAVFGYVMESGDDTTFDERDSARFVPKCVVVDPDFDWKGEPGRKFVPWDQAIIYETHVKGFTKLHPDVPEHLRGTYAGFGTKPVVDYISSLGVTAVELLPIHTFVNDSYLLDKNLVNYWGYNTIGFFAPDPRYAADVPNSLREFKEMVARLHDVGLAVILDVVYNHTAEGNELGPTLSFKGIDNASYYRLLPEQKRYYINDTGTGNTVNLTHPRVIQMVNDSLRYWAGEMHIDGFRFDLGTILAREHYGFDEQSGFLKSVMQDPLLSSVKLIAEPWDCGPGGYQVGGFPPGWAEWNDKFRDTARDYWRGEAPAAALAPRLSASGDVFNRQGRRAWASVNFITAHDGFTLNDWASYNDKHNEANGEDNRDGHSDNRSWNCGAEGPTDDETILSLRERQKRNMLATLLLAQGTPMLLAGDEFGRTQNGNNNAYCQDNEISWVHWDHDEAAQHLRAFTQRLLELRRTTPTLRRSRFLTGQYDETLDVRDVTWINANGGEMQQEHWDDSNVKCFGMLLDGRAQTTGIRRLGEEATVLLVLNGFDGMVEFTLPEVPHGTKWSLLIDTNLPHGVPDEEFECGAAYQVTARSVLLFK

SEQ ID NO: 20541 - protein, 453 aa, Rhodopseudomonas palustris
PMVKPTGFREYDARWLFGQEINLMGVQALGMGLGTLIAELGRPQEIVTGHDFRGYSASIKYALIAGLMASGCKVHDIGLAVTPMAYFAQFELDVPCVAMVTASHNDNGWTGVKMGANRPLTFGPDEMNRLKEIVLGAAFKQGAGSYVFHPNFPARYIADLTKHAKLKRKLKVVVACGNGTAGAFAPQVMEAIGCEVIPLDTELDHTFPKYNPNPEDMEMLHAIRDAVLQHKADLGLGFDGDGDRCGVVDDTGEEIFADKVGVMLARDMSAIHPNARFVVDVKSTGLFATDPVLQQQGAQTEYWKTGHSYMKRRTNELNALAGFEKSGHFFFNAPLGRGYDDGLVSAIAICEMLARAPGKSMSDLKNALPKTWSSPTMSPHCADEVKYRVIDQVVKHFEAAKTNGDLVAGQPIRDLVTVNGVRVTCEDGSWGLVRASSNKPELVVVVESPVSEQ

SEQ ID NO: 20542 - protein, 226 aa, Rhodopseudomonas palustris
KVALITAGGSGMGAAAARRLAADGFRVAVLSSSGKGEALASELGGFGVTGSNQSNDDLKRLVDQAMAQWGRIDVLVNSAGHGPRAPILEITDEQWHQGLDVYFLNVVRATRLVAPIMLQQKAGAIINISTAWAFEPSAMFPTSAVARAGLAAYTKIFADQYAADNVRMNNVLPGWIDSLPATEQRRDTVPMKRYGTSAEIAATIAFLASDGAAYITGQNIRVDGGL

SEQ ID NO: 20543 - protein, 202 aa, Rhodopseudomonas palustris
LEPSEFLEVAVQPDQPRPSRAEAEAAVKTLLSYIGENTEREGLIDTPRRVVEAYDELFQGYHQCPKEVLERTFGETAGYDDFVLVRNISFTSHCEHHVMPFYGKAHIAYTPVERVVGLSKLARLVDIFARRLQTQEHLTAQIAAAIDEVLKPRGVAVLLEAEHTCMSVRGIAKKGATTFTSRYTGVFRDNPAEQARFMSMVR

SEQ ID NO: 20544 - protein, 230 aa, Rhodopseudomonas palustris
AGKAALVTGGSKGIGFAIAQALAQAGASVMICARDESEIAQALPALRNGVRGRVHGLACDVRDEAEVRQLVDHTVTAFDGLDILVNNAGVGLLGPVETFPPEHWRLTLDTNLTGAFYCCHYAIPALKARGGGAIVNIGSRSSVNAYGGGAAYCASKFGLLGLSESLLQELHPFGIRVSCVMPGRVATDFAGEPPQDWHLSADDVAQAVIDVLSFAPRALASRIELRPARP

SEQ ID NO: 20545 - protein, 244 aa, Rhodopseudomonas palustris
GRRAMVTGAAQGIGLAIARTLALHGAQVVLVNLKHESGEAAARAITNAGGDARFIVGDMSDEDAIAATVAASTAAIGGLDILVNNAAPTQRARPPFAEQSAALWDTTEAVMLRGYMLTAQAALPHLAQARGAIVNLSSVLARSVAHETAAYHVAKAGVEQLTRYLAWHLGRSGVRVNAVAPGVVDRDIGAKLSDDPVNRAVLEAAVPLGRAATGAEIAEVVAFLCSPAAGYITGQTLVIDGGLS

SEQ ID NO: 20546 - protein, 622 aa, Rhodopseudomonas palustris
LAADAVRPLVRIVIVGHVDHGKSTLVGRLLHETGSLPEGKLEMLKAVSARRGMPFEWSFLLDALQTERDQGITIDTTQIRFRTPSRDVVLIDAPGHAEFLRNMITGASQADGAVLIIDALEGVRDQTRRHGYLLQLLGIKQVAVVVNKMDRVEFSAARFGDISNEITAHLTSLGITPTAVIPISAREGDGVAERTDNIAWYDGPTVVEAIDKLTPAQPLDALPLRLAVQAIYKFDDRRIVAGRIESGHLRAGDDIVIMPAGKIAKIKTVEGWPVTPLAGAFGAGRSVGITLDRELFVERGDVIGHAGNAPRDTRRLRARIFWLHDQPLTAGASVLVRLGTRETRANVVAIEKAVDPGDLASEAATEIKRNHVGEIDLSLSQPVAADPADNNPRTGRLVIEINGRIAGGGLVLSVDSGQRAATADIVPVESALLPGERAARYRHNGAVLWFTGLPGSGKTTIARALERRLFDRGGSPILLDGDTLRAGLNSDLGFSPADRAENIRRLGEIAAHLAANGHIAIVAAVSPGLADRAAARRIAGDRFREIHVATSAEVCEQRDPKGHYAKARSGGLPNFTGIGNDYQPPTASELVLDTAGLSVGEAVAQVETMLAQTDVLIEDPAD

SEQ ID NO: 20547 - protein, 489 aa, Rhodopseudomonas palustris
HHAEVRPERIAVVDLASSRKISYRAMDERVDRLAAHLAALGVGRGDRVAVLALNAVETLEVQFACFRLGAIFVPLNVRLTVHELSYIVGDAAPRVLAHDDELAPMAKELKAACSVPHLLAFGAAYEAALAASPRLGASEPVTLDDVSTIMYTSGTTGKPKGAMITHGMTFINAVNLGIPAFISQRTVFLCVLPLFHTGGLNCYTNPVLHAGGTTLLMRAFDPGAALSIIGDPSVGLTHFFGVPSIYQFMCQHPAFAATDLSRLQIAGVGGAPMPVPLLKIWQERGCALVQGYGMTETSPAVLMLDADDAARKAGSAGKPVLHADLKIVGPDGDPVKPGEMGELWVKGPNITPGYWNRPDANRTSFTDGWLHTGDAARVDDEGFYYIVDRTKDMYISGGENVYPAEVEDVLYQLPEIAEAAVIGAPDPQWGETGVAVVALKPGQELSEAKLLAHCRERLARFKCPQRVSFVEALPRNATGKVHKPTLRER

SEQ ID NO: 20548 - protein, 946 aa, Rhodopseudomonas palustris
MALVHETDFGTPPSLSENMVTLTIDGRSVSVPEGTSIMRAAMEIGTAIPKLCATDMVDAFGSCRLCLVEIDGRSGTPASCTTPVADGLVVHTQTERLKQIRKGVMELYISDHPLDCLTCSANGDCELQDMAGAVGLRDVRYGYSGEKHPNPGLDESNPYFTYDASKCIVCSRCVRACEEVQGTFALTIAGRGFDSVVSPGMQESFLGSECVSCGACVQACPTATLNEKSVIEIGTPERSVVTTCAYCGVGCTFKAEMRGEELVRMVPYKDGKANRGHSCVKGRFAWGYANHKERILKPMIRGKITEPWREVSWDEAFAYAASELKRIQAKYGRDSVGGITSSRCTNEETFLVQKLIRAGFGNNNVDTCARVCHSPTGYGLSTAFGTSAGTQDFDSVEHADVVMIIGANPTDGHPVFGSRLKKRLRQGAKLIVVDPRRIDLVRSAHVEAAQHLPLKPGTNVAVLTALAHVIVTEGLANEAFVRERCDWSEYEHWAAFVSDEKHSPEATAAFTGVDPQAVAKPRGCTPPAATARSYYGLGVTEHSQGSTTVMAIANLAMATGNLGRPGVGVNPLRGQNNVQGSCDMGSFPHELPGYRHISTDAVRESFEALWNVKLDNEPGLRIPNMLDAAVEGSFKALYVQGEDILQSDPNTKHVAAGLEAMECVIVHDLFLNETANYAHIFLPGSTFLEKNGTFTNAERRIQRVRKVMTPKNGLEDWEVTLRLAEAVGYKMNYTHPSQIMDEIAALTPTFTGVSYDRLEELGSIQWPCNERAPEGTPVMHIDHFVRGKGKFVITEYVATDERTGPRFPLLLTTGRILSQYNVGAQTRRTANTVWHDEDRLEIHPHDAEQRGVRDGDWVRLASRAGETTLRALITDRVAPGVVYTTFHHPDTQANVVTTEYSDWATNCPEYKVTAVQIAPSNGPSEWQRSYEQQAAAARRIAVPAEA

SEQ ID NO: 20549 - protein, 327 aa, Rhodopseudomonas palustris
HGGDLTAAMARHGGDAADWLDLSTGINPRPWPIPDIAADAWLRLPSQADETALCDAARLAYEVPDESGIVAAAGTQALIQWLPYLAAPGGVAIVGPTYAEHALAWRNAGRELVGIASLDDIPEQARHAVVVNPNNPDGRVVEPDTLRRAAAQLRRRGGWLVVDEAFADVDPSFSAASLTPELPIVVLRSFGKFYGLAGVRLGFAIAGEATARRIALALGPWSCSGPALRIGAAALRDQAWTIETRDELREQATRLDDVLRVGGFEIVGGTPLFRLARHAEAHRLHEALAQQRIWCRRFDWADDLLRFGLPADAAGLDRLAAALAAPL

SEQ ID NO: 20550 - protein, 1244 aa, Rhodopseudomonas palustris
MHLKLDTSVSIDDGDVARDLGQSTADIVVLSAADSDLAAFGAARAGMPDDYPTLQLTNFLALGHPASVDLYVERTLAKAKLVMLRMLGGEAYWPHGVDSLRRDALARGAQFVCIPGEMEWNAELAARGTADLDDAHALWRYCSEGGVDNIRLALRYAAWMILRDDCPPPARPMPAAGFWPAEPPSSPRRRALVIFYRALAASGDTAAIAALRDALTARGLDPVCVFVTSLKDARSIAFLRSVLTATPPDVIVNATAFATATATDESGVLASADCPILQVAQAGVTREHWEQSGRGLNPRDLAMHVVLPEVDGRVFAGAVAFKQRGGDAEFAPTVYQPLQDRIDAVADLARAWVRLRHLQRDQRRVAIVLANYPNRDGRLGNGVGLDTPQSLHDLLFTLRTEGYLTGELPADTAALMDRLQRGPTNELDDRAARDGGVSWPVADYAAAFEGLPQAVCDAVTARWGAPEDDPHVADGVFRLGLHRFGNILVGVQPARGYAIDPKSSFHDPELPPPHHYVAFYLWLRQAFGADAVIHLGKHGNLEWLPGKSAGLSRDCFPAALLGPLPHLYPFIVNDPGEGIQAKRRSAAVIVDHLTPPMTRAELHDEMARLEALVDEYAMAADLDPNRADAIAEDIISLARATRLDEDVAIDRDTATLDALRAIDAHLCDLKEMQIRDGLHVFGRTPQASQRDELLVSIARLPRSELKPQDASLHRALARDLGLTASDGAEFDPLTRDLATPYIGARPAVLAALSDRPWRTSGDTVERVEMLALQLVSTLHQAAPSPARDEAERPQPLPHTQPVLDWIATSLRPAIEASGDAEREALLRGLDGRFIRPGPSGAPTRGRPDVLPTGRNFFAVDVRAVPTPSAWRIGQLAAERLVESYWQEAGEWPRSIALSAWGTANMRTGGDDVAQALALIGVRPTWEDATGRVTGFAIVPLSELRRPRVDVTFRVSGLFRDAFPVQMDLIASAVAAVAALDEPADANPIAAQVRLRSEQLVQSGVDPELAKKQAGARVFGARPGSYGAGLQAMIDDGGWTSRDDLADAYLAWGGYAYGAGQDGAEATDAFAARLKAVDLVAQAQDNREHDILDSDDYYQFIGGLAATVESLRGQAPRIAHVDTSRPEAPLPRTLAHEISRVVRGRAANPKWIQGVMRHGYKGASEIAATVDYLFGFAASTDAVGNRHFDLLFAAYLEDDAVRQFLQDTNPAALRDIVARFDEAIRRGLWTPRSNRAADVLAEILT

SEQ ID NO: 20551 - protein, 224 aa, Rhodopseudomonas palustris
AIEAENLTCRFGDFTAVDHVNFQIKRGEIFGFLGSNGCGKSTTMKMLTGLLTPTEGEARLFGEVLDASDMATRKRVGYMSQSFSLYSELTVRQNLLLHAQLFELPSAQIPDRVAEMLTRFDLADAADSRPDSLPLGMRQRLQLAVAVIHRPEVLILDEPTSGVDPVARDSFWRMLIALSREDGVTIFISTHFMNEAERCDRISLMHAGKVLAVGAPHELVERRG

SEQ ID NO: 20552 - protein, 367 aa, Rhodopseudomonas palustris
MDIRAAVFREVGAALRVERIVLDPPQPTEVLVRLAAIGLCRTDYHVMRGERRVAMQPMVLGHEAAGIVEAIGDQVQGVAPGDHVVLTFIPGCGHCRWCQRGLHHLCAEGPRITHGPQLDGSFRRRDAGGRDVGAFCMIGAFAEATVVDQASVLVIDKDIPLDHASLIACGVPAGVGAARHRARVKPGDTVLVVGCGGDGMNVVQGAKLCGASMIIAADIVAQKLEWARDFGATHGTTAQGDELISTVLALTDGIGVDHAFVCINPAETLLPAFRATTKAGNVVVTAITPDTVKQIDVPPLELFATQKAIMGAVYGFASPRLQIPELLGLYRRGDLKLGELISRTYRLDEINQGYADLDAGRNLRGVV

SEQ ID NO: 20553 - protein, 516 aa, Rhodopseudomonas palustris
TMPLRDYNAAVDFVDRNVAEGRGGKIAFIDPQRSLSYGELRDAVARVGPMLARLGVEQENRIALVLKDTVDFPILFWGAIRAGIVPVLLNTRLTADQYRYLLEDSRSRVVFASSEFLPVIEEAAADLPHLRTIIAVGDAPAPTLQLANLLATEQEGGAPAATCADDIAYWQYSSGTTGMPKGVMHVHSSPRVMAENAGRRIGYREDDVVFSAAKLFFAYGLGNAMFCPMGIGATSVLYPERPTADSVFDTLRLHQPTLLFAVPTLYAAMLADPRSRTETLPDRLRLCVSAGEPLPAQVGLNWRNRFGHDIVNGVGSTEMGHLFLTNLPHAVEYGTSGVPVDGYRLRLVGDRGQDVADDEIGELLVSGGSSAAGYWNQRDKTRTTFVGEWTRTGDKYHRRADGVYTYCGRTDDIFKVSGIWVSPFEIEQALMSHAKVLEAAVIPAEDTDGLIKPKAFIVLASRGDIDPGALFDELKEHVKSAIGPWKYPRWIQIMDDLPKTSSGKLQRYLLREMTLG

SEQ ID NO: 20554 - protein, 524 aa, Rhodopseudomonas palustris
MNAAAVTPPPEKFNFAEHLLRTNRVRPDKTAFVDDISSLSFAQLEAQTRQLAAALRAIGVKREERVLLLMLDGTDWPVAFLGAIYAGIVPVAVNTLLTADDYAYMLEHSRAQAVLVSGALHPVLKAALTKSDHEVQRVIVSRPALRWSRARSTSLSSSARRCPLEKPAATQADDPAFWLYSSGSTGRPKGVVHTHANPYWTSELYGRNTLHLREDDVCFSAAKLFFAYGLGNALTFPMSVGATTLLMGERPTPDAVFKRWLGGVGGVKPTVFYGAPTGYAGMLAAPNLPARDQVALRLASSAGEALPAEIGQRFQRHFGLDIVDGIGSTEMLHIFLSNLPDRVRYGTTGWPVPGYQIELRGDGGGPVAAGEPGDLYIHGPSSATMYWGNRAKSRDTFQGGWTKSGDKYVRNDDGSYTYAGRTDDMLKVSGIYVSPFEIEATLVQHPGVLEAAVVGVADEHGLTKPKAYVVPRPGQTLSETELKTFIKDRLAPYKYPRSTVFVAELPKTATGKIQRFKLREGVLG

SEQ ID NO: 20555 - protein, 251 aa, Rhodopseudomonas palustris
RLQNKTAVITGGGGGIGGATCRRFAQEGAKIAVFDLNLDAAEKVAGAIRDAGGTAEAVRCDIADRTSVDAAIATTTTTLGPVDILVNNAGWDIFKPFTKTEPGEWERLIAINLTGALHMHHAVLPGMVERRHGRIVNIASDAARVGSSGEAVYAACKGGLVAFSKTLAREHARHGITVNVVCPGPTDTALLADVTSGAANPEKLIEAFTKAIPLGRLGKPDDLAGAIAFFGSDDAGFITGQVLSVSGGLTM

SEQ ID NO: 20556 - protein, 374 aa, Rhodopseudomonas palustris
MNPYLNEDLVALAAQARRFAADRIAPGFQERDRTRVLDRGLMKAMGEMGFIAPELPEVCGGLGMGSLAAGVIHEEIARADLSMSYVNLLASLNGQILSQHGRPEIVQPWLAKLIGGEALFAIALTEPRGGSDAANLRLRIERDGDDYIVNGEKTSISAADQADAAVVFGRTGSIDAGAHGVTALLIPMDLPGITRNRFDCHGQRAIGRGSLFFENVRVPAAHRLGDENKGFVQVMQGFDFSRALIGLQVLAVARVALEETWAHVAERQAFGKPLSAFQGVSHPLADLDTQVEAARLLCLQALWLKDHGAPHSAEAAMCKWWAPKLAYDVIHQCLLMHGHGGYDRGPMEQRLRDVLGFQIGDGTAQIMKTIIARH

SEQ ID NO: 20557 - protein, 485 aa, Rhodopseudomonas palustris
NMEFDAVLLPPRRAASIAAGLWHDRTINDDLDACVAHCPDKVALTAVRLDGGAVRRFSYRELATLADRVAVGLNRLGVGRGDVVAMQLPNWWQFTVLYLACSRIGAVLNPLMPIFRERELSFMLKHGDAKVLVVPKSFRGFDHEAMARSLQPDLPALRTIVVVDGGGADDFDTLLTTPEWEKQPDAAAILQGSRPSPDDITQLIYTSGTTGEPKGVMHSANTLMANIVPYAQRLALRESDVILMASPMAHQTGFMYGLMMPIMLRASAVLQDIWEPTKAAELIRTERVTFTMASTPFLTDLTRVVKESGEPVPSLKTFLCAGAPIPGPLVEQAQAGLGAKIVSAWGMTENGAVTLIKLDDDDKLASTTDGCPLPGVEVKVIDGDGKTLPPNQIGRLVVRSCSNFGGYLKRPHWNGTDADGWFDTGDLAYMTADGYIRISGRSKDVIIRGGENIPVVEVEALLYKHPAVAQVAIVAYPDERLGERA

SEQ ID NO: 20558 - protein, 285 aa, Rhodopseudomonas palustris
QARILSEALPHMQRYDEETIVIKYGGHAMGAEDTAKAFARDIVLLEQTAVNPVVVHGGGPQIAQMLKRLGIKSEFAAGLRITDAATIEIVEMVLAGSINKQLVGYINEAGGKAVGLCGKDGNMVSASKATRTMVDPDSRIEEVIDLGFVGEPEKVDLTLLNQLIGHELIPVLAPLATSASGQTFNVNADTFAGAVAGALRAKRLLLLTDVPGVLDQNKKLIPELSIKDARKLIADGTISGGMIPKVETCIYALEQGVEGVVILDGKVPHAVLLELFTNQGTGTLI

SEQ ID NO: 20559 - protein, 253 aa, Rhodopseudomonas palustris
MPADIRIVPCLTDNFGYLVHDPATGATASIDAPEAAPLIAALDKEGWKLTDILVTHHHGDHVGGIAELKKKYQCRVHAPHDANAKIADADVRLQEGDVVRVGDLTARVLETPGHTLDHLSYVFDDDRALFAADTLFSIGCGRVFEGTYPMMWESLLKLRALPDDFKLYCGHEYTASNVKFALGIEPDNAALQARAKQVESLRAEGKPTIPVTLGEEKQANVFLRADVPSVAAAVGMPGAPAAEVFGEIRERKN

SEQ ID NO: 20560 - protein, 757 aa, Rhodopseudomonas palustris
  unsure (1)..(757): unsure at all Xaa locations
LLRRLRETMAEQVSAQERLDKIVVLIAANMVAEVCSVYVLRIDNTLELYATEGLNREAVHQTVLNAHEGLVGLVASEATPLNLSDAQSHPAFSFRPETGEEIYHSFLGVPILRAGNTLGVLVVQNRAKRTYVEEEVEALQTTAMVLAEMIASGELSALAQPGAEPAARHSIHKTGAVLSDGIALGHVVLHEPRVVITNYIAEDLPKEIKRLDAALAKLRSDLDRMLERGDFAEGGEHRDVLEAYRMFANDHGWSHKLHEAVATGLTAEAAVERVQSDTRARMLRSTDPYLRDRLHDLEDLGHRLMRQLVGQDHAPSREQLPDNAILIARSMGPAALLDYDRKRLRGLVLEEGTANSHVSIVARALGIAAIGEVPNAPGIADPGDAIIVDATSGSIYVRPSAEIEAAYAERVRFRARRQAQYSALRDLPCATKDGQPIDLMINAGLTIDLPHIEDTGSSGIGLFRTELQFMVGQSLPRSSDQLALYRAVLDAAGSKPVTFRTLDIGGDKALPYMETVVEENPALGWRAIRLGLDRPGLLRSQIRALLRAAAGRYLRVMFPMISEVAEFDAAKSIIERELTYLRQHGHTLPERVDVGTMLEVPALLYQLDELFKRADFVSVGSNDLFQFLFAVDRGNSKVSERFDTLSAPILRALRDIVRKARAAKRSLSLCGEMASQPLAALALIAIGYRSLSVSALAHGPVKAMILGLDLAKAEAMIGPLLDAPAGSVSIRDKLIEFAEAHQLALXRRGCPAAALSS

SEQ ID NO: 20561 - protein, 414 aa, Rhodopseudomonas palustris
MGRLVMKFGGTSVANIERIQNVARHVKREVDAGHEVAVVVSAMSGKTNELVAWCTEASPLHDAREYDAVVASGEQVTSGLLAIALQSLGIQARSWQGWQIPILTSDAHASARIVGIDGSEIIKRFSERKEVAVIAGFQGIHAETGRITTLGRGGSDTSAVAIAAALKADRCDIYTDVDGVYTTDPRVVPKARRLDKVSFEEMLELASLGAKVLQVRSVELGMVHNMPIFVRSSFDKPEDIDPHGTPPGTLISSEENSMENHVVTGIAFSKDEAQISVRRIEDKPGVAASIFGPLADANINVDMIVQNVSEDGKTTDLTFTVPASDFARAKQTITSAQDKIGYARFDSETDVAKVSVIGSGMRSHAGVAAQAFAALAARNINIRAITTSEIKFSVLIDAAYTELAVRTLHTLYGL

SEQ ID NO: 20562 - protein, 398 aa, Rhodopseudomonas palustris
MPMIAGVRLATAAAGIRYKGRTDVLLVEMEKGTTVAGVFTTSKCASAPVEWCRDKLKGGSARALVVNSGNANAFTGKSGKQAATLTAQLAAKAIGCKPAEVFLASTGVIGEPLDATKFDGVLDALALDAGPDGWMDAAKAIMTTDTFPKVATATVKLGKAKVTINGMAKGAGMIAPDMATMLSFIFTDAPLSASCLQALLKAGVTDTFNAVTIDGDTSTSDTLLAFATGAAAENGAPKISRASDPRLKAFVKAFNAVLADLAEQVARDGEGARKLVEIIVEGAKTKVSARKIALSIANSPLVKTAIAGEDANWGRVVMAVGKAGEPADRDKLSISFNGIRVAKAGARDPSYNEKEVSAEMKKPVIQIKVALGLGKGRDRVLTCDLTKEYVAINGDYRS

SEQ ID NO: 20563 - protein, 467 aa, Rhodopseudomonas palustris
SGDGEVRHLKRSLSAVNLVALGVGGIIGAGIFVLTGHAAAANAGPAVSLSFLLGAITCAFAGLCYAEMASTVPVSGSAYTYAYATIGELVAWIIGWDLILEYAVGAITVAIGWSGYFVSLLGNFGIHLPPQFTTAPLAYDAATHAWSTTGAFLNLPAIAIVVAIATLLVIGIQESARFNNVIVGIKLTVIALFLIFAAPMVTPANWVTAANPDGAFIPPAQENGIFGWSGVLRGAAVVFFAFIGFDAVSTAAQEAKNPQRDMPLGILGSLAICTVLYVSVAFVLTGIVPYDRLNVPDPIAVGIDAAGIGWLSSIVKIGVVTGLTSVILVLMLGQTRVLRAMAHDGLMPRGAAATHPRFRTPHVATIGTGVIVAGLAGVLPIGLVGELVSIGTLFAFAVVCVGVLALRIKHPEQHRPFKVPAIWLVAPAGAIVSFILMLGLPLDTWIRLAVWLAIGLAIYFLYGRHHS

SEQ ID NO: 20564 - protein, 277 aa, Rhodopseudomonas palustris
RTALVTGANSGLGKAIVTALAADGLRVGLVARDRGRGEAALADVRAATGNQDLHLFVADLADQESIRALAQDVRARFDRLHLLINNAGTAFPERRLSPQGIERAFAINHLGPFLLTNLLLDLIKASAPARIVNVGTRIDAAIDFDDLNWDKRPYGMMKGYAQSKLGNLHFTFELARRLEGSGVTVNCVFPGVFKSNLGGTDGAQGLFWKLLAKLGGWAIPKPESAAQRVLYLANAPELESVSGQYYANRKTIPAPAQALDAEANRRLWEISERMTGL

SEQ ID NO: 20565 - protein, 418 aa, Rhodopseudomonas palustris
SLFGQVVTALVLGVVVGALWPEVGVALKPLGDLFIKLIKFAIAPLVFGVVVNGIVGAGDLKKVGRVGLKSLIYFEAVTTLALALGIALAYVFQPGAGMNVNTATLDGSALAGYSSHVKEVTGFTDFIMRLVPTTFIDAFAKGDVLQVLIIAILFGAGLSLLGERGKPLADSIERITEVLFKIIGIIVKLAPLGVLGAVSFTVAKYGIGSLKQLGLLVGLFYVGVALFVFVILGGIMRLAGFSLIKLLAYLREELTVVAGTASSDSVLPQVMRKLERLGIKDSTVGLVIPTGYSFNLDAFSLYLTLATVFIAQATNTPLSFGHLLVILGIALLTSKGAHGVPGSAIVVLAATLSAVPDIPLIGLVLVLSVDWFVGIARALGNLVGNCVATVVIAAWEGDIDRAQAKRVLNGEVTPTPRR

SEQ ID NO: 20566 - protein, 816 aa, Rhodopseudomonas palustris
LPIDDALDELTAALEASNTAVLVAPPGAGKTTRVPLALLDAPWLRNQKIIVLEPRRIAARASAERMAKTLSEKAGERIGYRVRFGSKVSRATRIEVVTEGIFTRQILDDPELNGVAAVLFDEFHERSLDADLGLALARDAQQGLREDLRILVMSATIDGARVARLLGDAPVVESLGRAFPVETRYLGRRSDAPLERQMAEAIAQALRAETGSVLAFLPGAAEIRRTETMLRERVQDPAVEIVPLFGALDAAVQDRAIQPAPKGQRKVVLATSIAETSLTIEGVRIVVDCGLSRVPRYEPDLGLTRLETVRASRAAVDQRRGRAGRIEPGVCYRLWDEPQTASLPAYTQPEILSADLSSLLLDLAQWGVADPSSLAFLDPPPQPALKEARELLGELGALDPDGRITDEGRSLRAMALPPRLARMIVDAARHDCAKDAAEVAAILTERGLGGDSADLDNRRDQFRRDRSQRASSARQMAQRWATQAASSSPSPQDAGELSSGVLLAFAFPDRVAKNRGNGSFTLANGRGAAVEQTSALARAPYLAVGELTGSAAQGRILLAAPIALSEIELHFGDQITDADEVSFDRSAMALRARRRRALHAITLSEAPLALTPSEQTARVLAEGLVVAGLDRLPWSKQLQQWRGRVMFLRKAEGDPWPDLSDAALAETRENWLVPALFDKTGLKDFSASDLSDALMNLLPWELRARLDREAPTHFEAPTGSKLPIDYEAEQGPTIAVRLQELFGLTTHPSVAGGAVPLVLELLSPAHRPVQVTRDLPGFWRGSYAGVRADLRGRYPRHPWPEDPASAPPTRRAKPKG

SEQ ID NO: 20567 - protein, 239 aa, Rhodopseudomonas palustris
MTRVALVTGGTRGIGAAISKALKAAGYKVAASYAGNDSAAEKFKNETGIPVYKWDVSSFDACAEGVKKVEAELGPVDVLVNNAGITRDGAFHKMTLEQWNAVINTNLGSLFNMTRQVIEGMRTRKFGRIVNISSINGQKGQFGQVNYSAAKAGDIGFTKALALENARGGITVNVICPGYINTEMVQAVPKDVLDKAILPLIPCNRLGEAEEIARAVVFLAGDDAGYITGSTLTINGGQY

SEQ ID NO: 20568 - protein, 387 aa, Rhodopseudomonas palustris
VVIVSAARTAVGSFNGAFANTPAHELGAVAIKAALERGGIDPAQVSEVIMGQILTAGQGQNPARQASIAAGIPVDSPAWGINQLCGSGLRSVALGYQALMNGDSDIVIAGGQESMSMAPHAQYLRGGVKMGAVELVDTMLKDGLWDAFNGYHMGNTAENVARQWQITRDQQDEFAVASQQKAEAAQKAGKFKDEIVPVTIKTRKGDIVVDTDEYPRHGATLEAMAKLKPAFEKDGTVTAGSASGINDGAAAVVLMTAKQAEKLGKKPLARIVSWGQAGVDPKIMGSGPIPASRAALKKAGWSVGDLDLIEANEAFAAQACAVNKDLGWDTSKVNVNGGAIAIGHPIGASGARVLVTLLHEMQKRDSKKGLATLCIGGGMGIAMCLAR

SEQ ID NO: 20569 - protein, 296 aa, Rhodopseudomonas palustris
AKRLDTTAEETEALLGRLLSDELMSDEIARPRRLMDAIRYSTLGGGKRLRPFLAVESAAVFGIDRAAALLVGAALECIHCYSLIHDDLPSMDNSDLRRGRPTLHKAYDDATAILAGDALLTFAFDIVTRDEVHNDPTVRLLLTRVLARCAGLGGMVGGQMLDLAGEGRFGDREPVDVARLQQMKTGALLRYGCVAGAILGQASPDQYRALDDYGRALGEAFQIADDLLDVEGDAAALGKPAGADAALGKTTFVTQLGIDGAKQRLRDLVARADQALAPFGERGEVLRAAARFVAER

SEQ ID NO: 20570 - protein, 401 aa, Rhodopseudomonas palustris
MADVFVCDAVRTPIGRYGGSLAKVRTDDLAAVPIKALMAKHPDMDWSAVDEVFFGCANQAGEDNRNVARMAALLAGLPDSVPGQTLNRLCASGLDAVGAAGRAIRGGEIDLAITGGVESMTRAPFVQGKATEAFARSADIFDTTIGWRFINPLMKQQYGVDSMPETGENVAEEFQISRADQDAFAIRSQQRAGAAIAAGYFAEEIAPVTYAGGKAGPITVDKDEHPRPETTLEGLAKLKPIVRNPGTVTAGNASGVNDGAAALLIASEAAVKKYGLTPRAKILGLASAAVPPRIMGIGPVPATRKLMERLGLKISDFDLIELNEAFASQGIACLRQLGVADDADFVNPHGGAIALGHPLGMSGARLALTAVHGLEKRGGKLALATMCVGVGQGVAMAIEKL

SEQ ID NO: 20571 - protein, 877 aa, Rhodopseudomonas palustris
SPMMEQYHEIKAANPGLLLFYRMGDFYELFFEDAEIASRALGITLTKRGKHLGADIPMCGVPVERSDDYLHRLIALGHRVAVCEQTEDPAAARARKSVVRRDVVRLITPGTLTEDTLLDARANNYLLAIARARGSAGADRIGLAWIDISTGEFCVTECSTAELAATLARINPNEAIVPDALYSDTELAPTLRELAAVTPLTRDVFDSATAERRLCDYFAVATMDGLAALSRLEATAAAACVTYVDRTQLGKRPPLSPPAREATGSTMAIDPATRANLELTRTLAGERRGSLLDAIDCTVTAAGSRLLAQRLAAPLTDAATIARRLDAVEAFAVDSGLREQIRSSLRAAPDMARALARLSLGRGGPRDLANLRDGIRAADEVLVQLAQLASPPQEIASAMAALQRPSRELCAELGRALADDLPLLKRDGGFVREGYEPALDETRKLRDASRLVVASMQARYADDTGIKALKIRHNNVLGYFVEVSAQHGEKLMAPPLNATFIHRQTLAGQVRFTTAELGEIEAKIANAGDRALGLELEIFDRLAGSIDAAGDDLRAAAHAFALLDVATALAKLASDDNYVRPEVDESLAFAIEGGRHPVVEQALKRAGEPFIANACDLSPGPAQKNGQIWLLTGPNMAGKSTFLRQNALIALLAQVGSFVPAIRARIGIVDRLFSRVGAADDLARGRSTFMVEMVETAAILNQASERALVILDEIGRGTATFDGLSIAWAAIEHLHEQNRCRSLFATHYHELTALSAKLPRLFNATVRVKEWRGEVVFLHEVLPGSADRSYGIQVAKLAGLPPSVVSRAKAVLAKLEANDRGQPKTLIDDLPLFAITARAPAEAAPPSEAEQLIDAVKALHPDEMTPREALDALYALK

SEQ ID NO: 20572 - protein, 194 aa, Rhodopseudomonas palustris
PRMPRMSETVPTAAAGRSPQEAEIVAALGDRPVVLIGMMGAGKSTVGRRLALRLGLPFLDADTEIESAAAMTIPEIFETHGEPHFRDGEARVISRLLDGGTKVLATGGGAFMREETRDRIREKAISMWLEAEADVILRRVKRRADRPLLKTPDPAGTIARLIAERYPLYREADITIASRDVPHEKIVDECVAAL

SEQ ID NO: 20573 - protein, 364 aa, Rhodopseudomonas palustris
TVEVALGDRAYEIVIGRDVIASLGERIAKLRPGARTAIVTDRTVAKTWLKRTEEVLDQAGIAHASVIVGEGESSKSYAGLEQVCEALIAAKIERNDLVIALGGGVIGDLAGFSASLLRRGVDFVQVPTSLLAQVDSSVGGKTGINSPQGKNLIGTFHQPVLVLADTAILDTLSPRQFRAGYAEVAKYGALGDEAFFAWLEANHAELFSGGAAREHAVATSCRAKAAIVARDERETGDRALLNLGHTFGHALEAATGFSDRLFHGEGVAIGMVLAAEFSAERGMMPATDAERLAKHLAEVGLPTRLQDIAGFTQEGLADADRLMALMAQDKKVKRGELTFILMEGIGRAVIASKVEPAPVRDFLQ

SEQ ID NO: 20574 - protein, 251 aa, Rhodopseudomonas palustris
IVTGSASGLGAATAKILAKDGARLVINYASSKDDAEKTAEECRKLGAAEVIVVQGDVAKDEDCKRIVEAAAPWGKLDALVNNAGTTKHVAHHLLDQLSADDFQRIYAINTVGPYQMVRAARELLVAGAKAAGRASAVVNVSSVAGISGIGSSIAYAASKGALNTMTLSLSRALAPNIRVNAICPGYIDTPWFTKGRGAEEAKQVRDMVVSRVPLKIASTAEDIAELVCFLATPKSSSMTGELVRMDAGMHL

SEQ ID NO: 20575 - protein, 474 aa, Rhodopseudomonas palustris
RWTYAQLNDDARRCASWLLTQFKTGDHICVWAPNVPEWIVLQYGAALSGLVLVTANPALKASELEFVLQQSQSVALFHLDAFRGVETGAVARSFASAKLRCISFSGWLAEIRRTEIGALPRIDPGQPAQIQYTSGTTGRPKGALLHHRGLITNASYVAARAGLDHSVLLSPMPLFHTAGSIMSVLGCLNSRSTLVLPLLFDPGTVLDAIAHTRADTLFGVPTMLLAVIDAQLQAPRDLSSLRVAASGGAQVPPELHRRIHDALKLPLLTVFGQTELSPIVSQTCIDDPDEQRIHSVGRPLWNVEVRIVDPNGDRVVVIGVEGEIQVRGYQTMLGYFNAPKETSETITADGWLRTGDLGAMDEAGYLRITGRLKDMIIRGGENIYPAEVEACLLRHPAVADISVFGAPDDKWGEVVAAAVRLVPDVPVTATELSAFCKTEIAPHKAPTVWYACTGFPLTASGKIQKFRLRDAAVE

SEQ ID NO: 20576 - protein, 290 aa, Rhodopseudomonas palustris
EFSTLTIAPDPNAPRIARLVLNRPDRFNAINDAMPREIRAAVEWAQAEDAIHVIVIEGAGKGFCGGYDLVDYAESDIDHPCQQEKEPWDPLVDYAAMKRNTEDFMSLWRCSKPTIAKIHGAAVAGGSDIALCCDMIVMADDARIGYMPTRVWGCPTTAMWTFKLGPTRAKQMMFTGDVITGQTAAEWGLVNLSVPVAELEQATMKLATRVAGVPKSHLAMHKLVVNQVMLNMGLEQTQMLATIFDGVSRHNPEGLWFRRYAQDAGFKAAIEWRDSGRPIPEGDDARARIR

SEQ ID NO: 20577 - protein, 455 aa, Rhodopseudomonas palustris
AVTNPASGQTIAKVPHLGAAEATQAVEAAAQAFPAWAKLTAKQRSNILRKWFELIIANREDLALILTSEQGKPLTEALGEVDIGAAYVEFFAEEARRVYGETIPTQRADARLIAIKQPIGVCGAITPWNFPSSMITRKVSPALAAGCTVVLKPAEETPLSAFALAALAEKAGVPKRVFNVLTGDAPAIGKVLCEHPAVRFVGFTGSTEVGKILYKQASVGVKKLGLELGGNAPFIVFDDADVDAAVEGAMVSKYRNMGQTCVCANRLYVQDGVYDAFVEKLAAKVKAMKVGDGTEQGVTQGPLINEAAVEKTERHIADALSNGAKIITGGKRHALGGTFFEPTVLADVRPDALVAHEETFGPLAPVFRFKDEAEVIKLANNSPFGLASYFYARDLGRVWRVAEALESGMVGVNTGLITTEVAPFGGVKESGLGREGSHHGIEEYVEIKYVMMAGI

SEQ ID NO: 20578 - protein, 546 aa, Rhodopseudomonas palustris
PSYVCGVSDAPLLGITIGQALDRAVALWPDREALVSPSHDTRWTWSEFAARVDALAAGFLALGLERGARIGIWSMNRPEWTLTQFAAAKAGLILVTINPAYRLSELEFALAKVGCAALVTATAFKTSHYMEMLNTLIPELAISSPARCNRPSCPKLRTVIQIGGPKAPGTIAFDEVAAMGGARHRDQIAAFASELQFDDAVNIQFTSGTTGSPKGVTLTHHNILNNGYFVGRAMKLTEADRICIPVPLYHCFGMVMGNLASVTSGAAMVYPGEGFDPLVTLQTASREKCTALYGVPTMFIAELDHPEFASFDLSSLRTGIMAGAPCPVEVMRRVNDAMNMREVTIAYGMTETSPVSFQSAVDDPEDRRVSTVGRIHPHVEVKVVDLDGKIVPRGQRGELCTRGYSVMLGYWDEAEKTADVLDAAGWMHTGDLATIDDEGFCNIVGRIKDMVIRGGENLYPREIEEFLYRHPKIQDVQIFGVADDRYGEELCAWVRPRPGETLTADDVRAFCQGQIAHNKIPRYIEFVDEFPMTVTGKIQKFIMREK

SEQ ID NO: 20579 - protein, 313 aa, Rhodopseudomonas palustris
QYDVLAIGNAIFDVLVRTEEDFLVKHGMAKGGMALIDEARAAAIYADMGQATEMSGGSAANTIVGLASFGARTAYLGKVKDDQIGKLYTHDIRAAGVTFDTKPATAGPATGCSYILVTPDGQRTMNTYLGAAQDLSPADIDEAKIAASAITYLEGYLWDPPQAKEAFLKASQIAHGAGRKVALTLSDAFCVDRYRGEFLELMRSKTVDLIFANEAELHSLYQTSDFDAALTLLAQDVALGVVTRSEKGCAVVDKDGVTLVPAAAIDQLVDTTGAGDLFAAGFLFGLVRNLGYENAGRLGALAAAEVIQHIGAR

SEQ ID NO: 20580 - protein, 213 aa, Rhodopseudomonas palustris
ELVIFDCDGVLVDSELISCRVHAETLTRYGYPITPDQVAARFLGRSGREARREIEAEIGRRFADDIEANLLDALLRAFAETLQPIPFVTDALDTLGRPFCVASSGTLDRIGVALTHAGLHARFAPHLFSAQQVAHGKPAPDLFLFAAAQMGAAPECCVVIEDSVPGVLGAKAAGMTVLGFHGGSHCTDATAAALAAAGAGRCFDDMRQLSGII

SEQ ID NO: 20581 - protein, 639 aa, Rhodopseudomonas palustris
PAAKPGASKQRGRLTVVTALNADDVRERSIASFRRRTQRLKGHASNEPKEKLVREVVIPEVIAIQELANRMSERAVDVIRLLMKQGAMHKITDVIDADTAQLIAEELGHTVKRVAASDVEEGLFDVVDDSTDTEPRSPVVTVMGHVDHGKTSLLDALRHANVVSGEAGGITQHIGAYQVTSPESGKKITFIDTPGHAAFTAMRARGAKVTDIVVLVVAADDGVMPQTIEAINHAKAAGVPIIVAINKIDKPDAKPDRVRTDLLQHNVQVESMGGDVVDVEVSAKNKINLDKLLEMIALQAEILELKTNTQRPAEGTVIEAKLDRGRGPVATVLVQRGTLRVGDIIVAGAEMGRVRALISDQGETVQEAGPSVPVEVLGFNGPPEAGDRLAVVENEARARQITDYRAHQKREKSAASVSGMRGSLEQMMTQLKTSGRKEFPLIVKADVQGSLEAILGSLEKLGTDEVAARILHAGVGGISESDVTLAEGFNAVILGFSVRANKEAAAAAKRNGIEIRYYNIIYDLVDDIKKAMSGLLAPTLRETMLGNAQILEIFNISKVGKVAGCRVTDGTVERGANVRLIRDNVVVHEGKLSTLKRFKDEVKEVVAGQECGMAFENYTDMRAGDIIECYRVETIQRSL

SEQ ID NO: 20582 - protein, 735 aa, Rhodopseudomonas palustris
DRRDTMDAKTDDKGAGKCPFSGGSHGHRNRDWWPDQLDISVLHNNSKKSDPMGAAFNYAEEFKKLDLEAVKKDLHALMTDSQEWWPADFGHYGGLFVRMAWHSAGTYRITDGRGGAGAGQQRFAPLNSWPDNANLDKARRLLWPIKQKYGSKISWADLMVLTGNVALESMGFKTFGFAGGRADVWEPEELYWGPEGTWLGDERYSGERQLAEPLGAVQMGLIYVNPEGPNGNPDPVAAAKDIRETFARMAMDDEETVALIAGGHTFGKTHGAGDPSLIGPAPEGGLLEEQGLGWTSKYGTGFGADAITGGPEVIWTQTPTQWSNHFFENLFGFEWELDKSPAGAKQWKAKGAEATVPDPFDPAKKRVPTMLTTDLSLRFDPIYEKISRRFLENPDQFADAFARAWFKLTHRDMGPRERYLGPEVPKEELIWQDPIPAVNHELVGEADIEALKAKILASGLSVAQLVSTAWASASTFRGSDKRGGANGARIRLAPQKDWEVNQPAELAQVLGKLEAIQGEFNGAQKDGKKVSLADLIVLGGAAAIEKAAKDAGTAVKVPFTPGRMDASAEQTDVESFKVLEPRADGFRNYINTKRHQFMHPEEALVDKAQLLTLTGPELTVLVGGLRVLGANYAHSTHGVLTERPEKLTNDFFVNLLDMGTKWTKANGEVEIYEGRDRKNGELKWTGTRVDLVFGSHSQLRAFAEVYACSDAQEKFVSDFVAAWSKVMNADRFDIV

SEQ ID NO: 20583 - protein, 252 aa, Rhodopseudomonas palustris
GLMQGKRGLIMGVANDHSIAWGMAKTLAAHGAELAFTYQGEALARRVKPLAQSLNSDLVLPCDVEDIASVDAVFDTLKDKWGKLDFVIHAIGFSDKNELRGQYIDTSRANFSRTMVISCFSFTEVAKRAAALMPDGGAMITLTFGASERAMPNYNVMGLAKAALEASVRYLACDLGPKGIRVNAVSAGPVRTLAGAGIGDSRAMFGFMEKHSPLGRGVTLEELGGSALYLLSDLSGGVTGETHYVDSGYNIV

SEQ ID NO: 20584 - protein, 405 aa, Rhodopseudomonas palustris
MRRVVVTGMGIVSSIGNNTQEVLASLHDAKSGISRAEKHAELGFRSQVQGAPTLNPADVVDRRAMRFLGEGAAWNHVAMEQAIADSGLEESEISNIRTGIVMGSGGPSARTIVEAADITRTKGPKRVGPFAVPKAMSSTASATLATWFKIKGVNYSISSACATSNHCIGNAYELIQWGKQDVMFAGGCEELDWSLSVLFDAMGAMSSKYNDTPATASRPYDVNRDGFVIAGGAGVLVLEELEHAKARGAKIYGEIIGYGATSDGYDMVAPSGEGAERCMKMALSTTGGIKIDYINPHATSTPAGDPPEMNAIRAVFGIGDKCPPISATKALTGHSLGATGVQEAIYSLLMMQNGFICESAHITELDPAFADMPIVRKRVDNAKLGAVLSNSFGFGGTNATLVFKR

SEQ ID NO: 20585 - protein, 246 aa, Rhodopseudomonas palustris
VTLITGASAGIGVELARIFADNAHRVALVARRGDRLESLAAEIRAKGGPEPIVIACDLGKPDAAEQIIAALAAAGVEVEYLVNNAGYGLFGRAMELDRESQLGIIDVNNRALTDLTLRFADSIARLRGGILNVASIAGFLPGPGMAVYYASKAYVLSFSEAMHQELGPKGVRVTALCPGPVQTEFQNRAGFEPGFDSAVLNVTPAEVARQAYQGLMNNKRIVLPGLGVKIVPFLLRFFPRGFIAAA

SEQ ID NO: 20586 - protein, 286 aa, Rhodopseudomonas palustris
MTARIIDGKTISAEVRARVAAEVTRLKTDHGITPGLAVVLVGNDPASEVYVRSKHKQTQEAGMASFEHRLPADVPQAELMALIAKLNADPAVHGILVQLPLPKGLDSNAVIDAIDPAKDVDGLNPTNAGRLASGLFALTPCTPLGSIIMAKTVHASLEGMNALVIGRSNLVGKPLVQLLLNENATVTIAHSRTRDLPALCRQADLVFAAVGKAEMVKGDWIKPGATVIDVGINRTPGKDGGKDKLLGDVAFAEAKEVAGAITPVPGGVGLMTVACLLVNTVRAACA

SEQ ID NO: 20587 - protein, 415 aa, Rhodopseudomonas palustris
VSAVVGSRMPSSSFPSSVDIAIIGAGASGLGAARTLEGMGLSVIVLEARNRIGGRAWTRMVTPEIAFDVGCGWLHSADENSFVGIAKQLGIGIDKTHPPWGEASFGDVFPKRDRAAFGKALDAFYERVWRAAKNKTDVAAATLLEPGNRWNPMIDAVSTYVNGAELDRISVHDLESYRDTGINWRVREGYGSLIAAYGAPCPVALNCVVEQIDHSERRIKINTSLGTLSASQIIITVPTNLIADEAIRFAPALPGKVEAARHLLLGVDDKVMLKLSDSNGFPADGNLRAATMRSAMGTYHLRPFGQDCIEGFFGGRYARELEDAGEGAFAAQAIDEIADLLGNDIRRKLSPLAESRWAHDPFARGAYSHALPGHAGARAVLAAPVDGRLFFAGEATSPQFFSTAHGARDSGERAA

SEQ ID NO: 20588 - protein, 238 aa, Rhodopseudomonas palustris
LVTGAASGMGRATAHVFAEEGARVAVTDVTLAGAQPVADAIKARGGDATAFALDVGDAQAIRSGVEQIAQSLGGLDIVINNAGISAALPIDDANYEAVWDRALAILLTAHPRVIRAALPYLRKSQSPRIVNIASTEALGATATHSPYSAAKAGVTGLTRSLAVELGPEGITVNCICPGPITTGMTDRISAEHKQKYARRRTALHRYGDPEEVAHMTLSLCLPAASFITGAVIPVDGGL

SEQ ID NO: 20589 - protein, 285 aa, Rhodopseudomonas palustris
GLWLPLITPFRDGELDAASLRRLIAHYARAPLDGLILGATTGEGLTLDEAELERLVMLTADALAASDRKLPVYLGLSGSDTRKLVKTLARTAHWPIDGVLIACPYYTRPSQRGLVLHFEAAADATARPILIYNIPYRTGVNLQNEAMLRLAERANIVGVKDCCADPAQTAELLRLRPPGFAVLTGEDALAFDALSRGCDGAILASAHLETEAFAAMMHRLQAGDRLGGATEWQRLADLPKLLFAEPSPAPVKYALWRRGLIDSPEVRLPMTPVSPTLAAAIDARM

SEQ ID NO: 20590 - protein, 323 aa, Rhodopseudomonas palustris
MTVVGISKPGGPEVLLPETRDVPKPGPGEILVKVAAAGVNRPDVAQRSGSYPPPPGASDLPGLEIAGEVVALGDGASRHKLGDKVMSLVAGGGYAEYCIAQDAQAMKVPAAYSMIEAGATPETLMTVWHNVFERGGLQPGETLLVHGGSSGIGTMAIQLAVALGSKVITTVGSQDKADACLKLGASRAINYKTEDFVAAVKEATGGKGVEVILDMVGGDYIERNYDAAAMDGRIVQIAFLGGAKANVNFVKLMTKRLHHTGSTLRPRSNADKAAMVAAIEAKVLPLLEQGRIKPLIDGTFALRDAADAHRRMETSQHIGKIVL

SEQ ID NO: 20591 - protein, 601 aa, Rhodopseudomonas palustris
  unsure (1)..(601): unsure at all Xaa locations
TLRADADPSQVEEVAAVVKRSRLKPLLSLMPYVARYRGRATLALIALIVAAATTLVVPVAVRRLIDFGFSAEGVELINGYFSVMLGVVVVLAAASAARYYLVMTIGERIVADVRRDVFRHLTALSPAFFDSARSGELISRLTADTTQIKSAVGASVSIALRNMLLFVGAISMMVISSPRLSGFVLAAIPLIVIPLVAFGRWVRRLSRNAQDTLADASAYAAELVGAIRTVQAYTNERVANARFGGAVEESYEAARSSTGARALLTAIIIFIVFASVVAILWVGSHDVAIGAMSPGRLGQFILYAVFAASSLGQLSEVWGEVSAASGAAERLFEILRVKPEIAAPAKPKALPMPVRGDVLFDNVSFSYPTRPDFLALDGLSLSIKAGEKVAIVGPSGAGKSTLFHLLLRFYDPTSGTIALDGVAINAADPQAVRERIALVPQDSVVFAATARDNISFGRDDASELDVERAAQQAHATEFISRLPEGFDTKLGERGVTLSGGQRQRIAIARAILRDAPLLLLDEATSSLDAESEVLVQTALQQLMRDRTTLVIAHRLATVLSCDRIVVMEHGRIVEQGTHAQLVARGGLYARLAKLQFEAAXV

SEQ ID NO: 20592 - protein, 333 aa, Rhodopseudomonas palustris
ADLNQIARAMVAPGKGILAADESSGTIKKRFDVIGVESTETNRRDYREMLFRSKEAMSDYVSGVILYDETIWQNAADGTPLVKLIEQAGSIPGIKVDEGTQPLPNCPGETITVGLDKLAERLAKYYKQGARFAKWRAVIDIDTARGVPSHTAIMTNAHALARYAALCQQAQIVPIVEPEVLMDGAHDIDTCYNITEWVLKETFQQLYFQRVALEGMILKPNMAVPGKKSAKKASVQEVAEKTVKLLKACVPSAVPGIAFLSGGQSDEEATAHLDAMNKIGGLPWGLTFSYGRALQAAPQKAWSGKAENVAAGQAAFTHRARMNSLAAKGEWSA

SEQ ID NO: 20593 - protein, 392 aa, Rhodopseudomonas palustris
FRTLDDVDVKGKRVLLRVDLNVPMDAGKVTDTTRLERVMPTITELSGKGAKVILLAHFGRPKGRDDKNSLKPVAAALADVIKKPVGFADDCIGEPAAKAIAAMADGDILCLENTRFHPEEEKNDPAFVAKLAELGDIWVNDAFSAAHRAHATTEGLGHKLPAYAGRTMQAELVALNKALEAPVKPVIAIVGGAKVSTKIDLLENLVTKVQALVIGGGMANTFLHAQGVKVGKSLCEKDLAPTALRILDKAEAANCAIILPVDATVAYHFEANAPSFAYGLDAIPDDAMILDVGPRSIERIHAAIDDAATLVWNGPVGAFELTPFDKGTVEAAKHAAKRTKAGKLVSVAGGGDTVAALNHAGVADDFTYISTAGGAFLEWMEGKPLPGVEVLQ

SEQ ID NO: 20594 - protein, 331 aa, Rhodopseudomonas palustris
MAVRVAINGFGRIGRNVLRAIYESGRKDIEVVAINDLGPVETNAHLLRFDSVHGRFPFEVKVDGDTIDAGRGKIKVTAIKDPSALPYKEVGVDIALECTGIFTARDKAATLLTAGAKRVLVSAPSDGADATIVYGVNHETLSKDHMVVSNGSCTTNCLAPVAKVLNDTVGIETGFMTTIHAYTGDQPTLDTMHKDLYRGRAAAMSMIPTSTGAAKAIGLVLPELKGKLDGVAIRVPTPNVSVVDLKIIAKKATTKEEINEAIKRAAEQELKGILGYTNAPNVSIDFNHDPHSSTFHMDQTKVQNGTLVRVMSWYDNEWGFSNRMADTAVAI

SEQ ID NO: 20595 - protein, 655 aa, Rhodopseudomonas palustris
DHSRMANAIRALAMDAVEKAKSGHPGLPMGAADVATVLWTQFLKFDAVDPHWPDRDRFILSAGHGSMLLYALLYLTGNEELTLDQIKNFRQLDSKTPGHPENCITSSVETTTGPLGQGVASSVGTALAERLLQAEFGDIVDHYTYVLCSDGDLMEGVSHEAIALAGHLRLSKLIFLYDDNGISIDGPLSLTDTVDQVARFQAHGWNSFRIDGHDHKAIADAIRKAQASDRPTMIACKTTIGFGAPHKAGTSKAHGEPLGAEELAGAKKALGWDYGPFEIPDDVLSAWRNVGKQGASARADWLARFDALPADKRGDFKRRVIDRKRPAAIADAIRTLKDKLVAEPQTIATRKASELALEALTPVVPELLLGSADLTPSNNTRVKQAKDVTPDDFSGRYIHYGIREMGMAAAMNGLAMHGGFAPAGGTFLCFTDYARPSMRVAALSHVPVVYIMTHDSIGLGEDGPTHQPVEHLAALRAMPNMRVFRPADAVETAECWQLALENTNGPTLLALSRQNLAQVRTATSEANLCATGGYELIPAPGKAQVSIFATGSEVEIAVAAQKLLEVQGVAARVVSVPSLDLLLAQDDATRAAIIGDAPVKVAVEAAVRFGWDAVIGPDGGFVGMTGFGASAPAKDLYKHFGITAEAVADAAKRRL

SEQ ID NO: 20596 - protein, 630 aa, Rhodopseudomonas palustris
TEFSKTPLLDTIRTPEDLRKLRIDQVRQVADELRLETIDAVSVTGGHFGAGLGVVELTTALHYVFDTPRDRLIWDVGHQAYPHKILTGRRDRIRTLRTGGGLSGFTKRTESDHDPFGAGHSSTSISAGLGMAVASELAGKKNNVIAVIGDGSISAGMAYEAMNNAGAMNSRLIVILNDNNMSIAPPVGAMSAYLSRLYSGKTYRSLREAGKQIGKHLPKLIADRAARAEEYSRGFMMGGGTLFEELGFYYVGPVDGHNLDHLLPILQNVRDADTGPFLIHVVTQKGKGYGPAEAAADKYHAVVKFDIATGAQAKAKSNAPSYQNVFGQSLVKEAQKDDKIVGITAAMPSGTGIDIFEKAFPKRTFDVGIAEQHAVTFAAGLATEGYKPFCAIYSTFLQRAYDQIVHDVAIQKLPVRFAIDRAGLVGADGATHAGSFDNAYLGCLPNMVIMAAADEAELVHMVATQVAIDDRPSAVRYPRGEGRGVEMPEVGIPLEIGKGRVIRQGNKVALLSFGTRLAEAEKAADELATLGLSTTVADARFMKPLDVELVLKLARDHEVLLTIEEGSIGGFGSHVMQTLAEHGMLDGEVKMRALVLPDVFMDHDNPVAMYARAGLDAKAIVKKVFDVLGK

SEQ ID NO: 20597 - protein, 537 aa, Rhodopseudomonas palustris
PAPRAAELLPPPVDLRILAINDFHGNLQPPPGGIAIDDPADRTKKIHVSAGGAEHMATLVKALRKDHPNAIFVAAGDLIGASPFLSAMFHDEPTIESLSLMGLALSSVGNHEFDEGKTELLRMQNGGCHPVDGCQGPHPFKGAAFNYLAASTVETATGKTVFPPYAIRKFGGVPVAFIGLTLKNTPNMVSPPGVAGLSFKDEAETVNALIPELKAKGVEAIVVLIHEGGFPTGDYNECPGISGPIVEIVNKLDRAVDVVISGHTHRAYTCRIDGRLVTSGDKYGTIVTAIDLKLDPTTGDIISAAANNTIVRTETLAKDPAQTELIAAYDKLAGPIAARPAGSVTAALSRMSNAAGESVLGDVVADAQLAATLDKDKGGAEIALTNPGGVRSDILGGEGGAVTFGQVFAAQPFRNQLVTMTLTGAQLKAALEQQWAEPARPRILQVSKGFHFAWDAAGAPGGRIPPDRMSLNGAPIDPNRTYRVTLNAYLAAGGDGFTVFKDGAAPQTGVYDVDALFSYFKTHSPVAPPPTDRVTRL

SEQ ID NO: 20598 - protein, 576 aa, Rhodopseudomonas palustris
TYRAPIDDILLSLNHGAGLQAAVAAGHFGDYDSEITAQVLDEAGKFASDILAPLNRVGDKHGIKLEHGKVTTAPGWPDAYQRWIAAGWNAVSGPEDFGGQGLPMAVNAACTEIWASSNMAFGLCPLLTLSAIDALHTHGSDALKQVYLGKLISGEWTGTMQLTEPQAGSDVGALRTRAERAADGSYRIFGSKIFITYGDHDMTDNIVHFVLARLPDAPAGTKGISLFLVPKFLVNADGTLGARNDIYPSGVEHKLGIHASPTCTMTMGDHGGAIGYLIGEENRGMQCMFTMMNQARLAVGLEGVGIADRAYQQALAYAQERKQGRAIGSAGPGSDPIIKHPDVKRTLLTMRALIGAARTICYSTAVALDIAARSTDPKVKASAAARGALLTPIAKAFSTDIGIEVASLGVQIHGGMGFIEETGAAQHYRDARIAPIYEGTNGIQAIDLVTRKLGANGGASVFALLDELTLIVKDVEASNDPGFGLTGLRLREGLEALDRTSRYLLDKLGSDTNDALAGATPYLRLFGATLGGCALAAEALAARDLEGINDPSRYVALARFFAETVAVQAPALERSV

SEQ ID NO: 20599 - protein, 375 aa, Rhodopseudomonas palustris
  unsure (1)..(375): unsure at all Xaa locations
TEELDTFRDQFRKFLAKDLAPHSDTWRKQKMVDRSAWLKLGEMGALLPSVPEEYGGLGASFAYDAAVYEDMEKIVPDALSGVTVSSGIVAHYILNYGSEEQKRRWLPGMARGELIGAIAMTEPGTGSDLQSVRTTAKLDGDDYVINGQKTFITNGQNCDLIIVVARTGGAGAKGLSLIVLETKDNPGFKRGRNLDKIGLHASDTSELFFENARTPKENLLGGEEGKGFVQLMQQLPQERLIIAIGAVAAMERAVALTSEYTRERKAFGQPIIEFQNTAFTLAERKTEAFIARVFVDYCLVQLVAGNLDAVTASMAKWWTTQKQVETVDECLQLHGGYGYMQEYPIGRMFIDSRIQKIYGGTNEVMKLLIARSLXH

SEQ ID NO: 20600 - protein, 479 aa, Rhodopseudomonas palustris
DRALSYRELDLLVRKIAVSLAALGIGKGDRVALFLGNCWEFLAVTLACNRLGVLVVPIGIRQRRAELEFLLNNSGAKVVVFEAELTDEIPAAAEVPQLAHRFVAHGTAEGARPFEDLLAAEPANAPLAEMHEDDTAVILYTSGTTGKPKGAELTHLSILHSSYAFARAHELTERDRGLVAVPLSHVTGLVGVSYATIAAGGCVVLMRQAFKTVDFLALAARERITYSILVPAIYTLAVMHPEFDKHDLSAWRIGCFGGAPMPVPTIEMLAKRLPNLQLRNAYGATETTSPTTIMPQAYWRDHMDSVGQAVPYAHVRVLDADDNEVAPGEPGELLIAGPMVVPRYWQRPDANAKEFVNGYWRSGDIGSIDQDGFVRVFDRKKDMINRGGFKIFSAEVENVICGIDGVLETAIIGTPDPVLGERVNAIVVTSEGASLSERDVAAYCAARMSDYKVPESIIIRSEPLPRNANGKIQKTVLRE

SEQ ID NO: 20601 - protein, 310 aa, Rhodopseudomonas palustris
MERVNATILSRTGSDVTMIPEVANHLISSGGKRLRPMLTLAMANLTGYTGDGHIKLAAAVEFMHTATLLHDDVVDESEMRRGKKSARMLWGNEASVLVGDFLLGQAFRMMVEVGSLRALDILSSASATIAEGEVMQLAAAKNTATTEDEYLAVIRGKTAELFAAACEVGPAIANRPKPEQSACRSFGMNIGIAFQLIDDVLDYGGKAAKLGKNVGDDFREGKITLPVVLAFRRGNDAEREFWIKSLERGEISDADLDQAIKLMTKHRALDDTIQRAHHYGAMAVDALALFPSSPMKTALEQVVAFCLARS

SEQ ID NO: 20602 - protein, 880 aa, Rhodopseudomonas palustris
VYTFGDGKAEGRANMRDLLGGKGANLAEMANLGLPVPPGFTIPTSVCTYFYANGKTYPKELQSQVERALDHVGKLTNKKFGDAKNPLLVSVRSGARASMPGMMDTVLNLGLNDQTVEALAEKSGDRRFAYDSYRRFITMYSDVVLGFEHHHFEEILDAYKDAKGFTLDTDLDADDWVDLVGQYKEAVARETGEDFPQDPHAQLWGAIGAVFSSWMNARAVTYRRLHDIPESWGTAVNVQAMVFGNMGETSATGVAFTRNPSTGESRLYGEFLINAQGEDVVAGIRTPQDITEHARIESGSDKLSMEMAMPEAFKELTRIYTLLEKHYRDMQDMEFTIEQGKLWMLQTRGGKRTAKAALRIAVELANEGLINRKDAVTRIEPGSLDQLLHPTIDPNAKRDVIATGLPASPGAASGEIVFSSDEAAKLHADGRKVVLVRIETSPEDIHGMHASEGILTTRGGMTSHAAVVARGMGKPCVSGCGAIRVDYGRGTMMIGNRTFKAGDIITIDGGTGQVLAGKMPMIEPELSGDFNTLMGWADEVRKLKVRVNADTPADARTAIKFGAEGIGLCRTEHMFFEETRIRTVREMILAEDEQSRRSALAKLLPMQRADFVELFEIMKGLPVTVRLLDPPLHEFLPHTQAEIEEVARAMNADPRRLADRARELAEFNPMLGFRGCRLAIAYPEIAEMQARAIFEAAVEAEKRTGEQVGLEVMVPLIATRAEFELVKARIDATAQAVNRDTGSNLKYQVGTMIELPRACLMAGDIAESAEFFSFGTNDLTQTTFGISRDDAASFLGTYIEKGIFTVDPFVSVDRDGVGELVRIGVERGRKTRAKLKVGICGEHGGDPALVAFCHEVGLDYVSCSPYRVPIARLAAAQAAL

SEQ ID NO: 20603 - protein, 495 aa, Rhodopseudomonas palustris
VHGDVVIVGGGLAGLFCALKLAPRPVTVISAAPLGEGASTAWAQGGIAAAVGEGDSAESHAADTIAVGAGLVDEAVAHRLAGEAAARIHDLLSYGVPFDRDLEGRLAVAREAAHSARRIVHVRGDMAGQAIISALTEAVRNTPSIKVIEGWFADGLLMHDDAVAGLRLRKVGNAAGSPMHIAARAVVLATGGIGHLYAVTTNPIEARGVGLAIAARAGARIADPEFVQFHPTAIMVGRDPAPLATEALRGEGAILINGQGERFMLAAHPLAELAPRDIVARGVFAEVASGRGAYLDATKALGAHFAEHFPTVYESCISAGIDPATQPIPIAPAAHYHMGGIAVDMRGRSSLHGLWAAGEVSCTGAHGANRLASNSLLEAVVYAARIAEDIASTELAATKSRLDVHETHSTPIDPAQELLLRQTMAGKVGVVRDRDGLTEAVRTFAALEAETTSTTLANMATTALLVATAALARTESRGAHYRADYPTENPAQAKR

SEQ ID NO: 20604 - protein, 465 aa, Rhodopseudomonas palustris
TLSPELIARFTAIVGDKHALTDPLELEAYITEERNLYRGHSPLVLRPGSTEEVVAICKLANEARVALVPQGGNTGLVGGQTPHNGEVVISLKRMDKIREIDTSSNTITVEAGAILQRVQEKAAEVDRLFPLSLGAQGSCTIGGNLSTNAGGTAALAYGLARDMALGVEVVLADGRVMNLLSKLKKDNTGYDLRDLFIGAEGTLGIITAATLKLFPKPRAVETAFVGLQSPDDALKLLGIAQGEAAGNLTSFELIAETPLDFSVRHANNRDPLEARYPWYVLIELSSPRDDARAALESILERGFEDGIVVDAAIANSVQQQQAFWKLREEISPAQKPEGGSIKHDISVPVAAVPQFIEQANAAVVALIPGARPVPFGHLGDGNIHYNVSQPVGADKAEFLARWHDVSQVVFEVVLRLGGSISAEHGIGVMKRDELAEVKDKTAIELMRSIKALLDPHGIMNPGKVV

SEQ ID NO: 20605 - protein, 401 aa, Rhodopseudomonas palustris
RAQTKDKPAQASFKWDDPLLLEDQLTEDERMIRDTARAYAQDKLLPRINQAYLEEKTDREIFNEMGSLGLIGVTLPEEYGCANASYVAYGLVAREIERVDSGYRSMNSVQSSLVMYPIYAYGDENQRKKYLPKLASGEWVGCFGLTEPDAGSDPGGMKTKAEKVADGYRLTGSKMWISNAPIADVFVVWAKSAAHDNQIRGFILEKGMKGLSAPKVGGKLSLRASITGEIVMDGVVVPEDALLPNVSGLKGPFGCLNRARYGISWGAMGAAEDCFHRARQYTLDRKQFNRPLAATQLVQKKLADMETEITLGLQASLRVGRLMDEGKMAPEMISIVKRNNCGKALDIARMARDMHGGNGIQIEYHVMRHAQNLETVNTYEGTHDVHALILGRAITGLQAFS

SEQ ID NO: 20606 - protein, 238 aa, Rhodopseudomonas palustris
VALVTGAARGIGLAAAKRFLADGWSVALLDRDDDGLRAAMQALALPERTIALHCDVADRGSVARDIAAVTERFGRLDALVNNAGIAVFKPLMETTPDEWQRVMDVNLTGPFLMTQAAVPLMRDSGGGAIVNITSISSLRASTLRVAYGSSKAGLAHFTKQCAVELAALGIRVNGVAPGPVDTAMAKQVHTADIRSDYRDAIPMARYGLEEELAEAIFFLCSDRASYITGQILAVDGGF

SEQ ID NO: 20607 - protein, 648 aa, Rhodopseudomonas palustris
MNANLRNFALWVIIVLLLLALFTLFQNPGQRTASQEIPFSQLLSEIDQNHVRDVVIQGQEIRGTFTNGSTFQTYAPNDPSLVTRLYNGKVSITAKPPGDNVPWFVSLLVSWLPFIALIGVWIFLSRQMQGGAGKAMGFGKSRAKMLTEAHGRVTFEDVAGVDEAKQDLQEIVEFLRDPGKFQRLGGRIPRGVLLVGPPGTGKTLIARAVAGEANVPFFTISGSDFVEMFVGVGASRVRDMFEQAKKNAPCIIFIDEIDAVGRHRGAGLGGGNDEREQTLNQLLVEMDGFEANEGVILIAATNRPDVLDPALLRPGRFDRQVVVPNPDVVGREQILKVHVRKVPLAPDINLKNIARGTPGFSGADLMNLVNEAALMAARRNKRMVTQSEFEDAKDKVMMGAERKSLVMTEEEKLLTAYHEGGHAIVGLNVPATDPIHKATIIPRGRALGMVMQLPERDKLSMSLEQMTSRLAIMMGGRVAEEMVFGREKVTSGAASDIEQATKLARMMVTRWGLSEELGTVAYGENQDEVFLGMSVSRTQNASEATIQKIDAEIKRLVEEGYNEAKRILTERRADLEALAKGLLEYETLTGDEITDLIQRQEAEPRIGAGAVGPPHLGGAAGRQAAAAARSGPGAAAPGVSRPANLTSK

SEQ ID NO: 20608 - protein, 497 aa, Rhodopseudomonas palustris
MTILMPEPDQSVLARRDEIIAALRKIVPGEGVISSAAEMKPYESDGLMAYRQPPMVVVLPSTTKQVSEVLRYCHQNGIKVVPRGSGTSLSGGALPLADGVLLGLGKFKRIREIDFDNRAVVVEPGVTNLAISQAVDHAGFYYAPDPSSQIACSIGGNIAENSGGVHCLKYGMTTNNVLGCEIVLMTGEILKIGGKAAECAGYDLMGVITGSEGLLGVITEVTVRILRKPETARALMIGFQSVEAAGQCVADVISAGIIPGGMEMMDKPAIHAAEAFVHAGYPLDVEALLIIELDGPQVEVDELISRVEAIALGCGSTTCQISTSEQQRLLFWSGRKAAFPAVGRISPDYLCMDGTIPRKQLPLVLRRMNEMSEKYGLRVANVFHAGDGNLHPLILYDANKPGEQDAAEAFGADILKLCVEVGGVLTGEHGVGIEKRDLMPEMFSDIDLNQQQRLKCAFDSEGLLNPGKVFPTLHRCAELGRMHVHKGQLPFPDIPRF

SEQ ID NO: 20609 - protein, 101 aa, Rhodopseudomonas palustris
  unsure (1)..(101): unsure at all Xaa locations
INFRPLHDRVVVKRIDAETKTKGGIIIPDSAKEKPQEGQVIAVGPGGRDETGKLTPIDVKVGDRVLFGKWSGTEIKLDGEELLIMKESDIMGVVGXAASRQ

SEQ ID NO: 20610 - protein, 188 aa, Rhodopseudomonas palustris
TLPNILTYARIAAIPVVVGCIFAQSILGGPLALRWVALAVFIAAAITDFLDGHFARIWDQQSAFGRMLDPIADKLLVASCLLMLAADSIIHGWTLWAAIVILCREILVSGLREYLAALRVSVPVTRLAKWKTTAQLVAIGFLLAGEAGDEVLPFTTEIGVSLLWLSALLTMYTGYDYFRAGIHHLIEE

SEQ ID NO: 20611 - protein, 322 aa, Rhodopseudomonas palustris
  unsure (1)..(322): unsure at all Xaa locations
RMRDPYEVLGVQRDASAAAIKSAYRKLAKKHHPDSNKNDPKAAARFSEINSANEILGDETKRKQYDRGEIDAEGKPRFQGFPGGGGRAGGAGGFEQYSFRSGGGAPGGGSAVRLVSRTSXIRCSAAQPARAALVRVVAPRASTSIPASRPDLDQSVSMTVTLEEATRGTEKRVRLPTGKELNVKIPAGVSAGQQIRLKGQGESAPGHRAGDLLITVNIAPHPYFKIDGNDLKLELPLTLYEAVLGAKVRVPTLTGAIELSIPKNISSGRIFRLKGKGLPKGSAVGDLFVTTRIILPDGHDAALEKLMQKWRDEHPYNPRTEL

SEQ ID NO: 20612 - protein, 254 aa, Rhodopseudomonas palustris
SGLMQGKRGVILGVANNRSIAWGIAKACRAQGAEIALTYQGDALKKRVEPLAAELGGLVLGHCDVTDGATIDAVFDAVKEKWGKIDFVVHAIAFADKDELDGRYVDTSPENFSKSMLISCYSLTAIAQRAEKLMTDGGSIITLTYYGAEKWMPHYNVMGVAKAALEASVRYLAADLGEKNIRVNAISAGPIKTLAASGIGDFRYILKWNEYNAPLRRTVTIEEVGDSALYFLSDLSRGVTGEVHHVDSGYHVVG

SEQ ID NO: 20613 - protein, 359 aa, Rhodopseudomonas palustris
MSFNTFGHLFRVTTFGESHGVAIGCVVDGCPPLIPLTEADIQGDLDRRRPGQSRFTTQRQEADQVKILSGVMVHPETGVQVTTGTPIALLIENTDQRSKDYSDIQNKFRPGHADFTYEAKYGIRDYRGGGRSSARETASRVAAGAIARKVIAGMTVRGALVQIGPHKIDRDKWDWDEIGNNPFFCPDKDKAAFYADYLDGIRKSGSSIGAVVEIVAEGVPAGLGAPIYAKLDGDLAAALMSINAVKGVEIGDGFASAELTGEQNADEMRTGNHGPAFLSNHAGGILGGISTGQPVVARFAVKPTSSILTPRKTVDRTGHDTEILTKGRHDPCVGIRAVPVGEAMVACVLADHLLRHRGQ

SEQ ID NO: 20614 - protein, 383 aa, Rhodopseudomonas palustris
MTATTFFIPSLNLFGAGCVSSAADHAKARGFKRALIVTDSGLHKLGVADQIASMLIERNVTSVVFPGAKPNPTIKNVEDGLALLKQENCDCVISLGGGSAHDCAKGIALTATNGGSIKDYEGVDRSAHAQLPLIAINTTAGTASEMTRFCIITDEERQVKMAIVDRHTTPLLSVNDPVLMLGKPPALTAATGMDALTHAIEAYVSIAATPITDACALKAMSIISNSLRTVVAEGQNLVAREAMSYAGFLAGMAFNNASLGYVHAMAHQLGGFYDLPHGVCNAVLLPHVQAYNAQVAAGRLKDVAHALGVDTTGMTDAQGADAAIHAIQRLSADVGIPPGLGGLGMKETDVPILAANALKDACGFTNPKQATQTEIETIFRAAA

SEQ ID NO: 20615 - protein, 492 aa, Rhodopseudomonas palustris
FKARYGNFIGGRWVAPVDGRYFDNTTPITGAKLTEIPRSQKEDVELALDAAHTASVTWSKTTTTERSLILNRIADRMEANLDLLAIAETLDNGKPIRETRAADLPLAIDHFRYFAGALRAQEGSISEIDHDTIAYHFHEPLGVVGQIIPWNFPLLMAAWKLAPALAAGNCVVLKPAEQTPASILVWAELVGDLLPPGVVNVVNGFGVEAGKPLASSPRIAKIAFTGETSTGRLIMQYASENLVPVSLELGGKSPNIFFGDVTAEDDPFFDKAIEGFVMFALNQGEVCTCPSRALVQESIYDRFMERALARVAAIRQGDPRDPATMIGAQASQEQLDKILSYIDIGRHEGAELLAGGGRAQLPGGLAGGYYVHPTVFRGHNQMRIFQEEIFGPVVSVTTFKDEAEAIAIANDTQYGLGAGVWTRDGTRAYRFGRAIAAGRVWTNCYHAYPAHAAFGGYKQSGIGRETHKMMLDHYQHTKNLLVSYGTGPLGFF

SEQ ID NO: 20616 - protein, 530 aa, Rhodopseudomonas palustris
RQHGDAVVLRWKRYGLWQPVRGRQFADRIEAIAAGLRAQGVGPGSVGAVMGDNCYEWVLADLAIGAAGGVSAGLDPHGDADDLARVLGDCKASVLFVAGDDQLHKALRVRERCPSLRRIVAMHQQWDDGAGDPGVIPLSALEAAGRDGASGTAGREAVIIYTSGSTGPVRGAILGHDAVIVQAERAKQALGLRASDERLSLTPLHHVLERVVGIYASLLAGTVINFPESPDTALADLAELQPTIVQASPQLFARLHAGIMLAIGETTKFQRWACRIAFARGRGGSPLRLVTDPLVLAPIRRRLGLGRARLCLSSGAVLRPDVADWFAALGRPLTDIYGHAEAGGAVRIADHHAMEWKLGDHDELWLRGDALFLGYAGDTTPVLHRDGWWHTGDIARRESADRYAIVGRLEDVLQRGGERVLPFAAEQALSASPYIADAFVYLDAAGRAVARVLLDSDHAVRYAQDRGIPFTHFQSLCQADEIRALVGEAIADVNRRHTAIRIEHFTLIERALRAGDAELAPSGTLRRHLL

SEQ ID NO: 20617 - protein, 788 aa, Rhodopseudomonas palustris
  unsure (1)..(788): unsure at all Xaa locations
MDLTPSDEQRLLRESADRFIAETYTTKLREQNAKEPFGFSEAIWKQFADLGWLALPLPEAHGGIGGGAIEVGILMEAFGRGLVSEPYLSTVVLGAGLVAEHGRDEQKAALLPQIAEGTLRLAFAHAERAARADLSRVDTTARKDGDHYVIDGAKVAVLDGASADQLIVSARLANNGSGSLRLFLVPRDAAGLSLADYPRLGGGRACNLTLQVVRVPADAMLGTDSDAYPAIEAVVDRALAAMSAEAVGMMQTLTDKTLDYTKVRKQFGRPLAANQVVRHRLTDMSVQVDEARSMALRAALKADAEATERGRAASGAKAKIGKGARFVAEQSVQLHGGMGVTEELDVGAYFKRLLAFETLFGGSTHHYRRHAALSGRPVXAKRGIDMDMTFGDAELAFQQEVRDFIAANLTPDMKRAESLNASVFSEPETGVPWQRALNAKGWGAPGWPVEYGGTGWTPAQRWIFETECAHAGVPSPTPMGVKMVGPVIIGFGSPEQKNYFLPRILSCEDYWCQGYSEPGSGSDLSSLKTRAVRDGDEYVINGTKIWTTHAHNANMMFALVRTSDEPRQQDGISFVLIDMKSPGITIRPILTIGGDHEVNQVFFDDVRIPASNLVGQEGKGWTYGKYLLEFERGSGIASAKLRKALHRTAALAESEATGRAIEDPEIAIRMSEAEVDIDALEMTELRVLSALQNGQNPGAVSSILKLRTSEIYQAVSRLGVDVIGTDGLYVEPTRPLHRLNAQPAIPENELAVMPTHLNGRAYTIFGGTSEIQRDIISKLVLGLXARSP

SEQ ID NO: 20618 - protein, 271 aa, Rhodopseudomonas palustris
  unsure (1)..(271): unsure at all Xaa locations
RRHKPRQXEKGGWMSSYETILVERPDPAVARIVMNRPDARNAQNLQMTYDLNAAFDDAVQDDSVKVIILAGAGPHFSAGHDLRATTKNEAGIDFPPIGAWGGFREPGAHGRMAREQEIYLQITRRWRNLAKPTIAEVHGKCIAGGLMLAWACDLIVAADSAEFCDPVVTMGVCGVEWFVHPWELGPRKAKELLFTADSWSAQEAHQLGMVNHVVPATELSAFTMALAQRIAAKPSFALKMTKEAVNRSVDIQGQPAAIDQAFALHQLCHAH

SEQ ID NO: 20619 - protein, 486 aa, Rhodopseudomonas palustris
  unsure (1)..(486): unsure at all Xaa locations
PDRTAFMVDGVRLTHRDYLARAERLASGLLRDGVHTGDRVAILSQNCSEMIELIGAVALIGAILLPVNYRLNADEIAFVLGDGAPSVVVAGTDYRDIVAGVLPSLGGVKKAYAIGDGSGPFAPFKDLASDTPFSAPEFGAADGFVIIHTAAVGGRPRGALISQGNLLIAQSSLVDAWRLTEADVNLGMLPLFHVTGLGLMLTLQQAGGASVIAAKFDPAQAARDIEAHKVTVMAEFAPMLGNILDQAAPAQLASLRAVTGLDTPETIERFEATCPNATFWATFGQSETSGLSTFAPYRDRPKSAGRPLFWRTVAVVDAEDRPLPPGEVGEIVLRGPTVFKGYWNNAAATQHAFRNGWHHTGDMGRFDADGYLFYAGRAPEKELIKTGGENVYPAEVEGALKQHPAIADAVVIGVPDPQWSEAIKAVCVCKPGESIAADALAEFVASLIARYKKPKHVVFVEALPKDAKGAIDRAAVKTAHGQAXRR

SEQ ID NO: 20620 - protein, 432 aa, Rhodopseudomonas palustris
IVGVVSWLFVLARLSRQAAEAETRRQTQLLMQEIDAHRQTDAELQRAKEAAESANLAKSRYVVGLSHELRSPLNAISGYAQLLEQDNTLPPRPRDQIRLMRRSADHLSGLIDGLLDISKIEAGRLYLSRDEVRFGEFLDQLVGMFRLQAAAKDIEFVFKRPQYLPPMVYADEKRLRQVLINLLSNAIKFTQEGSVHFIVHYRNPVAELEVRDTGPGIHTDDLERIFAPFERGALGAAQPHSGTGLGLTISKLLAGVMGGDLTVTSTPDKGSTFRVKLLLSEVTNPTRTRSIRAPVLGYHGPRKTILVTDDDPAQRGLLQDALAPLGFIVLVATDGYSCIDLAEHCQPDLFLLDISMPGMDGWTVAETLRTQGHHHARILMLSASALEAHGTLLSQPFHDAYLMKPVDIPRLLELIGQLLNIDWIYKGEATAT

SEQ ID NO: 20621 - protein, 885 aa, Rhodopseudomonas palustris
WHAIDADRVLTGLATSRGGLSTEEAKRRLQSYGPNALPEPPRRSAILRFLSQFNNTLIYFLLAAAVAAAFLGHQIDAAVIVAVVTINAIVGYIQEDKAEKALAAIKKMISPRAHAWRDGHRVVLPAEELVPGDVVMIEAGDRVPADLRLTRARGLLIDEAMLTGESVASEKHDQPAAVDVPLGDRLCMGFSGTLVSAGQGFGVVVATGARTEIGRISTMIQGVEQLATPLLAQINKFGERFTWVAISAAAAIFAFATLVRDYAWADALIAVVALAVGVVPEGLPAVITITLAIGVQRMAKRNAIIRRLPAVETLGATSVICSDKTGTLTRNEMTARRIVTADHTILVSGSGYVPKGDLTVDGKDNPEAVSSAMQLVRSALLCNDAQLRPVDGHYVVDGDPMEGALVALAIKAGLDPDTERAAWKRSDEIPFDAQHRFMATRHATDSGAQVIFVKGAPERLLAMCATQVGPGGALHPIDQEFWTAQIARAAAEGERVLGFALRSPARPSDQLGFADLDEGLAFMGLVGFIDPPRDEVIQAIAECRSAGIVVKMITGDHAATAEAIARQLNLTDHPDVVTGADLDRTPDSGFVELARRTDVFARTNPEHKLRIVQALQSTGAVVAMTGDGVNDAPALKQADVGISMGHKGTETAKEASQVVLLDDNFVSIVAAVQEGRTVYDNIRKVIAWTIPTNGGEVLTVIVAILFGFTMPMTPVQILWINLILTVTLGLVLAFEPPEPGVMKRPPRPAHAPLLSRFLVWRIFFVSFLFTVGALAIFFFALGKGLSLDTARTMVVNVLVVFEIFYLFNVRYLHTSSISLRGALGTMPVLAALVVVIAAQLAFTYAPFMHSLFATTPISLVDGAVVIGAGVVLMIVLELEKLVMRK

SEQ ID NO: 20622 - protein, 522 aa, Rhodopseudomonas palustris
YGWGREGEGMNEAEQAFVLGRYKAKFGRDSFDTVEVAHLDDIKLREPRIVPPKSLSEICAVDVYHRAAHAYGKSYPDYVRGMLGDYDAAPDVVAYPRDEAEIAAVMDWAGGAGAALTPFGGGSSVCGGVECRVDGNRHKAAVTLDLRHLGKVLEVDATSRAALIQGGAYGPALEAQLKPHNVTLRHFPQSFEYSTLGGWIATRSGGHYASLYTHIDDFVESVRVVTPRGVLETRRLPGSGAGPSPDRMFIGSEGILGVISAAWMRLQSRPRFRAGASVRFPSFFAAARAVRAVAQAGLYPSNCRILDPQEAYNTGAADGSVAIMVLAFESGDHPVEPWMARALECCADHGGIREEAEASSGHLEGAAGLWRNAFIRMPYAREFLTPAGLINDTFETSITWERFESFHDSVKTVTEQAILDATGIKGEVTCRFTHVYPDGPAPYFSFHALGRHGELLEQWQAIKDAASDALIAAGGTITHHHAVGRDHRKWYDRQRPDLFAVALRAAKRELDPQAMLNPGVLI

SEQ ID NO: 20623 - protein, 366 aa, Rhodopseudomonas palustris
GFGLGAEGHAVGEVCFNTAMTGYEEILTDPSYAGQLITFTFPHIGNVGTNDEDIETVNMAATPGARGVILRSAITDPSNYRSSRHLDAWLKARGIIGLSGIDTRALTALIRSKGMPNAVIAHSPTGEFDLHALKEEAREWPGLEGMDLVPMVTSAQRFTWDETPWAWGESFGRQDKPEFNVVAIDYGIKRNILRLLAGEGCKVTVVPATTSAEDILAMKPDGVFLSNGPGDPAATGKYAVPVIRKVIETGVPTFGICLGHQMLGLALGGKTVKMHQGHHGANHPVKDLTTGKVEITSMNHGFAVDKSTLPANVQQTHISLFDDSNCGIALADKPVFSVQYHPEASPGPQDSHYLFRRFTDLMRAKK

SEQ ID NO: 20624 - protein, 328 aa, Rhodopseudomonas palustris
IEAGEIEPLQPSSSEFIEKASGIKSRYVVAKPGIVDPDVMRPIIPERSNDELSILAEMAVTAAEQAIERWGKPRERIGAVLCACSNMQRAYPAMAIEVQNALGLGGFAFDMNVACSSATFGLKTAADFVGGGSVDAVLMVNPEICSGHLNFRDRDSHFIFGDVATAAIVERADDAQGGWSILGTKLKTQFSNNIRNNAGFLNRAWPEGRDKADKLFVQQGRKVFKEVVPLVSEMIIEHAREIGIDPHGLKRMWLHQANINMNEIIGRKVLGRDPTRDENVIILDDYANTSSAGSIIAFHKHQDDMAQGDLGLICSFGAGYSAGTVFVQ

SEQ ID NO: 20625 - protein, 208 aa, Rhodopseudomonas palustris
IDRAGVAKAYARWAPIYDLVFGKVFDSGRQSTIAVADAIGGRVLDVGVGTGLSLSDYSKTTRLCGVDISEPMLRKAHERVRTLNLSNVDVLAVMDAKNLAFPANYFDAVVAQYVITAVPDPEATLDDFIRVLKPGGELILVNHIGAESGPRKLFELAFSPIARRLGWRPEFPWQRLVNWAARHRGVELAERRPMPPMGHFSLIRYRKL

SEQ ID NO: 20626 - protein, 457 aa, Rhodopseudomonas palustris
QRREFDSMGSVDVPADRYWGAQTQRSLQHFSIGGDRMPKAVYHAYGYVKKACALVNHAAGRLPAWKTEAIVRAADETISGALDDHYPLFVWQTGSGTQSNMNVNEVVSNRAIQLLGGTLGTQQPVGPNDDVNMGQSSNDTFPTAMHIAAVTAIDDQVVPRLSKLIEIIEQKADGWMDVVKIGRTHLEDAVPLTVGQEWHGWAGQLRDARDAIEASRAGLYQLAVGGTAVGTGLNAPKGFAADVAARIAELTGKPFVTAPNKFAAQGSLDAMVRAHGALRDLAVALMKIANDMRWLASGPRCGFGELLLPSNEPGSSIMPGKVNPTQCEAMVMICIQVMGNDSAVAFAGSQGNFELNAMRPVIINNFLHSARILADGCEKFRTYSVEGTELNRDRVAQYVEGSVMLVTALSPVIGYQNAAHIAEDAIAKNLTLKQAALASGKVDEATFDRIVRPIDMV

SEQ ID NO: 20627 - protein, 738 aa, Rhodopseudomonas palustris
  unsure (1)..(738): unsure at all Xaa locations
PPTRPRPEXRPMASVPASGTVFWVSLXPSVTPSGRASVWRVPVITSATMLPSNTLVGADRTSRPASRPIVXPSSQRDVVAPWLGLPQTSLTPQREWSTVKLRPSAMIGMPAGTLPIGYNRPSAPSTLVVSTCPAXXVIVPPDRLNTEPACATSSAALSVMTPPTAVHSPIVCPVLARXPETSSNPPLVXXRSDAXPPVPPAPAPGRARRSRRPCWXAPRSRDXPARRASRWAGCXSSGCWPTSAAALEVPETSSTALFAVNTRPAALTAIWPPCASVSEPPSNFTTPPLTISTRPRSRRSARLERLSNWPLPAPTREFAVRASRXELSAVSALPSSGMIWVSDAAPRVTLPLPSEAALSRWMVPRTSTEVVAMATPLCVTAXPASVMSPCWAKTRPLLRTAPPPGVQLLLPAFQSPGATSLPRVVETLLASVAXPLRMTKSRPAASTVWPLGVVIEPALSTLAPSSITKPPPCVTAPGARVVISAPCSTTIDPPAPVKLGVXLVPDTFEXMPFALNCASEINAADAIRLPTLIWLAPPKMMPFGXXHRPVRRPGCGRGFGSATTHRRRGXARPNCCCPADRTPGWYLLRHXSSTSXGSLGRRSAARSPSAHRSVRSAPACARXSNSAPDWRRPAPQARNPAQVLQPPDRSARPPAPXPTPPPPARPRAPPPVPPAHPAAPAPPASATRSSAVPPRCPAAPLPSPQPPRLQPPNNPATLHHPANAPAPASRPAAASTPA

SEQ ID NO: 20628 - protein, 492 aa, Rhodopseudomonas palustris
TKRNVLFIMCDQLRYDYLGVSGHPRLKTPNIDALAQRGVRFVNAYVQSTICGPSRMSTYTGRYVRSHGSTWNGIPLRVGEPTLGDHLKEIGVRNVLVGKTHMVPDREGMARLGIVPDSLIGVHVSQCGFEPYERDDGLHPDGPYDPAPDYDAYLRSQGFDADNPWEVWANSAEGGDGELLSGWLLSHADKPARVPDEHSETPYITRRAIEFIGEAEADGRPWCLHLSYIKPHWPYIVPAPYHDRYGVDDVLPVVRSDRERQHPHPIFAEFQHERVSQAFSRPGVRERVIPAYMGLIEQIDDQLGLLFAYLDERGLTDDTLIVFTSDHGDYLGDHWLGEKQMFHDVSVKVPLIVVDPSPAADATRGTVSEVLVEQIDLAPTFLDYFGGRPKPHILEGRSLLPLLRGERVENWRSYVFSEYDYALDRARIKLGTPVPDCRLTMVADGRWKAVFVEGFRPMLFDLDNDPHEFDDLGDSEDHAEVRQRLSDAFFAW

SEQ ID NO: 20629 - protein, 465 aa, Rhodopseudomonas palustris
MPMVLLKCDKDIPEREKHIYLKVDGEDTRDYLPVSNAPTIPGTLSERGCAFCGAKLVIGGVLKDTIQMIHGPIGCAYDTWHTKRYPSDNGHFQMKYVWSTDMKESHIVFGGDKRLEKSIHEAFDEMPHIKRMIVYTTCPTALIGDDIKATVKRVMEVRPDVDIFTCECPGFAGVSQSKGHHVLNIGWVNEKVGTVEPEITSPYTINFIGDYNIQGDTQLLQQYWDKLGIQVIAHFTGNANYDDLRAMHRAQLNVVNCARSAGYIANELKKRYGIPRLDIDSWGFNYMAEGIRKVCAFFGIEEKGEALIAEEYAKWKPQLDWYKERLKGTKMAIWTGGPRLWHWTKSVEDDLGVQVVAMSSKFGHQEDFEKVIARGQSGTYYVDDGNELEFFEIIDLVKPDVIFTGPRVGELVKKLHIPYVNGHAYHNGPYMGFEGFVNLARDMYNAVHNPLLKLAATDIRGETST

SEQ ID NO: 20630 - protein, 455 aa, Rhodopseudomonas palustris
KERVGVINPMYDCQPAGAQYAGIGVKDCIPLVHGGQGCTMFVRLLFAQHFKENFDIASTSLHEDSAVFGGHQRIIDGVLTLARRYPELRVIPVITTCSTEIIGDDIEGNIGKANAALKKEFPGRKIHVVPVHTPSFKASQVGGYAECMQAIIKTICDHKVAPTGKLNVFPGWVNPGDVVLLKHYFNEMGVDATIFMDTEDFDSPMLPDKSIHTHGRTTVEDIKHASGAIASLALAKYEGGSTADYLKTEFEVPSHLVSTPYGIANTDAMLKRISEITGKPIPDSLVKERGIALDALQDLAHMFFADKKVALFGHPDLVIGLAEFCLEVEMKPVLMLLGDDNSRYKKDPRILALKNKCNWDMEVVCNADLWELEKRALDKDYGIDLIMGHSKGRYVAIDANIPMVRVGFPTFDRAGLYRHPTMGYRGAMLLGETIANTLFAHMEYNKDREWLLNTW

SEQ ID NO: 20631 - protein, 490 aa, Rhodopseudomonas palustris
FSKVLIANRGEIAGRIGRTLRRMGIASVAIYSDADRFTRPMREADEAVRVGGDAASDSYLNVDAVIDACLLTGAQAVHPGYGFLSENRGFAERLKQHGIAFIGPRPEHLEAFGLKHRARELAQGSNVPLLPGTGLIDSIDEALEAAARIGFPLMLKSTAGGGGIGMQLCHDEATLRERFATVQRTARASFGDARVYLERFVADARHIEVQIFGDGQGNVIALGERDCSLQRRNQKVVEETPAPGISDEMRARLHQAAVALGQSVAYESAGTVEFIYDVARDEFYFLEVNTRLQVEHPVTEAVFGVDLVEWMVRQAAGDSPLATYTPRPPKGAAIEVRLYAENPGAGFRPSAGRLTRVDFPDDVRVDGWIETGDEVTPFYDPMLAKLIVHAADRDAAIDQIIGALAATTVAGIETNLDYLRAIASSALFHSGKVATKVLADFSFAARTIDVVAPGAQSGLQELPGRLHLVARRRAAERTDGRALVPPRQPD

SEQ ID NO: 20632 - protein, 507 aa, Rhodopseudomonas palustris
MQLTAGLRKAASFRADDVALVTSERSFSHGEMLDRVARLASVFRRLGVTGGERVAILAANGHEYIECYFAVLWAGGVVVPINSRFSLAEMIEQVTDAEPIVLVSDRSFLDSALQLADACRGITAVVAAAPGAAGLPKLYDYEAALADEKPCADAGRGNDDLACLFYTGGTTGRAKGVMLSHRNLWVNAVVTSLSFGFDETTVALHAGPLFHLGAGARVYTTSIMGGRHVVIPRFAPKDVLAAISHHKVTVATFVPTMLGMILQLPDLDSYDLSSLKLITYGASPMPEAVLQECLRRFPSIRFGQSYGMTELSPVATILSPDDHLPSAPRHRLRSAGRPVVSAEVRIVDAEDRQLKPGEVGEVVVRGPMVMMGYWKQPELTAHVLRGGWMHTGDSGRFDTEGYLYISDRIKDMIITGGENVYSIEVENAIAAHPDVLQCAVIGVPHAKWGEAVHAVVVRRPGSSLTTDELITFCRSVIADYKSPRSIEFRDDPLPLSSVNKINKAALR

SEQ ID NO: 20633 - protein, 461 aa, Rhodopseudomonas palustris
MNCQFKPKDRIGTINPIFTCQPAGAQYASIGIKDCIGIVHGGQGCVMFVRLLISQHLKESFEIASSSVHEDGAVFGALDRVEEAVDVLLMRYPHVKVVPIITTCSTEVIGDDVDGVVTKLQEELLDVKYPDREVHLIPIHCPSFVGSMVTGYDVAVRDFVKHFSKKDKPSLKINLITGWVNPGDVKELKHLLAEMQVEANVLFEIESFDSPLMPDKSAVSHGSTTIADLTATADAQGTIALNRYEGGLAATWLQTRWDVPAVIGPTPIGIRNTDTFLRNVKEMTGKPIPESLVKERGIALDAITDLAHMFLADKKVAIYGNPDLVLGLAEYCLDLEMKPVLLLLGDENAGYANDPRIAALKANVDYPMEIITNADLFELEERIKNGLELDLILGHSKGRFVAIDYNIPMLRVGFPTYDRAGLYRYPVVGYAGATWLAEQMANTLFNDMEVKKNREWILNVW

SEQ ID NO: 20634 - protein, 512 aa, Rhodopseudomonas palustris
MPYHEFDCSKCLPERQKHAVTKGAGDNLATALPLGYLNTIPGSISERGCAYCGAKHVIGTPMKDVIHMSHGPVGCTYDTWQTKRYISDNNNFQLKYTFATDVREKHIVFGAEGLLKQNIIEAFKACPDIKRMTIYQTCATALIGDDINAVAAEVMEEMPDVDIFTCNSPGFGGPSQSGGHHKINIAWINDKVGTVEPEITSDYVINYVGEYNIQGDQEVMLDYFTRMGIQVLSTFTGNGTYDGLRAMHRAHLNVLECARSAEYICNELRVRYGIPRLDIDGFGFEPLSQSLRKIGMFFGIEDRAEAIIAEETARWKPELDWYKERLKGKKVCLWPGGSKLWHWAHAIEEEMGVKVVSVYTKFGHQGDMEKGIARCGEDALAIDDPNELEGLEALEKLQPDIIFTGKRPGEVAKKVRVPYLNAHAYHNGPYKGFEGWVRFARDIYNGIYSPMHQLSGLDISKDEIPADRGFVTQRMLSDAKLPEEIAKSETLRRYTGKDDIISDLRKKNAPYF

SEQ ID NO: 20635 - protein, 543 aa, Rhodopseudomonas palustris
WAKAWPKDTPREPQYLHGEVALSEYLRAWAKSAPLRPAVIFYGHVTTYADLDEQSDRFAALLLQKGVKKGDRVAVFLPNCPQFHIVFFGILKLGAIHVPVSPLSRAFELSYELNDTDAEVIVALDQLAGVVEQVRAETSLREVIVTSFADVIPSDPTIPVPDSVSGSRIIVPGATDLLSALAALPKPEPLPPAALDEVAALNYTGGTTGMPKGCVHTQRDMVYTAAANHGISVVADQNSVFLSFFPEFWIAGENFGLIFPLFTGATLVLLARWDALGVLTAIQRYKVNVTAMPVDGAVELMDHPRFKEFDLSSLSQVRVVSFVKKLNPTYRKRWKDLTGTILTEAAWGMTETHTSNTFTAGFQGDDFDLVSQPIFVGLPVPGAEFKITDFETGKLVPLGGEGEIRVRTPSLLKSYWNKPEATAESLVDGWLRTGDIGTIDPQGFLHFLGRRKEMLKVKGMSVFPPEIEALLGQHPKVLGSGVVGRDDPGKGQVPVAFIQLKPEAEGTITPAELQAWCAERMAVYKVPEIRIIDALPMTATGKV

SEQ ID NO: 20636 - protein, 555 aa, Rhodopseudomonas palustris
KLLIANRGEIAIRIARAAAESGLTTVAIHPADDAASLHVRIADHAEQIPGRGARAYLDIEAVIVAAKAAGCDALHPGYGFLSENADLARRCAEEGITFIGPSPEALRLFGDKVAAKELAKRCGVPIIAGTIGPSTLEEVQAFFASLGDKPAVMIKAMAGGGGRGMRVVERAEELADAYARCQSEAKAAFGYEGVYAERLIRNARHIEVQIIGDRHGNVSQLWERECTIQRRNQKLIEIAPSPSLSEGLRSRIVDAAKTLAAAANYDSLGTFEFLVDSEAGEGDGAFAFIEANPRLQVEHTVTEEVLSVDLVRSQLAVAGGAMLTALGLDQASVPRPRGFAIQLRVNMETMDAKGATKPTGGTLAIFEPPSGPGVRVDTFGYAGYTTSAAYDSLLAKVIVHGRGDWAEAVAKASRALREFRAGGVVTNIPLLQAILAHNDFKANRVSTSFIDRHVADLVEAAQQFDQPLIATDGADNRSSAAAAASKEPVPEGAVAIAAPLQGTVVAITVAEGDVVRPGQQLAVIESMKMEHLVAAEQGGRIRRIVATDGVTLMQG

SEQ ID NO: 20637 - protein, 544 aa, Rhodopseudomonas palustris
VSPLAGKTVDPNSLVNVPRLVTAYFAGKPDPAVATERVAFGTSGHRGSSLNNAFNESHIVAVSQAVCDHRRAAGITGPLYIGIDTHALAEPALVSALEVFAANEIDVVIDERGGYTPTPVISHAILTHNRGRTDGLADGVVVTPSHNPPEDGGFKYNPPNGGPADTDITSAVEKAANAMLENGLKGIKRISYDRARKASCVHRRDYITPYVEDLANVVDMEAIRSSGVKLGIDPLGGAAVHYWQPIIERYKLDAKVVSDAVDPTFRFMTADWDGKVRMDCSSPYAMARLIGMRNDFDVAFANDTDADRHGIVTRSSGLMNPNHYLSVAIAYLFAHRPHWGRDAAIGKTAVSSAMIDRVASKIGRKVVETPVGFKWFVDGLIGGSFGFAGEESAGASFLRRDGSVWTTDKDGIILGLLAAEITAVSKADPGELYQRLTAELGAPFYARIDAAASPAQKALFKTLTAEKLGVKQLAGEPVTATLTKAPGNGQSIGGVKVTTANGWFAARPSGTEDVYKIYAESFVSADHLSKIQHEAQAALSAMFA

SEQ ID NO: 20638 - protein, 445 aa, Rhodopseudomonas palustris
  unsure (1)..(445): unsure at all Xaa locations
MKRNLFFVTASVLVLSSSAAFAADSNTVYLNQTGNDQQANITQSGNGNSVGAFNGNSGFLQENGTLSGANLLTVKQSGNSNSVGRDIQGKQSGAGNSAAIFQEGTGSDVELQQTGTSNGAVPSGWNWTNDPGVFNKITQDSSSNGSKVSVIQDGKNNVFSIKQGNTGNSTSVNQIGEWGMAYVRQGIGAAETDASTGNALPTGGNYNVASITQNSAGLNYAVAVQGGGNSNSLSISQSGNLQGANAWQNGNANVFSSIQTNVGNVVGLTGGIYGTDSPITQTGDNNTYINTQTGSSNSANGSQTGNFNQVFNTQSGGSETVRGTQVGTYNYVSNSQAGSSNLLDYKQTNTVSTAFNQIVNDQSTTAVSNTAYVVQDGNGLYSKGLQTGGSYNSANVSQTGQFSASYYTQDGSSNSIIVAQVGNYNVSNVSQIGAGNHANIQQKPX

SEQ ID NO: 20639 - protein, 274 aa, Rhodopseudomonas palustris
DGVQLRFARWEPPGHRKGTVCVFTGRTEQIEKYFETVRDLRDRGFAVAALDWRGQGHSERRLRDYRKGYVRNFADFEVDVETFVREVVLPDCPPPHFALAHSMGGAVMLRIARSGKRWFDRMVLSAPMIDLAGNTTALPIRLLLRAMRLAGQGGRYVPGGNDVLANTEPFVGNKLTSDPVRYARNAAIVAEDPTLGLASPTVAWADTAFRAMHAFKATNYPSQIRQPILMIAAGMDGVVSTPAIEEFAYHLRAGSHLVIPGAKHEILQEQDRYR

SEQ ID NO: 20640 - protein, 284 aa, Rhodopseudomonas palustris
IRKAVFPVAGLGTRVLPATKAMPKEMLTIVDRPLIQYVVDEAREAGIEHFVFVTGRNKGMIEDHFDRQFELDVTLEKRNKKSEMEILARDQPEAGAMSFTRQQAPHGLGHAVWCARDIVGNEPFAVVLPDELVLNTPGCLKQMIQAAEKLGDKANVIAVEEVPADKTHQYGICGVGKRDGKMFEIDGMVEKPAPGTAPSNLSISGRYILQPEIFQILATQERGAGGEIQLTDAMIGLSKTQKFYGVEFEGERHDCGSKAGFLRANIAFAMQRDDLRAGLIEDMK

SEQ ID NO: 20641 - protein, 345 aa, Rhodopseudomonas palustris
MSVIVPIHGPAIAPAPAPERVGVLLVNLGTPDSCDTKGVRIYLREFLSDPRVIENQGLFWKLALNGIILNTRPARKAKDYQKIWNHEKNESPLKTITRAQAEKLSASLGDRGHLIVDWAMRYGNPSLRDRIEALVAKGCTRLLVVPLYPQYSAATSATVCDQAFRVLRELRAQPTLRVTPPYYRDSAYIDALATSIKSHLASLTFEPELIVASFHGMPQAYIDKGDPYQAQCVATVEALRERMGVADDKLLLTFQSRFGFDQWLQPYTDKTIEALARKGVRKLAVVMPGFSADCLETLEEIAQENAEIFMEHGGEEFTAIPCLNDSDAGVQVIRQLVLRELQGWL

SEQ ID NO: 20642 - protein, 674 aa, Rhodopseudomonas palustris
NPLLAAWTTPFETPPFAEIRPEHFMPAFEQAFADHAGEIAAIVNDPTEPDFDNTVTALERSGKLLNRVAAVFYDLVSAHSSPELLKIDEEVSLRMARHWNPIMMNAVLFGRIAALRDKAARLNLTPEQSRLLERSYTRFHRAGAGLDEASKARMAAINERLAQLGTSFSHHLLGDEQEWMMELGEGDTEGLPDSFVAAARAAAEERGLPGKAVVTLSRSSVEPFLKMSSRRDLREKVYRAFIARGDNGNDNDNNAIIGEILSLREESAKLLGYPTFAAYRLEDSMAKTPEAVRGLLERVWKPARARALADRDALQELVTEEGSNFKLAPWDWRYYAERLRQRRANFDDAAIKPYLTLDGMIAAAFDTATRLFGITFEERKDVPVWHPDVRVWEVKDADGAHRGLFYGDYYARPSKRSGAWMTSLRDQQKLDSAVAPLIINVCNFAKGAGGEPSLLSPDDARTLFHEFGHGLHGMLSDVTYPSLSGTSVFTDFVELPSQLYEHWQEQPQVLRQFARHYQTGEPLPDDLLQRFIAARKFGQGFATVEFVSSALLDLEFHTQPAASIGEVRAFERKELDKIGMPEEIALRHRPTQFGHIFSGDHYASGYYSYMWSEVMDADAFGAFEEAGDIFAPDVAKRLRDDIYSSGGSRDPEEAYVAFRGRKPEPDALLRRRGL

SEQ ID NO: 20643 - protein, 363 aa, Rhodopseudomonas palustris
RRAKGLDVEPCLVVDLEVVRDNFMHFAKALPDSRVFYAIKANPAPEVLSLLASLGSCFDCASVQEIQMALAAGATPDRISFGNTIKKERDIARAYELGIRLFSVDCTPEVEKVARAAPGSKVFCRILYDCAGAEWPLSRKFGCDPEMAVDVLDNAKRLGLEAYGISFHVGSQQRKVKAWDRALAMAAQVFRDCAERGISLSMVNMGGGFPTKYLKEVPPVVQYGRSIFRALRKHFGNQIPETIIEPGRGMVGNAGVIETEVVLISKKSDEDDVRWVYLDIGKFGGLAETMDESIRYAIKSRHDGAEMTPCVLAGPTCDSADVLYEKMPYPLPVTLEIGDKLLIEGTGAYTSTYSSVAFNGFPP

SEQ ID NO: 20644 - protein, 409 aa, Rhodopseudomonas palustris
MQYNQFFQDALTRLHDERRYRVFADLERMAGRFPHATWHSNSGPRDVVIWCSNDYLGMGQHPKVVGAMVETATRIGTGAGGTRNIAGTHHPLVQLEQEIASLHGKEAALLFTSGYVSNQTGLSTLGKLIPNCLILSDALNHNSMIEGIRQSGCERVVWRHNDTAHLEELLIAAGPDRPKLIAFESLYSMDGDTAPLAKICDLAEKYNAMTYCDEVHAVGMYGAHGAGVAERDGVMDRIDIIEATLAKAFGCLGGYITGKNEVIDAVRSYAPGFIFTTSLPPPICAAATAAIKHLRSSTWERERHQDRAARVKAVLNNAGIPVMPTDTHIVPVFVGDAEKCKKASDLLLEQHNIYIQPINYPTVARGLERLRITPSPYHDDKLIDALAEALVQVWNELGLPLGAKAIAAE

SEQ ID NO: 20645 - protein, 397 aa, Rhodopseudomonas palustris
LPSGLTIVTDTMPHLETAALGVWTGVGGRDEKPDEHGISHLLEHMAFKGTTRRTSREIAEEIEAVGGDLNAGTSTETTAYYARVMKADVPLALDVLSDILANPSFEAEELEREKSVIVQEIGAAQDTPDDVVFEYLNELCYPEQPIGRSLLGTAKTLKSFSREKLQSYLSTHYRGPDMVVAAAGAVDHARIVEEVSHRFASFDGTPAPKPQPAMFGAGGSRVVHRDLEQAHLTLALEGLPQSAPTLFSLQVFTNILGGGMSSRLFQEVREKRGLCYSIYTFHAPYSDTGFFGLYTGTDPADAPEMMEVIVDVINDAVDTLTDAEISRAKAQMKAGLLMALESCSSRAEQLARHILAYGRPLPVDELVGRIDAVTIDTAREAGRTLLARSRPAVVALG

SEQ ID NO: 20646 - protein, 202 aa, Rhodopseudomonas palustris
MKLYYSPGACSLSPHIALSEAGLPFDLVKVDIRAKKLENGDDYAAINPKGSVPALGLDDGSVLTEGPAIVQYIADKEGSGKLAPANGSPERYRLQEWLNYISTDLHKSFGPLFAPTLGDDAKNFFKDRIARHLGYVDKQLAGKDYLMGSSFTVADGYLFVILSWCDRMQIDLAPYPNLTAYKARIAARPKVQAAMQSEGLLQ

SEQ ID NO: 20647 - protein, 400 aa, Rhodopseudomonas palustris
EAYIYDHVRTPRGRGKADGSLHEVTALALATVPLKALKERNNLKQDVVDDVVMGVVDPVGEAGSDIARFAAMKAGLGEAVPGIQISRFCASGLDAVNFAAAQIMSGQHELVIGGGAESMSRIGIGASGGAWPMDPSMAIPSYFMPQGISADLIATKYGFSRDDVDAYAVRSQQLAAKAWDEGRFDKSVVPVKDINGLTILAKDEHMRPSTTMQSLAQLQPSFAPIAAMGGFDAVAIQSHPEVEKVNYVHHAGNSSGIVDGAGAVLLGSKEAGEKHGLKPRAKIRAFANIGSEPAMMLTGPVDVTNKLFERSGMKKSDIDLFELNEAFASVVLRYMQAFEIDNDKINVNGGAIALGHPLGATGAMILGTVLDELERTGKATALVTLCIGGGMGTATIIERV

SEQ ID NO: 20648 - protein, 322 aa, Rhodopseudomonas palustris
  unsure (1)..(322): unsure at all Xaa locations
FDAVSLPLLRWLDPEDAHRLAIQGLKLWPPVKPRPDDSKLAVRAFGLNFSNPVGIAAGFDKNAEAPDALLRLGFGFVEVGTVTPKPQAGNPRPRLFRLERDEAVINRMGFNNEGAEVVLRRLAARAQYGGIVGVNVGANKDSDDRVADYVKLIETFAPLASYFTVNVSSPNTPGLRNLQQAAALDDLLARVIDARERVRAAAGDTPVLLKIAPDLSLGELDDVVHIARSRRVDGMIVANTTLSRSPTLRERTKMNEQGGLSGRPLFRLSTRMVAETFVRAEGAFPLIGVGGIDSGGAALTKIRAGAHAGPVVFGAGLXGPRP

SEQ ID NO: 20649 - protein, 253 aa, Rhodopseudomonas palustris
RLDGKVAVITGATSGIGWRTAEVFVAEGARIVVAGRRMAEGEALAAQLGSSCVFKQTDVTDEAQVKALIDTALDTFGRLDCLFNNAGGPAQTGGIEGLEVDRFDAAMATLVRSVMLGMKHAAPAMKKQGAGSIINNGSIAGRLAGFSSSLVYGAAKAAVNHLTKCVAMELGESGIRVNSISPGAIATGIFGKALGLTTDAAEKTAATMREIYKTAQPIPRAGIPDDIAQAAVFLASDESTFINGHDLVVDGGI

SEQ ID NO: 20650 - protein, 402 aa, Rhodopseudomonas palustris
MDFDHSDKVQRLRAQLSDFMRFHVEPANVAWHREVAAGHYPLALIERLKSRAFSEDLWNLFLPGLRDQDPGQRLSNVEYAPLAEIMGRVHWASEVFNCNAPDTGNMELLHLAATPKQRAEWLDPLLIGEIRSCFAMSEPDAASSDARNIRTTITRDGDDYVINGRKWFITGAAHPNCKLAIVMGVTGEHLPATSTERHSMLLVPMNTPGLSIVRNIPVMHYHSPEGHCELVFRNVRVPASNLLGEEGKGFRLAQDRLGPGRVHHCMRTIGQCEVALELMAERALEREAFGKHLADFANIQDWIAESRLEIDQARLLVMQAAHRMDRAGNAAARVDVSAIKLVAARLQTRIVDRAMQVFGAMGLTPDTPLSYLWTWGRAMRFLDGPDEVHLRVVARAELAKAK

SEQ ID NO: 20651 - protein, 344 aa, Rhodopseudomonas palustris
FTSNDYLGLAESDELRQAAANAVARGVPIGAGGSRLLRGNHEEHEALEAEAADYFGAESALYLGGGFSANHAIFATLPQRGDLVLYDELIHASVHEGMRRGRATCESVPHSDIDAFDARLRQWRASGGRGRAWIAVESVYSMDGDSPRLDELVAVADRHDAILVIDEAHATGVAGPEGRGLAASFEGRANVITLHTCGKALGTMGGFVLGPKIVRDFLVNRARPFIFATAPSPLIAAVTRAALDISRTRPERRERLAALVAFADRELKQRCGITSSGSHILPIIVGANSTAVALAASLQRRGFDVRAIRPPTVPEGTARLRIALSANLSEDVIASLFAALAEDM

SEQ ID NO: 20652 - protein, 399 aa, Rhodopseudomonas palustris
VWHPFTQHAVQGDTPTIVHSEGAWLQADDGRRIFDAISSWWVVTHGHRHPTIISAIKQQSDQLDQIIFAGFTHPPAEQLAQRLVEITPPELTHVFFSDSGSTSVEVGLKMALGYWLHSGESRRRILALEGAYHGDTIGGMSVGERGVFNAPYDPLLFDVSRLPFPRAGAEQATLDALEQACRNEAVAALIVEPLVLGAGGMLIYPPWVLAEMARICKAHGLLLIADEVMTGWGRTGTLFACEQANVVPDIACYSKGLTGGSVPLAVTMCRREIFDAHFSTDRRKTFFHSSSYTANPIACAAALANLQVWASEPVRQRIDDLAAVHARALNRFRDDARFSNVRQIGTIAAVDLQVGDSGYLADVGPRLYAYFINRGLLVRPLGNTIYLMPPYCSTAVEIE

SEQ ID NO: 20653 - protein, 418 aa, Rhodopseudomonas palustris
MSKVGTSDSKNTLYCSFCGKSQHEVRKLIAGPTVFICDECVELCMDIIREENKSSLVKSRDGIPTPKEICKVLDDYVIGQNHAKKVLSVAVHNHYKRLNHQTKHNDVELAKSNILLIGPTGSGKTLLAQTLARILDVPFTMADATTLTEAGYVGEDVENIILKLLQAADYNVERAQRGIVYIDEIDKISRKSDNPSITRDVSGEGVQQALLKIMEGTVASVPPQGGRKHPQQEFLQVDTTNILFICGGAFAGLEKIISSRGRTTSIGFAAQVLAPEDRRTGEIFRHVEPEDLLKYGLIPEFVGRLPVVATLEDLDENSLKKILTDPKNALVKQYQRLFEMENVELTFADEALGAVARKAIERKTGARGLRSILESILLETMFDLPGLEGVEEVVISREVVDGTARPLYIYADRTDRAA

SEQ ID NO: 20654 - protein, 799 aa, Rhodopseudomonas palustris
SITYGESHSYPVLPLRDIVVFPHMIVPLFVGREKSIRALEEVMKNDALIMLATQKNASDDDPAPDAIYEIGTLASVLQLLKLPDGTVKVLVEGLARAKVDKYTDRADYYEADAVALEDSDATSVEAEALGRSVVSDFESYVKLNKKISAEVVGVVQSITDFAKLADTVASHLAVKIADRQGILETLSVTQRLEKVLGLMESEISVLQVEKRIRSRVKRQMEKTQREYYLNEQMKAIQKELGDEDGRDELAELEEKIAKTKLSKEAREKAQHELKKLRQMSPMSAEATVVRNYLDWLLSIPWNKKSKVKKDLEAAQAVLDSDHYGLEKVKERIVEYLAVQSRANKLSGPILCLVGPPGVGKTSLGKSIAKATGREFVRVSLGGVRDEAEIRGHRRTYIGSMPGKIIQSMRKAKTSNPLFLLDEIDKMGADFRGDPSSALLEVLDPEQNGTFNDHYLEVDYDLSNVMFITTANTLNIPGPLMDRMEIIRIAGYTETEKVEIARKHLIPLALTKHGLEPKEWSIDDNALLLVIRRYTREAGVRNLEREISTLARKVVKDLMLSKKKSVHIDEKQIEEYLGVPKFRFGEIEKDDQVGVVTGLAWTDVGGELLTIESVMMPGKGRMTVTGNLRDVMKESIQAAASYVRSRAITFGIEPPFFEKRDIHVHVPEGATPKDGPSAGVAMATTIVSVLTGIPIRRDIAMTGEITLRGRVLPIGGLKEKLLAAARGGIKTVLIPEDNAKDLTEISDAIKGGLNIIPVARMDEVIANALTRAPVPIVWEEETKLPGTPDSAEADEAGGGL

SEQ ID NO: 20655 - protein, 698 aa, Rhodopseudomonas palustris
ARRSGRARSGAHASGGVTAMIKIIVDGKEVEVPPEYTLLQACESAGAEIPRFCYHERLSIAGNCRMCLVELKGTPKPVASCAWGVRDCRPGPNGEPPEISTKSPMVKKAREGVMEFLLINHPLDCPICDQGGECDLQDQAMGYGVDQSRFAENKRAVEDKYLGVLVKTSMTRCIQCTRCVRFAAEICGVPEMGAIGRGEDMEITTYLERALTSELQGNLVDICPVGALTSKPYAFAARPWELGKTQSVDVMDGVGSAIRVDTRGREVMRILPRVNEAINEEWISDKTRHVVDGLRTQRLDRPYVREGGKLKPASWQQAFAAIKAKLDGTSAKKIGAIAGDLAAVEEMFALKQLLAKLGSTNVAAQNVAAFDPKAGRASYIFNPGIVGIEQADAVLIIGSDPRKEAAILNARIRKRWRASGMPIGVIGDQAELTYHYDYLGAGTDTLNDLIAGKLGFAETLKNAKRPIILVGAAATARRDGAAILSLAAKLAADVGALDDGWNGFAVLHPAASSVGALDIGFVPGAGGLGAAEMATAGGVDVLFSLGADEVKLPDGAFVVYIGTHGDRGAHRADVILPGAAYTEKSGIYVNTEGRVQIAGRASFPPGDAREDWAILRALSEALGAKLPYDSLAALRKALFAEVPHLMRVDQIEAGNPADLRKLASAGGSVEKTPFKPVIADFYMTNPIARASAVMAECS

SEQ ID NO: 20656 - protein, 140 aa, Rhodopseudomonas palustris
DINTILKTLPHRFPFLLIDRVINIREDYSGIGIKNVTVNEPAFQGHFPERPVYPGVLMIEGMAQTAGVIGILSVTGTEKPRAVYFLTIDKCKFRKPVMPGDTVEYHLTRTGRRKTMWWFHGEAKVDGQIVAEADVGAMLA

SEQ ID NO: 20657 - protein, 433 aa, Rhodopseudomonas palustris
MDATTNNKTATLTVGNKNFDLPVLTGTVGPDVIDIGKLYAQTGMFTYDPGFTSTASCQSKITYIDGDAGVLEYRGYPIEQLAEKGDFLETCYLLLYGELPTKAQKEDFDYRVTRHNMVHEQMARFFQGFRRDAHPMAVMVASVGALAAFYHDSTDINDPTQRMVASIRMIAKVPTLAAMAYKYSVGQPFIYPKNTLSYAANFLRMCFATPCEEYVVNPVLANALDKIFTLHADHEQNASTSTVRIAGSSGANPFACIAAGIACLWGPAHGGANEAALAMLKEIGTVENIPDFIAKVKDKSSSVRLMGFGHRVYKNYDPRAKIMQQVCHEVLAETGHHGDPLLKVAMELEKIALSDQYFIDRKLYPNVDFYSGITLKAMGFPTDMFTVLFAVARTVGWISQWSEMIEDPQQKIGRPRQLFTGATTRNYVEIGKR

SEQ ID NO: 20658 - protein, 471 aa, Rhodopseudomonas palustris
RPVVTRFAPSPTGFLHIGGGRTALFNWLYARKHGGTMLLRIEDTDRQRSTQEAIDAILDGLKWLGIDWDGDTVYQFARAARHREVAEQLLAAGKAYRCYATAEELTAMRDKARAEGRAKLYDGSWRDRDPSEAPAGVKPTIRLKAPLTGETVIEDQVQGRVAWQNENLDDLVLLRGDGTPTYMLAVVVDDHDMGVTHVIRGDDHLINAARQKQIYDAMEWELPVMAHIPLIHGPDGSKLSKRHGALGVDAYRAMGYLPAALRNYLVRLGWSHGDQEIFTTQEMIDAFDLPAIGRSAARFDFAKLESLNGHYIRQSDDHSLVTLLEDLLKYIPQGPAIATKFDDSIRAKLTQAMPGLKERAKTLIELLDNAGFIFADRPLALDPKAQAVLTPETRQLIGRLRAALEDVSPWTAATTEAAMRAFAEQAGLKLGAVAQPLRVALTGRTTSPGIFDVLAVLGRDECLSRLADQSA

SEQ ID NO: 20659 - protein, 542 aa, Rhodopseudomonas palustris
DFIRDIVQADLDSGKHRTIVTRFPPEPNGYLHIGHAKSIALNFGIAQEFGGRCHLRFDDTNPTKEEQEYIDSIQADVRWLGFDWGEHMFYASDYFEQLYAWAELMIKNGDAYVDDQSQDEIRASRGTLTEPGKNSPFRDRSVEENLDLFRRMKAGEFPNGARVLRAKIDMASGNINLRDPVLYRILHAHHPRTGDKWSIYPSYDYAHGQSDAIEGITHSICTLEFEDHRPLYEWLLSKLPVPSQPRQYEFARLNITYTLLSKRVLTELVRGGHVAGWDDPRMPTIAGMRRRGVPPAALRDFVKRIGVAKANSVVDLGMLEFCIREELNRTAQRRMAVLKPLKVVIENYPEGQTEELEAINHPDDPSLGTRKIAFGREIYIEQDDFMENPPKKFFRLSPGNEVRLRYAYFIKCRDVIKNDAGEIVELRCTYDPETRGGNAPDGRKVKATMHWLPAAQSVKAEIRIYNQLFANPAPSASTFADDLNPQSLEVLTEARIEPETAASTSAEPLQFERQGYFVRDRDSTADKPVFNRTIGLRDTFAK

SEQ ID NO: 20660 - protein, 828 aa, Rhodopseudomonas palustris
GLSEREAAARLASEGYNELPSPDRRTLLGIVLEVVREPMLALLLGGGVVYMALGDLKEAIILLIFATLSVVITVVQEARTERVLETLRDLTSPRALVIRDGIRKRIAGREVARGDVMVLSEGDRVAADAVLLQADDLLVDESLLTGESVPVRKLSRGEADATTLRRPGGDDQPAVYSGSLVVRGGGLAEVVATGPRSEIGKIGQALGSLQTEAPRLQIQTRAVVRTFGFIAAGFTALVVVLYGTLRDGWLDAVLAGITVGMSMLPEEFPVVLTVFMAMGAWRISQARVLTRRAAAIEALGSATVLCTDKTGTLTENRMSVAELRLTSGEVFRPREGGALPVGFATLLETGLLAAAPDPFDPMDQALHRLAGDHLPGGSGDRTLVHSYGLRRDLLAMTQVWRDTDDRSDYVVAAKGAPEAIARMCGLDDATLGALSGAVDAMATEGLRVLGVARTSHPDQDWPATQLGFRFEFLGLVGLADPLRAAVPAAVADCRAAGIRVVMITGDYPATAQAIARQAGIDAETCVTGEEIAALDDAALAERLRRATVFARIMPEQKLRIVQALKADGEVVAMTGDGVNDAPSLKAAHIGIAMGGRGTDVAREASAIVLLDDDFASIVKAVRLGRRIYDNLVKAMGFIFAVHVPIAGLALLPLLFGLPILLGPIHIAFLEMIIDPVCSIVFEAETAEDDAMRRPPRDPEQPLFSRALIVWGMLQGLLVFLLVAGVFVIGQMRAMPDTELRALTFFALVLSFVGLIFVNRSFSASLLTALRRPNAMLAGMLGIVAVVLIASLAWPWLRDLFRFGPLHPDDLGLTAAAALLVLIVLELVK

SEQ ID NO: 20661 - protein, 248 aa, Rhodopseudomonas palustris
RPLIAGNWKMNGLKDSVAELDAMLKGAAELPQGIDLLVCPPATLVASFAARVAEAQAGKALPFSIGGQDCHANASGAHTGDIAAEMLADAGAAAIIVGHSERRADHAENDAIVRAKAQAVWRAGLVAIVCVGETQGERDAGHTLDVVAGMLAGSLPDGATAANLVVAYEPVWAIGTGRTPTAADVEEVHGFIRKTLSDRFGAAGETMRILYGGSVKPSNARELLAVPHVNGALIGGASLKASDFLAIA

SEQ ID NO: 20662 - protein, 424 aa, Rhodopseudomonas palustris
MTAIVDIIGREILDSRGNPTVEVDVVLEDGSVGRAAVPSGASTGAHEAVELRDGDKARYLGKGVQKAVEAVNGELFDALGGMDAEQQVQIDQTMIELDGTPNKGRIGANAILGVSLAAAKAAAASYDMPLYRYVGGTSARTLPVPMMNIVNGGVHADNPIDFQEFMIMPVGAPTFADALRCGSEIFHTLKGELKKAGHNTNVGDEGGFAPNLPSADAALDFVMAAIGKAGYKAGGDVMLALDCAATEFFKDGSYVYGGENKTRSRSEQAKYLADLVARYPIVSIEDGMSEDDMDGWKELTDLIGSKCQLVGDDLFVTNVTRLADGIKNGRANSILIKVNQIGTLTETLAAVEMAHKAGYTAVMSHRSGETEDSTIADLAVATNCGQIKTGSLARADRTAKYNQLLRIEQELGAHAHYAGKAALK

SEQ ID NO: 20663 - protein, 343 aa, Rhodopseudomonas palustris
AMAAPKKSAAKETTQDKAGGASPSNVPPFTKEQELGAFLEMLLIRRFEEKAGQLYGMGAIGGFCHLYIGQEAVVVGMQMALREGDQVITGYRDHGHMLACGMEANGVMAELTGRRGGYSKGKGGSMHMFSREKSFFGGHGIVGAQVSLGTGIAFANRYRGDGRVCLAYFGDGAANQGQVYESFNMAELWKLPVVYVIENNRYAMGTSVTRSSAQTDFSKRGVSFNIPGEQVDGMDVRAVKAAGDKAVAHCRAGNGPFILEMQTYRYRGHSMSDPAKYRSREEVDKIRNDQDPIEQVRKRLLGLDMTEDDLKAIDAEVRKVVNESADFAQHDLEPDPSELYTDV

SEQ ID NO: 20664 - protein, 469 aa, Rhodopseudomonas palustris
MPIQVLMPALSPTMEKGNLSKWLKKEGDKVKSGDVIAEIETDKATMEVEAADEGTLGKILIPEGTNDVAVNTPIATILGDGESAADADKASDPAAQSKASQSAPPSAEPEAAQAKSAPAPAQHAPEAPTVSAAADPDIPAGTEMVTVTIREALRDAMAEEMRRDPDVFVMGEEVAEYQGAYKVTQGLLQEFGDRRVIDTPITEHGFAGVGVGAGFAGLKPIVEFMTFNFAMQAIDQIINSAAKTLYMSGGQLGCSIVFRGPNGAASRVAAQHSQDYSAWYAQIPGLKVVAPYSAADAKGLLKAAIRDPNPVIFLEHEMLYGQHGEVPKLDDYVIPIGKARIVREGKDVTLISWSHGMTYALKAADELAKDGIAAEVIDLRTLRPLDTDTIIASVKKTGRAVTIEEGWQQNGVGAELSARIMEHAFDYLDAPVTRVSGKDVPMPYAANLEKLALPSVAEVVEAAKAVCYR

SEQ ID NO: 20665 - protein, 463 aa, Rhodopseudomonas palustris
MPINILMPALSPTMEKGNLAKWLKKEGDKVKSGDVIAEIETDKATMEVEAADEGTLAKIIVPEGTQDVPVNDVIAVLAADGEDVKAAGAGWKASAGGAPSPQRGEGAGPSGGKAEANSHIQDKADQRPTPQPPSPLPNGERSLPQAAGEGAPAPANGRVFASPLARRLAKDAGIDIARVTGTGPHGRVIARDVEQAKSGGGLKAPASAPAGPAIAAAMSDQQIRALYPEGSYEVVPHDGMRRTIAQRLTQSTQTIPHFYLTIDCNLDRLLAAREDINAAAPKDKDGKPAYKLSVNDFIIKAMAIALQRIPDANVSWTEGGMLKHKHSDIGVAVAMPGGLITPIIRSAETQSLSSISAQMKDFAARARARKLKPEEYQGGTTAVSNLGMFGIKDFTAVINPPHATILAVGTGEQRAIVKDGKIEVATMMSVTLSCDHRAVDGALGAELIGAFKTLIENPVMMMV

SEQ ID NO: 20666 - protein, 467 aa, Rhodopseudomonas palustris
FDVIIIGSGPGGYVAAIRAAQLGFKTAIVEKSYLGGICLNWGCIPTKALLRSAEIYHYMQHAKDYGLSADNISFDPKAIVQRSRGVSKRLNDGVGFLMKKNKISIIWGQATIDAPGKLTVAASKTDAPKGALPPGSYQAKHIIVATGARPRVLPGLEPDKKLVWTYFEAMVPEVMPKSLLVVGSGAIGIEFASFFHTMGAKVTVVEVLPQILPVEDAEIAALARKRFEKQGIKILTGAKVTKLDKKADSVVATIDPGNGKPETAEFDRVISAVGVVGNVENLGLDKLGVKLDRGTIVTDGLGRTNVPGLYAIGDVAGPPMLAHKAEHEGVICVEAIKGLHPHPLDKSLIPGCTYCQPQVASVGLTEAKAKEQGREIRVGRFPFTANGKAIALGEDQGLVKVIFDKKTGQLLGAHMIGAEVTELIQGYVVAMNLETTEEELMHTVFPHPTLSEMMKEAVLDAYGKVLN

SEQ ID NO: 20667 - protein, 254 aa, Rhodopseudomonas palustris
MRIATWNVNSVRQRLDHLVSWLQDCQPDVVCLQEIKCVDEAFPREPIEALGYNVVTHGQKTFNGVALLSKYPLEEANPGLAGDESDVHARFLEGVVSLKHGVVRVACLYLPNGNPVGSEKYPYKLSWMARLRDYAQQRLKTEEPLILAGDFNVIPQAEDVHNPAAWTEDALFRPETRESFQTLLGLGLTDALRATTDAPGQYTFWDYQAGAWQKNWGIRIDHLLLSPQAADRLRHVGIDSYVRNWEKPSDHVPV

SEQ ID NO: 20668 - protein, 195 aa, Rhodopseudomonas palustris
LRRRGISDQAVLRTMEAVPRDQFVDPGYRDGAWRDTALPIACGQTISQPFVVAFMTEQLELRPRDRVLEIGTGSGYHAAVLSRLAADVLSFERFKTLADRARKRLAELGCRNVEVVFGDGFDLPETAGTFDRILITAAVPELPARLLERLDPGGVLIAPVGPPNGRQTLLRVRRTPNGDEHKALGEVRFVPALRG

SEQ ID NO: 20669 - protein, 648 aa, Rhodopseudomonas palustris
LDGLNPEQRCAVEHGAGPAPCPPLLVIAGAGSGKTNTLAHRVAHLVVGGADPYRILLMTFSRRAAAEMTRRVERIARKVLGDRASALSGGLHWAGTFHGIGARLLRDYAERIGLDPGFTIHDREDSADLMNLVRHDLGFSKADSRFPAKATCLSIYSRCVNAGQPLDVVLGANYPWCAGWAAELKQLFAAYVEAKQRHNVLDYDDLLLYWAQVMEEPAFAEEIGSRFDHVLVDEYQDTNALQARVLLALKPNGVGLTVVGDDAQAIYSFRAATVRNILDFPKAFDPPARVVTLDRNYRSTQAILSAANGVIDLARERFTKNLWTDRADGARPLLVSVRDETDQARYIVERVLDAREGGVTLKQQAVLFRTSSHSAPLELELTRRNIPFVKFGGLKFLDAAHVKDMLALLRFVQNPRDRVAGFRVMLLMQGVGPASAQKALDTMTAAADPLGALTALPAPPRAGADWRGFVAAVQELRSGDAGWPAEIERALIWYAPHLDRIHEDAETRKADLVQLAQIASGYPSRERFLTELTLDPPDATSDQAGVPTLDDDYLILSTIHSAKGQEWKQVFVLNVVDGCMPSDLGTGTSAEIEEERRLLYVAMTRAKDDLHLVVPQRFFTHGQNAQGDRHVYAARTRFIPERLLPLFE

SEQ ID NO: 20670 - protein, 552 aa, Rhodopseudomonas palustris
  unsure (1)..(552): unsure at all Xaa locations
ANFVPLSPLSFLERTANVYPEMTSVVYEGRHYTWKETRARCRRFASWLTRSGIGRGDTVAVMLPNVPAMVEVHFAVPMAGAVLNALNIRLDAAAIAFQLDHGGAKIILVDPEFSSVVAEALKLMTKPKPLVIDVDDKMYPGSHRIGELEYEYAVASGDPTFAGHRPEDEWDAISLGYTSGTTGNPKGVVTHHRGAYLNAVSNILAGNLGQHPVYLWTLPIFHCNGWCFPWTLAAAAGINVCLRKVDPAKIFELIPKHGVTHMCGAPIVYNALINAPEAPKGVPTKPVVGLIAGAAPPMAVLAGAETIGIKLTHVYGLTEVYGPASVCAEQPGWDELPVAERAKLKRRQGVPYPMQEAVTVLNPETMQEVPRDGETIGEVMFRGNIVMKGYLKNEKATKEALAGGWFHTGDLGVLDADGYVIIKDRSKDIIISGGENVSSVEVEDVLYKHPAILFAAVVAKPDPKWGEVPCAFVELKDGASATEAEIIAYCREHLPGFKTPKSIVFSSIPKTSTGKIQKFMLRDQVKSAKAILEXLVFVIPGRAKREPGISRL

SEQ ID NO: 20671 - protein, 270 aa, Rhodopseudomonas palustris
LPAFAATQPSPILLRETVDGGVAVLTLNRPAARNSLSLEMIDDLHAALDLIARDDGVRVVVIAANGPAYCAGHDLKELTAHRNDADRGRASFTRIMTACSAMMQAIVKLPKPVIAAVQGVATAAGCQLVASCDLAIASEQATFATPGVDIGLFCSTPMVALSRNVPRKNAMHMLLTGEPVGAEEARQIGLINRVVPHGTERAAAVALAEQIAGKSAHTIKIGKEAFYRQAELNLADAYHYASQVMAENMMAADAEEGICAFLGKAPAGME

SEQ ID NO: 20672 - protein, 424 aa, Rhodopseudomonas palustris
MTERNPGFATLAVHAGAQPDPTTGARATPIYQTTSFVFNDADHAASLFGLQAFGNIYTRITNPTTSVLEERVAALEGGTAALATASGHAAQLVALQQLMQPGDEFIAARKLYGGSINQFTHAFKSFGWNVVWADTDDLASFQRAVSPKTKAIFIESIANPGGSITDIEAVAEVARNAGVPLIVDNTLATPYLIRPIDHGADIVVHSLTKFLGGHGNSLGGIIVDAGTFDWSKDGKYPMLSEPRPEYHGLKIQETFGNFSFAIACRVLGLRDLGPALSPFNAFMLLTGIETLPLRMQKHCENAKAIAEFLSTHKAVDEVNYSGLASSKYAALARKYAPKGAGAVFTFSLKGGYQAGIDLVANLKLFSHLANVGDTRSLIIHPASTTHSQLDDAQKTAAGAAPNMVRVSIGIEDKDDLIADLDQAL

SEQ ID NO: 20673 - protein, 551 aa, Rhodopseudomonas palustris
  unsure (1)..(551): unsure at all Xaa locations
LVGGQLLAKTLKAAGVSQAFALHGGHLEALLKGCIEEEIALIDFRHESSAGHAADAYARATGKLGVASSPPGQGSPTCCRRXPMRSSMAHRCCSSSAAPPLREVETNPLQGGIDQVAMARPAVKWAFSIPSTERIADLTAMAIRKAMTLPRGAVLLEVPIDVLHMSVAAARATPPAGVGVNPRPAPAPAEVARLVELLQAAKRPVLIAGNGAANHETAEALRALCARVPLPVFTKSLAAGILPPGHHCNGGAAGNLALLPMLGIDRPDLVILLGGKLGLLLGGRSGALVPHGATLVQIHGDAAEMGRIRDVDLAILADCTEATRALDAALKDGQFEEMEAWRAQAFSATGLFATMFPERETTRGIHPYHAARAVADAAGTEAAYVFDGGEAASWGAAAAVVDRPGALLGHGYLGCLGIGPGFAIGAQLAAPERRVIHLTGDGALGFHLQELDTMVRHRLPIVTVVLNNEVWGMSIHGQQIMFGSNYHVISKLGGTQFANIAQAFGCHAERVTRFADLAPALERAFASGGPAFVEVMTDADVVHPVTVAMLG

SEQ ID NO: 20674 - protein, 322 aa, Rhodopseudomonas palustris
IRSVVLGCGAYLPERVLTNEELARTVDTSDEWIVQRTGIRERHIAADGEFTSHLATKAAQAALDNAGITADQIDLIVLATSTPDHTFPATAVQVQAALGMTHGVAFDLQAVCSGFVFAVATADNYLRAGSAKRALVIGAETFSRILDWNDRGTCVLFGDGAGAIVLEAQEGWSTSADRGVLTTHLRSDGRHKHKLYVDGGPSSTQTVGHLRMEGREVFKHAVGMITGVIVDAFNASGTSADNVDWFVPHQANKRIIDASAQKLHIAPEKVVMTVDRHGNTSAASIPLALCTAVADGRIQKGHLVLLEAMGGGFTWGAALLRW

SEQ ID NO: 20675 - protein, 350 aa, Rhodopseudomonas palustris
MAIKFGRPIEIRDPSTRPAAPPLDLTIRPRRNRKTEWARRLVRENVLTTDDLIWPMFVVDGTNQRVQVASMPGVERLSVDQIVRDAERAAKLDIPCIALFPFTEPSLRDEHGTEAANPENLICKTVRAIKKEFPQIGVLCDVALDPYTSHGHDGLIEDGRILNDETVAVLVQQSLVQAQAGCDVIAPSDMMDGRIGAIREALDAAGYLDVQIMAYAAKYASAFYGPFRDAIGSAKALTGDKRTYQMDPANTDEAIREVELDLAEGADMVMVKPGMPYLDIVRRVKETFGVPTFAYQVSGEYAMIAAAANNGWLDGDRAMMESLLAFKRAGANGVLTYFAPAAAEKLRQQG

SEQ ID NO: 20676 - protein, 296 aa, Rhodopseudomonas palustris
MAAKTKFRGSFTALVTPFKNGALDEQAFRSLVNWQIEQGTHGLVPVGTTGESPTLSHEEHHKVVEWCIAEAKGRVPVIAGAGSNSTREAVELARHAEKAGADAVLVVTPYYNKPTQEGMYQHFKAVNDAIGIPIIIYNIPPRSVVDMSVDTMSRLYELDNIVGVKDATANLGRVSQQRHAMGPDFIQLSGEDMTALAYMAAGGHGCISVVSNIAPKLCSDLMGAVFAGDYPGALKIQDRLVPLHDAVFKEPGVAGAKHGLTLLGRIQEDVRLPLMTVTEPTGKAIRAAMVHAGVIN

SEQ ID NO: 20677 - protein, 383 aa, Rhodopseudomonas palustris
IEPNSYDAIVVGGGPAGLTAAIALAETGAVTALIARQVPYGDNRTTALLGDSIDILDRLDVWRRCSSKAAALRSMRLVDDTGRLIRAPEVKFASDEIGMDAFGYNIENRALLVGLEERAAELSNLQRFDDEAESVVPGDDEVIVRMRGGRTVSAKLVVGADGRQSQCREAAGIKVSSRALHQSALTFNVKTTRSHDNISTEFHTKEGPCVFVPLPGRRMSIVWVAAPKEAQRLMALSDDELSAAAEKQSQSIYGRMTVEPGRNLFPLAIEKPAAYAQRRIALVGEAAHVVPPIGAQGLNMGLRDAGDLAEIVRDAMANGTDIGSDAVMTRYGRSRGPDIASRTAAIDIANRTLLSDLLPAQMLRATGMHLISSVGPIRRFAMR

SEQ ID NO: 20678 - protein, 608 aa, Rhodopseudomonas palustris
MCGIIGILGRGPVAEQLVDSLKRLEYRGYDSAGVATLEDGELVRRRAEGKLKNLEAVLKRQPLAGHVGIGHTRWATHGKPNEANAHPHAASGVAVVHNGIIENFRELRDELEGGGATFASETDTEVVAHLVNSFLVKGLSPQDAVKAALPRLRGAFALAFVFKGYDDLMIGARKGSPLAIGYGDGEMYLGSDAIALAPLTDDISYLDDGDWVVLTHTTAEVRDAKGDVVKRDVMKSGASSFVVDKANYRHFMAKEIHEQPEVVGHTLARYLDMASERIALPMKLPFDFKDVQHLSITACGTANYAGYVAKYWFEQFARLPVEIDIASEFRYREAPLRSGDLAIFISQSGETADTLAALRYAKEQGLHTLSVVNVPTSTIARESEVVMPTLAGPEIGVASTKAFTCQLTALAALAIAAGRARGTLTDADEAKLVHGLIELPRLMAAALTHEPQIERLARDISKAQDVLYLGRGTSYPLALEGALKLKEISYIHAEGYAAGELKHGPIALIDEKMPVVVIAPYDRVFEKTVSNMQEVAARGGRIILMTDAKGAEEATVDSMVTIMMPDMPAAFTPMVYAIPVQLLAYHTAVVMGTDVDQPRNLAKSVTVE

SEQ ID NO: 20679 - protein, 393 aa, Rhodopseudomonas palustris
GPATWALYMGEQHRQVGDPVTPGPALSASFLTAPNAVGFSANDLGAAAPHFYTRWSNPTVELLEARLAALDAGEAAVTFASGMAAVAALFSDRLHAGDHLVLSDVCYAGVAELAHDELTRNGIAVTTVDSSKPEAIAAALRPNTRLVHIETPANPILRLADIAAIAPLVHAAGAELSVDATIATPLGLRPLELGADYVVHSLTKYICGHGDTLGGAVIGRAEAIARLRRGSLIHLGGCLAPFSAWLILRGLETLAPRMRLHEANARAVEALLANHPKVKAVYWPGSPRHPQHELAQRTMRCFSGLLSFTVNGDGPALAEQLAERMRVVSYAVSLGKTKSLLVYIPTEDILRSSFRLTGDAAASYRAWAGDGVFRLSVGIEDSADIIADLETAL

SEQ ID NO: 20680 - protein, 521 aa, Rhodopseudomonas palustris
DFIIVGAGSSGCVLANRLSEDPATSVALLEAGPRDSNPWIHIPIGYAKTIRNPNINWCYETEPEPTMDGRRIFWPRGKVLGGTSSINGLVYMRGHPDDYDGWAAAGASGWAWSDVLPYFKRSEDQVRGADAYHGVGGPLSVADLSERNPICQAFIDAATAAGVPANLDFNGESQDGVGYVQLTTREGRRCSSAVAFLRPALRRANLRVETEALVGRVLIEGGRAVGVEYLRGGERRVLRARSEVILCGGAVNSPQLLQLSGIGPAAHLASVNVEPVQDLPAVGANLQDHLQVRIVWKAAHPLTLNDIVRNPVRKLWMGARYLLSRSGPMTISACQVGLFARTRTELTRPDIQYHFMMFSAESSADQLHSFSGFTANVCQLRPESRGSVLIAAPDPRQAPRIRANYLATETDRRAVIDGLRLARTIANEQPLADFIVEEYLPGAGATSDDALAAHARQKGQTLFHPAGTCAIGPVLDPQLRVHGIEGLRVADCSVMPTLVSGNTNAPAVMIGEKASDLVLRQ

SEQ ID NO: 20681 - protein, 376 aa, Rhodopseudomonas palustris
TRLVTAGRDTAAQKGFVNPPVVHGSTVLYPTAADLHAHRGEYSYGRHGTPTTKALQQALIALEGPQCAGVGITPSGVSAISTALLAVVKAGDHVLVCDNAYRPTRLFCDQMLNRLGVETSYFDPLIGAGIASHLRPNTVAVVVEAPGSQSFEMPDIPAIAAVAKQHGALVIDDNTWATPLYHRSLEQGVDISIQAATKYIGGHSDIMFGTVSANAAAWPKVSEAIRLLGVCAGPDDVFLALRGLRTLEVRLARHYQAGLDMARWLTARPEVQRVLHPGLDTDPGHAIWKRDFTGASGLFSIVLQPAPQAAVDALLDTVSLFGMGYSWGGFESLVIPFDCASYRTATQWNPGGPALRLHIGLESTDDLKADLERGFA

SEQ ID NO: 20682 - protein, 650 aa, Rhodopseudomonas palustris
LLIANRGEIACRVIRTARAMGLRTVAVYSEADVGAQHVAEADEAVLLGPARARDSYLNIERIIQAAKQTGAEAVHPGYGFLSESAEFAQACADAGLVFVGPTPQMITAMGSKSGSKALMEKAGVPLVPGYHGAAQDEATLAAAADKIGFPVLVKASAGGGGRGMRVVREAGELAAAIVSAKREAKAAFGDDTLLIERYVDNPRHIEVQIVGDSHGNLVSLFERECTLQRRHQKVIEEAPSPTLDAAQRETVCAAARRAAGAVNYVGAGTIEFVSDGKDVFFIEMNTRLQVEHPVTERISGVDLVEWQLRVAFGEALPLKQDQLKLSGHAIEARVYAENPAKNFMPSVGKITTWRTPAEVDGLRIDAGYRGGDSVSPYYDAMLAKVIAWAPTRQAAIDRLDRGLNETDVRGVVTNIPFLSALVTHPEVRANAIDTGFIERNLAALTAAPSTLGDLEFAAAVAAILRGEDEAAKAEGPSPWRTAGWMPVGRRKRSFLFRRGQGHDHTDHTIELTYGGGSSALTIDGRELAFAWTAAGDGIDVALGDARSRIHAVVDGAELYVRTRSGRFELHLVDPFGGESEEAVGEDKIVAPLPGTVVALLAEVGAKLDKGAPILTLEVMKMEQTLRAPFAGTLTAVKCKVGDIVQEGAEL

SEQ ID NO: 20683 - protein, 436 aa, Rhodopseudomonas palustris
LRVGIAGLGTVGAEVVRVIERQERTLSARCGRPVRVVAVTARSKAKKRGLDLSGIKWAKSPLAIATDPEVDCFVELIGGAGDPAGPAIEAALAAGKAVVTANKALIAKHGLKLASLAEKHNAALNYEAAVGAAIPVIKTLREGLAGTDIDRIYGILNGTCNYILTRMEQEGLSFDDCLADAQRLGYAEADPTFDIDGHDTAQKLAILASLAFGTKVSESSVYVEGIRSITPEDLRAADDLGYRVKLLGVAVRTAKGIEQRVHPTMVPKTSSIAQVMGVTNAVSIDGDGIPPITLVGAGAGAAATASAVVADIADVARGIRAVPFGRPVAGLKATAKAPMQRHEGGYYLRLLARDHAGTAATIAKRLAEQDISIESIVQRHPHRSLDANGKAAKSSIPVPVILITYATAEDAVRRALQAVQRDKVISGRPQVIRIEK

SEQ ID NO: 20684 - protein, 390 aa, Rhodopseudomonas palustris
ESRTMEEFYRIRRLPPYVFEQVNRAKAAARNAGADIIDLGMGNPDLPAPPHVLEKLKDTLGKPRTDRYSASRGITGLRRAQAAYYDRRFGVKLNPDTQVVATLGSKEGFANVAQAITAPGDVVLCPNPSYPIHAFGFLMAGGVIRSVPSEPTPDFFAAAERAIIHSIPKPIALIACYPSNPTAYVASLDFYKDLVAFAKKHEIMILSDLAYAEVYFDDNNPPPSVLQVPGAMDVTVEFTSMSKTFSMAGWRMGFAVGNERIIAALARVKSYLDYGAFTPVQVAATAALNGPDDCIKEMRETYKKRRDILVESFGRAGWEIPPPSASMFAWAPLPPAFREIGSMQFATLMVEKCGVVVSPGVGFGEHGEGFVRIAMVENEQRIRQAARGVR

SEQ ID NO: 20685 - protein, 309 aa, Rhodopseudomonas palustris
KPVVFIDGAAGTTGLGIRERLARHGQVTVKDIPDDKRKDPGAKRALMAEVDLVILCLPDDAAKETVALIDDLGASGPKVLDASTAFRVAPDWVYGFAELAPDQADNIRAAKKVANPGCYPTGGIALLRPLVDAGLLPADYPVTINAVSGYSGGGKSMIAAYEAGTAPAFELYGLGFAHKHLPETQKYAGLSRRPIFIPSVGNFRQGMLVSVPLHLDTLPGKPAAADLHAALTQRYAGSTYVSVPPLDAAPYAAGRIEPEALNDTNRLELYVFGSDAHRQAVLVARLDNLGKGASGAAVQNMRLMLGLAD

SEQ ID NO: 20686 - protein, 453 aa, Rhodopseudomonas palustris
MSFSNLGLSEKVQAAVAAAGYVSPTPIQQQAIPHVLARKDVLGIAQTGTGKTAAFVLPMLTMLEKGRARARMPRTLILEPTRELAAQVKEQFDKYGAGQKLNVALLIGGVSFGDQDLKLTRGVDVLIATPGRLLDHTERGGLLLTGVEMLIIDEADRMLDMGFIPDIERICKLVPFTRQTLFFTATMPTEIRRITETFLHNPEKIEVSKPASTAVTVTQSQVPCGREPHEKRETLRRLIRGATDLKNAIIFCNRKREVALLAKSLQRHGFSVGALHGDMDQTARTAALEAFRKGDLPILVASDVAARGLDIPEVSHVFNFDVPHHPDDYVHRIGRTGRAGRTGTAVTIVAPSDQKSMAAVEKLIGQAIPGPKSVRRSRARLPTPRPRPSVRHAPAAPRRKPVSANRAASRANSASASRAASPAAPQAPQAPQRPPPPTPPSAPPLPLATRRRR

SEQ ID NO: 20687 - protein, 421 aa, Rhodopseudomonas palustris
AIKANPDAADAYTTRANFWNVSGKPERALADADQAIKLDPNLPLAHFVRGSAELKLGHDDRAIADYSRAIELRPKESGEVYAVRGFAYHRKGDDIRAVADYTEALKAAPEDVGTLLNRGDARRNLRDTAGAAADYSEAIKLAPGNAGGFKGRGFIRLLTQDTGGAVADFTEAIRLSPSESGLYLNRASALGLQNQSLLALADEDMAIRLEPQHPLAYVNRAETLKLLGDKVAARASVTKALQLAPGFPPAVEVLKKLGEPKRSKEPSSEAAQEAYRRCTFPVTDLGPGEEGIKQIIKVCTLLVTAQGGSDANRALVHLQRGSMYRRQGDYQHALIDFSESLRYDPESALAYTGRGNAYRGLKLLDQALADHTEAIRLDPKYATAYNNRGNVWRDKNDLAKAIADFDRAIAISPNYAMAYFN

SEQ ID NO: 20688 - protein, 399 aa, Rhodopseudomonas palustris
  unsure (1)..(399): unsure at all Xaa locations
ILGLCFVLSLLGRGLGESFTVFLLPISGSFGWDRAEVVSIYSLTALCTGLASPLVGRLFDRSGPRVVYTLGMTLLGGALLIAAYAERLWQLQLTVGLCVGLGIAFTGNVPNSILLGRWFGARLPTAMAVVYSAIGAGVLVMLPIAQLLIDRYGWREAYLILGGAMLILLVPLSLMPWRRFAAGADAHAQRPAQDADEDGWTLGSAMRHHAFWALFATFFFTAIGMYSISAQVVAYLVDAGFTPLQAATAWGFSGVVLVVGMLGVSWLDGVIGRRPSILFSYAISITGLVLLWLLQWYPNLLLLGGFVICFGSMIGSRGPLITATAMSIFRGRRVGTIYGTISIGSGLGSAFGSWCGGLLHDLTQSYNPVLGFALVSVVLGMIPFLVVPALRERQXAYAV

SEQ ID NO: 20689 - protein, 405 aa, Rhodopseudomonas palustris
FYKVLYVQVLFAIVVGVLVGWLSPHFATNEWIKALGDGFVKLIKMVIAPIIFCTVVSGIAHIQDARKVGRVGIKALLYFEVVSSFALVLGLIVGNLFPVGHGLAAKPDAGAVAKYVDQASHMSAVDFVLHIIPDSVVGAFAKGDILQVLLFAVLFGFALMALGERGHRLRDVIDDAAHAVFGVIAIVMKAAPIGAFGAMAFTIGKYGPAALGNLIGLVALFYATSALFVVLVLGTIAKFVGFNIFKFIGYIKDELLIVLGTSSSESALPQLMEKLERLGCSKSVVGLVVPTGYSFNLDGTNIYMTLATLFIAQALGIELSFGDQVAILLVAMLTSKGASGVTGAGFVTLAGTLAAVNPALVPGMAIVFSIDKFMSEVRALTNITGNGVAAVFVSWWEGELDHDRL

SEQ ID NO: 20690 - protein, 206 aa, Rhodopseudomonas palustris
MSLHIGDIAPDFTADTTKGKISFHDFIGNSWVFFFSHPADFTPVCTTEMGKTAKLAQPFASRNVKPIGLSTDTVDEHLKWIADVNDTQQTDLQFPIIADPELKVAKLYDMIHPNQSDTAAVRSVFIIDPNKKIRLTMTYPMNVGRNFDEILRVIDALQFADKHTVAAPADWRPGDKVIIPLSVKGEAATKAFPQGWEEPRPYLRLT

SEQ ID NO: 20691 - protein, 141 aa, Rhodopseudomonas palustris
IYVLNGPNLNLLGTREPEIYGRATLADVEKLCAETAAGFGLIAVCRQSNHEGQLIDWIHQARSEKVAGLVINAGGYTHTSIALHDALVGVQIPTVEVHVSNVFAREDFRHHSFIAKAAFASLCGFGIDGYRLAITGLAAKL

SEQ ID NO: 20692 - protein, 443 aa, Rhodopseudomonas palustris
MFDKILIANRGEIALRVLRACKELGIATVAVHSTADADAMHVRLADESVCIGPPPSKDSYLNVPALLAACEITGADAVHPGYGFLSENARFAEILSDHNLHFIGPKAEHIRLMGDKIEAKKTAKRLGIPVVPGSDGGVGPDDDAMAIAKEIGFPVLVKAAAGGGGRGMKVAHTAEDLALAISTAGNEAKAAFGDASVYLEKYLQKPRHIEIQVLGDGRGGAIHLGERDCSLQRRHQKVWEESPSPVISPEARARIGGICAKAMQDMQYLGVGTIEFLYEDGEFYFIEMNTRIQVEHPVTEMITGIDLVLEQIRIAAGGDLPVTQDEITLNGHAIECRVNAENPVTFRPSPGKISRYHPPGGLGIRIDSAVYQGYTIPPYYDSLVGKLIVHGKTRGECLMRLRRALDEMVVDGIETTLPLFRALVREPSIIDGDYHIHWLEQYL

SEQ ID NO: 20693 - protein, 245 aa, Rhodopseudomonas palustris
LGLKGAKVLVTGGTKGIGRAIAETFAAEGAHIGLCARNAAEVDGAVAALKATGVSAFGGAVDVSDGPGLKAWVADMAAKLGGIDVVVANVSALAIGSDEESWAKGFATDMMGTVRLVDAAMPYLEQSQQPAIVTVSSVSGREIDFAAGPYGTFKAAIIHYTQGLAYQLAGKGIRANTVSPGNTYFEGGVWEQIKNGNSDLYNTALALNPTGRMGTPQEMANAVVFLASRAASFITGTNVVVDGAL

SEQ ID NO: 20694 - protein, 1253 aa, Rhodopseudomonas palustris
VDLVILDTPRPGDAAKVQERVGADLAASDRPWLRVGGGQPAFANMSPPQARRLSGYYAGGGEANLTAMFAYLAASKAGTDTSTIAAPVPLASRGFYHPSAPHPFADIDAYLAWGAQRWKPEAPKVAFIIHPGLLAGFETAAIDMMITRAEAAGLLPVAFWFEARDPEALQQVLGPGKADVIVIATHLQNGSARSAEFRKLDVPVLQAISSRAGSPEQWAAAQSGIAQQLVAPFLAVPESLGVSDAIVTDALEDGRPTPMPEQVEALIAKARRLAVLRHKPAAEKKLALMFWNYPPGDKNFSASNLNVPRSVQRLISALAKAGYAVPPLGENQLIEIGQALLGGIYHPETLPELHKRGYAATFPVRTYRAWLDRLPAARRDELIARWGQPEVAQTVFEIDGERQFVVPRYEVGHLALMPQPQRGGGGGSNYHDTQEPPSHAYLAAYLLLADRGADALIHFGTHGTQEWTPGKDRGLAVTDYPFLSVGDLPVLYPYIQDNIAEAVQAKRRGRAVTVSHQTPPFAPAGLYDELRDLHAKIHEYIQLDDGNVRDQTAAEIRAIAIKSNINRDMSWDEGRMAGDFLGFLAALHDHIHELGRQSMPLGLHTFGEPATSDNRIATVMQQLGEPFYRQVGSQPDELFAADFSSFQATAPYRILRDVFASGGTVPSDAAPELKATLERAIVLDRRLTDTQEMEALLAGLAGRFVQPGAGGDPIRNPDVPSGRNIYPFESDKVPTRAAYDAGGAALSQLLDAYRTEHADAMPQKLAFSLWGSETMRHLGIQESQILHALGLRPVWDGGGRLVRLDIIPRAELGRARIDTVIQVTSVYRDQFDSFMRMLADAIERVAALDEPDNAVASNARALEARLIGRNQDAATARRLASLRMFSNAVGDYGTSLPGSVLKSASWDNEGSVADAYLDRLQYAYGSRDWGVRVGGNNLFAEQLKGVQAAVLSRSSKLHGLLSTDHSFEYLGGLSLAIRHLSGASPSLYVADLREQTSRVGSVARFLADELRSRYLNPHWIAGMQKEGYAGTLEILNAVNNLWGWQVTDPTSVRTDQWQAVHDTFVLDKHELGLAAWFKQSNPAAETQMIERMVEAVRKGYWKASEQTKRELVERLREIEDGPNSQITAAATRAFIAKLRAGFDLSAIAQPASEPASAPAPVSEAGGESRPGSCDAAGPGVSRRRPAKMAAMGGPGLASCVLCDRRLHAGPVRRETARRKAIDVNVIESSLFELTKLFLLPVLGLILLALAYAF

SEQ ID NO: 20695 - protein, 771 aa, Rhodopseudomonas palustris
TLGTPRIGPRRELKSALESFWAGKSTEADLLKVAAALRAANWARQSARGVSVIPSNDFSLYDQVLDTSVMVGAIPEIYGWRGGPVSLATYFAMARGTQAEIAGHGCANGHHHGDSTPQGVPAQEMTKWFDTNYHYMVPEFSAGQSFQLASVKPLEEYREAKALGYDTRPVLLGPVTYLKLGKSADAGLDVLSLLPKLVPVYIEILGRLAAAGAKWVQLDEPALVLDLDDRERLAFRDAYGQIARELPHLDIMLTTYFGGLGDNLDTALALPIAGLHLDLVRAPKQINAVIAKGPKDLVLSLGVVDGRNIWRADLPDLLDRVEPIVQQRGAERVQLAPSCSLLHVPVDLELETGLDPDLKSWLSFSLQKMGELSTLSRALSGDRAAVQDQLSASAKAAATRRKSPKVHDMAVSSRAAAVTPAMTQRNSGFAARATLQHQRLQLPAFPTTTIGSFPQTAQIRQARAAHAKGAISDADYNTFLRGETARAIQWQEKVGLDVLVHGEFERNDMVQYFGEQLSGFAFTKEGWVQSYGSRCVRPPILFGDVSRPKPMTVGWWKYAQSLTGRPMKGMLTGPVTILNWSFVRDDVPRSTACLQIALAIRDEVGDLEQAGATMIQIDEAALREGLPLRRSEWKGYLDWAVECFRLCSSGVKDETQIHTHMCYSEFNDIIDAIAAMDADVISIETSRSKMELLDAFKTYKYPNEIGPGVYDIHSPRVPSVEEMTTLLQLARQRLSDGQLWVNPDCGLKTRGWDEVQGALVNMVEAARQIRQ

SEQ ID NO: 20696 - protein, 431 aa, Rhodopseudomonas palustris
  unsure (1)..(431): unsure at all Xaa locations
PGNIDTLALHGGSFRADPATGATQVPIYQSTSFDLQTTERADRLVNFEEFGFVYSRIGNPTAHVLEERLAAIEGGAAALALASGQAAVALSVLTLVQAGDNIVTGTDLYGGTWNFFANRLKQFGIEARFVDPSDPEAFRAATDDRTRLYFGETLPNPKLNVFPIREVADIGRSFGIPLIIDNTAAPLLARPIEHGAAIVVHSATKYIGGHGTTIGGVIIDSGQFPWEEFADRHRLITGPDPSYNGRNWPDIARPFGPVAYAFAARAGLLRDLGPALSPQNAFQLIQGVETLPLRIRQQTANAARIADYLAQHPKVASVIYPGLQSGEARRRADTYLKGGYGALVGFELPGGFAAGRRFIDSLKLLFHVANIGDAHSLAIHPSSTTHAQLAPDKQLAAGVTPGYVRLSIGIESVDDIIADIAQALDATXKLL

SEQ ID NO: 20697 - protein, 258 aa, Rhodopseudomonas palustris
MTASPSQLPVLDLSRFRSDTAERAEFLRDVRDAAFGPGFFYLVGHGISDRLIRDVLFASRNFFALPEADKLDIEMINSPHFRGYTRAGREFTRGQPDWREQLDVGAEREAFPLSRSAPPWTRLQGPNQWPDALPELKPLLLRYQQEVTELAIKVLRVFAAALGQAEDVFEPIYVPSPNQLIKIIRYPGRAADESDQGVGTHKDSGFVTILLQDTVAGLQVETADGWIDAPPLPGSFVVNIGEILELASNGALRANVHR

SEQ ID NO: 20698 - protein, 350 aa, Rhodopseudomonas palustris
STFVQSAPGVHKGYEYARSQNPTRAAFEAAIADAERGHAGFAFASGLAAEAALLEIAGQGSHIVASDDLYGGSWRLFHRVRSHSAGLTITHVDPANLDALRDAIQPNTAFIWIETPSNPTLRLADLEAIAAIGRERGVLTVVDNTFASPAVQRPLEHGIDIVVHSVTKYIGGHSDIVGGAIVVRDPDLAQKLQFLQNATGGILDPFSSFLALRGIKRCRCGCNATVRMALAVARWLDAHPKIERVVYPGLNSHPQHALAVRQMDGGGGMVAAYLKADEQQVVDVLSRFRLFALAESLGAVESLVGQPWTMSHGSLPEADRLAREITPNLIRLSIGIEDVEDLTDDLEQAL

SEQ ID NO: 20699 - protein, 371 aa, Rhodopseudomonas palustris
YRAVIHPVLRELESRLAAFEGGASALAVASGQAASTFSVLNLAQAGDNFVTSTGLYGGTWILFDNTLRELGIEARFVDPSDPENFRRATDARTRLYYAETLPNPKLEVFPIREVAAIGRSLGVPLVMDNTAVPGVVRPLDHGAAIVMYSTTKYIGGHGTTLGGAIIDGGNFPWQQHAERFPLLTAPDAVDPQVVWTDVARPFGPIAFSLRARLKLLGDLGAGMAPIAASQILQGLETLPIRMEQHNANAIVVADYLKDHPKVAAVHFPGLQSGELRRRADASMRGGYGALIGFELRDGQAAGQRFIEALKLFYHVANIGDARSLAIQPSATTHSQLSEQDQLAAGVTPGFIRLSIGIEHPDDILADLAQAL

SEQ ID NO: 20700 - protein, 384 aa, Rhodopseudomonas palustris
TLAVHGGSFRSDPVTGAVVPPIYLTTSYQFQDTEHARRIFALEEIGYTYTRTVNPTREFLERRVSALEGGVGALALATGESASLYALLNIAHSGDNVVLSPDIVTGRNAGLVASLRQFGIDVRFAAETGSAESFATATDARTRAYYVESLSVPQLRAFPLAGAAEAAQQAGVPLIVDNTAQPLSVRPFEHGAALVIYSAAEYLGGHDGAQGGLIIDGGRFSWEAHGTRLPTLSEPDASYHGVVWTELVKKWNASPFVARTRAHLLRDLGAAINPLAVFQIIQGVETLPLRLRRQTANAREVATYLGAHPKVSGLATGAALIAFDLPSAAAAARFTDALTLFDPAVTYGGVRSAVLDRTSTSPRVVLSIGLEHAGDLLADLDSAL

SEQ ID NO: 20701 - protein, 452 aa, Rhodopseudomonas palustris
VFNPATGERIGAVPRFGTDEAEEAVRAAEIAFRQWSKLLAKQRATMLRAWFDQIIANRDDLALLLTREQGKPLAEALGEIDYAASFVEFYAEEARRIYGETIPSHRADARTMVIRQPVGVVAAITPWNFPAAMITRKVAPALAAGCTVVIKPAPETPLTALALGVLAQRAGFPPGVLNIITGDAPAIGKAWTEHPTVRAISFTGSTEVGKILMRQAASTVKKVALELGGNAPFIVFDDADLDAAVEGVIASKFRNMGQTCVCANRIYAQDGIYDAFVEKLTAKVATLQVGNGVDAGVTQGPLITTEAIAKVERHVSDAVAKGAKVVLGGKRHKLGRTFFEPTVLAGVTTAMLITREETFGPVAPVYRFTDEADVIAQANDSPFGLASYFYARDLGRVFRVAEALESGMVGVNSALLGADVVPFGGVKQSGLGREGSRHGIEEYVETKYILLG

SEQ ID NO: 20702 - protein, 423 aa, Rhodopseudomonas palustris
MTNSELLTRRQTAVVRGVSQATPVFAERALNSEIWDVEGKRYVDFAGGIAVLNTGHCHPRIVAAIREQLDRFTHTCFQVAPYEGYIRLAERLNQLAPINGPLKSILLSTGAEATENAVKIARAATGRSGVIAFTGGFHGRTAFASAMTGKVIPYKKALGPPLPGVWHVPFPVAGSDVSVEDALRCVQFVFKADIDASQVAAIIIEPVQGEGGFHQAPPELMRGLRRLCDENGIVLIADEVQTGFGRTGKMFAMEHYDVQADIVCVAKSLAGGLPLSGVIGRAAIMDAAEPGGLGGTYAGNPLACAAALAVLDVFEEENLIARANQIGERLRSAIDRFALSNTLVPTSVARGPGAMVAFDILKQRGSNEPDAEATKRVTRLAHENGLILLSCGTAANTIRILVPLTASDAIVDEGLAILERCLA

SEQ ID NO: 20703 - protein, 373 aa, Rhodopseudomonas palustris
LNELQTQIRDTARDFAHERLAPTAAARDAAHAFPRAELTEMGQLGFLGMLVPEAYGGSETGMVAYTLALEEIAAGDGACSTIVSVHSSVACMPILKFGTEEQKQRFLPKLASGEWIGGFALTEPQAGSDASNLRTTARRDGDHYVINGAKQFITSGQNGQLIILFAVTDPSAGKKGITAFIVPTDTPGYEVVRVEDKLGQHSSDTCQLAFNDMRIPADLRLGAEGEGLKIALSNLEGGRIGIASQAVGMARAAFEAARDYARDRVTFGKPIIEHQAVAFRLADMATRIAAARQMVLYAASLREAGLPCLTEASMAKLFASETAEAVCSSAIQTLGGYGYLKDFPVERIYRDVRVCQIYEGTSDVQRIVIARNL

SEQ ID NO: 20704 - protein, 389 aa, Rhodopseudomonas palustris
IVIVGSARTPMGGFQGELKDATASQLGAAAISAAVVRAGLKPDAIDEVVFGCVLPAGQGQAPARQASLGAGLPLSAGCTTVNKMCGSGMKAAMFAHDLLIAGSATVAVAGGMESMTNAPYLLDRARGGYRMGHGRVIDHMFLDGLEDAYDKGRLMGTFAEDCAQSYQFTRETQDNFAITSLTRAQAAIKDGSFAREITPVTIKAGKSEVTVTTDEQPLKAKLEKIPTLKPAFREGGTVTAANSSSISDGAAALVLMRRSEADKRGLKPLAAIVGHSTHAHEPALFATAPIGAIRKLSERTGWNLADVDLFEVNEAFAVVALAAMHDLGLPHDKVNVHGGACALGHPIGASGARVLVTLLAALEKHDLKRGIASLCIGGGEATAVAVERL

SEQ ID NO: 20705 - protein, 252 aa, Rhodopseudomonas palustris
ITDRVFLVTGAASGLGAATARTLVAGGAKVVGLDLNAEAGAKLEQELGASFRFLATDVTKAEDAEAAVKLAQDVFGHVNGLVNCAGVAPGEKVLGRNGPHKLDSFARAITINLIGSFNMIRLAAEAMSKEQPDAEGERGVIINTASVAAFDGQIGQAAYSASKGGVAAMTLPIARELAQHGIRVVTIAPGIFETPMMAGMPQPVQDALGKSVPFPPRLGRPAEYAALVKAICENTMLNGEVIRLDGALRMAP

SEQ ID NO: 20706 - protein, 544 aa, Rhodopseudomonas palustris
IEDYADVLARFRREDLEALFDGNFATGINVCIECCDRHVAGGGTALDWESQDGRTASFSFAEMKDYAARVANLLVAQGVKPGDVVAGMLPRTPELLALILGTWRAGAVYQPLFTAFGPKAIEHRVKMSAAKLVVTDLANRAKLADVADCPTVAIVLRPGETAPLGDLDFHAEIAAQSTEFAPVLRKGTDLFLMMSTSGTTGLPKGVPVPINALPAFYSYIRDAVDLRAGDIFWNIADPGWAYGLYYAVTGPLLHGHATTFYDGPFTAESTYGLIKRRGITNLAGAPTAYRLLIAAGPEAAAPVKGQLRVVSSAGEPLNPEVIRWFAEHLAAPIHDHYGQTELGMVVNNHHRLRHTVHPGSAGLAMPGFRVAVLDEHSNELPPNVPGVLSVDLKRSPLMWFSGYWQQETPAIEGGYYRTGDTVELEPDGSISFVGRADDVITSSGYRIGPFDVESALIEHAAVIEAAVIGKPDPERTEIVKAYVVLAKDVTPSEALAEELRQYVKKRLSAHAYPREIEFLEQLPKTPSGKLQRFILRKRDTEPAG

SEQ ID NO: 20707 - protein, 343 aa, Rhodopseudomonas palustris
AADDPTFMLRLAERGVEAVRINCAHDDAAAWQRMINHLHVAEEATGRRMKVLMDIAGPKIRTGDARTPDGRDRIVTGDLVAIVAQGEFERIDLDDEHFAVECTLPDPLTRAAVGARVFVDDGKLCVRIERKTAWGLLGRVTATADTGFRLKPEKGLNFPDTPLDIPALTAKDRADLDFVAAHADGVEFSFVQSVGDVKMLQAALAERRPDDWHKLSLVLKIETPDAVAHLPDILVQAAGRQPTAVMIARGDLAVEIGFARLAEMQEEILWIGEAAHVPVIWATQVLEHLVKKGTPSRGEMTDAAMAARAECVMLNKGPYLFKAITELDTLLGRMADHQHKKTP

SEQ ID NO: 20708 - protein, 322 aa, Rhodopseudomonas palustris
  unsure (1)..(322): unsure at all Xaa locations
IRFDGRVAIVTGAGNGLGRAHALGLAALGAKVVVNDFGGARDGTGGSMTAAETVVEEIKKAGGTAMADGADVSNYEQVQAMVAKATKEWGSVDLLVANAGILRDKSFGKMELSDFQKVIDVHLAGTFYCCKAVWDGMKERNYGRIVLTTSSSGMFGNFGQANYGAAKAGIVGLMNVLAQEGRKTDIRVNTVSPTAATRMTEELLPPQALQLMKPEAITPAVLFLLSENAPTRTTLGAGAGSFAQIKIIETEGINLPENEWTPDGIAAHFAEISDDSKAQALEGAFQQTQKYVAQAAARLGIKMXDRAAARSSRRTTPDSGFA

SEQ ID NO: 20709 - protein, 196 aa, Rhodopseudomonas palustris
MIDLYYAPTPNGWKISIMLEECGLPYKVVPMQLGRGDQHQPGFLKLSPNGRMPAIVDHAPIGGGAPLSVFESGAILIYLAEKSGQLMPTETRARFEVMQWLMWQMAGLGPMLGQNGHFLLYAPEKIPYAIDRYSREAKRLYGVLDQRLADRACIAGDYSIADIACFPWIMTHKAQGLTLDDYPNIKRWYAALRARP

SEQ ID NO: 20710 - protein, 246 aa, Rhodopseudomonas palustris
KIALVTGAGTGVGRAAALALMQSGFTVVLAGRRLELLQETQKLGAEFGDGLPVVADMADPASIAALFDTIVQRYGRLDVLFNNAGIGAPPVPFEDLPLEQWQAVVTTNLTAPFLCTQHAFRIMKDQTPRGGRIINNGSISAHAPRPFSAAYTATKHAISGLTKASNLDGRAYDIAVGQIDIGNAATPMTDRMVQGVLQPDGRTIAEPRMDAKAVGDAVAYMAGLPLDANVLFITVMATKMPFVGRG

SEQ ID NO: 20711 - protein, 104 aa, Rhodopseudomonas palustris
MNFRPLHDRVVVKRIDAEEKTAGGIIIPDTAKEKPSQGEIVAVGPGGRDEAGKLIPIDLKVGDRVLFGKWSGTEVKIDGKELLIMKESDIMGVITDVGAKKKAA

SEQ ID NO: 20712 - protein, 153 aa, Rhodopseudomonas palustris
EFGALDDITPEHFHRQFDVNVLGLLLVTQAAARQFNDGGSVVNISSGVSTIAMPNTAVYGATKASVDLITAVLAKELAPRKIRVNAVNPGMVVTEGVKAAGFHDGEMRKQVEAITPLGRIGEAAEIASVVAFLASDGASYVTGETLHVTGGLK

SEQ ID NO: 20713 - protein, 463 aa, Rhodopseudomonas palustris
YIDGAWVDPVVKKSTPVVNPATEEAMYEVALGSKADVDKAVAAAKRAFETFSVTSREERIALLEKVVAIYKSRMKEIGAAISDEMGAPLPMAEKMQAGAGLGHIMSTLDVLKNYQFEEPLGSAMIVREPIGVVGMITPWNWPLNQIACKVAPAIAAGCTMVLKPSEFTPTSALLFAEILHEAGVPKGVFNLVNGLGPEVGAAMSEHPDIDMISFTGSTRAGIDVAQRAAPTVKRVSQELGGKSPNVILEDADLTKAVTGGVMHMFNNSGQSCNAPSRMIVPLSKMKEVAAIAKGVAEKTKAGDPRGEGTTIGPVVNRIQWDKIQTLINKGIEEGATLVAGGPGLPEGVNKGFYVRPTVFADVTKDMTIAREEIFGPVLVIMGAKDENEAVELANDTPYGLAGYVSAGSVDRARAVGRKIRAGNVNLQGVPNERTAPFGGYKQSGNGREWGKFGLEEYLEVKAI

SEQ ID NO: 20714 - protein, 267 aa, Rhodopseudomonas palustris
LAPIGQGTWYIDQGDRASALAALRRGLDLGLTHIDTAEMYGDAEPLVAEAIAGRRDEVFLVSKVLPSNASRRGTIAACERSLARLRTDRLDCYLLHWRGHYQLSETVAAFEELVAAGKILSWGVSNFDAGDLRELHRIAGDGKIACNQVLYHLLERAIEHTVIPWCEAHGVAVTAYSPFGHDEFPAPRSAAGQLLQSIAGAHGAKPRQVALAFLTRRPSVFAIPKAGNPSHAADNAAALALRLSEEEIDAIDQACPLGPEPASLPML

SEQ ID NO: 20715 - protein, 488 aa, Rhodopseudomonas palustris
AVMFGDQRMTFTEVDLLSNRIANVFIDTFRLEVGSRVGMLLNNSIYTLPIDFGFVKSRLSRVPLNSRLSLVEQQQMLEGAGVNILIHGTDLTDPARELAQAMQGLKLISIGSADADDLLQLAKAQSDAPPARRCEPDDIVITIFTSGTTGKLKAVEHTQASWAAMATNVLINMEVGEGDVMLHAASMIHASGCFIVPYWLRGGVAAVLPGFTPASYLDAVERWKPTALNLVPTMIGMLLDHPGIEHADFSSVKRIIYGASPMPRPVMQRALKLWGPRFAQYYGQSEAPIFITHLTQADHVGPKAEQRLASCGRPSIDCEVKLVDEAGDEVAPGEAGEIALRTPFAMKGYYNAPELNAQMFLPDGWLRTRDVGRFDDDGYLYLVDRTSDMIVSGGYNVYPREVEDALAAHPAVREVVVVGLPDDKWGESVAAFVALRAGASAEEVELIAFARERVASYKVPKQVRFIDEVPKSPVGKLLRRAVRDPFWQ

SEQ ID NO: 20716 - protein, 678 aa, Rhodopseudomonas palustris
WRSAAKAKRASHSACVRGVQAMSVTRMLKLTPFSKILIANRGEIALRVMRSARRLGYGVVAVYSDADADAAHVRAADEAVAIGGAQPSQSYLNIPAIIAAAKTAGADAVHPGYGFLAENEDFAAACRDAGLVFIGPSAESIAAMGNKAGAKEIMLKAGVPCVPGYQGEDQSDAAMVREAERIGFPIMIKAVAGGGGRGMRLVKDAAALPDALRSARSEAQSAFGDPTVILERAILQPRHIEIQVFGDRYGAGIHLGERDCSVQRRHQKLIEEAPSPAVSEALREQMGAVAVNAVKAIGYEGAGTLEFLLDAEGNFYFMEMNTRLQVEHPVTEAITGLDLVELQLRIAAGEPLPLRQDDVTFKGHAIEVRLCSEDADHDFMPQSGRMALWRMPPELRVEHALQSGAEIPPYYDSMIAKVIAVGASRDEARRKLIHGLDGTIAFGVTTNRGFLAACLRHKAFAAGEATTAFISQHRDELVRSLPDDAVSAVAVAALLLYVTDSYAPPHRPGRSLAAVFPTRLKFELDGVEQACEVVRERDGSYVVSHEGQSISFVIEELSAGSIRFQAQGLGESAVFHRDGHRLFVQRLGVQNSIVDLTRSAPQSAARGGGDGKLRAALNGRVVAVLVKAGDRVEAGQPVLTLEAMKMEHVHTAPGSGIITIDVAEGEQVTAGRIVAEIE

SEQ ID NO: 20717 - protein, 498 aa, Rhodopseudomonas palustris
LRKSARRFPDRVALTDGGRSVTYTELERDANRFANALVARGLKPGAKISTVCNNSIEFVKALFGIHRAGLVWVPINTMLGPDDMGYILDHAGVKVAVIDDNLHGQPERRAALEARGIDLIAINLAGKAADTGLPVFDQLIEGLSEIEPDVAFDDRDLAMIIYTSGTTSRPKGAMHCHLAVTMAVMSNAIEMQLSRKDGITGQFPLFHCAAHVLLLSYLIVGGQMAIMRGFDPVACMEAIQRNKLTVFIGLPLMYQVILDHPRRKEFDLSSLRCCIYTMAPMPRPLLERAIAELCPTFVQPSGQTEMYPATTMSQPDRQLARFGNYWGESTLVNETAIMDDAGNLLPPGEVGEIVHRGPNVMLGYYKDPEATEAARKFGWHHTGDLALIDEHGEVLFLDRKKDMIKSGGENVASIKIEETLLAHPSVMNAAVVGLPHPQWGEAVSGFVKLKPGASATEAEIVEHCKKHLGGFQVPKLLRIVDEMPMTATGKLRKVELRN

SEQ ID NO: 20718 - protein, 378 aa, Rhodopseudomonas palustris
RNQMLFTADHDEPRRILQRFIQSDINPHVDEWENAGIFPAHELFKKLGDLGFLGLNKPVEYGGQGLDYSYALMMAEELGAINCGGVPMAIGVQTDMATPALARFGSDELRKEFLAPSIAGDYVACIGVSEPGAGSDVAGIKTTAKSDGDDYVISGGKMWITNGTQADWICLLCNTGEGPVHRNKSLICVPMKTKGVTIARKLDKLGMRSSDTAQIYFDEVRVPKRNRIGEEGKGFTYQMVQFQEERLWGAAACLKAHEKTIQNTIEYTRGRKAFGKPLLDNQVIHFRLAELQTEVELLRSLVYRAAEALVAGEDVTQLATMAKLKAGRLGREIPDACLQFWGGMGFMNETLVSRSYRDSRLTAIGGGADEVMLGILCK

SEQ ID NO: 20719 - protein, 365 aa, Rhodopseudomonas palustris
FRDVIRRFVQNEIEPFATEWDEAGGFPRELYEKAAAIGLLGLGFPEEYGGTPCDQFMWIVATQELARAAAGGVSASLNSHSIGAPPIARAGSPELKARVLPEILSGKKISALAITEPSGGSDVANLRTRAVRDGDHYVVNGEKTFITSGMRADYITTAVRTGGEGPGGVSLLLIPGDTPGLTRTPLKKMGWWASDTATLHFDNCRVPAANLLGTEGAGFMIIMMNFNSERLTMAAGCIAASKVCLDEATEYARQRVTFGKPLVKHQVIRHKLVDMAQKIAASQAMLELLAWRVDQGESPIAEICMLKNQATQTMAFCASEAVQIFGGAGYMRGVKVERIYRDVKVNAIGGGTEEIMKDLASRQMG

SEQ ID NO: 20720 - protein, 275 aa, Rhodopseudomonas palustris
FVKTKDGVDIFYKDWGPKQAQPIVFHHGWPLSSDDWDAQMLFFLANGYRVVAHDRRGHGRSSQVDTGHDMDHYAADASAVAEHLDLKKAVHIGHSTGGGEVARYVAKFGEPQGRVAKAVLVSAVPPLMLKTEKNPGGLPIEVFDGFRKALAGNRAQFFLDVPAGPFYGFNRPDAKTMPGVVNNWWRQGMMGSAKAHYDGIKAFSETDQTDDLKAITVPTLVLHGEDDQIVPIEDSAKLSVKLLKNGKLKTYPGYPHGMLTTHADVLNADLLAFVK

SEQ ID NO: 20721 - protein, 393 aa, Rhodopseudomonas palustris
  unsure (1)..(393): unsure at all Xaa locations
MKALTWHGKNDIRCENVPDPKIQHGRDAIIKVTACAICGSDLHLMDGVMPSMQSGDVLGHETMGEVVEVGSENTKLKVGDRVVVPFTISCGECFFCQRGFYSGCERSNPNAKMAEKMWGHSPAGLFGYSHMLGGYAGGQAEYLRIPYADVGPIKVPDGLTDEQVLFLSDIFPTGFMAADFCNLKGGETVAVWGCGPVGQMAIKSAFLLGAERVIAIDTVPERMELARQSGAIVINFMDDDVYDKIQDLTNGRGADACIDAVGTEAAATASLDSMIDRVKVATFMGTDRPHVLRQAIHCCRNFGTVSIVGVYGGLLDKIPMGSAINRGLTMRMAQTPVQQYLPQLLGRIQQGEIDPSFVITHRATLDEGPELYKTFRDKKDGCIKVVMRPXATS

SEQ ID NO: 20722 - protein, 277 aa, Rhodopseudomonas palustris
YPEPPYPSQRQSMPGSTDKMTPRPDHGEHSYKGSGKLTGKVAIITGGDSGIGRAVAIAYAREGADLLIAYLSEDEDAQQVKELVEAEGRKAVLVAGDIAQPDHCRKVVDHAVEEFGRIDLLVNNAAHQAAFKDIGDISDEEWQTTFAVNIHAMFYLTKAAVPHMKPGSAIINTASVNSDMPNPMLLAYATTKGAIQNFTRLAQMLASKGIRANAVAPGPIWTPLIPSTRPDDAVKNFGKQVPLGRAGQPAELATAYVMLADPLSSYTSGTTVAVTGG

SEQ ID NO: 20723 - protein, 710 aa, Rhodopseudomonas palustris
  unsure (1)..(710): unsure at all Xaa locations
FPIVLLIRRKRFEEVPVEVLDFIDGYVFLSEETPTFIARNLISRLKQYADTLKTPFFGALVDYAEEGNQLWTCPGHNGGMFYSRSPIGRVFIEHLGEAVFRDDLDNSVLDLGDLLTHEGPALRAQKEAAQIFGAEKTYFVLNGTSTSNKVALGALVSDGDLILFDRNNHKAAHHGALMMGGGIPVYIPTVRNAWGLIGPMAWDALDETALRERIRSHPLVKDPEAWRKPRPFRVAVVEQCTYDGTIHSAEMILRRIGHLCDYILFDEAWAGFMKFHPLYAGRFAMGLANLGDDAPGIIATQSTHKQLASFSQASQIHIKDRHIRGQKRRVEHRRFNESFMQHASTSPFYPLFASLDVGAQMMKGRSGEVLWDDTIRLGIELRKKIRAVRREFEEKEARAERRWFFDPFVPDRVTIADAAREGAVHDVAWEAVSTDQLATDPTFWQIAPGAAWHGFADMAPGFAMTDPNKLTLLTPGFDRATGRYAEHGVPAPVVAQYLRENRIVPEKNDLNSLLFLLTPGVEASKAGTLISGLVAFKKLHDDNAPLDEVIPEFSRRRPARYAGVRLRDLCGQMHRFFRDADVSALQAKQFLPEHLPEIAMSPHDAARCLVRNDVDYLPISQIAGRIATTPFVVYPPGIATIVPGERLSERAKPMLDYLQMFERSFNEFPGFEVEIQGVYREFDELGRVRLYTYVVAEXPAVSWSCRGRRL

SEQ ID NO: 20724 - protein, 240 aa, Rhodopseudomonas palustris
KCVVVTGVSSGIGHAIARMLLDKGFRVFGSVRKHSDAERLIVELGAGFTPLVFDVTDETAIRAAADEVRRALDGETLAGLVNNAGIAVAGPVLDLPADEFRRQFEVNVIGPILATQAFGPLLGTDRSLRGAPGRIVMMSSIAGKFGNPLMAAYSASKHALNGLSDGLRRELMLFGIDVVVIMPGAVKTPIWGKAEREDVSRFANSPFYPALQKLRALLPEMDESGLPPETIAQHVYDALT

SEQ ID NO: 20725 - protein, 119 aa, Rhodopseudomonas palustris
FHLIDRIAELRLADRSITVEARVPETSTIFEGHFPGYPLMPGVLLIETMAQSSGWLLIALMQFQRMPFLAAVKEAKMRTFVTPGETLSIDVSVVHEGSGFTVTEAKIKSGGKLACNATL

SEQ ID NO: 20726 - protein, 411 aa, Rhodopseudomonas palustris
VVVTGMGVVTSLGAGKNDNWAKLTAGESGIRTITRFPIDGLKSTMAGTVDFVPVEPFSSVVLGEKLADLATEEAIAQSGIGRKGDFPGPLFLAVAPVELEWLPRQELARATGANTAIDYDALLRVSGGGTFTQYHRRFLFGSVADHLADTFGTKGSPISLSTACASGASAIQLGVEAIRRGEADAALCVATDGSVNAEALIRFSLLSALSTQNDPPQASSKPFAKNRDGFVMAEGAGALVLESYESAVARGASILGVIAGCGELADNFHRTRSSPDGKPIIGCINKTLADAGMSVDQIDYINAHGTGTPENDKMEYLGISSVFGERASSLPVSSNKSMVGHTLSAAGAVEAIFSLLTLEHQRIPPTINYDVPDPAIPLDVVPNQARDARVTAVMSNSFGFGGQNASLILTR

SEQ ID NO: 20727 - protein, 360 aa, Rhodopseudomonas palustris
QLARDNDAINLGQGFPDDPGPEDIRRAAADAVLNGYNQYPSMIGLPELRQAISTHYAHWHGVQLDPMTEVMVTSGATEALASAILSVVEPGDEVIVFQPVYDSYLPIIRQAGGIPRLVRLEPPHWRITEESLRRVFNAKTKAIVFNNPLNPAAVVYPREDLELLARFCQEFDAVAICDEVWEHVTFDGLSHIPLITIPGMRDRTIKIGSAGKIFSLTGWKVGFVCAAPKLLRVAAKVHQFLAFTTAPNLQAAVAYGLGKSDDYFLQMRKDLARSRDRLAQGLSSIGFPVIRSQGTYFLTVDLSPLGLNETDEAFCKRIVTDYKVAAIPVSAFYEEEPVTSVVRFCFAKKDQTLDTALERL

SEQ ID NO: 20728 - protein, 485 aa, Rhodopseudomonas palustris
LAYRTFVHMHDLSLRFHLERKTGGLTRVLERGRLGIEVIVRMVILQLVPTIIELSLVMAVLLWQFDWRYVAAVMVTVVFYMLYTYKATEWRIGIRRRMNDSDSDANQKAIDSLLNYETVKYFGAEEREAKRYDKSMRHYEDASVATYTSLAVLNAGQAVIFTFGLTATMLMCASGVRNGTNTVGDFVMINAMMIQLYQPLNFMGMVYREIKQAIIDIEKMFAVLSRKPEVEDRAGAKPLAVEAGTVRFEDVKFAYDPARPILKGLNFEVPAGKTVAIVGPSGAGKSTISRLLFRLYDVSGGRILIDGQDIRSVTQTSLRAAIGMVPQDTVLFNDTIRYNIRYGRWDATDAEVEEAAKTAQIDAFIKASPKGYDTEVGERGLKLSGGEKQRVAIARTVLKAPPILVLDEATSALDSHTEHEIQGALERVAQNRTSLVIAHRLSTIVGADEIIVLDQGRIAERGTHSQLLAAGGLYASMWNRQREAE

SEQ ID NO: 20729 - protein, 450 aa, Rhodopseudomonas palustris
LRSIVGDGGVLEAAELSKRSAGTYRFDTLKAAALVRPTSTQQVSEILRWCHANGVHVVTHGGLTGLVHGADAEPSEVILSLERMRTIEEIDPKQRTAVVQAGVPLQALQEEVDKHDLAFPLDLGSRGTATLGGNAATNAGGNRVIRYGMTREMILGLEVVLADGTVLSSLNHLIKNNAGYDLKQLFIGSEGTLGVITRLVLRLREKPLATNMAFVGLDSFDAVAKFLKHCDRALGGTLSAYEVMWQSFYRLVTSPPAKGRPPIGQDHAYYVLVESQGSDLELDSQRFTAAMEAALESGLIADAAIAQSDEDCRSFWALRDDVGQVLQGGLPIVFDVSLPIAAMEGYAETLRETLTNEIGEHRLWIFGHLGDGNLHVVVQVKPMEYLALRPKVEALVYRPLAACNGSVSAEHGIGLEKKPYLYVSRSANEIALMRRLKQALDPKGILNPGK

SEQ ID NO: 20730 - protein, 448 aa, Rhodopseudomonas palustris
RWTPDSWRAKPVQQMPQYPDAKALADVEAQLASFPPLVFAGEARNLKKALATVAAGDAFLLQGGDCAESFAEHGANNIRDLFRVFLQMAIVLTYAGASPVVKVGRIAGQFAKPRSAPVEKRDGVELPSYRGDIINDVAFTEEARVPDPRRQIEAYRQSAATLNLLRAFAKGGYASVENVHSWMLQSVSDSPQSKAYADLADRVSGALDFMRACGLTFAVDSSLGTTDFYTSHEALLLGYEQAMTRVDSTTGDWYATSGHMLWIGDRTRQLDHAHVEYFRGIKNPIGLKCGPSLKTDELLKLIDILNPDNEPGRLTLIGRFGHEKIGEHLPAMVRAVKREGRTVVWSCDPMHGNTITSNSGYKTRPFDRILSEVRSFFAVHAAEGTHAGGVHLEMTGQNVTECLGGARAITDEDLNNRYHTACDPRLNAEQSIDMAFLIADLLKQGRAG

SEQ ID NO: 20731 - protein, 369 aa, Rhodopseudomonas palustris
MKTRAAVAFEAKKPLEIVELDLEGPKAGEVLVEIKATGICHTDAYTLDGFDSEGIFPSILGHEGAGIVREIGPGVTSVKPGDHVIPLYTPECRQCKSCLSQKTNLCTAIRATQGKGLMPDGTSRFSYKGQTIYHYMGCSTFSNFTVLPEIAVAKIRDDAPFDKSCYIGCGVTTGVGAVVNTAKVTPGSNVVVFGLGGIGLNVIQGAKMVGADKIVGVDINDDKEEWGRRFGMTHFVNPKKIDGDIVQHLVGLTDGGADYTFDCTGNTNVMRQALEACHRGWGVSVVIGVAEAGKEISTRPFQLVTGRVWKGSAFGGARGRTDVPKIVDWYMNGKIEIDPMITHVLKLEEINKGFDLMHQGKSIRSVVVY

SEQ ID NO: 20732 - protein, 264 aa, Rhodopseudomonas palustris
RLIVAGAGGRMGRALTRAISETEGVVLTGALESPNSELLGKDAGTLAGLPANGVLLSADLWSLSANADGIVDFTVPQATIANVAIAAQRGIAHIIGTTGLSTSDNAVIQSVTDRAVVVKSGNMSLGVNLLAAIAKRVAQSLDDSFDIEIVEMHHRAKVDAPSGTALLLGEAVAAGRKIDLATHSARGRDGFTGARKPGDIGFASLRGGTVTGDHTVIFAGASERIELTHKAEDRMIFAHGALTAARWAKGKKPGLYSMADVLGL

SEQ ID NO: 20733 - protein, 630 aa, Rhodopseudomonas palustris
MGKVIGIDLGTTNSCVAVMDGKSAKVIENAEGMRTTPSIVAITDDGERLVGQPAKRQAVTNPERTFFAVKRLIGRRYDDPMVEKDKGLVPYKIVKASNGDAWVEADGKTYSPSQVSAFILQKMKETAEAHLGQKVDQAVITVPAYFNDAQRQATKDAGKIAGLEVLRIINEPTAAALAYGLDKAKTGTIAVYDLGGGTFDVSILEIGDGVFEVKSTNGDTFLGGEDFDMRLVNYLADEFQKEQGIDLRKDKLALQRLKEAAEKAKIELSSTTQTEINLPFITADQSGPKHLTMKLTRAKFEALVDDLVQKTIEPCRKALKDAGLTAGEISEVVLVGGMTRMPKVQEVVKQLFGKEPHKGVNPDEVVAIGAAIQAGVLQGDVKDVLLLDVTPLSLGIETLGGVFTRIIDRNTTIPTKKSQVFSTAEDNQNAVTIRVFQGEREMAADNKMLGQFDLMGIPPAPRGMPQIEVTFDIDANGIVNVSAKDKATGKEQQIRIQASGGLSDSEIDKMVKDAEANAAEDKKRREAVDAKNHADALVHSTEKALAEHGSKVDESERRSIEDALSDLREALKGDDAEAIKAKSNTLAQASMKLGEAMYKQAEAAGGAQQAGKDDVVDAEFTEVDDDKKKS

SEQ ID NO: 20734 - protein, 557 aa, Rhodopseudomonas palustris
  unsure (1)..(557): unsure at all Xaa locations
ASQEPPPDLQPNQSKTRALIAARESADAANHAKSRLLAMASHEIRTPLNGIIGMSRLLLDTPLSAEQATYAKAVKTSGEALLALTDELLDYARIEAGKIELDCRPFVLSSLIEDIIELLAPRAQARGLEIAADIDERLPVSLIVDAARLRQVLLNLCGNAIKFTETGGVALIVERGDQSGELRIIVRDTGIGIAPDAQARIFHEFEQADAGIARNFGGTGLGLSISDRIVAAMGGRIALESKPGEGSTFTITLPLSTAENDRATAAFAPPDLHGSSVMIVSAHGVEASLAARRLERWGAETCLCDDLAAAIARLPERSWHAVLIDHALGSDAIETLAREAQRVPPIAWXCXRRRHGTNCCRICPPRSQAIWXSRCGPRRLPHGSARRSRSRRQVSQTAIRRPFRMRPRPITHEAFAILVAEDNDINALLIRALLHRLGHHAEIVGDGRRAVEAWGAADNTGTPFDLVLMDVQMPILDGLAAARQIRTLEAERARSRVPILALTANTLAEDREACLESGMDGFLVKPIDPDRLAAILAGVPPRTKPPDTAGKYRAPLL

SEQ ID NO: 20735 - protein, 99 aa, Rhodopseudomonas palustris
LHDLAATVDARAASGGESSYTKKLLDKGPEHCAKKFGEEAVEMVIAAVENDRGHLISETADVLFHMLVLLKSRGVKLEEVEAALAQRTSMSGLEEKASR

SEQ ID NO: 20736 - protein, 259 aa, Rhodopseudomonas palustris
  unsure (1)..(259): unsure at all Xaa locations
MFKVRVIPCLDVKDGRVVKGVNFVDLRDAGDPVEAAIAYDAAGADELCFLDITATHENRGIMLDVVRRTAEACFMPVTVGGGVRTVDDIKTLLRSGADKVSINSAAVARREFVKEAAEKFGDQCIVVAIDAKRVPGRDRWEIFTHGGRKGTGIDAIEFAQEVVSLGAGEILLTSMDRDGTKSGFDIPLTRAIADSVGVPVIASGGVGNLDHLVDGIREGHATAVLAASIFHFGEYTIRQAKDHMVQAGLPMRLDPXRYA

SEQ ID NO: 20737 - protein, 194 aa, Rhodopseudomonas palustris
ATIKRKTKETDIEVTVDLDGTGVANAATGIGFFDHMLDLLAKHSRIDITVKAVGDLHVDFHHTTEDVGIALGQAVKQALGNMAGITRYATVLMPMDETLTRVVIDVSGRPFLVFKADFPRDKIGEFDTELVREWFQAFAMNAGVTLHVETLYGENSHHIAESCFKGLARALRAAVAIDPKTAGEVPSTKGQLGG

SEQ ID NO: 20738 - protein, 268 aa, Rhodopseudomonas palustris
LTLTTWNINSVRLRIDLVAKFLKAQRPDILCLQETKCPDDAFPLKRFKRLGYEHIALNGQKGYHGVAVISKLPFVTTDIRTFCDIIDSRHISVSVKTDENAPPLVLHNFYVPAGGDIPDPAVNPKFKHKLSFLDEMKACEPLHPSGDQRHILVGDLNVAPHEHDVWSHKQLLKVVSHTPVECEKLLAVLRAGNWVDVARERIPLDQKVYTWWSYRAADWTVGDRGRRLDHIWVSEALKDRVVDFKVLRDARSWERPSDHVPVTMTMEL

SEQ ID NO: 20739 - protein, 327 aa, Rhodopseudomonas palustris
GSLNSIAVLGGGAWGTALAQTAARAGRKVTLWEHDAGNAEHLIAARESRFLPGVRLEPSIQVTRDLAEAARADALLLVVPAQVLRQVVTSLQPLIAPRTPLVACAKGIEHGTHRFMTEIIAEAAPAAIPAILSGPSFAADVARGLPTAVTIAATDAACAQALAQAMNSGSFRPYHSTDVRGVELGGATKNVLAIAAGIVEGRQLGASALAAMTTRGFVELVRFGKAYGARIETMHGLSGLGDLTMCCSTPQSRNFSFGMALGRGEGIESAAHGKLAEGYYTAPVLLEMAQAKDIDMPISTAVAAVLGGKLSVDAAIEGLLTRPLKAE

SEQ ID NO: 20740 - protein, 270 aa, Rhodopseudomonas palustris
FAKMNGIGNEIVVVDLRDQPAPVTPADARAVAAHVPYDQLMLLQPARLSGTEAFVRIYNNDGSESGACGNGMRCVARQMFSGSEKNGLTFETRAGLLNCWRGPADGLYTVDMGEPKFGWQDIPLAEEFRDTRMIELQIGPIDAPVLHTPSVVSMGNPHAIFWVDDVNAYDLGRFGPLLENHPIFPERANITLAHIVDRQHITMRTWERGAGLTKACGSAACSTAVAAARLKRTDRTVEMTLPGGQLTIEWRESDNHVLMTGGAAFEFEGR

SEQ ID NO: 20741 - protein, 337 aa, Rhodopseudomonas palustris
TMGYKVAVVGATGNVGREMLAILDERKFPADEVVALASRRSVGVEVSYGDKTLKCKALEHYDFSDVDICLMSAGGEVSKEWSPKIGAQGAVVIDNSSAWRMDPDVPLIVPEVNAAAAAGFTKKNIIANPNCSTAQLVVALKPLHDHAKIKRVVVSTYQSVSGAGKDAMDELFSQTKAVYTNSELVNKKFPKRIAFNLIPQIDVFMEDGFTKEEWKMVVETKKILDPKIKLTATCVRVPVFVSHSESVNIEFENPISADEAREILRKAPGCLVIDKHEPGGYVTPYEAAGEDATYISRIRTDPTVDNGLVLWCVSDNLRKGAALNAIQIAEVLINRKL

SEQ ID NO: 20742 - protein, 366 aa, Rhodopseudomonas palustris
THKLLLLPGDGIGTEVMAEVSRLIDWLNKAGIASFETEHGLVGGAAYDADKVAITDATMALAQASDAVIFGAVGGPKWDGVPYDARPEAGLLRLRKDLGLFANLRPAVCYPALADSSSLKRDVVEGLDIMIVRELTGGVYFGEPKTITDLGNGQKRAVDTQVYDTYEIERIGRVAFDLARKRRNKVTSMEKRNVMKTGVLWNEVITAVHDREYKDVQLDHQLADSGGMNLVKWPKQFDVIVTDNLFGDMLSDIAAMLTGSLGMLPSASLGEVDAKTGKRKSMYEPVHGSAPDIAGKGMANPVAMLASFGMALRYSLDMGALADKLDEAIAAVLAKGLRTADIKSEGTTVISTSQMGEAIVTELQAL

SEQ ID NO: 20743 - protein, 477 aa, Rhodopseudomonas palustris
GDKISYAELVARAGRVANVLVARGLQVGDRVAAQTEKSVEALVLYLATVRAGGVYLPLNTAYTLHELDYFITDAEPKIVVCDPSKRDGIAAIAAKVGATVETLGPDGRGSLTDAAAGASEAFATIDRGADDLAAILYTSGTTGRSKGAMLSHDNLASNSLTLVDYWRFTPDDVLIHALPIYHTHGLFVASNVTLFARGSMIFLPKFDPDKILDLMARATVLMGVPTFYTRLLQSPRLTKETTGHMRLFISGSAPLLADTHREWSAKTGHAVLERYGMTETNMNTSNPYDGDRVPGAVGPALPGVSARVTDPETGKELPRGDIGMIEVKGPNVFKGYWRMPEKTKSEFRDDGFFITGDLGKIDERGYVHILGRGKDLVITGGFNVYPKEIESEIDAMPGVVESAVIGVPHADFGEGVTAVVVRDKGATIDEAQVLHGLDGQLAKFKMPKKVIFVDDLPRNTMGKVQKNVLRETYKDIY

SEQ ID NO: 20744 - protein, 594 aa, Rhodopseudomonas palustris
NAYPIEDHTYDVVVVGAGGAGLRAVVGCSEAGLRTACITKVFPTRSHTVAAQGGISASLGNMHKDDWRWHMYDTVKGSDWLGDQDSIEYMVRNAPEAVYELEHWGVPFSRTEDGKIYQRPFGGMTMDFGKGQAQRTCAAADRTGHAMLHTMYGQALRHSAEFYIEFFAIDLIMDDQGCCRGVVALKLDDGTIHRFKAQTTILATGGYGRAYASCTSAHTCTGDGGAMALRAGLPLQDMEFVQFHPTGIYGSGCLVTEGARGEGGYLVNSEGERFMERYAPSAKDLASRDVVSRAMTIEMREGRGVGKKKDHIFLHLDHLAPEVLHERLPGISESARIFAGVDVTREPIPILPTVHYNMGGIPTNFHGEVVTKKDGDDNAVVPGLMAIGEAACVSVHGANRLGSNSLIDLVVFGRAAALRCAEKLVPNGKQPELPASSADMSLSRLDKYRYAKGGTPTAKLRERMQHVMQNNCAVFRTGEVLAEGKELIANVHGSVGDVGVSDRTLVWNSDLVETLEFDNLIVQAVVTMNSAANRTESRGAHAREDFPDRDDANWMKHTLAWIGDKGDVTIDYRPVHDYTMTNDVQYIPPKPRVY

SEQ ID NO: 20745 - protein, 260 aa, Rhodopseudomonas palustris
MVEFALPKNSKIVGGKTWPKPEGATEVREFRVYRWNPDDGKNPSVDTYYVDKHDCGPMVLDGLIWIKNNIDPTLTFRRSCREGVCGSCAMNIDGENTLACTKAMDDVRDDAVKINPLPHQPVVKDLVPDLTNFYAQYASIQPWLQTVTPTPQKEWRQSHSDREKLDGLYECILCACCSTSCPSYWWNSDRFLGPAALLQATRWVEDSRDEATGERLDNLEDPFRIYRCHTIMNCAKACPKGLNPSEAIANLKLKLVERQI

SEQ ID NO: 20746 - protein, 641 aa, Rhodopseudomonas palustris
IYDVPAEWASRAFVDDAKYRQMYERSVTDPTGFWAEHAKRVDWIKAPTKIDNWSFAPGNVSIKWFEDGVLNAAYNCIDRHLDKRGDQVAIIWEGDDPSQSRSITYRELHDEVCKFANILRNRNVGKGDRVTIYLPMIPEAAFAMLACARIGAIHSVVFAGFSPDSLAGRINDCNSKIVITADEGLRGGRKVPLKANVDAALKKCEGVDWVMVVKRTGAAVEMDDVRDFWYHEAAEVVTTECPVEHMHAEDPLFILYTSGSTGQPKGVLHTTGGYLVFASMTHQYVFDYHDGDIYWCTADVGWVTGHSYILYGPLANGATTLMFEGVPNYPTNSRFWEVIDKHKVNIFYTAPTAIRALMQAGDEPVKKTSRKSLRLLGSVGEPINPEAWEWYHRVVGEDRCPIVDTWWQTETGGILITPLPGATKLKPGSATRPFFGVVPEILDPEGNVLEGECTGNLCLARSWPGQMRTVYGDHARFEQTYFSAYKGKYFTGDGCRRDTDGFYWITGRVDDVINVSGHRMGTAEVESSLVAHPKVSEAAVVGYPHDIKGQGIYAYVTLMAGEEPTEELRKELVAWVRKDIGPIASPDLIQFAPGLPKTRSGKIMRRILRKIAEDEPSSLGDTSTLADPAVVDDLVEHRQNK

SEQ ID NO: 20747 - protein, 901 aa, Rhodopseudomonas palustris
DSFKCRKILKVGSKSYVYYSLPTAEKNGLKGISRLPYSMKVLLENLLRNEDDRTVKKADIMAVAKWMRKKALEHEIAFRPARVLMQDFTGVPAVVDLAAMRNAMQKLGGDAEKINPLVPVDLVIDHSVIVNFFGNNQAFKKNVAEEYKQNQERYEFLKWGQKAFSNFAVVPPGTGICHQVNLEYLAQTVWTKKEKMTIGRKTGTFEVAYPDTLVGTDSHTTMVNGLAVLGWGVGGIEAEAAMLGQPLSMLLPEVVGFKLKGALKEGVTATDLVLTVTQMLRKQGVVGKFVEFFGPGLDNLSVADKATIANMAPEYGATCGFFPVDGETIDYLKTSGRASARVALVEKYAKAQGLFRTAKSPDPVFTVTLTLDLADVVPSLAGPKRPEGRVALPAVAEGFTTAMDAEYKKALDGARYKVEGRNFDIGHGDVVIAAITSCTNTSNPSVLIGAGLLARNAAAKGLKAAPWVKTSLAPGSQVVAEYLANSGLQKDLDKVGFNLVGFGCTTCIGNSGPLPEEISKSINDNGIVAAAVLSGNRNFEGRVSPDVQANYLASPPLVVAYALAGSVTKNLAVDPIGTGKDGKPVYLKDIWPSTKEINAFVKKYVTSKIFKARYADVFKGDTNWRKIKTVESETYKWNMSSTYVQNPPYFEGMTKQPEPITDVVDARVLALFGDKITTDHISPAGSIKLTSPAGKYLTERQVRPADFNQYGTRRGNHEVMMRGTFANIRIKNHMLKGADGNIPEGGLTKHWPDGEQMSIYDAAMKYQEEKVPLVVFAGAEYGNGSSRDWAAKGTRLLGVRAVICQSFERIHRSNLVGMGVLPLTFEEGTSWASLGLKGDEKVTIRGLEGDLKPRQMLEAEITSAAGKRKRVPLLCRIDTLDELDYYRNGGILHYVLRKLAA

SEQ ID NO: 20748 - protein, 311 aa, Rhodopseudomonas palustris
MARDKIALIGSGQIGGTLAHLVGLKELGDVVLFDIAEGVPQGKALDIAESSPVDGFDSKLTGANSYEAIEGARVVIVTAGVPRKPGMSRDDLLSINLKVMEQVGAGIKKYAPDAFVICITNPLDAMVWALQKASGLPAKKVVGMAGVLDSARFRYFLADEFNVSVEDVTAFVLGGHGDTMVPLVKYSTVAGIPLPDLVKMGWTSQARLDEIVDRTRNGGAEIVNLLKTGSAFYAPASSAIAMAESYLKDKKRVVPVAAHLNGEYGVKDMYVGVPVVIGDKGVERIVEIELAGKDKEAFDRSVAAVQGLVEA

SEQ ID NO: 20749 - protein, 395 aa, Rhodopseudomonas palustris
MNIHEYQAKAVLREFGVPVGHGFPIFKASEAEAAAKQLGGPVWVVKSQIHAGGRGKGKFKEASAGDKGGVRLAKSIDEVKEFAKQMLGATLVTVQTGADGKQVNRLYIEEGSDIDKEFYLSLLVDRATSRISFVVSTEGGMSIEDVAHETPEKIVSFTVDPATGIMGHHGRTVAKALNLKGEQAKQAEAMVAKLYTAFVAKDMDMLEINPLVLTKQGDLKCLDAKISFDGNALYRHTDIQALRDETEEDAKEIEASKYDLNYVTLDGTIGCMVNGAGLAMATMDIIKLYGMSPANFLDVGGGASKEKVTAAFKIITADPNVKGILINIFGGIMKCDVIAEGVVAAVKEVGLDVPLVVRLEGTNVEAGKKIIKHSGLNVLPADNLDDAAQKIVAAV

SEQ ID NO: 20750 - protein, 292 aa, Rhodopseudomonas palustris
MSILIDSNTRVICQGFTGKNGTFHSEAAIAYGTKMVGGTSPGKGGSTHLGLPVFDTVREARDKTGADASVIYVPPPGAADAICEAIDAEIPLIVCITEGIPVLDMVRVKRSLNGSKSRLIGPNCPGVMTAGECKIGIMPANIFKPGSVGIVSRSGTLTYEAVFQTSAEGLGQTTAVGIGGDPVKGTEFIDVLEMFLADDNTESIIMIGEIGGSAEEDAAQFLIDEAKRGRKKPMVGFIAGVTAPPGRRMGHAGAIISGGKGDAASKTAAMEAAGITVSPSPARLGKTLAEKL

SEQ ID NO: 20751 - protein, 984 aa, Rhodopseudomonas palustris
MSRQDANAAFALSSFLQGANATYIDDLYSRYESDPSSVDADWQAFFRSLKDAPGDIQKNAEGPSWEQANWPLTPRDELTSALDGNWNQVEKAVGQKIQAKAQSRGVELSSADVLQATRDSVRALMLIRAYRMRGHFHAKLDPLGLSPAKDHEELDIRSYGFTEADLDRKIFLDHVLGLEYGSLREIVAICERTYCQTMGIEFLHISNGAQKAWIQERIEGPDKEISFTREGRRAILMKLIESEGFEKFCDLKFTGTKRFGLDGGEALIPALEQIIKRGGNLGVREIVLGMPHRGRLNVLTQVMAKAHRALFHEFKGGSANPDEVEGSGDVKYHLGASSDREFDHNKVHLSLTANPSHLEIVDPVVLGKVRAKQDQHGDLPEERISVLPLLMHGDAAFAGQGVVAECFALSDLKGYRTGGSIHFIVNNQIGFTTYPRYSRSSPYPSDVAKMIDAPIFHVNGDDPEAVVFAAKIAVEYRQKFHKPVVIDMFCYRRHGHNEGDEPSFTQPLMYRKIAGHPTTLEIYSKRLIADGVITEGEVEKARADWRARLDAEFEAASSYRPNKADWLDGKWAGFKSADQEEEPRRGITGVDLPTLKEIGRRITKVPEGFRLHRTVQRFLENRARAIDSGNGLDWATGEALAFCTMLLEGHRIRLSGQDSERGTFSQRHSVLIDQEDETRYTPFNHLSPDQGHYEVINSLLSEEAVLGFEYGYSLAEPNALTLWEAQFGDFANGAQVLFDQFISSGERKWLRMSGLVCLLPHGYEGQGPEHSSARLERYLQMCAEDNMQVVYPTTPANYFHALRRQLKREIRKPLILMTPKSLLRHKRAISRLEELGPDTSFHRVLLDDAQTLPDDKTKLVADAKIRRVVVCSGKVYYDLYDEREKRGIDDVYLLRVEQLYPVPVKTLVHELSRFKDAELVWCQEEPRNMGGWHFIEPYLEWVQNQIEAKHRRPRYVGRAASAATATGLMSKHLAQLKAFLDEAL

SEQ ID NO: 20752 - protein, 417 aa, Rhodopseudomonas palustris
MTEIRVPTLGESVTEATIGRWFKKPGEAVAVDEPLVELETDKVTIEVPAPSAGTLGEIVAKDGETVAVGALLGQITDGAAPAKPAAAAPAKAAAPAAAPAPAAPAPAAAPAAKAPPSDAPLAPSVRRLSTESGVDASTVPGSGKDGRVTKGDMLAAIEKAASAPTPVNQPAAAVQVRGPSPADDAAREERVKMTRLRQTIARRLKEVQNTAAMLTTFNEVDMTNVMALRAQYKDVFEKKHGAKLGFMGFFTKACVQALKDIPAVNAEMDGTDLIYKNYYHIGVAVGTDKGLVVPVVRDCDEKSIADIEKSIVDYGKRARDGQLKIEEMQGGTFTITNGGIYGSLMSTPILNAPQSGILGMHKIQERPVVIGGKIEVRPMMYLALSYDHRVIDGKEAVTFLVRVKESLEDPARLVLDL

SEQ ID NO: 20753 - protein, 244 aa, Rhodopseudomonas palustris
VVIITGGSRGIGRATALGCAKRGFKVVVGYASNAAAADEVVAEIAASNGKAIAVKCDVGSEADILALFAAADAFGPLGALVNNAGIVGPTARVDEMSAERIQRMMAVNVTGSILCAREAVKRMSTRHGGKGGVIVNLSSVAAKLGSPNTYVDYAASKGAVDSFTVGLGHEVAGEGIRVAAIRPGLIDTEIHASGGDPERAHRLSVNVPMKRVGRAEEIANAVVWLLSDEASYVTSAIIDVSGGR

SEQ ID NO: 20754 - protein, 463 aa, Rhodopseudomonas palustris
DLVVIGTGPGGYVCAIRAAQLGLKVAVVEKNATLGGTCLNVGCMPSKALLHASELFEEAGHSFAKMGIGVSAPKLDLPAMMNFKQQGIDGNVKGVEYLMKKNKIDVLVGKGKILGTGKVEVTGADGKATSVEAKSIVIASGSAVAQLKGIEIDEKRVVSSTGALSLDKVPGKLIVVGAGVIGLELGSVWRRLGAEVTVVEFLDRILPGMDGEVVKQFQRILEKQGFAFKLGAKVTGVDTSGAKLAVKVEAAAGGNPETLEADVVLVAIGRVPYTEGLGLKEAGVALDERGRVVIDDHFATSLKGVYAIGDVVRGPMLAHKAEDEGVAVAELIAGKAGHVNYDVIPGVVYTTPEVSSVGKTEEDLKQAGVAYTVGKFPFTANGRSKVNQTTDGFVKILADAKTDRVLGVHIIGREAGEMIHEAAVLMEFGGSAEDLARTCHAHPTRSEAIKEAALTVGKRAIHM

SEQ ID NO: 20755 - protein, 184 aa, Rhodopseudomonas palustris
SEDPSVSGVSGRYATALFELARDEKSIDAVTADLDKFSAMLAGSPDLVRLVRSPVFASEVQGKALAAVLDKAGITGISANFLKVLAANRRLFVVADVIRAYRALVAKFKGEATADVTVAEKLSDKNLEALKAALKSVTGKDVALNINVDPAIIGGLVVKLGSRMVDSSLRTKLNSIKHAMKEAG

SEQ ID NO: 20756 - protein, 472 aa, Rhodopseudomonas palustris
IRAAEISAILKDQIKNFGQEAEVSEVGQVLSVGDGIARVYGLDNVLAGEMVEFENGTRGMALNLETDNVGVVIFGADREIKEGQTVKRTRSIVDAPVGKGLLGRVVDALGNPIDGKGPIQAVERKRVDVKAPGIIPRKSVHEPMATGLKSIDALIPIGRGQRELIIGDRQTGKTAIALDTILNQKPLNVEGAPESQKLYCVYVAVGQKRSTVAQFVKVLEEQGALEYSVVVAATASDPAPMQYIAPFTGCTIGEYFRDNGMHAVIIYDDLSKQAVAYRQMSLLLRRPPGREAYPGDVFYLHSRLLERAAKLNDEQGNGSLTALPVIETQANDVSAYIPTNVISITDGQIFLETDLFFQGIRPAVNVGLSVSRVGSSAQTKAMKKVAGKIKGELAQYREMAAFAQFGSDLDAATQRLLNRGSRLTELLKQPQFSPLKMEEQVCVIWAGTNGYLDALPLNKVRAFEDGLLALLR

SEQ ID NO: 20757 - protein, 291 aa, Rhodopseudomonas palustris
MASLKDMRVRIASTKATQKITKAMQMVAASKLRRAQMAAEAARPYAEKMEAVISNIAGAAAGSPGAPVLLAGNGKDQVHLLLVCTGERGLSGAFNSSIVRLARERAYELMSQGKTVKFFCVGRKGYEQLRRNFEKQIIDNVELRSVRQIGFVNAEDIAKKVIARFNAGEFDVCTLFYSRFKSVISQIPTAQQLIPLEVTAPAAGTVATSYEYEPEEDEILSGLLPRNLAVQIFRALLENNASFYGAQMSAMDNATRNAGEMIRKQTLVYNRTRQAMITKELIEIISGAEAI

SEQ ID NO: 20758 - protein, 475 aa, Rhodopseudomonas palustris
ATPANQTGRITQVIGAVVDVQFEGHLPAILNAIETKNGDNRLVLEVAQHLGESTVRTIAMDTTEGLVRGQEVTDTGAPISVPVGAGTLGRIMNVIGEPVDEQGPIKSEGLRAIHQEAPAYTDQSTEAEILVTGIKVVDLLAPYAKGGKIGLFGGAGVGKTVLIQELINNVARAHGGYSVFAGVGERTREGNDLYHEFIESGVNKKGGGEGSKCALVYGQMNEPPGARARVGLTGLTVAEHFRDQGQDVLFFVDNIFRFTQAGSEVSALLGRIPSAVGYQPTLATDMGALQERITTTTKGSITSVQAIYVPADDLTDPAPATSFAHLDATTVLNRAISEKGIYPAVDPLDSTSRMLSASIVGEEHYNTARMVQQILQKYKSLQDIIAILGMDELSEEDKLTVARARKIERFLSQPFFVAEVFTGSPGKFVDLADTIKGFRAICEGKYDHLPEAAFYMVGTIEEAVEKGKKLAAEAA

SEQ ID NO: 20759 - protein, 405 aa, Rhodopseudomonas palustris
ARAAARTLALAPPEQKNRALEAMERAIRAGADKILAANAEDVADAKAAGTTSAFLDRLTLTPARVEAMAEGIAVVRGIADPVGTVTESWQRPNGMTIERVRVPLGVVAVIFESRPNVAADAGVLCLKSGNAVILRGGSESFRSCRAIHDRLVQGLREAGLPDAAITLVPTRDRAAVGLLLAGLDGSVDVIVPRGGKSLVARVESEARVPVFAHLEGVNHVYVDRSADLEMAKSIVLNAKMRRTGVCGAAETLLIDRAAATTHLAPLVTMLIDSGCEVRGDQTVQQVDPRVKPASDEDWDTEYLDAVIAAKLVDGVDGAIVHIHNHGSHHTDAIVAEDAQAAAKFLGEVDSAIVLHNASTQFADGGEFGFGAEIGIATGKFHARGPVGAEQLTTFKYRIHGSGQTR

SEQ ID NO: 20760 - protein, 286 aa, Rhodopseudomonas palustris
IKGIILAGGSGTRLHPMTAAVSKQLMPIYDKPLIYYPLATLMMAGIREILVISTPADLPRFQQLLGDGASWGMSFSYAEQPKPEGLAQAFVIGADFVAGQPSALVLGDNLFYGHDLIPLLQNAAQHPEGATVFAYQVSDPERYGVVEFDTNQVARSIEEKPAQPRSNWAVTGLYFYDQDVVEIAANLKPSARGELEITDVNRAYLERGKLRVEKMGRGFAWLDTGTPDSLLDASEFVRVLEKRQGFKICCPEEIAFRFGWIDTRQLERLAQPLAKSNYGGYLLKLA

SEQ ID NO: 20761 - protein, 476 aa, Rhodopseudomonas palustris
LQARHLIGNTLVPSVGGATLDVIDPATGQVIGKAPAASGDDVARAVEAASAAFPGWAATPARQRGKLIAAAASAIAERSDVIATVLALETGKAIRTECRGEVATAIDITTMYAGLASELKGETLPFDPQILTYTSREPLGVVAAILPWNVPLVLMMLKIAPALVAGNTVVVKASEEAPYATIEMARLMARLLPDGVLNVICGTGRDCGAALVEHPAVAKVTFTGSQAVGELIYQMAAKKIIPVSLELGGKSPMIVYPDADMARVVAGAIAGMRFTRQGQSCTAASRIYVHTTLIDAFVAALREAVSKLKIGDPLDEATDIGTVISPRQKAKVESYIDLGARTAGAKVDRCGELPGAAHLKDGLFLQPTIITGVPEDSPLMREEIFGPVVCVQPWDDEDDVIARANDSDFGLAATVWTNDLRSALRTVQRLDAGYVQVNQNLTIQPNLSYGGFRKSGLGKEASLEAMLEHFTKKKTV

SEQ ID NO: 20762 - protein, 240 aa, Rhodopseudomonas palustris
KVAVVTAAASGIGAATAARLAREGAYVYLSDIDQDALGRQAESLVDVAERISTVVADVTVPEQVSALIDGAARERGRLDILINNAGMGAFGRITEVTPEAWHRVFGICVDSIFHASRAAIPHLIKARGTIVNTASISGLFGDYGFAAYNAAKGAVINLTRNMALDYSRDGLRVNAVCPGLIATPLSLKLRDNAAVMAEYDRLIPLGRAGSPEEVAGAIAFLASDDASYITGVAFAVDGGL

SEQ ID NO: 20763 - protein, 453 aa, Rhodopseudomonas palustris
RAAFVFAREGVFGVVDPALIPPAGQVPVRLARLIERRGAKSGARLSRALTRLGPAYLKLGQFLATRPDVVGVAMARDLESLQDRLPPFSQDEAEQVIAISLERPVRDLFVSLSPPVAAASIAQVHRGEIELGGVRKQVAVKVLRPNVSARFRRDLSDFFYVAEKAELYSAEARRLRLVEVINTMSRSVAMEMDLRLEAAAASEMAENTKDDPDFRVPTVDWDRTSHNVLTMEWIDGIPLNDHARLKEANVDTVELGRKVIQSFLRHALRDGFFHADMHPGNLFLDRDGKLVAVDFGIMGRLLPKERRFLAEILLGFITRNYRRVAEVHFEAGYVPPHHSVENFAQAIRAIGEPIHNRLAEEISMAKLLTCCSRSPALFDMRTRPELILLQKTMVVVEGVARSFDPKLDIWKVADPVVREWIQRNLGPIGKVEGRSPAPASSATPDQPADHRVA

SEQ ID NO: 20764 - protein, 449 aa, Rhodopseudomonas palustris
AAGPAGRAAGVSEGSAPPAPLGELRSRLTQLHPVAIDLTLGRIERLLAALGHPERKLPPVIHVAGTNGKGSTVAFLRAILEATELKVHAYTSPHLVRVNETIRIAGRLVGDDQLLTALAHCERVNAGAPITLFEIETAAALWLFAQHPADVTLLEVGLGGRLDATNVIEHPLACVLTPIGIDHTEFLGPTIADIAAEKAGILRRGAPVIVAEQRDEAMEVIERDAKRLRAPLFACGQQWHVQLEHGRLAYQDERGLLDLTAPKLFGRHQIDNAGLAIATLRAQSRFTIPQDAYQAGLLAAEWPARMQRITSGKLLDDAPAGCELWLDGGHNADGGRVAAAALGDLEERVSRPLVLIAGMMANKDAAAFLANFTGLTRHLIAVSIPNRDGAMPPERLADAGRALGLRVELADDVRAALRRIASLAYELPPRILITGSLYLAGHVLSLNGT

SEQ ID NO: 20765 - protein, 207 aa, Rhodopseudomonas palustris
VKICGLTTADTLEAAVEAGADMVGFVFFPASPRHLDIDFADALGRQVRSRAAKVALTVDADDDLLDAIVEQLRPNWLQFHGSESPERVRSIKRIYGLPVMKAIAVAGPDDLSVLPDYAAVADRILFDARPPKDATRPGGLGAAFDWKLLDGVNLKLPFLVSGGINAGNVAEALRVTRAQGVDVSSGVETSPGEKDPDLIRDFIRAAR

SEQ ID NO: 20766 - protein, 430 aa, Rhodopseudomonas palustris
SNQPMPLQARKSGALHGTARVPGDKSISHRALILGALAVGETRISGLLEGEDVINTAKAMRALGAKVERTGDCEWRVHGVGVAGFATPEAPLDFGNSGTGCRLAMGAVAGSPIVATFDGDASLRSRPMRRIVDPLELMGAKVVSSSEGGRLPLALQGARDPLPILYRTPVPSAQIKSAVLLAGLSAPGITTVIEAEASRDHTELMLQHFGATIVTEAEGAHGRKISLTGQPELRGAPVVVPADPSSAAFPMVAALVVPGSDIELTDVMTNPLRTGLITTLREMGASIEDSDVRGDAGEPMARFRVRGSKLKGVEVPPERAPSMIDEYLVLAVAAAFAEGTTVMRGLHELRVKESDRLEATAAMLRVNGVAVEIAGDDLIVEGKGHVPGGGVVATHMDHRIAMSALAMGLASDKPVTVDDTAFIATSFPDF

SEQ ID NO: 20767 - protein, 359 aa, Rhodopseudomonas palustris
MSNLENLQSQILADIAAAADEAALEAVRVGALGKKGSISALLATLGKMDPEQRKTEGAAINRAKEAVTDALTARRDVLKAAALDAKLAAETIDVTLPMREPAAEQGRLHPLSQVWDELTAIFADMGFSIAEGPDIETDDYNFTKLNFPEGHPAREMHDTFYFNPKEDGSRLLLRTHTSPVQVRTMLSQRPPIRVICPGRTYRSDSDQTHTPMFHQVEGLVIDKGSHLGHLKWILHEFCKAFFEVDNVNMRFRPSFFPFTEPSLEVDIQCRRGKDEIRFGEGEDWLEILGCGMVHPNVLTACGLDPDEYQGFAWGMGIDRIAMLKYGMSDLRQLFEADVRWLNHYGFKPLDIPTLAGGLS

SEQ ID NO: 20768 - protein, 344 aa, Rhodopseudomonas palustris
DDLRLQKITELSTPAEVMGEIPRTLTATRTVAASRSAIHAILNGADDRLLVVVGPCSIHDPAAAMDYASRLAALRETLADRLEIVMRVYFEKPRTTVGWKGLINDPDLDGSFRIDKGLRLAREVLSAVNNLGLPAATEFLDLITPQYIADLVAWGAIGARTTESQIHRELASGLSCPIGFKNGTDGNVRIAAEAVKSAAQPHHFMAVTKGGRNAIAATTGNSDCHVILRGGVTPNYDAASVEAAAAVLGKIGLPPRLMIDASHANSSKQPDNQPKVTADIGRQMAAGESRIIGVMIESNLVAGRQDVAPGRPLQYGQSITDGCIDWATTETVLHELADAVESRR

SEQ ID NO: 20769 - protein, 280 aa, Rhodopseudomonas palustris
SLQGKTLFITGASRGIGLAIALRAARDGANVAIAAKTTEPHPKLKGTIYTAAEEIVAAGGKALPLVCDIRDEAQVIDAIGKTVAEFGGIDICVNNASAISLTNSQATDMKRYDLMMGINTRGTFMVSKYCIPHLKKAANPHILMLSPPLDMKAKWFAASTAYTMAKFGMSMVALGLSGELKHSGVAVNALWPRTTIATAAVGNLLGGDAMIRASRTPEIMGDAAHAILTRPSREFTGQFCVDDSVLYEAGVRDFEPYRVDPSVPLMSDFFVPDDSVPPPG

SEQ ID NO: 20770 - protein, 710 aa, Rhodopseudomonas palustris
SKTLTAGSRHLDLAVEGVHCASCMAKIERGLQSIPDVTLARVNLTDRRLAVEWNKGSTLEPGQFIDRLAELGYKAYPYEPVRAEVEEAERTKFLLRCLGVAVFATMNVMMLSVPVWYGGDLSPEARDFFHWLSALVALPCAAYAGQPFFQSAFRALKAKSVNMDVPITIGITLALGMSLVETINHAEHAYFDAAVMLIAFLLAGRFLDQKMRQKTRAVAGNLAALKAETATKFVGPDEISEVPIAAVRAGDIVLLRPGERCAVDGTVIEGRSEIDQSLITGETLYVPAERGTQVYAGTLNISGTLRVRVDAAAEGTLLSEITRLLDHALQARSRYVRLADRASQLYAPVVHATALLTIIGWVLAGASWHDAIVIGIAVLIITCPCALGLAIPAVQTVASGAMFRAGVLLNAGDAIERAASVDTIVFDKTGTLTLPELDVVNAAGIPPEVFDLAGRLALASHHPVAAAVARAAHAKSPLPNVVEEPGRGVRTVFGGQELRLGSPAFCGADAEANQILSEDPEVSVVAFSRGEQRVVFAVRQLLRPDAAKTIDALTNRGIAVELLSGDREPAVRHAAAALGVSAWRASVTPAEKIAHIEALKKQGRIVMMVGDGMNDAPSLAAAHVSMSPISATHLSQATADLVFLGKELAPVLAAVDYSRKAMAVMRENLGLAIGYNVLAVPIAIAGYATPLIAALAMSGSSLLVMLNAMR

SEQ ID NO: 20771 - protein, 355 aa, Rhodopseudomonas palustris
ISADNPMGTDGFEFVEFAHPDPAQLHSLFKLMGFSLVAKHRTKAISVYRQGDVNYLVNEQPGTHGTDFVTAHGPCAPSMAFRVVDAKQAYERAISLGAEPAGVTAAQATLDVPAIKGIGGSLLYFVDRYGAKGSAYDAEFDWVGSRDARPAGAGLYYIDHLTHNVHRGRMDVWTGFYAKLFNFRQIRFFDIEGRASGLFSRALTSPDGKIRIPINEDAGDSGQIEEYLSLYRGEGIQHIACGCRDIYSTVEGLRAAGLPFMPSPPETYFERVDARLPKHGEDIARLQRNGILIDGEGVVDGGQTKVLLQIFSANAIGPIFFEFIQRKGDDGFGEGNFKALFESIEEDQIRRGVLK

SEQ ID NO: 20772 - protein, 212 aa, Rhodopseudomonas palustris
KSTAMPSAAEALPGRPTPIPTARTHFVSGNRLQPPFPEGLQQAVFGLGCFWGAERKFWQLGDGVYSTAVGYAGGFTPNPTYEEVCSGRTGHTEVVLVVFDPARISYEALLKTFWESHDPTQGMRQGNDVGSQYRSAIYTFGDDQKRAAEASRVTYGDALKAKGYGPITTEIAASGPFYYAEDYHQQYLAKNPGGYCGLGGTGVSCPVGVRVT

SEQ ID NO: 20773 - protein, 481 aa, Rhodopseudomonas palustris
GPSRSWSYGEFHDRVGALAAGLARRGIKQGDYLLIHLDNCVEFLLAWFACTELGAIAVTTNTRSAAAEIEYFADHCGAVAAITQPAYADLVAANCKKLKWMAVIGHDPGAAIAAQPVAKGHSFDSLFGDSDDRPRRPTDPLAPCSVQYTSGTTSRPKAVLWTHANALWGAKINAAHQTLRADDVHLLYLPLFHTNALAYSMLSTLWVGGTVVVQPRFSASRFWKVSLEHGCTWLSTIPFCMKALLEHEVPKAHRFRLWGSAVAEPPPFASFGIKIIGWWGMTETITHGIIAEADQPNTPMSIGRAAPEYAIRIVGDDGAPTRVGDTGNLLIKGVPGLSLFKEYLHNEAATRDSFDEHGYFITGDRVTRLEHGAIRFGDRAKDMLKVGGENVAASEIEQVVITVPGVREAAVVAKKHPMLDEVPVVFVIPQGGVAAAPPDFADRITAACTAALADFKRPREVRLVDDMPRSTLEKVAKAELR

SEQ ID NO: 20774 - protein, 510 aa, Rhodopseudomonas palustris
RSTMYPGQFAKTRPDHPAFIMASTGETVSYAELEARSNRLAHLLRNHGLQRLDHYSIFMENNNRYIEACAAGERSGYYYTCVNSYLTPAELAYILTNSESRALITSKAKLDVAREALKDCPNVTLCVVVDGDGESERIVGLAEATKNLPDTPIADESLGTAMLYSSGTTGRPKGILRPLPEQPPSEPLPLFHFLNMLWKYRDGMIYLSPAPLYHSAPQAAVGLTIRDGGTVIIMEHFDPEQYLALIGKHKVTHSQLVPTMFSRMLKLPEEARKTYDLSTLEVAIHAAAPCPPQVKEQMIEWWGPIIHEYYGATEGLGFTACNSAEWLAHRGTVGKVMFGDLHILDDGMKPCPKGTPGQIWFKTATPFEYFNDPKKTQEARSEDGSMSTVGDVGYVDDDGYLHLTDRATFMIISGGVNIYPQECENLLITHPKVADAAVFGVPNEDLGEEVKAVVQPMPGVAAGADLAAELIAFCAQSLSRQKVPRSIDFMDELPRLPTGKLYKRLLRDRY

SEQ ID NO: 20775 - protein, 372 aa, Rhodopseudomonas palustris
  unsure (1)..(372): unsure at all Xaa locations
MEEVVYGQPAAAALAAQLDRIGAQRALLMVSGTLNRTTDEIAKIKDALGGRCAGVFDAMPAHTPRAAVIAATEQARAIQADIIVTVGGGSITDGAKAVQICLANNILSAAEIDRVRNINAPVAPKVRQISVPTTISGGEFSAIAGVTNEATRVKEKLAHPLTMPRAAILDPAITLHTPEWLFLSTGIRAVDHCVEAICSREAHPYGDAQALRGLAMLAAGLPRVKADPTDLDARLDCQIGTWLSMGALSSGVPMGASHGIGYVLGAVFDVPHGHTSCIMLPAVMRWNKSANRDRQALVAAAMGHPGEDAGDVLDALIRVLGMPRSLREVNVGPEHFERIATQAMGTPWVPRNPRPIEGPAQVREILELAAXG

SEQ ID NO: 20776 - protein, 616 aa, Rhodopseudomonas palustris
ETKPFQAEVAELLNLMVHSVYSETDIFLRELISNASDALDKLRYESIAKPELMEKGGEPKIRIIPKKAPDTLTIVDNGIGMDRQELIDNLGTIAKSGTKSFISKLAETKDSAGLIGQFGVGFYAAFMVADKITVTSRRAGSDDVWTWTSAGGAGFEIAPASEEAAARVERGTEIVLHLKPDASKYLEDWQIERIVTEYSDNIQFPILLMPEEGEPRQINSASALWQRSKSELSEDDYKQAYKQIAGAFDDPAMTLHYRAEGRQSYAVLLFAPSTKPFDLFEPERKGKIKLYVRRVFITSEAELLPPYLRFLRGVIDSEDLPLNLSREMLQKNPQLAQIRTAVTGKVISELESLADKKPEDFTKIWDAFGPVLKEGLYEDFERREKLLSLARFTTTAGEKRSLKQYVEAMKENQTEIYYLVGDSLERLKSNPKLESATARGIEVLLLTDPVDAFWTSGQLDFGGKPLKSLSQGDVNFDLIPKLEQDQDKDNKDEAKVDEATVIAVIKDALGERVSDVKASQRLTSSASCLVAGGMGPDRELEKLLARANKGAGSKPILEINLQHPLVAALGDTKTDKAEAADLAFLLLEQAQILDGELPEDPAAFASRLNRLVLRGV

SEQ ID NO: 20777 - protein, 397 aa, Rhodopseudomonas palustris
  unsure (1)..(397): unsure at all Xaa locations
YHGWRIVAVCFIVATFGWGLGFYGQSVYLAELARLHGWPSSQIATATTFFYLAGALLVAFVGDVIRAIGARACLLGGIAAMALGTVLLGRIDAPWQLYAVDAILAVGWAGTSLGAITNTLGLWFDRRRGMAISLALNGASFGGIAGVPVLVALIGALGFTGATTAAAIAAVVLLMPLVAVVVAPPLHLVSAAAAAPRALSSGAIRSGALRDLDFLTATIAFSLVLLAQVGFIVHLIAYLDPLIGRERAAVAMSLLTAMAVVGRVSLSVVIDRLNQRLVSALSFASQAVALGVLISTRDATLLLVACALFGFSVGNLITLPSLIIQREFPTSSFGVLVALNTAINQVTYAFGPGVIGLLRDASGSYTLPFTGCIALQLAAAALIMVRLRRRXSFCRHS

SEQ ID NO: 20778 - protein, 392 aa, Rhodopseudomonas palustris
MTDLDTFRAETRAWLETNCPAEMRTPMQGDEDNFWGGRNAKFASEAQKVWFERMRDKGWTVPDWPTQYGGGGLDGARHKILREEMAAIGGRSPLSSFGIWMLGPALLKYGNEQQKAEHLPKIARGEIRWCQGYSEPNAGSDLASLQTRAESDGDDFIINGSKIWTSYANYADWIFCLVRTDPTAKKHDGISFILFDMTSKGVTTKPILLISGKSPFCETFFDNVRVPKSHVVGTINRGWDVAKYLLQHERAMISGMGGRDGGRPLGQVAADSLGTDEKGRLDDPILRGQIATFDVDEAALACAAERAVDLAKAGQLHPAFSSAMKYYGTELNKRRHEILMSAGGIDALEWESERSQEGARARAWLRTKANSIEGGTSEVMLGIVAKRILDLP

SEQ ID NO: 20779 - protein, 374 aa, Rhodopseudomonas palustris
MALVLTEEQTMLRDSARGLIGDKAPVAQLRKLRDERDATGFSRDLWKSFAEMGFAGLLVPEEFGGSGLGCVEAGVVMEEIGRNLTPSPLLSTAILAASALARGGSEAQKKAYLPKIADGSLIAALAVDEGAKHRPAKIAMTATRAGNGFKLKGDKALVVDGHVADLLIVAARSAGQPGDADGLTLFLVDPKAKGVAIERTVMVDAHNAARISFDDAEVNADQVLGEVDRGGALLEAVLNVGRAAVAAEMLGVADEAFGRTVSYLKERKQFGKLIGEFQALQHRAAHLYTEIEILRAAVLKALQAVDADAVQARVAVSVAKAKAGTVATLAVQEGVQMHGGMGMTDQFDIGLFMKRARVLQELLGDSAYHAEALA

SEQ ID NO: 20780 - protein, 249 aa, Rhodopseudomonas palustris
FSLQGRVALVTGGSRGIGKMIAAGFLAYGATRVYITARKAAACQATADELTEMYPGECVALPIDISTMAGIDMLAAEIKRRESSLDILVNNAGAAWAADFDEFPESGWDKVMDLNVKTPFFLTKALAPLLRAAASAEQPGKVINIASIDGIFVNPLETYPYAASKAGLIHLTRRLAVRLIKDHIVVTAIAPGPFASDMNKAARDESDAVAKRVPAGRIGTDEDMAGTAVFLASRAGDYVVGSTVTVDGG

SEQ ID NO: 20781 - protein, 397 aa, Rhodopseudomonas palustris
SAMSQSASTSHLLPVFARADVAFERGEGVWLHGTDGERYLDFTSGVAVNALGHCHPHLVEALQQQASKLWHVSNLFKSPEGERLAARLCEQSFADKVFFCNSGAEAVECALKMARHYHFSKGEPERTRVITFEGAFHGRTLGTLAATGSAKYLEGYGQPLEGFDQLPLGDLDAVKAAIGPNTAAILIEPLQGEGGVRSPELAFFRGLRELCDAHGLLLVFDEVQTGMGRTGELFAYKRIGVAPDIMALAKALGGGFPIGACLSTAEAAKGMAPGAHGSTFGGNPLAVAVANAVLDVMLQPGFFDHVKKMSLLLKQKLAGVVDRHPRVVSEIRGEGLLLGLKAVVPSPELIAALRAEKLLSVGAGDNVVRLLPPLIVNEAELDEAVGRLERACVTLAG

SEQ ID NO: 20782 - protein, 302 aa, Rhodopseudomonas palustris
RHFLDLTELPTSELRNMLSAAVAMKAKRKANADGEKPLAGKTLAMIFDKPSTRTRVSFDVGMRQLGGESIMLTGAEMQLGRGETIADTARVLSRFVDIIMIRILNHEALLELAANATVPVINGLTRKSHPCQVMADVMTFEEHRGPIKGRTIAWTGDDNNVLASFAHAAQRFEFKLNIATPPQLSPSKALRDWIKASGAAITIGTDPEEAVRGADCVVTDTWVSMGDKDGEHRHNLLKPYQVNAKLMSLAHKDAIFMHCLPAHRGEEVTDEVIDGPQSVVFDEAENRLHAQKGILAWCLGAV

SEQ ID NO: 20783 - protein, 393 aa, Rhodopseudomonas palustris
  unsure (1)..(393): unsure at all Xaa locations
TAHFRRETRLVHSGSLRSQFGETSEALFLTQGFVYESAEQCEARFTGDDAGFQYSRFSNPTVFSFEQRMAEFEGAEAARSTATGMAAVTAAMLAPLRAGDHVVASKAMFGSCRYVVEDLLPRYGIESTLVDGLDLDQWQRAVRPNTKTFFLESPTNPTLDVLDIGAIAEIAHAAGARLVVDNVFATPIWQSPLQLGADVVVYSATKHIDGQGRCLGGVVLSSQAFIEEHIQMYLRQTGPSLSPFNAWVLLKGLETLAVRVEKQTSNAAAIADALAGQPKVPRLVYPGRADHPQAATVKKQMGAGSTLVGFEVKGGKAEAFRFLNALKLVKISNNLGDAKSLVTHPATTTHQRLKPEARAELGISEGFIRLSAGLEHKDDLIEDLLAALDKVXA

SEQ ID NO: 20784 - protein, 524 aa, Rhodopseudomonas palustris
VSWWAAGVLYQIYPRSFQDSNSDGIGDLRGIIDRLGYLSDLGVDAIWLSPIFPSPMADFGYDVADYVGIDPIFGTMDDFDALVLTAHARGLKVILDLVPNHSSEQHPWFIESRSSRHNPKRDWYIWRDPAPGGGPPTNWLSEFGGSGWEYDDATGQYYYHAFLKQQPDLNWRNPEVRAAIYDAMRFWLRKGVDGFRVDVIWHLIKDDQFRDNPPNPDFRPGMPPHAALIPIYSADRPETLEVVAELRRVVDEFDHRLLIGEIYLPVERLVAYYGAELKGAQLPFNFALLSTPWRAREIATLIERYEQALPAGAWPNWVLGNHDRPRVASRVGPAQARVAAMLLLTLRGTPTMYYGDELGMEQVEIAPEDVQDPFEKNVPGIGVGRDGCRTPMQWDASDQAGFSDVRPWLPLAPNATQDNVANLRADAQSILNLYRALLRLRRALPQLALGAYQPLAAEGELLLYRRHHQGQSILVALNLGPDPISAASDAIGLDGEVLLSTMLDRAGERIGATLDLRGNEGIIV

SEQ ID NO: 20785 - protein, 293 aa, Rhodopseudomonas palustris
MAAAIKKVGVIGAGQMGNGIAHVAALGGFDVILNDVSADRLKSAMATINGNLSRQIAKKLISEDARKQALARITATEKLDGLSDCDLVIETAVEKEETKRKIFNELCAVLKPEAIVASNTSSISITRLAASTDRPERFIGIHFMNPVPVMELVELIRGIATDDATFETAKAFVTKLGKQIAVSEDFPAFIVNRILLPMINEAIYTLYEGVGNVEAIDMAMKLGAHHPMGPLELADFIGLDTCLSIMQVLHEGLADSKYRPCPLLVKYVEAGWLGRKTQRGFYDYRGDKPVPTR

SEQ ID NO: 20786 - protein, 454 aa, Rhodopseudomonas palustris
ERRQMSNKMWGGRFTDRPDAIMEEINVSIDVDRHLYAQDITASKAHAAMLAAQGIITANDAKNIGKGLDTILSEITAGKFTFKRALEDIHMNVESRLAELIGPAAGRLHTARSRNDQVATDFRLYVRDVLDETDAALAALQQALAERALEQADTVMPGFTHLQTAQPVTFGHHLMAYVEMVARDRGRFQDARKRLNESPLGAAALAGTSFPIDRHATAAKLGFDRPMANSLDAVSDRDFVLETLSAASICAVHLSRFAEEIVIWTSPLVGLIRLSDKFTTGSSIMPQKRNPDAAELVRAKTGRVIGALNGLLIVMKGLPLAYQKDMQEDKQGAMEGFAALSLAIRAITGMVRDLEPEPERMKLAAGEGYATATDLADWLVRTLKMPFREAHHVTGRIVGLAAKKGVALHELPLAEMQSVEKRITKDVLAVLSVESSVKSRTSYGGTAPKNVRSQ

SEQ ID NO: 20787 - protein, 389 aa, Rhodopseudomonas palustris
QDVGTPFYCYSSATLERHYRVFTEAFAGLDALVCYAMKANSNQSVLRTLAKLGAGADVVSGGELQRALAAGIPPSKIVFSGVGKTEAELRAALDHDIKCLNVESEPELEQLSRIAVETGRTARISLRVNPDVDSGTHAKISTGKSENKFGIPIRHAREVYARAAKLPGIQVTGVDVHIGSQIIDLAPMEAAFRKVAEFIHVLRGDGHTVNHVDFGGGLGIPYYEDRDAPPEPFAYAEMVKRVTHNLGCTLLFEPGRMIVGNAGILVAKVIYVKHGDGKTFVIIDAAMNDLIRPTLYEAYHEILPVAAPAPGVATMVADVVGPVCETGDYLALDRKLPELKAGDLIAIMTAGAYGAVQACTYNTRALVPEVLVKDDQVAVVRPRIEVEQL

SEQ ID NO: 20788 - protein, 310 aa, Rhodopseudomonas palustris
RRVALLGVPIEIGAGLRGTLMGPAALRTAGIGRVLDQLGFAVEDHGDMTRPALDGGNDPVPANANYYSEVRSWVGAISARAYELARSGAVPLFMGGDHSLSMGSVNGVARYWQSEGKPLFVLWLDAHADYNTPATTLTANMHGMSAAFLCGEPGLDDLLGDEPRVSIPPSRLDLFGIRSIDPLEKDLVRQRAIPVVDMRAIDEFGVGVLIRRVIDRVRAAGGVLHLSFDVDVLDPSVAPGVGTTVPGGATYREAHLVMELLHDSGLVRSVDIVELNPFLDERGRTARVAVELLGSLFGMQITDRVTPSNA

SEQ ID NO: 20789 - protein, 821 aa, Rhodopseudomonas palustris
HLPVQSLPEKKSSQSAPLDELALAEIKSAILAKLTLAIGKEAAHATKHDWYKASALALRDRIVHRWLVSEKESYDAGRKRVYYLSLEFLIGRLFTDSLNNMGLLAQFDAALGDLGVGLNDLRKCEPDAALGNGGLGRLAACFMESMATLEIPAYGYGIRYDYGLFRQIINHGWQQEFPDEWLSFGNPWELQRPEVVYQVKFGGHVDQVTDAKGYTRAVWTPGETVQAIAYDTPIVGWRGEHVNALRLWSARAPDPLLIDVFNTGDYLGATAHEARAEAICKFLYPNDESPAGRELRLRQEYFFVSASLQDLIKRHLDSDGQIRNLAKKAAIQLNDTHPSLAVAELMRLLVDVHGLRWDDAWQITVATLSYTNHTLLPEALETWPLDLFQRTLPRHLEIIYRINEVHLGLAEARSPGDIEFRASVSLIDEKAGRRVRMGHLAFIGSHRVNGVSAMHSDLMKETVFHDLNFLYPGRITNKTNGITFRRWLTLANPGLTELVRSVAGDEVLDDPTRLERLEAFAGDSAFQQQFRSVKHRNKVALARLIGERNNIRIDPSALFDVQIKRIHEYKRQLLNVLETIALYQAIKDEPNRDWVPRVKIFAGKAAASYRYAKLIIKLINDVAEVVNNDASIGGKLKVVFLADYNVSLAEVIIPAADLSEQISTAGMEASGTGNMKLALNGALTIGTLDGANIEIRDLVGPKNIAIFGMEALEVVARRAQGLDATDVINRSPQLANAIRAIDSGVFSPDDRARFASVAHALRHLDHYMVSADFDSYYEAQRGIDARWRAGSAWTRAGILNVARMAWFSSDRTIREYAEEIW

SEQ ID NO: 20790 - protein, 99 aa, Rhodopseudomonas palustris
ADSLDRLYQAVLAARDLDPATSRTARLFQRGSGKMAKKLAEEAIEVVIDAVNGNREAVIRESADLLYNLTVLWASAGVRPEDVWAEMRRRENLLGIAEK

SEQ ID NO: 20791 - protein, 432 aa, Rhodopseudomonas palustris
SSQDITPGYMSGFGNSFETEALPGALPVGRNSPQRCAYGLYAEQLSGSPFTAPRGANERSWLYRIRPSVKHSGRFAKTDMGLWRSAPCFEHDLPIAQLRWDPPPMPQEALTFLQGVRTMTTAGDVNTQAGMATHLYLITQSMVDQHFYNADGEMMFVPQQGSLRLVTEFGIITIEPAEIAVIPRGVKFRVELVDGPARGYLCENYGGAFTLPERGPIGANCLANSRDFLTPVAAYEDKDTPTELYVKWGGSLYVTKLPHSPIDVVAWHGNYAPYKYDLRTYSPVGAIGFDHPDPSIFTVLTSPSETPGTANIDFVIFPERWMVADNTFRPPWYHMNIMSEFMGLIYGVYDAKPQGFVPGGASLHNMMLPHGPDREAFDHASNGELKPVKLTGTMAFMFETRYPQRVTEYAASSGLLQDDYADCWNGLEKRFD

SEQ ID NO: 20792 - protein, 238 aa, Rhodopseudomonas palustris
PGALVPHLDQCALLLDIDGTLLDLAPTPREVWVPPELEQTLTNLLVRTSGALALVSGRSINDIDLIFAPMRLPAVGGHGAEMRLSGEGEAIATHAPPLDSELKSRLAAIARISPGILLEDKGYSLALHYRLAPHTEKAIYEAVAAIRAENPEAPLEVLPGKSVCEIKHSGFTKATGVLELMTRAPFKGRRPIFIGDDVTDETVFAIMPELRGLAFSVGRYSELTSGHFDEPRDVRNWL

SEQ ID NO: 20793 - protein, 451 aa, Rhodopseudomonas palustris
LVVVSNRVARASGNEPMTGGLAAALLPVVEKSGAIWVGSSGRVRDGVHREPFAEIEPLGAGALAMLDLPAAHYGGYYEGFANSALWPALHSRPDLIRVSHDDYRSYREVNAFMARALLRFRKPDTAFWIQDYHFLALGAELRQLGVQHPIGFFLHTPWPSRATIGCVPHHRELIEAMLTYDLIGFQTEEDRRNFLGYVESELGLKIDGSEVSTTHGTARCEVFAISIDADAFAQQAQKAMTHPEVSRLRKSLNGEKLVIGVDRLDYSKGLINRVKAFDKMLTDRPALQRVVSLLQIATPSRGTIEAYGNLQGDLAKLVSDVNGRLGEVDWTPIRYLNKGYRQSVLAGLYRSAHVGLVTPLQDGMNLVAKEYVAAQNPLDPGVLVLSKFAGAANELDTALQVNPHDIEGMSRVIATALAMPLTERRLRWEAMMAKLRDNSIRRWFADFLAAL

SEQ ID NO: 20794 - protein, 156 aa, Rhodopseudomonas palustris
GIVWGVRGIVAVQLPQPTETQTRARITQRHPDSVEAAPTADVQRAIDGIVALLEGAATDFADIPLDLDGTSAFQRRVYDIARGIPAGKTLTYGDIAKQLGGVELSREVGQALGRNPCPIIVPCHRVLAAGDKPGGFSANGGVATKLKLLAIEGAAV

SEQ ID NO: 20795 - protein, 499 aa, Rhodopseudomonas palustris
ITLPALVRDTAQARPDRIAVIDGERQLRYAEFDALIDRIAATLQRDGLKPTDTISICALSSIEYAATFLAALRAGIAVAPLAPSSTAKDFSAMVRDSAAKILFTDDFAANAMKDAEIDAAVKRVAFDDGTSGEAFTRWLAPEGTKPAPVTIDPEWVFNIIYSSGTTGTPKGIVHSHQMRWAQYGKLDPIGYGPDAVTLLSTPLYSNTTLVCFNPTLAGGGTVVLMKKFDARGFLELAQKYRVTHAMLVPVQYRRIMALPEFGQFDLSSFQMKFCTSAPFAPELKADILKRWPGGLTEYYGMTEGGGSCTLLAHEFPNKLHTVGQPRPGHEIRMIDEDGNFLPNGEVGEIVGRSDTIMKGYLNQPQKTAEVFWTDKDGNLWVRSGDVGRFDADGFITLMDRKKDMIISGGFNIYPSDIEAVAAKHPDVLEVAVVGMPSEEWGETPVAFVAARPGRSIDPAELKTWTNGQVGKTQRLAEVVLVESLPRSAIGKVLKRELRD

SEQ ID NO: 20796 - protein, 385 aa, Rhodopseudomonas palustris
AEAENRAKSSFLAMMSHEIRTPMNGVLGLANSLLETKLDPEQQQAVTTIRDSGDDLLRILNDILDLSKLEAGRLEFEQADFSPTTLVESVRAIIEPEVRGKGIELKVDIDPRLPPSLNGDAARIRQVLLNLAANAVKFTEQGSIAIVLTCVKRNDSHATVEWQVTDTGIGISPDRVGSLFTDFAQADVSINRRFGGTGLGLAISRRIVEQMGGDIAVTSREGEGSTFRFSLDLPWSNAWIADHRLDRLGSDDLRTRIAMLGRPLRVLIAEDDSTNQMVVMKMLQEFAAEITVVSDGTDAVQAAGEGEFDVVLMDVRMPNMDGLAATRAIRGKGGALAKLPIIALTANAFPDDVKVCRDAGMNDFLAKPLRKPALVAAVLRALRGA

SEQ ID NO: 20797 - protein, 482 aa, Rhodopseudomonas palustris
DLAIIGGGINGCGIARDAAGRGHSVFLCEMNDLASGTSSWSTKLIHGGLRYLEYFEFRLVREALIERERLWQIAPHIIGPLRFVLPHHDGLRPAWRLRLGLFMYDYLGGRKLLPPTRSVDLAHDEVGKPLIPGRYTKGFEYSDCFVDDARLVVLTARDAAERGAEIRTRTRAVQVSQQGGIWQVTLEDVGSGARSTIQARALVNAAGPWVEGVLRSGAGVDARYKVRLVQGSHIVTRKLYDHDRAYIFQNADGRIVFAIPYQGDFTLIGTTDRDYHGDPSQVKATPEEIDYLCKAVSGYFAKPVTPADVVWTFSGVRPLYDDGASKPRRRPATTCSSSTPRAARRCCRSMVARITTYRRLAEEALEKLSSYLKGGTAKQGWTAHQPLPGGDFPVDGGPALIGDLLREYPFLASAHASRLVHAYGTRARDVLGSAKSAADLGRDFGATLTEAEVRYLMSREWACSADDHRLAAIQARFAADTG

SEQ ID NO: 20798 - protein, 262 aa, Rhodopseudomonas palustris
VVLAGAGKMGGALLTGWLAQGLDGGDVVVIEPHPTEEIAALSARGVRLNASAGDVGAVSTLVVAVKPQMFAEAAAALRGYVGPSTLVVSIMAGKPIAALSEQLGGHVVRAMPNTPAAIGRGITVAVAAGNVTAAQRGIADALLRATGGVEWVDDEALIDAVTAVSGSGPAYVFLLAEELARAGVEAGLPEGLAMTLARATVAGSGELLHRSDLDAATLRKNVTSPGGTTAAALEVLMANDGFRPLLTRAVAAATKRSKELAK

SEQ ID NO: 20799 - protein, 310 aa, Rhodopseudomonas palustris
VKLVAGNSNPALARDIAQWLNMPLTKASVRRFADNEVFVEIQENVRGSDVFIIQSTSFPANDHLMELLIITDALRRASARRITAVIPYFGYARQDRKVGSRSPISAKLVANLITHAGVDRVMTLDLHAGQIQGFFDIPTDNLYASPVMVRDIKERFDLSKVMVVSPDVGGVVRARGLAKRLNTPLAIIDKRRERAGESEVMNVIGEVAGYTCILLDDIVDSGGTLVNAAEALLANGATEVYAYITHGVLSGGACARITNSKLKELVITDSIQATEGVCKAPNIRTITIASLIAEAIGRTAAEESVSSLFD

SEQ ID NO: 20800 - protein, 415 aa, Rhodopseudomonas palustris
DAYIIDAVRTPRGIGKVGKGALADMHPQHLAATVLKAIAERNKLNTADVDDIIWSTSTQRGKQGGDLGRMAALDAGYDIKASGTTLDRFCGGGITAVNFAAAQIMSGMEDVVIAGGTEMMSLTAAMAAEDMAAGKPPLGMGSGNARLAKTHPQSHQGICGDAIATMEGISRETLDALGLESQRRAAIAIQEGRFDKSIVPVKDDDGNVVLAKDEYPRPETTAEGLAALKPAFTAIADYPLDDKGTTYRKLINQKYPDVDIKHVHHAGNSSGVVDGAAALLLTSKEYAEKHGLKPRAKILAMANIGDDPTLMLNAPVPAAKKVLQKAGLTKDDIDLWEINEAFAVVAEKFMRDLDLDRSKVNVNGGAIALGHPIGATGAILVGTVLDELERRNLKRGLVTMCAAGGMAPAIIIERV

SEQ ID NO: 20801 - protein, 176 aa, Rhodopseudomonas palustris
AAVLLDMDGTLVDTERLYLESLTEVLNAFGLPDAIETCESMVGLPGPECQALLVARYGETLPLREINRAFVEKRDARFAQGLPVKPGTCELLDALDDAGCPVAVVTSSSRKTADMHLTLAGIRARFATILTRDDVVHGKPAPDLYLLAANRLGVPPAHCVAVEDSSVGVASAFTAG

SEQ ID NO: 20802 - protein, 206 aa, Rhodopseudomonas palustris
KLYSMQRSGNSYKVRLALALLDAPYRAVEVDILRGESRTPDFLAKNPSGQVPLLETAPGRYLAESNAILWYLAVGTSLAPDTRMDRAEALQWMFFEQHALEPNIGSAYFWLCLVKGGRDLQTHALEDWLERGYAALQVMENHLKTNDYFAAGQLTIADIALYGYTHVADQCDFDLSTFPAVNAWLRRVEQTPGFITMDWTPETIAA

SEQ ID NO: 20803 - protein, 267 aa, Rhodopseudomonas palustris
KRAACLIGCPAAHSRSPLIHHYWLRQLGIEGGYSIEAVPPEGFAEFVLHLKTHGYVGANVTIPHKERALQLTEPDERACAVGAANTLYYDGDLLRSTNTDIEGFIGNLDASAPGWDRSAHALVLGAGGSSRAVVFGLLERGVQRIALANRSIERAQALRDLFGERVVPIAWSDIPAALPGAGLLVNTTSLGMKGQPPLQIDLSALPADAVVSDLVYVPLETDLLAAAKARGLRTADGLGMLLHQAVRGFDLWFGARPHVTPELRALV

SEQ ID NO: 20804 - protein, 441 aa, Rhodopseudomonas palustris
SRRYFGTDGIRGRANGLITPELALKVGQAAGLAFQRGEHRHRVVIGKDTRLSGYMIENALVAGFTSVGMDVLLVGPMPTPAVAMLTKSMRADLGVMISASHNLFEDNGIKLFGPLGYKLSDDVEKQIELMLDESLDKKLAQSASLGRARRIDGVHDRYIEFAKRTLPRELSLEGLRVVIDCANGAAYKVVPEALWELGADVISIGVEPDGFNINKECGSTAPQALCAKVREMRADIGIALDGDADRVILVDERGHVVDGDQLLAVIGQSWKEDGRLAKPGVVATVMSNLGLERFLAGEGIALLRTPVGDRYVLEQMLKDGYNVGGESSGHIILSDFNTTGDGFVAALQVLAMVQKLGRPVSEVCHRFDPLPQILKNVRYRSGRPLDDSGVISAIQDGEKRLNGHGRLLIRPSGTEPVIRVMGEGDDHDVVEEVVDSIVDAL

SEQ ID NO: 20805 - protein, 195 aa, Rhodopseudomonas palustris
MKIYGDFNSGNCLKVKWTCDRLGLPYEWIAIDTMKGETRTPAFLKLNPAGQVPVVAFDDGRSLAQSNAVIRYLARGSDLIPADPWLAAKMDEWLFWEQYSHEPYIAVCRFQMVYLGKPASELDPDKVRRGHAALARMEQHLANSEFLAGERLSLADVALLAYTRMAEQGGFELHDYPAIRGWISRAEAGLGLPAF

SEQ ID NO: 20806 - protein, 379 aa, Rhodopseudomonas palustris
KPASRPNAPQFSSGPCAKRPGWTPENLKDAPLGRSHRAKVGKAKLKLAIDLTRDVLEVPADYKIGIVPASDTGAVEMALWSLLGPRPVTTLAWESFGDGWVGDITKELKLPNVTKLKAGYGEIPDLSKVDCNTDVVFTWNGTTSGVRVPNADWIKADREGLTICDATSAAFAQPLDWAKLDVVTFSWQKALGGEAAHGMLILSPRAVARLESYTPTWPMPKIFRLTKGGKLMEGIFQGETINTPSMLCVEDYIDALQWAKSVGGLKGLIARADANTKVLTDWQAKTPWVDFLAKDPAIRSNTSVCLKVVDPAITALSPEAQADFAKKLVAAVEKEGAGFDLGAYRDAPPGLRIWCGATVEAADVAALTQWLDWAFETTK

SEQ ID NO: 20807 - protein, 264 aa, Rhodopseudomonas palustris
LNVPKLGLGTFKLQGKDCHEAVLTALSLGYRHIDTAEMYANEDFVGDALEDTDVPRDQIHLTTKVWWTNLAPDAIRKAFDQSLRKLKTDYVDFYLIHWPAPDMNLGAALETLLRIKDQGGARAIGVCNFPVALMKQAVEEIGAPIACNQVEHHVLLGQTKLLPYLQSKGIPLTAYAPLAQGRLASYPELQAIADKHGATAAQVALAWLLEQEGVMAIPKARGEASQRSNLGALKIKLDFDDRAVIAKLPKNQRFVTPAFSPKWD

SEQ ID NO: 20808 - protein, 403 aa, Rhodopseudomonas palustris
MANVVVVGAQWGDEGKGKIVDWLSEQADIVVRFQGGHNAGHTLVINGQTYKLALLPSGVLRPSKLAVIGNGVVFDPQAFLDEVKKLQGQGVAISPENLRIAENVTLILPLHRELDATRENAAKAGAIGTTQRGIGPAYEDKVGRRAIRLMDLADLDTLPTKIERLLAHHNALRRGLDQPEIDAGQILADLSAMAPHLLPYAESVWRLLDIKRREGKRILFEGAQGALLDVDHGTYPYVTSSNTVAAQAATGTGMGPGAVGYVLGICKAYTTRVGAGPFPTELTNEIGEEIGRRGKEFGVNTGRKRRCGWFDAVLVRQTVRTCGIHGLALTKLDILDGFDSVEVCVGYKLDGKEIDYLPAGEGAQARVEPIYETIEGWKEPTANARSWAELPAQASNMFAASRN

SEQ ID NO: 20809 - protein, 556 aa, Rhodopseudomonas palustris
MERIWLKQYPPGVPADIDVTQYPSLVDLFEESFRKYGDRKAFICMDKAITYRELDEMSVALGAYLQGKGLQKGARVALMMPNVLQYPVAIAAVLRAGFAVVNVNPLYTPRELEHQLKDSGAEAIIVLENFAHTVEQVIARTPVKHIIVGAMGDMLGFKGVIVNLVVRKVKKMVPAFSLPGAVSFNDAVSAGRGQKFTKPAIGPESVAFLQYTGGTTGVSKGATLLHRNVVANVLQNDAWLQPALAKPPHVDQLFIVCALPLYHIFALTACYLLGMRAGGVNLLIPNPRDIPGFIKELMKYQVNSFPAVNTLYNGLLHAPGFDKVDFSKLKISNGGGMAVQRPVAEAWLKMTGCPIAEGYGLSETAPVLTCNPATVNEFNGTIGLPMPSTELSIRDEEGKEVPFGTAGEICAKGPQVMSGYWNRPDETALVMTADGFFRTGDIGVMSPDGFTKIVDRKKDMILVSGFNVYPNEVEEVVASHPGVLECAVIGVPDSRTGEAVKAFVVKKDPDVTAEDIIKFCHHELTNYKVPRQIEFRTTLPKTNVGKILRRELRDEK

SEQ ID NO: 20810 - protein, 580 aa, Rhodopseudomonas palustris
WPMSLFHLYTRVLQLLGKEARLGWILAVANLLLATAQFAEPILFGRIVDVMSGNLATGALVPETRSPWPLLGAWVGFGLFTIMCSALVALQADRLAHRRRQAVLTSYFEHILQLPISFHTGTHSGRLMKVMLQGTDALWRMWLGFFREHFAAILSLVVLLPLSLYINWRLAILLFVLCIVFTVLTTLVVHKTYGMQGEVEAQYSDLSARASDALGNVALVQSFVRVDAEVQGLRNVSGRLLEAQMPVLSWWALVTVITRASTTITVLSIFALGIYLNQQGLTSVGEIVMFVSFATLLIQRLEQVVNFINNVLMEAPRLREFIAVLDTVPAVRDRADAIDCGRLSGLVEFQNVSFSYDGKRPAIEDLSFTALPGDTIALVGATGAGKSTAIALLHRAFDPQSGVIKVDGMDIRGITLASLRRNIGVVFQEALLFDRSIADNLRVGKPDATPEELRLAAERAQALEFIERSDHKFDTNAGERGRMLSGGERQRLSIARALLKDPPILILDEATSALDAVTEAKLNLALDEVMKGRTTFVIAHRLSTIRDATRILVFDNGKVIESGTFDELVARGGAFAQLAR

SEQ ID NO: 20811 - protein, 755 aa, Rhodopseudomonas palustris
  unsure (1)..(755): unsure at all Xaa locations
IEIDGRVIEAKDGEDLLSACLTHGIDVPYFCWHGALGSVGACRQCAVKVYDGPDDTEGRIVMSCMTPVADVERVSVTDPEAVAFRAQVIEWLMVNHPHDCPVCEEAGSCHLQDMTIATGHIDRRYKFTKRTHRNQDLGPLVTHEMNRCIACYRCTRFYRDYAGGRDLDAFGAHDNVYFGRAEDGPLESPFAGNLAEVCPTGVFNDKGWSRDYSRKWDMRATPSICPHCSVGCNILVDQRDGRVKRVQNRYHGALNGYFICDRGRYGPLHVVSEHRLRQPLIGGVPASEHEAASAAHAIVAEGAIGIGSPRASLEANYALQRLVGPERFFAGVSDVEAGLVRRIVEILRAGPAKIASLHEVEHADAALVLGENLTGTAPRLALALRQTARGAERELAAQKGVHAFLDPAVRTAGEGRRSPIVLATPLPDALDDLAALSLRLDPQGIAAFGDSVAAALGAGPADAIEEHSEAARVAEILANAERPLIVAGCALMSPEIIEAAARIVAALGVKARIVLLAPEANSIGLALLGGDGLDSAAALLERGGAKTAIVLENDLFDRAPRAGVERLFAAAKGVVALDSMANETTARAAVALPVAPFTEATGTFVNYEGRAQRFFAAVAPQEAAPASWRRLDAFGAGDWHGLDALIGDLIVERPDLVAVADAAPGEDFGMADGKVTRAPRPYTGRTADDRAGQFATRXFRSIKTGRXPSVSRARAAPRCPRRXSLATRPPASIRPTTXRASWRKSAALCAAAIPA

SEQ ID NO: 20812 - protein, 427 aa, Rhodopseudomonas palustris
AMTQKLHPETLALHAGWRADPSTGSVAVPLFQTTSYQFHNTEHAANLFALKELGNIYTRIGNPTTDVLEQRVAALEGGVAALAVASGQAASAFALQNLARVGDNVVSSTDLYGGTWNLFANTLKDQGIEVRFVDPSDPQAFERATDERTRAYYAETLPNPKLAVFPIEEVAAIGRKHGIPLIVDNTAAPLLVKPLEHGAAIVVYSATKYLGGHGTSIGGLIVDGGNFPWEQFPQRQPVLNTPDPSYHGAVWVEAVKPIGPVAYIIKARTTLLRDLGSALSPFNAFQIIQGLETLPLRIERHVQNAQKVADYLEKRPEVVKVIHPSKQSGVARERAEKYLQGKFGGLVGFELAGGREAGRKFIDALELLYHVANIGDARSLAIHPASTTHSQLSTEEQLATGVSDGYVRLSIGLEHIDDILADIDRGL

SEQ ID NO: 20813 - protein, 683 aa, Rhodopseudomonas palustris
TCPHDCPSACALDVEVIDGGTIGRLRGSKRQTYTAGVVCAKVARYAERIHHPDRLTYPMRRTGPKGSGQFARISWDEALDEIAARFDAAEAEFGAESVWPYYYAGTMGLVMRDGINRLANVKKYSRFYSTICANVAWAGFAAGAGKVAGVDPREMAKSDLIVIWGTNPVSTQVNVMTHAARARKERGAKIAAVDIYDNETMQQADIRIILRPGTDGAFACGVMHVLFRDGLADRAYLARYTDCPDDLEAHLKTRTPAWASSICGVPEAQIEAFAHAVGHTKRSFFRLGYGFTRSRNGAAQMHAALCIPAVTGAWQHEGGGAFFNNGAIFGFDKTLIEGLDQLDPATRVLDQSKIGRVLTGDAEALDGGAPVKAMLIQNTNPMTVAPEQELVRAGFAREDLFVAVHEQFMTETALMADLVLPATMFLEHDDLYYGGGHQHISVGARLVEPPGECRSNHEVLQGLAQRLGVDHPAFAMTPREVIDTTLESQRPWRHRAARSRSVARSAAGFPRVSLPRGFGHPDGKFHFKVDWGNVNLARKLRLGPWQEMPRLPDHWAVTEQADAEHPFRLATSPARSFLNTTFNETPSSQAREGEPNVMMHPADAAEVGVGEGDLVMLGNVRGETMLTVRLSSGLRRGVLIAESVFPNRAHRGGRGINVLTSAESIAPHGGAAFHDNKVWVKKA

SEQ ID NO: 20814 - protein, 549 aa, Rhodopseudomonas palustris
MYAYDDIDRAIVHERVEEFRDQVSRRLSGELTEDEFKPLRLMNGVYLQLHAYMFRVAIPYGTLSSAQLRKLAHVARTYDRGYGHFTTRQNIQFNWIALKDLPDALADLAEVGIHAMQTSGNCTRNVTADQWAGVAPGEVEDPRVWAEILRQHTALHPEFSFLPRKFKFAITASDHDRAAIKIHDIGLKLVKNDAGETGFEVLVGGGLGRSPFIGRTIKSFVAGRDILSYIEAVLRVYNQYGRRDNIYKARIKILVHELGIEKFAAEVEQAWAEIADGPLTLDHEMIEDIRSRFIYPAYEKLPAEPDELRAAAGDARFEAWRNNSVAPHRHDGYAIVTLSLKPAGGPPGDATAEQMDAVADLADKYSFGEIRVGHEQNLVLPHVARRDLPALWAALDKLGLATPNVGLVSDIIACPGLDYCSLANARSIPIAQELSRRFASPETAALIGRLHINISGCINACGHHHVGHIGILGVEKNGEEFYQITIGGRADEGAELGELIGPAVPYGEVADVIEDIVEAYLSLRQRPDELFVDAVKRLGVEPFKERVYA

SEQ ID NO: 20815 - protein, 297 aa, Rhodopseudomonas palustris
RGKTTIKEFEIYPTLEQLPLWGFDGSSTMQAEGHSSDCVLKPVAMYPDAARKNGILVLCEVMMPDGVTPHPTNTRATILDDEGAWFGFEQEYFFYKNGRPLGFPEAGYPAPQGPYYTGVGYKHVGDIARQIVEEHLDLCLAAGINHEGINAEVAKGQWEFQVFGKGSRTAADQMWMARYLMLRLTEKYGIDIEFHCKPLGDTDWNGSGMHCNFSTAYMREVGGKEYFEAMMKAFEANLDDHIAVYGPDNHMRLTGKHETAPWNKFSYGIADRGASIRVPHSFVNNGYKGYLEDRRPN

SEQ ID NO: 20816 - protein, 255 aa, Rhodopseudomonas palustris
LTGKTAVVTGSTSGIGLSYARAFAKAGANVVINGMGDADAIEKERKAIESEFAVKAVYSPADMLKPAEIAEMIKLGETTFGSVDILVNNAGIQFVSPIEDFPIEKWDAIIGINLSSAFHGIRAAVPGMKKRGWGRIINTASAHSLVASPFKSAYVAAKHGIAGLTKTVALELATHKITCNCISPGYVWTPLVEKQIPDTMKARGLSKEQVINDVLLAAQPTKQFVTPEQVAALAVYLCGDDASQITGANLSMDGG

SEQ ID NO: 20817 - protein, 470 aa, Rhodopseudomonas palustris
MRRLRRIKILATLGPASSDSAMIRKLFEAGADVFRINMSHTPHDKMRELVKTIRNVESSYGRPIGILVDLQGPKLRLGSFANGPIQLNNGSNFVLDSIKEPGDETRVYLPHPEILAALKVGDALLLDDGKVRLICEETQGDRAVTRVVIGGKMSDRKGVSLPDTDLPMSAMTNKDRADLEAACETGIDWVALSFVQRAEDVVEAKRMIRGRAAVMAKIEKPQAIDRLEDILDVSDALMVARGDLGVEMPLERVPSLQKQMTRMARRAGKPVVVATQMLESMISSPVPTRAEVSDVATAVYEGADAIMLSAESAAGKYPVEAVSTMNRIGEEVERDVTYRTVVTAQRPDPEATAGDAIAGAARQIAETLDLSAIICWTSSGSTALRVARERPKVPVVAITPSLHTGRKLSAVWGVHCVVAEDAKDQDDMVERAGRIAFRDGFAKSGQRVIIVAGVPLGTPGATNMVRIAYV

SEQ ID NO: 20818 - protein, 276 aa, Rhodopseudomonas palustris
AIRLAARLGVPSYLITQHRFPDGEIAVNVGPKAEITILYLPLDQPNDKLVTILFAAEALRREGCNRLVLLAPYLCYMRQDVAFHPGDAISQKAMGRLLAGLVDRVITVDPHLHRTPRLGDVFPGITADELSAMPAIAAALRGTLAPDTVVVGPDSESQQWVDALAKLIGTRSAVAQKIRHGDRSVEIAFGDASAIAGRPALLVDDIVSSGGTLIACTRALLGAGATSVDAVITHALFPPAMLRDFAAAGIRSIRSTHTVPHPTNAITLDDLFVEAL

SEQ ID NO: 20819 - protein, 559 aa, Rhodopseudomonas palustris
RRSFDNHRVARGDRVEIGSKGQRRCYMVVDVIPDGSGVIDRATEVTIDHRAMADATTSPYDDVGGLAREVALVREMVELPLRFPHVFARLGIEAPKGVLLYGPPGCGKTLIARTVAREAGVYFLHVNGPEIIQKHYGESEEMLRRIFADAQKQPAAIIFFDEIDAIAPNRETVLGDVEKRVVAQLLALMDGLTARGNIVVIAATNLPNSLDPALRRPGRFDREIGIAPPDRAGRLEILRIHTRRMPLADDVDLAQIAAAAHGYLGADLAALCREAAMGCTRDLGPRLVAGDPGAAAALDGDLQVRMDHFRRALREVPLASTRSLTTEVAASHWDEVGGLDDIKALLRETVEWPLKYPQRLAFAKTTAPRGILLTGPTGTGKTLIVRALATQSDVNFIAVNGPELLSKWVGETERAIRDVFRKARQSAPSIIFFDEVDAIVASRGGDDGGARIGDRMVGQFLLEMDGLAGLDGVVVIAATNRPDLIDRALLRPGRFDHIATLALPDRAARAAILAIHCRGRALGSDVDLAALAKACAGMSGADLEALCRRAAMAAIRASI

SEQ ID NO: 20820 - protein, 1103 aa, Rhodopseudomonas palustris
MPKRTDISTILIIGAGPIVIGQACEFDYSGTQAVKALKQEGYRVVLVNSNPATIMTDPELADATYIEPITPEIVAKIIEKERYVIPGGFALLPTMGGQTALNCALSLRKLGTLEKFDVEMIGATADAIDKAEDRERFREAMTKIGLETPNSRQVKSLPDALRALDEIGFPALIRPSFTMGGTGGGIAYTKAEFIEIVERGIDASPTNEVLIEESILGWKEYEMEVVRDKHDNCIIVCSIENLDPMGVHTGDSITVAPALTLTDKEYQIMRDASLAVLREIGVETGGSNVQFAVNPDDGRLVVIEMNPRVSRSSALASKATGFPIAKVAAKLAVGYSLDEIANDITGGATPASFEPTIDYVVTKIPRFAFEKFPGASPTLTTAMKSVGEVMAIGRTFQESLQKALRGLESGLTGLDEIEIDGLGRGDDKNAIRAALGTPTPSRLLQVAQAMRLGWSNEEIFNSCKIDPWFLAQLRGIVDMEARVREAGLPDHAFGMRTLKAMGFSDARLAVLADTTEAEVKAKRRALGVRPVFKRIDTCAAEFASPTAYMYSTYESPFAGPASDESRPSDKQKVIILGGGPNRIGQGIEFDYCCCHACFALHDAGYESIMVNCNPETVSTDYDTADRLYFEPLTGEDVLEIIDTERSNGTLRGVIVQFGGQTPLKLARALEAADVPILGTSPDAIDLAEDRDRFKRILDKLRLKQPKNGIAYSVEQARLVAAELGLPLVVRPSYVLGGRAMQIIREDNQLSDYLLGTLPELVPGDVKARYPNDKTGQINTVLGTNPLLFDRYLSDATEVDVDCLSDGKDTFIVGIMEHIEEAGIHSGDSACSLPPHSLSAETIAELERQTRELALGLDVVGLMNVQYAIKDGEIYVLEVNPRASRTVPFVAKVIGMPVAKLAARIMAGEKIADLGLKKRNLDHVGVKESVFPFARFPGVDTVLGPEMRSTGEVMGIDRSFEIAFAKSQLGGGTRVPRKGTVFVSVRESDKARIVDAVKLLHSVGFKVIATSGTQRYLSDHGVPAEKVNKVLEGRPHIVDAIMNGEVQLVFNTTEGPQALADSRSLRRAALLHKVPYYTTLSGAVAAAKGIRAYLDGDLEVRTLQ

SEQ ID NO: 20821 - protein, 600 aa, Rhodopseudomonas palustris
IKLSDWLAQKVVELGVRHVFMVTGGGAMHLNHSLGSHKDLSCVFNHHEQACAIGAEAYYRLSNRLPLVNVTSGPGGTNAITGVYGAFVDSVGMVVISGQVKFETTVRSTGLPLRQYGDQELDIIELVRPITKYCEMVTDPQTIRYHIEKAFYLATSGRPGPCWLDIPLDVQAAKIDPDTLVGFDPSEIEEPWKKTDLTAASQAIFDRIAKAERPVIFAGGGVRLSGRHDAFLKLIDKLGIPVVTGWNAHDALFDDHFTYAGRPGTIGDRGGNFVVQNSDCLLVLGSRLNIRQVSYNWKSFAREAYKIWVEIDETELKKPSVKPDMPVLASLTDILPVMAETEYSGPTEQHKKWLAWAKAKHEQFPAVLPEYWHNQLVNPYCFMDALFGALDEDQIVVTGNGSACVISFQAAALKRGQRLWTNSGCATMGYDLPAAIGACTASGGKPIVCLAGDGSIMMNLQEMQTIIGNGLPIKIFLLNNSGYVSIFQTHRNFFNGVEIGGGPKSGVTFPDFEPVSKAFGFSYVRCARHQDMADAISATMQADGPSVCEIMLDENVAFAPKLGAKQLPDGRIISPPLEDLSPFLPRDQFRASMIIDTIDE

SEQ ID NO: 20822 - protein, 281 aa, Rhodopseudomonas palustris
EANKSLEYAPHLISELRKAGADRSTHLVAIGGGIIQDVVTFAASIFMRGLPWTYMPTTLLSMVDSCIGGKSSINAAGYKNLVGNFYPPKKVLVDVSFISTLDAEMIAGGLFEAAKICYASNYQAFLDYLACSPGLKMTDEQAVNVIRHSLLTKKWFIEIDEFDQKERLLLNFGHTFGHALEAATDFGISHGVGVGLGMLVAAQYAKRETELTDAGKDHVAHLIEHVKDMIGPRAERVLQSPAHVDLDLAMEKFEFDKKHKSDSYRIVIPNREGALALVSVS

SEQ ID NO: 20823 - protein, 220 aa, Rhodopseudomonas palustris
VFGATGAIGRAICEWFTEHRVRVVAIGRAEHPPSGVPCDHWLSWDAERPDNFSKVLAGVQLDAAVWAQGANYNDNIRTFDIEAHKRIYTANVTYILVSLQMLLNGNLLAPTAKLCIISSIWQNIAKQNKMSYGITKAALQGLVQSLAIDLGGSGILVNAVLPGALDTPMTRANLSSDQIARLEQMSPLGSLPSLADVCNLIGFLCSEANTGITGQFIAAD

SEQ ID NO: 20824 - protein, 354 aa, Rhodopseudomonas palustris
MIQPAFWRGKRVFLTGHTGFKGSWLSIWFAELGADVVGFALPPPTEPSLFEVAGLARRMNSIIGDVRNADALCSAMQEARPEIVIHMAAQPLVRLSYHQPVETYATNVMGLVHVFEAVRKCQSVRAVVNVTSDKCYENKEWVWGYRESEPMGGYDPYSSSKGCAELVTTAYRNSFFNPENYQTHGVAIASARAGNVIGGGDWAPDRLIPNIMRAIETGIPVQIRNPAAIRPWQHVLEPLGGYLCLAKKLYEAGPAFVGGWNFGPADSDAKPVQWIVDRMTRMWGKGASWQEVTDRTAPHEAHYLKLDCSKAQSLLGWKPAWNLERALEKIIDWHHSSLQGADLHAKTLGQIRDY

SEQ ID NO: 20825 - protein, 254 aa, Rhodopseudomonas palustris
MKVVLLAGGLGTRISEESALRPKPMIEIGGRPILWHIMKIYLAHGLRDFVICCGYKGYMIKEYFANYSLHMSDITIDMENESIEIHRKKTEPWRVTLVDTGEATQTGGRLKRIADYIDGDFCLTYGDGVGSINITELLMFHRSHGKPATMTATQPPGRFGALQLNGKSVTSFLEKPTGDGGWINGGFFVLSPKVLDRIDGDMTIWEREPLESLAQNGELQAYFHSGFWQPMDTLRDKNHLENLWQSGRAPWKMW

SEQ ID NO: 20826 - protein, 620 aa, Rhodopseudomonas palustris
TFPKLLRLNAREFGTEIALREKDLGLWRVFTWADYQARVHDFALGMVELGLKRGDVIGIIGDNRPDWVSAEIATHAIGGLSLGLYRDVLDEEADYLLNYGEAKLVFAEDEEQVDKLLGLADRAPHLKHIVYSDPRGMRKYDDPRLLPADQLAKLGRDRASREPGLYDRLVDATQGEDVAILCTTSGTTAHPKLAMLASGRVLKHCATYLSFDPKGPDDEYVSVLPLPWIMEQVYALGKGLLCRMTVNFVEEPDTMMNDFREIAPTFVLFAPRVWEGIAADVRARVMDASPLKQRLYNAGMRAGLAALDHGQHSAFADAVLFRALRDRLGFTRLRSAATGGAALGPDTFRFFRAMGVPLRTLYGQTELLGAYTLHKPDAVDPDTTGVPMGAEIEIKVLNPDVQGIGEVVVRHPNMFLGYYKNPEASTADIKDGWMHSGDAGYFNGAGQLVIIDRIKDLAELSHGERFSPQYIENKLKFSPYVAEAVILGAGRDMLAAMICIRYSIISKWAEKKRIAFTTYSDLASRPEVYELLRREVASVNATLPPAQRISRFLLLYKELDADDGELTRTRKVRRSVINEKYGDIIDGIYSGRSDISVDTAIKFQDGTTQRIRTTLRVVDL

SEQ ID NO: 20827 - protein, 435 aa, Rhodopseudomonas palustris
MRITMIGTGYVGLVSGACFADFGHQVTCVDKDAGKIAALHRGEIPIYEPGLDELVAANVKAGRLDFTTDLTLPVGEADAVFIAVGTPSRRGDGHADLSYVYAAAKEIAAALKGFTVVVTKSTVPVGTGDEVERLIRETNPTADAAVASNPEFLREGAAIRDFKFPDRIVIGTADERARKVMGEIYRPLSLNQGPLMYTARRTAELIKYAANAFLATKITFINEMADLAEKVGADVQDVARGIGMDNRIGSKFLHAGPGFGGSCFPKDTRALVQTAHDHDVPVRIVEAVLAVNDNRKRAMARKVSHALGGNMRGKTIAVLGLTFKPDTDDMREAPSIPLVTGLTDMGAKVKAFDPAGMAQAKAELPDITYCEDAYDCAKGADALVIVTEWVQFRALDLPRLKAAMAQPIVVDLRNIYRPAEMAEHGFSYHSVGRGD

SEQ ID NO: 20828 - protein, 399 aa, Rhodopseudomonas palustris
  unsure (1)..(399): unsure at all Xaa locations
ASYMFTSESVSEGHPDKVCDRISDEIVDLFYREGPKAGIDPWAIRAACETLATTNKVVIAGETRGPASVTNEQIEQVVRDAIKDIGYEQEGFHWKTADIEILLHPQSADIAQGVDALQPGTNKEEGAGDQGIMFGYATNETPDLMPAPIFYAHKILRLISEARHSGKEKVLGPDSKSQVTIQYENGKPQYVREIVVSHQHLIEDLSSNQIRDCVEPYVRQALPDGWITDNTIWHINPTGKFYIGGPDGDTGLTGRKIIVDTYGGAAPHGGGAFSGKDPTKVDRSAAYAARYLAKNVVASGLADKCTLQLAYAIGVARPLSIYIDTHGTGKVSEDKLETIVAEVMDLTPRGIRTHLDLNKPIYARTSSYGHFGRTPDADGGFSWEKTDLADAMKRAVXVR

SEQ ID NO: 20829 - protein, 463 aa, Rhodopseudomonas palustris
DYIVKDIGLAEFGRKEISLAETEMPGLMATREEYGPKQPLKGAKIAGSLHMTIQTAVLIETLVALGAEVRWVSCNIYSTQDHAAAAIAAAGIPVFAVKGETLKDYWDYTAKLFDWSDGGTPNMILDDGGDATMFVHQGLRAENGDTMFLDQHNSEEEEIFFALIKRILKEKPKGYFATLAKNIKGVSEETTTGVHRLYDMEKAGKLLFPAINVNDSVTKSKFDNLYGCRESLVDGIRRGTDVMLSGKVAMVAGFGDVGKGSAASLRQAGCRVMVSEVDPICALQAAMEGYQVVTMEDAAPIADIFVTATGNKDIITIEHMRAMKDRAIVCNIGHFDNEIQVATLKNMKWDNIKPQVDEITFPDGKRMILLSEGRLVNLGNAMGHPSFVMSASFTNQTLAQIELFQNQGKYEKKVYVLPKTLDEKVARLHLAKIGVKLTELRKDQADYIGVKVEGPFKADHYRY

SEQ ID NO: 20830 - protein, 513 aa, Rhodopseudomonas palustris
SKLTLATLGGRPLLTDLDLSFARERTGLIGRNGVGKSSLLAVIAGEGPALAGTVTVAGRIAMLHQAAQPRSGETVADLFGARDALALLRKAAQGEAAPSELDEVDWTIGQRIVSSLARFGLDVDLDVGLAALSGGQATRARLAALTFCEPDFVLLDEPTNNLDRGGRRAVLDLLAGWRGGAIVVSHDRELLETVDAIVELTSLGASRYGGNWSRYVERKDIELSAATRDLAEAERRLTETGCKAQAAIERQARRDGAGKRKQARGGMPRILAGARKDRSEDTGGAGARTASRQRVEALAGVDLARQRVEVLQTPSVALAPTGLAAGKTVLALDRVSVGYQPLRPVLSDLSLSITGPERVAIVGRNGTGKTTLLKLISGELRPWRGVVHVTSRLAVFDQQLSLLRPSDSVLVNYQRINPDSDLNACRAALARFLFRGDTVLQIVGQLSGGQILRAGLACVLAGPQPPFLLVLDEPTNHLDLDSIRAIEAGLIAYDGALVVVSHDEQFLEAIGVS

SEQ ID NO: 20831 - protein, 390 aa, Rhodopseudomonas palustris
LYDHVKKFIADVVEPMQHEFEIAEAKNPNRWSFSQEQLDLLAKAKAQAKEQGLWNFFLPDAETGEGLNNLDYAYIAAELGKAPLASEVMNCSAPDTGNMEVLERVGTPEQKEKWLKPLLDGEIRSAYVMTEPNVASSDAKNVSTSAVLDGNEWVINGEKYYISGLGDPRCKIMIVMVKTDPTAAPSKQQSQILVPVDTPGVEVLGPMHVFGHDHAPRGHMHMRFNNVRVPKENILLGEGRGFEISQLRLGPGRIHHCMRTIGKAEKALDLMVARGLTREAFGKKLAHLGGNLQIIAQARCEIEAMRLMVLKAAKAMDVLGNKEARVWVSMVKAMVPERACKIIDQAIQMHGATGISQWTPLAEMYTDVRHLRFADGPDEVHWMVVGRHEL

SEQ ID NO: 20832 - protein, 520 aa, Rhodopseudomonas palustris
PLARALAERNYLQATPVQSAVLAPDTAGRDLLVSAQTGSGKTVAYGLAIAQDLLGDAEQFAPAAAPLALIVAPTRELALQVHRELSWLYRHAGGRIVSCVGGMDPRREQRELADGAHIVVGTPGRLCDHLRRNRLDVSQLKAVVLDEADEMLDLGFREDMEFILETTPETRRTLLFSATLPRGIIALAKTYQHDAMRIEVEGAEGGHADIEYRAIRIAPNDVEHAVVNVLRYVESPTAIVFCNTRSAVNHLQTALLERGFAVVALSGELTQNERTGALNALRDGRARVCVATDVAARGIDLPNLGLVIHAELPNDAEVMQHRSGRTGRAGNKGVSVLLVPPARRRRAELLLQLAGIEANWGTAPQADEIRSLDQQRMLQDPLFTEEPTAEDQALAQALLAERSPEQIAVALARVVRARMPAPEDILDPGERPARGRDERPGKTAREPRDHEARDKAPRSRSAKAGEKHAITGGVWFRAAIGKRKNAEARWLLPMICRRGGITRQDIGAIRILDTTTEFEI

SEQ ID NO: 20833 - protein, 516 aa, Rhodopseudomonas palustris
IMFWSVVTLVVFSLKGAATYGQSVILTQIKNAILANNQRRMFHKLMSESIGFFSQRHSSEFLARLTAGANSVTEVLNLLINAIGRDLLSLIGLVIVMVVQDPFMALFGLLVAPPAAFVVRKLVKRVKGLALTQFTGNAQILETMQESLQGIRTVKAFSLEKTMSDRIDANIAAVQANADKMAKVSNRSSPLMETLGGFAVAASLMYGGYRVVATGATPGEFFSFLTAFLLAYEPAKRLARLNIELNSGLVGARMLLEIIDSPPSEPDDSHKPALQLTEARVEFDHVSFAYRPDEPVLNAMSFVAEPGKMTALVGPSGGGKSTVLALLLRLYEVQSGEIRIDGQSTSTVSRESLRRQTAYVGQDVYLFRDTVRANIAFGKLGATEDEIVAAAKAACAHDFIMGFPLGYDTPVGEHGAQLSGGQRQRIAVARALLRDAPIVLLDEATAALDSESEKLVQEAIDRLARGRTTIVIAHRLHTIMHADSILVVEAGEIVEQGRHDDLLRRSGRYASFFRLQ

SEQ ID NO: 20834 - protein, 214 aa, Rhodopseudomonas palustris
PMTPDLDKSLIETAYARWAPIYDAVCGPVMVKGRRAAAAEARAHGGKILEVGVGTGLSFDDYDASTEITGIDLCEPMLDKARAKMATGRYPWVKDVRQMDAHAMEFADATFDCVVAQFVITLVANPEQVLSECHRVVKPGGRIILVNHLYSEVGVAAAVERWAAQKTRGLGLRPEFPFARLQAWAQATSDAILVERRKLKPFGIYTLVCFERTP

SEQ ID NO: 20835 - protein, 266 aa, Rhodopseudomonas palustris
DVTDPSAVATMIAKLQPSHVVNLAALAAPSAANADPSASWRVHLDGPRNIGRAILQAAPACVLLHVGSGLAYGKNRPPICPTSEDRVLAPTDEYGASKAAADVALGPLIAKGLHCIRLRPFNHTGPGQTDAFVVPAFARQIARIEAGLAPPQMQVGNLDGQRDFLDVRDVVAAYAETIARSDSLTPDAILNIASGVPRRIGDMLQQLLTMARVPIAVQNDPARGKSDAADVILGDASRARSMLNWQPTIAFEQTLADVLEDQRSEV

SEQ ID NO: 20836 - protein, 321 aa, Rhodopseudomonas palustris
MSKTAFITGITGQDGAYLAQHLIAQGYAVHGLLRRSASADGMTSRLKWLGIADQVTLHDGNLTDLSSLIRLLTDLQPDEVYNLAAQSFVKSSWQQPLLTGTVTGLGAVNALEAVRIACPKARFYQASSSEMYGLIQQRIQSETTPFYPRSPYAAAKLYAHWMTINYRESFGMHASCGILFNHESPLRGIEFVTRKITDGVARIKLGLQTTLSLGNLDAKRDWGHARDYTRAMWLMLQQDVPDDYVIATGRTASVREFCEMAFACVGLDMNQYVVTDPRHLRPAEVDYLQGDAAKAKRKLGWTFETSLEQMIAEMVEADLAR

SEQ ID NO: 20837 - protein, 314 aa, Rhodopseudomonas palustris
KYLVIGSNSFTGASMVSYLLDQGADVVGISRSDEPHPAFLPYRWKKADRFRFQKLDLNHDLDAIMQLVTAERFPCIINFAAQSMVGESWANPDHWFMTNVVSTVRLHERLRICDFLERYVHVTTPEVYGNATGTLTEDAVFDPSTPYAVSRAAGDMSLRSYFRAYGFPVLFTRAANVYGPGQRLYRIVPRTILFIKLGRKLQLHGGGTSERSFIHAADVADATRRIACNGKLGDSYHISTDRIVTIRALVEMICAMMRVRFEDQVEIVGERLGKDAAYKLDSSKLRSELGWSDQITLEQGIEQTIAWIDRWFEE

SEQ ID NO: 20838 - protein, 328 aa, Rhodopseudomonas palustris
  unsure (1)..(328): unsure at all Xaa locations
MNPETSRRLLFDMLRIRSVEETIAARYGEQKMRCPTHLSVGQEAVSAAAGAVLRPTDLAVSGHRAHAHYLAKGGSLKAMIAEICGKVTGCARGKGGSMHLVDESVGFMGSTAIVGGTVPVGVGLSYPMKLNQTGQISCVFLGDAVPETGVFFESVNFAVVKQLPVLFLCENNGYSVYSPLSVRQPPGRKLYELVAGFGLKTHHGDGNDARAVYAALSEGVAAIRAGEGPRFYEFETYRWREHCGPMYDNDLGYRTVAEFEAWKLRDPVPALQRALITEAIVTAADVADMQAEIDAEIEEAFAFAESSPFPPPEDAFTDVYASAAGXGG

SEQ ID NO: 20839 - protein, 308 aa, Rhodopseudomonas palustris
TALAVDDDVICFGLGTDDPKGVFGTTLDLHKQFGPDRVFDMPTSEAAMTGFAIGAALNGMRPVMTHQRLDFALLSLDQLVNNAAKWRFMFGGKRGVPITIRMIIGRGWGQGPTHSQSLQSWFAHIPGLKVVMPTTAEDAKGLLLGAIFDDDPVIFLEHRWLHNMKGEVPAGDVRSPLGKARIVRQGDAVTIVAMSYMTVEALHAVDHLAAQGIACDLIDLRSIRPLDWPAVIASVQKTGRLLALDSGHLTGGVAGEIVARVATDHFASLKSAPQRLAAPDVPEATSPALTKNYHVRAEHIAEAVGRML

SEQ ID NO: 20840 - protein, 344 aa, Rhodopseudomonas palustris
VTFRAAVLHELNRPLSIETVEAPPLAAGQLLVKLAYSGVCHSQVMEARGGRGPDRYLPHMLGHEGSGVVVEIGGGVTKVKRGDRVILGWIKGQGADTQGVRYASGERVINAGAVTTFNEYAVVAENRVTPLPAGLPMDVAVLFGCALPVGAGIVINIAKPQPGATLAIFGLGGIGLAALMACKLFACNQVIAVDVEAAKLKMATELGATTVIDASRIDPVEEIRRLTGGLGVDYAIESAGLTRVIEQAFDATRRFGGLCVFASHPRSGEKIALDPFELICGKRILGTWGGDSKPERDIELLAGLYRDGKLPLDAMFTRRYKLDEINEALDDLEHRRSVRPLIEI

SEQ ID NO: 20841 - protein, 491 aa, Rhodopseudomonas palustris
TECGSIRGIVADGVRTWRGIPFAAAPAGALRFNAPQPPNAWQGVRDASEFGPIPMQKRGYEAIGGAGKTTPISEDCLTVNVSAPLQPSGNLRPVVVWIYGGGFSVGGTRAPLYRGDGLVKSGDVIYVSFNYRVGVFGFSDFSAWSTPESPIQSNPGLRDQVTALGWIKRNISAFGGDPDRVTIVGQSAGAMSVVTLMCIPSGAGLFHRAIAMSPNAGSAFGPERHRAWAAEIVKLLGLDPDDKAAVSHALKQVSAETLCEASSRFFYDVAPDAIAGMLPTSPVVDGDFLPFSPIDAFRLGKAHPVPLVIGTMSREGAILDKVLTVIATRPNRLEDMFKRAGWAVRERIASIYHGYPSKRAAIDVGGDFTFWHPSVLIAEGHARVAPCWAYRFDYATPLTRLIFGAATHGLDLPMLFGTTGEGDLGKLDLFRKRASREMSGRFQSDLLGFVRGARPSWPTYDLDRRMTRIFDHADREEADPRRDRRLAWGEF

SEQ ID NO: 20842 - protein, 296 aa, Rhodopseudomonas palustris
  unsure (1)..(296): unsure at all Xaa locations
ASPVMALRPEVXTSDDSSHDPLVSTDWLAERLGDPSVKIIDASFKMPGVLPLPADDYLAAHIPGAVFFDVDAVSDHASSLPHMYPSADQFARDVEALGISSGDTVVAYDAGGWVAAPRAWWMFLSFGHANIRILDGGLKKWVAEGLPTEAGKPTIAPGRFSAKLDPSFIRSRDQLVANLDSGAEQVIDARAAPRFEGSVAEPRPGLRAGHIPGSRNLPYNELFDAATGTMKPLAELRQAFERAGLDLGRPVVTSCGSGVSAAVLTLALYRLGVRGSALYDGSWSEWGLQDGPPVAT

SEQ ID NO: 20843 - protein, 125 aa, Rhodopseudomonas palustris
GIKAMLDEANSSIETLTTADAIALHKSGASDVVIVDIRDPREIERDGKIPGSFSCTRGMLEFWIDPQSPYAKPIFQEDKKFVFYCAGGLRSALAAKTAQDMGLKPVAHIEGGFGAWRDAGGPIEA

SEQ ID NO: 20844 - protein, 239 aa, Rhodopseudomonas palustris
KTALITGGNSGIGLATAKLFVTEGARVTITGRDRARLDAAARELGAQALAVEADVTDVAAIENAVARAAERFGKLDIVFANAGIPGATPLGGTSLAAFEQVIRTNLTAVFFTVQAALPYLNDGASIILNGSVISVLGNPGFAAYAASKAGLRGMARVMASELSPRNIRVNVVAPGGARTPIWKDTAPTDQAMAVLEKRIAAATPLGRIAEPEHIAKTVLFLASDDAAHIQSAEIFVDGG

SEQ ID NO: 20845 - protein, 353 aa, Rhodopseudomonas palustris
  unsure (1)..(353): unsure at all Xaa locations
MQIGMIGLGRMGGNIVRRLMKDGHHAVVYDRDPQAIETLTREGATGAGGLEDLVRKLDAPRAVWVMLPAGQITETTIEQLAKLLAAGDVVIDGGNTFWQDDIRRAKTLKETSIDYVDVGTSGGIWGFERGYCMMIGGDKAVVDRLDPIFATLAPGIGDIPRTPGRDDRDPRVEQGYLHAGPVGAGHFVKMVHNGIEYGLMQAYAEGFDILKNASSDSLPEAHRFDLDIADIAEVWRRGSVIPSWLLDLTATALAKNDQLDNYSGFVEDSGEGRWTINAAIEEAVPAEVLTAALFARFRSRREHTFAEKILSAMRAGFGGHKEPQQHPEPEQQAAPQQKLKPKAERAXPRKPTA

SEQ ID NO: 20846 - protein, 494 aa, Rhodopseudomonas palustris
QVPEGCAFVIFGATGDLTHRLVIPALYNLAEANLLPEKFCVVGVTRKEMSSDDLRDSLMQGLRKYATRPVDDKVADQLLYCVTAVSADPSEPASFERLRERLEKLEANRNTGGNRLFYLATPPDAFAPIATELGRAGLLKETSGAWRRLVVEKPFGTDLASAKALNDHLLSIISEHELYRIDHYLGKETVQNILVLRFSNGMFEPIWNREHIDHIQITVEEKLGVGHRGSFYDKTGALRDMVPNHLFQLLSLVAMEPPAHFNAHAVRSAKADVLAAIQIQTEEEALRNSVRGQYTSGKIGDTDIPDYRSAKDVAADSTTETFAALTLSIDNWRWAGVPFYLRTGKALSGKRTEVAIKFKEAPFSMFRCTPVQELSQNFLVIGIEPVEGISLQFNTKVPGPMIAIDGVEMTFRYKDYFKVAPSNGYETLLHDCMIGDNILFQRADGVEAGWRAVQPFLDAWKKAGAHGLQIYRAGSDGPEDADELLGRDGRNWRK

SEQ ID NO: 20847 - protein, 162 aa, Rhodopseudomonas palustris
MGVSGSGKSTVGEALAQRLGWRYEDADAYHPKANVAKMSAGQPLTDDDRWPWLKAIAAEIDRVIAGGGHIVFGCSALKGAYRDVLVHGRDDIRIVFLDGSRELIGGRMAARKNHFMPAGLLDSQFATLERPGPDERPIIASIDAPVATIVDDIVGQLPTSTS

SEQ ID NO: 20848 - protein, 549 aa, Rhodopseudomonas palustris
DRPDAETSDELWYKDAIIYQLHVKAFADSNNDGIGDFAGLTEKLDYLQELGVNTLWLLPFYPSPQRDDGYDIADYGSINPDFGTMKDFRRFIVEAKKRNLRVITELVINHTSDQHAWFKRARRSPKDSSARDWYVWSDTDQKYLGTRIIFTDTEKSNWTWDPEAGQYYWHRFFSHQPDLNFDNPRVVSAVVKVMKRWLDTGVDGFRLDAIPYLCERDGTNNENLPETHAVIKRLRAELDAYAKGKLLLAEANQWPEDVQQYFGDGDECHMAYHFPLMPRIYMAIAQEDRFPITDIMRQTPEIPANCQWAMFLRNHDELTLEMVTDVERDYLWKTYAADPRARINVGIRRRLAPLMDNDRRKIELMNSLLMSFPGTPIIYYGDEIGMGDNIYLGDRNGVRTPMQWSPDRNGGFSRADPARLYAPPIMDPVYGYASVNVEAQQRSLSSLLSAMKRLIAVRKSTPAFGRGSITFIRPSNRAVIAYVRQYKDEVILCVANLSRAAQATELDLSPWKDRVPQEMLGRTKFPPIGDPAYMITLAPFGFYWFKLQE

SEQ ID NO: 20849 - protein, 720 aa, Rhodopseudomonas palustris
RRLPRSFHDRAIERRSLRSLSKAVMADPFRYLGAHPEDGGTMVRVLLPDAVAVEVIGDNGDVAPLDQAHPAGLFVGPLPGASPRYTLRARFGDTTVELQDPYRFPPILSDFDLYLLGEGTDQRLYDKLGAHPMELEGVAGVGFVVLAPNARRVSVVGDFNFWNPLRHQMRVRGSGYWELFVPGARAGDHYKFDLAGPNGEQLPQKADPLAFAAELRPKTASIVVDATTLPRPRPAPENINALSAPMSIYEVHLGSWRRKEGDQWLTYRELAEQLPAYVRDMGFTHVEFLPVSEHPFDGSWGYQPTGLYAPTSRFGSPEDFCALVDACHAAGIGVILDWVPGHFPDDPHGLGNFDGTALYEHANPMQGRHLDWGTLIYNYGRTEVVNFLTANALFWLERYGIDGLRVDAVASMLYLDYSRPAGGWIPNKFGGRENIEAIDFIRRFNTEVYGKFPHSTTAAEESTAWPQVSRPIEFGGLGFGYKWNMGWMHDTLNYISKDPIHRKYHHGQILFGLHYAFSENFILPLSHDEVVHGKRSILGRMPGDEWQRFANLRAYYAFMFGHPGKKLLFMGSEFGQEREWSHDRSLDWHLLEYPKYSGIQALLRDLNKLYRSLPALHQLDCDPFGFEWLITEDANRNLFAWMRKGNDTRARCLVIVNFSPNVYQDYRVRVPFPGRWREVFNSDSAGYGGTNVGNGGEVRTLEGLVPELSLTIPPLAAIFL

SEQ ID NO: 20850 - protein, 666 aa, Rhodopseudomonas palustris
AMRLTAGTDSRLGATWDGRGTNFALFSANAHKVELCLFDAQGRRELERIELPERTEDVWHGYLNDVSPGQLYGYRVHGPYDPDRGHRFNAHKLLLDPYAKRLNGRLVWSEAHFAYRTGSPREDLSFDRRDNARGMPKVVVVDETVGSGRRETRPGVRWEDTIVYEAHVKGLTQLRDDVPPGLRGTFGGLACPTMIAHLKRLGVTTIELLPVQGFVDDRVLVEKKLVNYWGYNTISFFAPEARYAPDKDNPLDSFRTTVARLHDAGIEVLLDVVYNHTAEGNHLGPTLSFRGIDNASYYWLKPDNPRYYDDFTGCGNSMNLTHPRVLQMVMDSLRYWVEVCHVDGFRFDLATTLARGSNGFDRNSGFFTAIRQDPILAGVKLVAEPWDLGMGGYQVGAFPSQWSEWNDRYRSVMRRYWSGEGSLIGEVSRRMTGSSDMFNRDGRMPRASINHVTVHDGFTLADLFSYERKHNVANGEDNRDGSNDNHSINCGVEGPTDDPKLLGMRRQLRKNQLACLFLAQGVPLLLAGDEVGNSQAGNNNAYCQDNEIGWVGWDGTNTEDDMVEFVGLMTDIRRRFPQLRSRRWLDGRRADGSYGVLWLTPSAAEMTDQDWAFPDGRFLAYVLSPSEPGGSAIFIVLNSGVQEIEFHLPKLPEYQTWKELFDTTKN

SEQ ID NO: 20851 - protein, 350 aa, Rhodopseudomonas palustris
MRSFRVTDFGKPLSEDNRPTPELTGTQVLVRVKAAGICHSDLHIWEGGYELGHGRKKLSLADRGVALPLTMGHETVGEIVAAGPDAKDAKIGQVALVYPWIGCGECDVCKAGDENMCLKPRFLGVYCDGGYSDELIVPHPRYLLSLDGLDPVTAAPYACSGITTYSALKKLDFCLDSPIVIFGAGGLGLMALELLKAMGGKGAIMVDIDAAKREAAQKAGALGAVDGAAPDALAQIAASAKGPVRGALDLVGNPQTAQLGFDCLTKGGKLVIVGLFGGGAPWALPFIPMRAITIQGSYVGNLAETQELLDLVRAKKVSPIPVTKVALPQAYDALIDLQKGKLVGRAVLTP

SEQ ID NO: 20852 - protein, 536 aa, Rhodopseudomonas palustris
  unsure (1)..(536): unsure at all Xaa locations
IGTPNSRXQRQGRHDAMTAELNAFPTAGTQTLRALARYPSRTAFAWPGGSLSYRGATDMIGSIQKVFMGLDLQPGTRVALLTANRAETWCAGVAAQLCRFAITWLHPLGSRQDQLDQIEDSEAAVLIVDAAAFLERGGELAAQASGLRHVFTIGRAGYGLDLLTALEQAGSATARDFAQLDDVAVLNYTGGTTGKSKGALRHHRENAGFANAILADFEIPFDPRYLTVAPISHVAGTKVLPSLIRGGTIHMMKGFDPEAVLQTIEREKINFTLFVPTMVYVLLDHPALAKTDLSSLDLVLYGASPMSPTRLVEGIERIGPVFSQLYGQTECYPVSVLRKADHDPKQPELFLSCGFPIAACDARILDENDQEVPLGEAGEICVRAPHVMAEYWKRPEQTAETLKSGWLHTGDIAKQDDRGYMYILDRKKDMIVSGGFNIFPREVEDVLSTHRDVAMVAVVGVPDDKWGEAVTAVVVAKPGTKPDERELIELVKTRKGSAHAPKQVQFVTELPMTGVGKIDKKVLRAGFWAGRDRMVG

SEQ ID NO: 20853 - protein, 459 aa, Rhodopseudomonas palustris
SFQEFGLADPIARALQEENYHTPTPIQAQTIPLALAGRDVVGIAQTGTGKTASFALPILHRLLQNRIKPASKTCRVLVLSPTRELSGQILDSFNAYGRHVHLSAALAIGGVPMGRQVRSLMGGVDVLVATPGRLLDLVQGNALKLTQVEFLVLDEADRMLDMGFINDIRKIVAKLPIKRQTLFFSATMPKDIADLAEQMLRDPARVAVTPVSSTVERINQRVIQLDHSAKPAALAQILKDDKVNQALVFTRTKHGADKVVKGLARAGITADAIHGNKSQNYRERVLAAFRTGELRTLVATDIAARGIDVDGVSHVVNFDLPNIPETYVHRIGRTARAGADGTAISLCAGEEMAYLRDIEKLIKVSLPKEDRRTPGAHAAPTPPPHRGPRQAPHGHSPRNGDAPTRGKNHRRRGPAAGPARQSDASRHEAAPRPQHGGNGEGLQGVAFLQRKNRPAQPTA

SEQ ID NO: 20854 - protein, 488 aa, Rhodopseudomonas palustris
FVMAIDQGTTSSRAILFRSDISIAASAQQEFPQHFPASGWVEHEPEDIWATTIATCRAAMDKAGATAADIAAIGITNQRETVVVWDAVSGQAIHRAIVWQDRRTAEFCTRLKADGLEPMVTAKTGLIIDPYFSGTKVAWLLDNVPGARARAERGELKFGTVDCYLLWRLTGGKVHATDATNASRTLLFNIHDGAWDDELLKLLGVPRSMLPEVKDSSAHFGDSVPELFGGSITIRGIAGDQQAATIGQACFTPGMIKSTYGTGCFALLNTGATPVKSNNKLLTTVAYQLDGKRTYALEGSIFVAGSAVQWLRDGLGVIKHASETGPLADKSDSAQSVYLVPAFVGMGAPYWNPRVRGALFGLTRNTGPAELAHAALESVCYQTFDLWAAMRADWPDADAATTVLRVDGGMTASDWTMQRLADLLDAPVDRPVIQETTALGAAYLAGLSAGVFPEPQKFADNWRLDHRFRPAMSAATRERKLAGWGRAV

SEQ ID NO: 20855 - protein, 500 aa, Rhodopseudomonas palustris
  unsure (1)..(500): unsure at all Xaa locations
RVTASGKKLNDQEKWKREQHPFDAYARLKQQAKDNAAPKPADNFRWRYYGLFYVAPAQTSYMCRLRIPNGILTSWQMAGLAYLADTLADGYAHVTTRANLQMREIAPKDAVQLLQGIESLGLWARGSGADNIRNVTGSATAGIDPQELIDTRAYARDWHFYILNERALFGLPRKFNVAFDGGGLIPTLEDTNDIAFQAVTIGDGHGVAPGVYFRLALGGITATRTLPATPAXSWRPTRRPRSADAIVRVFIEHGDRTDRNKARLKYVLDAFGFDKYLELVEDKLGRKLIRVPAEAAAPRPAQDRAAHLGVHPQQQAGMNWIGVRLATGHLTSVQMRGLAEIARSFGDGDLRLTVWQNLLISGVPDARVTDATAAIEALGLAITASPLRAGLIACTGASGCRFAAAHTKETAEAIAQYCEPRVPLDTPINIHLTGCHNSCAQHFISDIGLIGAKVAVSDEDSVEGFHIHVGGGFGVDAAIGTEVLRDVKQDDAPRVIERML

SEQ ID NO: 20856 - protein, 246 aa, Rhodopseudomonas palustris
LSGKVAVVTGSSRGIGRASAELLAKLGAKVVISSRKADACEEVAEGIRKEGGDAHVIACNISRKAEVDGLIDGATAKYGKVDILVCNAAVNPYYGPLLDIADEAFDKIMASNVKSNIWLCAAIPQMAERGNGSVVIISSIGGLRGSTVIGAYGISKAADFALCRSLAGEWGPKGVRINAIAPGLVKTDFARALWEDEANLKRRTAGTPLRRIGEPHEIAGAVAYLGSDASTFMTGQTIVIDGGVTT

SEQ ID NO: 20857 - protein, 367 aa, Rhodopseudomonas palustris
MDFDLSEEQRLLKESVEGLLKGSYDFDSRKKYAKEKGGWSRAVWGKFAEQGLLGLPFSEEDGGFGAGAVETMIVMEALGHSLVLEPYLPTVVIGGGFLRRAGSAAQKAAHLPGIIDGSKTFAFAQLEKNSRWDLGDVSTTAKKSGDGWVIDGEKFVVLNGEAADTLIVTARTKGGQRDRTGVGVFLVPADAKGITRKGYPTQDGLHAADITFTGVQVGADAAIGDPENALELIEAVVDDARTALCAEAVGLMDESLTTTVEYIKTRKQFGVPIGSFQVLQHRAADMFVATEQARSMAMFATMAAEFDDAKERAGAIAAAKVQIGKSGKFVGQQSIQLHGGIGMTMEAKIGHYFKRLTMIEQTFGDTD

SEQ ID NO: 20858 - protein, 396 aa, Rhodopseudomonas palustris
MDLNFSKEEIAFRDEVRQFFKDNVPAKTRQKLIEGRHNTKEEMVEWYRILNKKGWAVTHWPKEYGGTGWSSVQHYIFNEELQAAPAPQPLAFGVSMVGPVIYTFGSEEQKKRFLPRIANVDDWWCQGFSEPGSGSDLASLKTKAEKKGDKWIINGQKTWTTLAQHADWIFCLCRTDPAAKKQEGISFILVDMKTKGITVRPIQTIDGGHEVNEVFFDDVEVPLENLVGQENKGWDYAKFLLGNERTGIARVGMSKERIRRIKQLAAQVESGGKPVIEDPKFRDKLAAVEIELKALELTQLRVVADEGKHGKGKPNPASSVLKIKGSEIQQATTELLMEVIGPFAAPYDVHGDDDSNETMDWTAQIAPGYFNNRKVSIYGGSNEIQRNIICKAVLGL

SEQ ID NO: 20859 - protein, 393 aa, Rhodopseudomonas palustris
MTEAVIVSTARTPIGKAYRGALNATEGATLLGHAIEHAVKRAGIDPKEVEDVVMGAAMQQGATGGNIARKALLRAGLPVTTAGTTIDRQCASGLQAIALAARSVLFDGVEIAVGGGGESISLVQNDKMNTFHAVDPALEAIKGDVYMAMLDTAETVAKRYGISRERQDEYSLESQRRTAAAQQGGKFNDEIAPISTKMGVVDKATGAVSFKDITLSQDEGPRPETTAEGLAGLKAVRGEGFTITAGNASQLSDGASATVIMSDKTAAAKGLKPLGIFRGMVSYGCEPDEMGIGPVFAVPRLLKRHGLSVDDIGLWELNEAFAVQVLYCRDKLGIDPEKLNVNGGAISVGHPYGMSGARLAGHALIEGRRRKAKYAVVTMCVGGGMGSAGLFEI

SEQ ID NO: 20860 - protein, 514 aa, Rhodopseudomonas palustris
LAQAAKDYASRPALEFRDRQITYTKLEAMAETAAAALLAAGYGRDSSVALYIGNTPDHPINFFGALKAGARVVHLSPLDGERALSHKLSDSGARVLITTDSAALLPMAERFLAKGLLDRLIVCSDASWGESATPLAPLPSDPRVITYADFIKGASKPMAWPAIVPDDIALLQYTGGTTGLPKGAMLTHSNLTSAVAIYDVWGLVRANSGGIHRVICVLPLFHIYALTVILLRCLKQGDLISLHQRFDVAAVFRDIEEKRATVFPGVPTMWIALANDPSLEKRDLSSLTMAGSGGAPLPVEVARLFERKTNLKLKSGWGMTETCSPGTGHPPEGPDKPGSIGLMLPGIELDVVALDDPKRVLPPGEVGELRVRGPNVTKGYWNRPEESAHSFVGDRFLTGDIGYMDQDGYFFLVDRKKDMIISGGFNVYPQMIEQAIYEHPAVQEVIVIGVPDDYRGEAAKAFVKLREGAKPFSIDELRAFLTGKLGKHELPTAVEFLDELPRTTVGKLSRHELR

SEQ ID NO: 20861 - protein, 529 aa, Rhodopseudomonas palustris
FDTIVVGAGTAGCIVANRLSADPSRKVLLLEAGGRDNWIWFHIPVGYLFAIGNPRSDWMFKTEPEPGLNGRSLAYPRGKVIGGSSAINAMISMRGQAADYDHWRQLGLTGWGWDDVRKVFRRLEDHFLGDSEHHGAGGGWRIEAARLSWPILDAVANAACEMGIPRSADFNTGDNEGVGYFHVNQKRGRRWSSARGFLKPALHRSNLRLETNVVVDRVLVENGRAVGVRFLQNGVPIEARARREVVLCAGAIGSIQVLHRSGIGPAEWLKPLGIEPVLDRPGVGRNLQDHLQQRAIYKVSGGRTLNEIYHSLPRRAWMGLDYALRRRGPLTMAPSQLGIFTRSDSHQERANIQFHVQPLSLDKFGDPLHRFPAITVSACNLRPTSRGEIKLKSTALDAAPSIAPHYLSTADDCRVAADAIRVTRRLMKQHALATYHPEEYLPGPSVGDDDASLAKAAGDIGTTIFHPVGTAKMGRADDPLAVVDERLRFHGLEALRVVDASIMPTITSGNTNTPTAMIAEKGATMILED

SEQ ID NO: 20862 - protein, 454 aa, Rhodopseudomonas palustris
LDLAEMFAAREANRSSMHARHLNEQLVRVLKTIGYDVGFQKGTGQYLYDRDGARYLDLLSGFGVFALGRNHPVVRKALQSVLDADLPNLVQLDVSTLAGILAERLLEQVPYLDKVFFANSGAESVEAAIKFARGATGRNGIVNCDHSYHGLTYGALSLTDDQNFQGGFGPLLPGVTTIPFNDLEALEKVLSTREVAAFIVEPIQGKGVNMPTDEFLPGAAALCKRYGTLFVADEIQTGMGRTGRFLAVEHWNVEPDMVLLSKALSGGHVPVGAVLTRKSIFDKIFNRMDRAVVHGSTFAKNDLAMAAGIATLEVLKAEKLVEAAAKRGAELRLALTRMVPGYELLKEVRGKGLMIGVEFGPPQSLRLKASWTMLETANKGLFVQLITVPLFKDHKILTQVAGHGLHTIKLLPPLTITEDDCAWIERAFDDTIAASHKVPGAIWSLGKTLVDNAV

SEQ ID NO: 20863 - protein, 653 aa, Rhodopseudomonas palustris
MDSGSYTTGVERNALEASIDAARSALLNYRRDDGHWVFELEADCTIPAEYVLLRHYLGEPVDAELEAKIAVYLRRIQGAHGGWPLVHDGDFDMSASVKGYFALKMIGDSIDAPHMVRAREAIRSRGGAIHSNVFTRFLLTLYGVTTWRAVPVLPVEIMLLPSWSPFTLTKISYWARTTMVPLLVLCALKPRAKNPKGVDIDELFLQDPKTIGMPVKAPHQNWALFKLFGSIDAVLRVIEPVMPKSIRKRAIDKALAFIEERLNGEDGMGAIFPPMANAVMMYEALGYPEDYPPRASQRRGIDLLLVDRGDEAYCQPCVSPVWDTALASHAVLEADGHEGAKSVRPALDWLLPRQVLDLKGDWAVKAPNVRPGGWAFQYNNAHYPDLDDTAVVVMALDRARKDQPNPAYDAAIARAREWIEGMQSDDGGWGAFDINNTEYYLNNIPFSDHGAMLDPPTEDVTARCVSMLAQLGETMDSSPALARALGYLRDTQLAEGSWYGRWGMNYIYGTWSVLCALNAAGVPHADPMIRKAVAWLESVQNRDGGWGEDAVSYRLDYRGYESAPSTASQTAWALLALMAAGEVDHPAVARGIEYLKSTQTEKGLWDEQRYTATGFPRVFYLRYHGYSKFFPLWALARYRNLQATNSKVVGVGM

SEQ ID NO: 20864 - protein, 350 aa, Rhodopseudomonas palustris
LIDFVAQVFERAGSSKEEARRIASYLTTANLTGHDSHGVIRVPVYIRWRNAGAVHPDQTVDVPVDLPSLAVVDGKFGYGQTVGPQAVRIGIDKCKAQGLSAVALKNAGHIGRIGDWAEMAAAEGLVSIHFVTAAGSILVAPFGGVERRLSTAPYCVGIPRPDAPPVVLDLATSIVAEGKVLVAARGGKKLPQGALINADGSLSEDPATLYGPHEKDGPINHANGRGAIRAFGEHKGSGLALICELLGGALTGNGATGPDRPFANGMFSIYVDPKRIDPAHVFDAEVTRYIDFFKSSKTVAGVDQVLIPGDPETATRAERTRNGVPLPDDTWAAIVATAREVGVDEAAIQA

SEQ ID NO: 20865 - protein, 467 aa, Rhodopseudomonas palustris
HLIGGEIVAASSGEVFETASPIDNSVLAQVARGTAADIDRAAKAAKAAFPAWRDMAPAKRRKLLHTIADAIEARADDIAVLECIDTGQAHRFMAKAAIRAAENFRFFADKCAEARDGLNTPSDEHWNVSTRVPIGPVGVITPWNTPFMLSTWKIAPALAAGCTVVHKPAEWSPVTADMLARICKDAGLPDGVLNTVHGFGEEAGKALTEHPAIKAIAFVGETATGAAIMAQGAPTLKRVHFELGGKNPVIVFGDADLDRALDAVVFMIYSLNGERCTSSSRLLVQSSIADSFIEKLAARVRALKVGHPLDPATEVGPLIHQRHLDKVCSYVDVARKDGATIAVGGAPFDGPGGGHYVQPTLVTNARSDMQVAQDEVFGPFLTVIPFKDEAEAIQIANDVRYGLTGYVWTADMGRALRVADALEAGMIWLNSENVRHLPTPFGGMKQSGIGRDGGDYSFDFYMETKHV

SEQ ID NO: 20866 - protein, 331 aa, SYNECHOCOCCUS SP. WH 8102
MGKVKVGVNGFGRMGRLVTRLAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHM

SEQ ID NO: 20867 - protein, 260 aa, SYNECHOCOCCUS SP. WH 8102
QMLDMSNRASLITGGAGHIGVEMALSLAELGSNIILIDKDFNGLQLAKESILNVFNAQVVTIAADLEDEQSPSKIASIVDNKFGKVDVLINNAAFGGTTVLEGWTTTFAHQSLSTWRRALEVNLTSAFALSQACISLLNQSKSASIINIGSIYGFLGPDLSLYEGTAMNNPAAYAASKGGLLQLTRWMATVLGPDIRVNAISPGGVARGQPQAFVDRYVSRTPLKRMGREEDFKGAIVYLASDMSAWVTGQNLVVDGGWS

SEQ ID NO: 20868 - protein, 438 aa, SYNECHOCOCCUS SP. WH 8102
  unsure (1)..(438): unsure at all Xaa locations
SKIAIVDYGMCNLWSIKSAIQFIGYDSILTSDPKDILNSSAIILPGVGSFKTGMDNLLSLGLSQAIIDACMFRSIPILGICLGFQLLCCSSEEPSYTKGLSLLPIQIVPLCRHIDASFVLPHVGFTSVYTSKNDPLFKNIANKSDFYFVHSYGAFNVPHDFTTYSYCNYDAKIISSANVNHIMGVQFHPEKSQTNGLILLDNFLSFSNVXKAYYLVLLYCDGFFCLSRNFKLQRIGDFRWLQRNYNFNYSATFIDELIILDISRKSRDINKLPPYVXLSENIFVPITAGGGIRSFEDAKVLFENGADKVCLNTSLIQCPHVSEKISSVYGQQSLVASIDFKHDHGDFKFFIDNGLIEVQYNIQELISFLDPLPFCEILLQSVDRDGTGTGFDLTLANTFRDQLSKPIILLGGAGHSDHLVEGLLHQSTDAVATAHLLN

SEQ ID NO: 20869 - protein, 174 aa, SYNECHOCOCCUS SP. WH 8102
LATPYAEALLQVTEARGESQTVADQCKQLLEIWDSSADFRNAMVSPVLEPDAKKMALQALVGEQVTPSMLNLLKVLADRQRLLAFDAVMLRYLELYREQQGITLAEVRSAQTLTEDQQAALSKKVQAMAGTNMVDIDLSVDPSLIGGFVVSLGSQVIDASLAGQVRRLGLALAK

SEQ ID NO: 20870 - protein, 502 aa, SYNECHOCOCCUS SP. WH 8102
MVSIRPDEISAILKQQIEDYDKSVSVSNVGSVLTVGDGIARVYGLQQAMAGELLEFEDGTEGIALNLEDDNVGAVLMGEGLGIQEGSTVKATGKIASVPVGEAMLGRVVNSLGRAIDGKGEIATSETRLIESMAPGIIQRKSVHEPMQTGITAIDAMIPVGRGQRELIIGDRQTGKTAIAIDTILNQKDQDMICVYVAVGQKAASVANVVEVLRERGALDYSVIVAANASEPAALQYLAPYTGASIAEYFMYKGKATLVIYDDLSKQAAAYRQMSLLLRRPPGREAYPGDVFYCHSRLLERAAKLSDAMGKGSMTALPIIETQAGDVSAYIPTNVISITDGQIFLSSDLFNSGLRPAINVGISVSRVGGAAQTKAIKKIAGTLKLELAQFAELAAFSQFASDLDASTQQQLERGKRLRELLKQPQFSPLILAEQVAIVYAGVKGLIDAVPVDKVVDFSRELREYLKSNKPEFITEIQEKKLMSPEAEAILKDAISEVVSTLV

SEQ ID NO: 20871 - protein, 315 aa, SYNECHOCOCCUS SP. WH 8102
MANLKEIRDRIKSVKNTRKITEAMRLVAAAKVRRAQEQVLRSRPFADRLARILENLQSRMRFEDASSPLMEQRDVETITLVSVTGDRGLCGGYNANIIKRTEQRFAELTGKGFKVKLVLIGNKAIGYFTKRDYPVQATFSGLEQVPTADEANTISTDVLAEFIGAGTDRVELIFTKFINLVSCKPVVQTLLPLDPQDIADPEDEIFRLTTKDGRLTVEPGAGPANTEPKIPSDIVFEQTPEQLLNALLPLYLQNQLLRSLQESAASELASRMTAMNNASDNAKELAKTLTLDYNKARQAAITQEILEVAGGAAAV

SEQ ID NO: 20872 - protein, 435 aa, SYNECHOCOCCUS SP. WH 8102
SSIHASRRQRFLDQLGAAAAVIPAAPLATHHADCEWPFRQDSDFFYLTGFDEPDAVALLLPHRPEGERFVLFVQPKDPAAEVWTGFRWGTEGAVERYGADIALPLDQLSARLPEFLDGAEAIAFRVGRHPAVEPLVLSAWGRQLDSYARCGAAALGLVAPTPILHRLRLRKEPHELDRMRLACRISAEAHELARGMTRPGMNESEVQAAIEAHFRAAGARGPAYGSIVAGGDNACVLHYTANTAGLQDGDLLLIDAGCSIADYYNGDITRTFPINGRFSAEQRDLYSLVLAAQEAAIAVVGPGGTAEQVHATALRVLVEGLVDLGLLVGEPDGIIEQGDYRHLYMHRTGHWLGLDVHDVGAYRLGEQPASLEPGMVLTVEPGLYISDRLAVPEGQPQIDDRWKGIGIRIEDDVAVTNGGHEVLTAAAQKSLAAME

SEQ ID NO: 20873 - protein, 544 aa, SYNECHOCOCCUS SP. WH 8102
MAKRIIYNENARRALEKGIDILAESVAVTLGPKGRNVVLEKKFGAPQIINDGVTIAKEIELEDHIENTGVALIRQAASKTNDAAGDGTTTATVLAHAMVKAGLRNVAAGANAITLKKGIDKASDFLVSKIKEQAKPIADSNAIAQVGTISAGNDEEVGKMIADAMDKVGKEGVISLEEGKSMETELEVTEGMRFDKGYISPYFATDTERMEAVLDEPYILLTDKKIGLVQDLVPVLEQIARTGKPLMIIAEDIEKEALATLVVNRLRGVLNVAAVKAPGFGDRRKAMLEDMAVLTNGQLITEDAGLKLENAKLEMLGTARRVTINKDTTTIVAEGNEAAVGARCEQIKKQMDETDSTYDKEKLQERLAKLAGGVAVVKVGAATETEMKDKKLRLEDAINATKAAVEEGIVPGGGTTLAHLAPSLEEWANGNLSGEELIGANIVAAALTAPLMRIAENAGANGAVVAENVKSRAISEGYNAATGDYVDMLAAGIVDPAKVTRSGLQNAASIAGMVLTTECIVADLPEKKDAAPAGGGMGGGDFDY

SEQ ID NO: 20874 - protein, 511 aa, SYNECHOCOCCUS SP. WH 8102
VAPVVLTILDGWGHRNDSEHNAIRQGDTPVMEALWHAYPHALIQASGSHVGLPDHQMGNSEVGHLTIGAGRIIRQELVRISDTVRDDQLNNTPALVELAEHLQNDTGTLHLLGLCSDGGVHSHVNHLCGLIHWAAAAGIKKVAVHAITDGRDTPTQSAMGSITLVQRAMEEAGVGHLASLCGRYWAMDRDKRWDRTEKAYDLYTDPTRSISDQSPQQLLAESYAAGITDEFLKPVRLSDDVMQDGDSVLVFNFRPDRARQIVQTLCLDDFDGFERRTTPKLDVVTFTQVEQDLPVSVAFPPEPLDDLLGQVVAEAGLRQYRTAETEKYPHVTYFMNGGIEQPLPGEERHLVPSPRVATYDLSPAMSADQLTDSCIDAIDQGTYSLIVINYANPDMVGHTGVMDAATEAIATVDRCIGRLLDAVGRRGGTMLITADHGNAELMQGPDGQAWTAHTTNPVPCILVEGEQRKLPGHGNDISLREDGGLADIAPTLLQILNLEQPAAMTGRSLIE

SEQ ID NO: 20875 - protein, 157 aa, SYNECHOCOCCUS SP. WH 8102
PVTDSPASDAAQSSVVLTSEQIAGLLPHRYPFALVDRVIAHEPGVSATGIKNVTVNEPQFQGHFPGRPLMPGVLIVEAMAQVGGLIVTQMPDLPKGLFVFAGIDGVRFRRPVVPGDQLVIHCELLSLKRKRFGKVKAEAKVDGELVCSGELMFSLVD

SEQ ID NO: 20876 - protein, 687 aa, SYNECHOCOCCUS SP. WH 8102
PLALSGIHPGTPWPLGSSITPRGVNFSVAAPAADRIELLIFKRASASTPERVIELDARRHRSGDYWHVELEGVGEGCCYGYRVFGPLAPGGHGFQPAKVLVDPAARAISGWDVYDRVLATGPTPNAHACLKAVVTERELFDFQRHPRPRHSWQRSVIYELHVGGFTGRDDSGVSPEQRGTYLGLIDKLPYLKELGITAIELLPVFCFDPADAPPGRDNVWGYSPLSWFTPHHGYGCGDDPLQLRHQVRQLVAACHDANIEVLLDVVYNHTTEGTRLGPTLSWRGFADRTYYHQTSSGDYLDVSGCGNSIAANQPISTQLILESMRCWALELGVDGFRFDLGIALSRGNQLKPLDQPPLFRAIEADPQLSDLKLVSEPWDCGGLYRLEDFPAQRIGTWNGHFRDGLRRFWKGDEHSTWTLAQRFKGSPDLYNDKPVALGRSVNLITAHDGFTLADLVAYNRKHNLANGEDNRDGENHNNSWNHGVEGPTTDPQVLALRRRQQRNLLSTLLLARGVPMLLMGDEVGRSQGGNNNSWCQDSPLSWMVWNDDHCDLELKLFLQRLLKLRQALPQLFNPLVPPRKPAASNPRTPTDLWRQWHGVELSKPDWAAWSRTTATSLHMGSRGALLWMGFNAYNEPLNFELPVPASPWMQLIDTSLPAGEDLPAQAVPYDAVDIPLASRSLVLLLAR

SEQ ID NO: 20877 - protein, 259 aa, SYNECHOCOCCUS SP. WH 8102
TYRGRYAPSPTGALHLGNLQTALLSWLQARQAGGVWLLRIDDLDTPRNRPGAVEAIQADLHWLGLDWDGEPILQSCRRGLYASWLSWFRRSGALFPCRCSRRELAGLARYPGTCRDGGAGWGWRDRRLPSWRLRVPSRDPDGSGDVVVRRADGFIAYQLATVIDELALGITDVVRGEDLREALPAQRSVYRALQQQPPRFHHGPLRCDAEGRKLSKREASSGLMALRELGLDAPAVVGLLASGLGYGPPGARLSAIELL

SEQ ID NO: 20878 - protein, 600 aa, SYNECHOCOCCUS SP. WH 8102
VLVVGTGLAGASAAATLAQQGYRVTVLNFHDSPRRAHSVAAQGGINAARSLAVDGDSVSRLFTDTLKGGDFRARESGCQRLAEISSGIIDQCVAQGVPFAREYGGSLATRSFGGALVSRTFYARGQTGQQLLYGAYQALMRQVELGRVRMLTRRDVLELITVDGVARGVVARHLLSGALEVHTARTVLLCTGGYSNVYFLSTNALKSNASAIWRAHRKGALFANPCFTQIHPTCIPSGDAFQSKLTLMSESLRNDGRIWLPLETGDKRSAEAIPEQERDYFLERLYPSYGNMAPRDVASRRARELCNAGRGVGPGGRSVYLDLTDAIKTEGREAIAARYGNLMTMYERISGDDPYRKPMRIYPAPHYTMGGLWVDYQLMSSIPGLFVLGEANYSEHGANRLGASALMQGLADGYFIAPSTVTAWLAGNAAPDVTPDNPACCEALESTRRRIETMLASGGTTPVDSFHRELGAVMIDRCGISRDAEGLRDGLSQVEALEKRFHGEVRVPGEAAGPNAELEKALRVSDFFGLAQLMLRDALAREESCGAHFREEHQSPEGEARRDDVNFAHIAAWEHQDGAEPIRHSETLQFTALQPSTRSY

SEQ ID NO: 20879 - protein, 421 aa, SYNECHOCOCCUS SP. WH 8102
RDRQQAEAELQRLTRRTQTSQQKDVQGRVDVILKAVRERGDAAVCDFTERFDGFRPDPVAVPKHQLEQAWKALPENLRDALELAHRRISEFHQRQRPEDIRMEGAHGEQLGRRWRPVQRAGLYVPGGRAAYPSTVLMNAVPARVAGVEQVVICSPAGSNGQVNPVVLAAAHLAGVHTVMRIGGAQAIAAMAFGTESVPKVDVISGPGNIYVTLAKQAVYGQVGIDSLAGPSEVLVIADQSAQPEQVAADLLAQAEHDPLASSVLITTSHQLADGISSAIAQQLEDHPRREICEASLRDWGLVVVCDDLETCAQLSDSFAPEHLELLVERPEALADRIQHAGAIFLGPWSPEAVGDYLAGPNHTLPTCAAARFSGALSVETFMRHTSMIQFNRAALDATASAVCELAESEGLHSHAESVRKR

SEQ ID NO: 20880 - protein, 413 aa, SYNECHOCOCCUS SP. WH 8102
LWPPFTQIESAPLPQRVIAGDGALLLREQGIPLIDAISSWWVTLHGHGHPVMAKAIADQAARLEQVIFADFTHEPAERLGERLSKLTGLDRLFFSDNGSTAVEVALKIACQWWVNRGEPRHQIVAFDGAYHGDTFGAMAVGERNLFSEPFDDKLFPVARCPWPATWWDDPDVDAREQAALAVLETTLQQPTAAVILEPLLQGAGGMAMVRGTFLRQVEMLVRQAGALLIADEVLTGFGRCGDWFACHRAGIQPDLMALSKGLTGGCLPMGVTMASERVFSAFVGADPSLTLWHGHSFTANPLGCAAANASLDLLQQDPDQFRGFEARHRPHLEQLRAHPNVTRCRLTGTVAAFDLSVSGDAGYLNPAGPTIKRIALEHGVFLRPLGQVVYLLPPLCISNDQLGQCYKAIATAL

SEQ ID NO: 20881 - protein, 379 aa, SYNECHOCOCCUS SP. WH 8102
VTAQTDAMASQDPARRRTLHTWSSADLPWTLQRAETEQQPLLDLASNDYLGLSRHPAVIDAATEALHRDGVGAGASRLVTGSRPCHARFEADLADWLGRSCVLLFPSGFQANLAAVCILADRHTTVLADRLIHHSLLVGVRASGARLQRFQHNDLTDLERRLQAMAGQPGSLVVLSESLFSMEGTSPDVAALAAVCQRFGADLLMDEAHALGVLGAEGRGLCFGIEPVRLISGTFGKAFGSGGAFLACDADLGDALLQTSGAFRYTTALAPPLVAGAQTALDLIRSHPHWSQQLQQRASHWRDALEGQGWSRPAGVGPVLPLLLGSDTAALAAQAVLEEHGLLSVAIRPPSVPEGTARLRLVLRRDLPNETVEQLLKAL

SEQ ID NO: 20882 - protein, 882 aa, SYNECHOCOCCUS SP. WH 8102
DPSKIFPFPLDDFQLEAIDALNQGHSVVVSAPTGSGKTLVGEYAIHRALAHGQKVFYTTPLKALSNQKLRDFREAYGDDNVGLMTGDLSVNREASIVVMTTEIFRNMLYAEASEQDDPLADVEAVVLDECHYMNDSQRGTVWEESIIHCPPSVQLVALSATVANAGQLTDWIQKVHGPTTLVLSDYRPVPLQFSFCSAKGLHPLLNDAGTGLHPNCKVWRAPKGHKRKGRSAKPPQPEPPPISFVVAQMAERDMLPAIYFIFSRRGCDKAVRDLGIQCLVNKEEQARIRARLKAYSSENPEAVRDGIHADALLRGIAAHHAGVLPAWKELIEELFQQGLVKVVFATETLAAGINMPARTTVIAALSKRTERGHRPLMGSEFLQMAGRAGRRGLDSRGYVVTVQSRFEGVREAGQLATSPADPLVSQFTPSYGMVLNLLQRHDLNKARELVERSFGRYLASLDLVEEEDVLSQLRLQLGQLEGVAGDIPWEDFEEYEKLRGRLREERRLLRILQQQAEETLANELTLALQFASTGTLVSLKSPQLRGRVTPAVIVDKIEGPGQFPLLLCLSDENLWLLLPCQSVVSIHAELSCLQVDGVTAPDLHKAGELRHGDQASGGLALAVAHVARRHDMTMPQYDLAGEVLTQARTVQALEQEQEAHPAHRWGDRKQLKKHRRRMEELEQEIEERQRLLHHRSNRHWETFLALLEILQQFGCLDELTPTEIGRTVAALRGDNELWLGLALMSGHLDDLSAPDLAAVFEAISTEVNRPDLWSGFPPPPAAEEALHDLSGLRRELLRAQERLGVVLPAWWEPELMGLVESWARGTDWSDLIANTSLDEGDVVRIMRRTVDLLAQVPYCEAISEQLRSHARQALRAINRFPV

SEQ ID NO: 20883 - protein, 456 aa, SYNECHOCOCCUS SP. WH 8102
MRQEHDSIGGVDVPAAALWGAQTQRSLNNFAIGHQKIPAELIHALARIKQCCAAVNGRHGLLNDQQVALIERAGQAIQTGQQDDHFPLSVWQTGSGTQTNMNVNEVISNLAAQESGENLGSHRPLHPNDHINRSQSTNDVFPAAIHVAAALQLQQELLPELKRLIASLDAKAVAWQDIIKIGRTHLQDAVPLRLGDEVSAWRDRLSDGAHWLTTAHQDLLALPLGGTAVGSGLNTPDRFAHEVCAELASRTGSDFQPADNLFAVMAGHDSLVQTMAQLRRLAVTLLTIANDIRLLACGPRAGLGELLLPANEPGSSIMPGKVNPTQCEAMAMVCTQVIGMDAAVAAAGAGGHLQMNVYKPLIGYNLIEGIRLLQDACRCFRLNLLTGMEADRDRIAFYVERSLMLVTALTPEIGYEKACAIAQHAHRDGLTLREAAMQSGAITDERFDQLIDPAAM

SEQ ID NO: 20884 - protein, 287 aa, SYNECHOCOCCUS SP. WH 8102
RKGIILAGGSGTRLHPITQAVSKQLLPVYDKPMIYYPLSTLMLAGIREMLIITTPHDQEAFQRLLGDGSRWGMTIQYAVQPSPDGLAQAFLIGADFLDGAPAALVLGDNLFHGHDLVPQLVSSDGRAEGATVFAYPVSDPERYGVAEFDADGRVLSIEEKPKQPKSRYAVTGLYFYDATVVERARQVKPSARGELEITDLNQMYLDDGKLKVELMGRGMAWLDTGTCDSLNDAGGYIRTLEHRQGLKVGCPEEVAWRQGWISGEQLESLAQPLKKSGYGTYLLQLLE

SEQ ID NO: 20885 - protein, 265 aa, SYNECHOCOCCUS SP. WH 8102
LGVIGLGRMAQALVEPLLSSKAFSAEQVLAVVGTVATAQRLRQGAFAGVSIQSSRSAEAARVWTAPIQLLAVKQQQIDGIAAAAPVAENQPLLVSVLAGVSLDRLQRLFPGHRVVRAVPNTPALVGEGLTALAWGEAISSEQRLKVREMFAGVSEVLELPEDKLDAFLALTSSGPAFVALMAEAMADGAVAAGLPRDLSHRLAHRTLAGTAALLDQRQLHPATLKDMVTSPGGTTIAGVRALERAGARSALMEAVIAAAERSREL

SEQ ID NO: 20886 - protein, 613 aa, SYNECHOCOCCUS SP. WH 8102
ELERVDAVWPWLAERHGTITAVDAPHAAHAERFSFAELAQRIATAAAAFQRQGVQEGDVVALFAENSPRWLVADQGLMRCGAADAVRGASAPVEELRYILDDCNATALVVQNADLWRRLDLTASQRQGLRLVLQLEGEPEQGVLGWEAFLASGAGQQSVTPTSARTAIATVLYTSGTTGQPKGVPLTHANLLHQMQSLACVAHPQPGAPVLSVLPIWHAYERSASYYFLSCACTQTYTNIKQLKKDLPRVRPIAMATVPRLWESVQAGFEDVVKTFPPSRQRLLRAALANSAAHRKAVRTARNLLLQPVALPGRMTAAAVAALRWPLHALASALIWPKLRLQLSGGRLAYPISGGGAIAPHIDAFFEAVGIELLVGYGLTETSPVVSCRRPWRNIRGSSGLPMPDTEFRIVDQESGASLGFRERGRVLVRGPQVMGGYLGKPEASAKVLSADGWFDTGDLGMLLPDGSVALTGRAKDTIVLSSGENIEPGPLEEALVASPLIEQVMLVGQDERQLGALLVPRVEPIRAWASEQGLSVGEDLGGRPGDSVLLNLLMRECNLVLRLRPGARGDERLCGVGLVEPFSIENGLLTQTLKQRRDRISRRDAAVIERIY

SEQ ID NO: 20887 - protein, 438 aa, SYNECHOCOCCUS SP. WH 8102
HDIFMPALSSTMTEGKIVEWLKQPGDKVGRGESVLVVESDKADMDVESFQDGYLAAVLMPAGSTAPVGETIGLIVETEAEIADAQAKATSAAPAASAPAPTPAPAAVQAPAPTPAPTQAPAAPAPVAASAAPVANGRVVASPRAKKLASQMGVDLSTVRGSGPHGRIQAEDVEQAGGQPISVPRVAEGTAAAVAASAAPSAAAPSAPAGNSFGRPGDTVAFNTLQGAVNRNMEASLAVPCFRVGYTITTDKLDAFSKLVKPKGVTMTALLAKAVAVTLARHPQVNAATTAAGMTYPAEVNVAIAVAMEDGGLITPVLRNADRTDLYEMSRQWKDLVKRSRSKQLQPEEYSTGTFTLSNLGMFGVDRFDAILPPGTGAILAVAASRPTVVAGKDGSIAVKRQMQVNLTADHRVIYGADGAAFLKDLAELIEHRPESLAL

SEQ ID NO: 20888 - protein, 372 aa, SYNECHOCOCCUS SP. WH 8102
LSTRVIHHGESFAGDTGTVMPPIFPTSTFAHGNAGGFDYTRSGNPNFRILDSVLASVEGCAHATVFASGVSAITAVVSQLKQGDLVLCEENLYGCTVRLFEQVFAKFGLKTAWVDFTQPAALEQIQAQTPAMVWLESPTNPLLKVIDLEAVCAITQPLGIPVVVDNTFATALVQRPLDLGATLSLTSTTKYINGHSDALGGAVCTNDHEWHQKMVFSQKALGLQPSPFDCWLITRGIKTLPLRLKQQMANAAALADQLADHAKVNWVRYPHRSDHPQHQVATRQMRAGGAIVTVSFNACQEQTYALCKQLRWFTMAESLGGIESLICHPATMTHAAVSAEVKAKLGIDDGLVRFSVGCEDLADLQADLEQAL

SEQ ID NO: 20889 - protein, 318 aa, SYNECHOCOCCUS SP. WH 8102
LVMSASLSIAAVCVGTSIPLTLAALPLWILYGAVTGTIAMGCWVLAHECGHNAFHPNRRVEGVVGFVLHSALLVPYYSWARSHAVHHAHCNHLEGGETHVPPRESSPQGQATEKLKRKLNTRLFGLISLFNHLIIGWQLYLFLGATGGEDYGFPTSHFWNDAPFRNGKRALFPSSFRKYMVRSNLGLIAMMTLLIGASIHFSFARIACLYGLPYIVINIWLTSYTWLQHTDRNIPHFSNETWDWAKGALQTVDRPYGPVLNFLHHGIGSTHVCHHINSAIPHYNAWRGTVILRQRFPDLVRYDSTPIHRALWRVATAC

SEQ ID NO: 20890 - protein, 421 aa, SYNECHOCOCCUS SP. WH 8102
IGVGLLGLGTVGGGVAEILLNPEERHPLVADLDLIRVAVRNVNRPRTVELSDAVLTTDPSEVVNDPNVDVVVEVIGGIEPARSLILQAIANGKSVVTANKAVIARHGPEIASAAKAAGVYVLIEAAVGGGIPIIEPLKQSLGGNRINRVSGIINGTTNYILTRMANEGAAYADVLAEAQRLGYAEADPAADVDGLDAADKISILSALAFGGTVDRDALPTTGISALQGRDVEYARQLGYGVKLLAVAERLAGQGDPLPLSLRVQPTLVPSDHPLAGVNGVNNAILVEGDPIGRVMFYGPGAGAGPTASAVVADILNIAGIRQASGDQGPVDPLLAAGSWRPCVLADSGDIRQRHYVRFNTEDAPGVIGKVGGRFGDAGVSIQSIVQFNASEAGAEIVVITHEVSQRKVIAALDAITSLDEV

SEQ ID NO: 20891 - protein, 347 aa, SYNECHOCOCCUS SP. WH 8102
SAVTAPRKRRVFPFTAVIGQEEMKLALLLNVIDPRIGGVMIMGDRGTGKSTTIRALADLLPDIEVVAGDPYNSSSTDPDLQSSEVRERMERGDSISTEPRQVPMVDLPLGATEDRLCGTIDIEKALSEGVRAFEPGLLAKANRGLLYVDEVNLLDDHLVDVLLDSAASGWNTVEREGVSVRHPARFVLIGSGNPEEGELRPQLLDRFGMSVEVSTVRDPELRVQVVDQRTAFDSDPDGFSTAVEANQDALQQRVVEAQQRLGQVSIDDDLRLRISAVCGELDVDGLRGDIVTNRAARALAAFEGRTEVSEEDVARVASCCLRHRLRKDPLEQVDSGDRVVKVFCKVF

SEQ ID NO: 20892 - protein, 287 aa, SYNECHOCOCCUS SP. WH 8102
VPGMALRLDGKALAATVERRLTSVVDAHSKTVGQPPGLAVLRVGDDPASAVYVANKEKACARVGIASYGAHLAADTPADQVLSTIQSLNADPRVDGILLQLPLPKGLDERPLLEAIDPEKDADGLHTLNLGRLLKGEPGPRSCTPAGVMALLRSNGIDPAGQRAVVIGRSILVGQPMALMLQAANATVTVAHSRTADLAAHTREADIVVVAAGRPGMVGAEHVRPGAAVVDVGIHRKPEGGLCGDVVAEEVEPIAAALSPVPGGVGPMTVTMLLVNTVVAWCRRHGI

SEQ ID NO: 20893 - protein, 290 aa, SYNECHOCOCCUS SP. WH 8102
FDFKAYLAKAKATVEQALDQSLVPERPESLREAMRYSLLAGGKRLRPILCLAACELAGGDAAQAMPTAVALEMIHTMSLIHDDLPAMDDDDLRRGRPTNHKVYGEAVAILAGDALLTRAFEMVALRSPGVPPERLLKVVGELSLVAGAPGLVGGQVVDLESEGKEVDLETLEYIHLHKTGALLSACVITGAMIGGADDELIAALRVYARGIGLAFQIIDDILDITASSEVLGKTAGKDLIADKTTYPKLLGLEESRKRAADLVQEAKGVLKPWASKAQPLLALADYITSR

SEQ ID NO: 20894 - protein, 85 aa, SYNECHOCOCCUS SP. WH 8102
RWRLLIHGRVQGVGFRASCNRRALDLGLRGWIRNLRDGSVEVQAEGPPLAISELRAWCEQGPPGAQVLRVQLSQLPVTGDDWFEV

SEQ ID NO: 20895 - protein, 506 aa, SYNECHOCOCCUS SP. WH 8102
MVATATNPLRVGLRQERVIAPQCLVIFGASGDLTHRKLVPALFELFKQRRLPSEFALLGCARRPWSDDEFRGKMAEALASKIAENQEAWDQFVSKLFYEPVDLQQPEDVVRLGKRLETVDQQCATRGNRTFYLSVSPKFYGSGCRALADAGLLKDPQRSRVVIEKPFGRDYGSAQALNRVVKSCGQENQIFRIDHYLGKETVQNIMVLRFANTIFEPIWNRNYISSVQITAAETVGVEERAGYYETSGALRDMVQNHLTQMLAITAMEPPGRFDPEAIRNEKAKVLQAARLADEQEPWNCCIRGQYGPGGSHDAPLAGYRQEPGVDPNSTTETYVAMKLFVDNWRWQGVPFYVRTGKRLAKRLSEVVLTFREAPVHLFDAATGGPTANQLILRIQPDEGAEFRFEVKSPGSGMRSRPIDMEFSYDESFGEPSDEGYVRLLADAMLSDPTLFTRSDEVEAAWRLYTPLLELIEDSPWQLPIHPYESRTWGPAAADALLARDGLLWRR

SEQ ID NO: 20896 - protein, 872 aa, SYNECHOCOCCUS SP. WH 8102
ISSQSAASAMVSAAPVRLADYSPWPFALPAIHLAVDIRPGDVLVTSRLDLEPRGGAEALQLRGVDLEICSIKLNGDDVAGDDYSYRDQLLTIHSPPSKPFVLETCCRIDPYNNSSLEGLYVSGGLLSTQCEAEGFRRITFHPDRPDVLSRWTVRIEASRASCPVLLSNGNAISEEELTDGRHAVTWKDPFPKPSYLFALVAGELREIRDLYTTASGRAVTLRLHVEEGDEPYSTHAMESLKRSMAWDEQVYQLEYDLDEYNIVAVRHFNMGAMENKSLNIFNSKLVLADAETATDAELERIESVIAHEYFHNWSGNRITCRDWFQLSLKEGLTVFRDQSFTADLHSAAVKRIEDVAMLRNTQFREDAGPTAHPVKPAEYQAIDNFYTTTIYEKGAELIRMLHTLLGQERFMRGMATYVSRFDGTAATTEDFVQSIVDGAAQDGQPLGFDSERFKRWYHQAGTPELTVQRQWDAVKGELTLELRQSTPPTPGQTEKQPLVLPIAVALVGEKGRIGEEQLLVMDGDQASLTLQGDPGSAAPALSLLRRFSAPVNVQLEQSLQESLQLLAHDDDPFSRWDAGQRLARQVLLARASGEPDATVEAALIQALRQRLNAFDGGGGQDLAVLLALPGTAELEALQNPVDPPALYAARREWIAELGRQLADPLNQLLDVCRGEWPQAWPAGQGGRSLTGLAWSWLAAAGDAEARNQALEAVSGPSMTLARAALRALQPMEVDERDLALDRFYQRWQDKPVILDAWFALEASAPRTDGLQRVQALLEHPRFDPLAPNSLRAVLGGFTANVPVFHAIDGSGYRFMADQIAAVDRRNPITASRMAKVFSRWSSYGVDRQSAMRQAIDQLAAGELSSNTAEVVA

SEQ ID NO: 20897 - protein, 354 aa, SYNECHOCOCCUS SP. WH 8102
HRVVLLPGDGIGPEITAVARQLLEAVSQRHGFELCFDGQLIGGSAIDACGEPLPASTLDACKAADAVLLAAIGSPRFDNLPRDKRPETGLLGLRSGMALFANLRPVKIVPALIGASSLRPEVIEGVDLMVVRELTGGIYFGQPKGRIQADGEERGFNTMTYSSSEVDRIARVAFDLARERRGNLCSVDKANVLDVSQLWRDRVDAMAPAYSDVEVSHMYVDNAAMQLVRSPRQFDVLLTGNLFGDILSDEAAMLTGSIGMLPSASLGSDCPGLFEPVHGSAPDIAGQDKANPMAMVLSAAMMLRIGLKQTEAAADLEAAVDKVLAAGFRTGDLMAEGCTALGCRAMGDALLKAL

SEQ ID NO: 20898 - protein, 357 aa, SYNECHOCOCCUS SP. WH 8102
MALVPLRLLLDHAAENGYGIPAFNVNNLEQVQAIMEAADETDSPVILQASRGARNYAGEIFLRHLILAATETYPHIPVVMHQDHGNAPDTCYSAAINGFTSVMMDGSLEADAKTPASYEYNVAVTKQVVDFAHSVGVSVEGELGCLGSLETGKGEAEDGHGFEGELSKDMLLTDPAEAADFVAKTKCDALAIAIGTSHGAYKFTRKPTGEVLAISRIAEIHKAIPNTHLVMHGSSSVPQEWLEMINKHGGAIPETYGVPVEEIQEGIRNGVRKVNIDTDNRLAFTAAVREAAMADPANFDPRHFNKPARKYMKQVCLDRYQQFWAAGNASKIQQQTINYYAGLYAKGALDPKAAVAA

SEQ ID NO: 20899 - protein, 335 aa, SYNECHOCOCCUS SP. WH 8102
MRIGINGFGRIGRLVFRALWGRPGIELVHVNDPAGDAATAAHLLEFDSVHGRWDRGISSDADGFSVEGSPLTWSSEKDPTAVPWTARGVEMVLEASGKIKTPETLSPYFEQVGLKRVVVACPVKGDVAGEEALNIVYGINHDLYEPDRHKLVTAASCTTNCLAPVVKVVHESFGIEHGMITTIHDITNTQVPIDAFKSDLRRARSGLTSLIPTTTGSAKAIAMIFPELKGKLNGHAVRVPLLNGSLTDAVFELKQSVTVEQVNDAFKAASEGALKGILGYEERPLVSCDYTNDNRSSIIDALSTMVVDDNQLKVFAWYDNEWGYSCRMADLTCHV

SEQ ID NO: 20900 - protein, 171 aa, SYNECHOCOCCUS SP. WH 8102
LDLQTYIRSIPDFPKPGILFRDINPLLRNPAAMVEVMRRLGAICDAVQPDLIVGIESRGFIVGTPLALQRSLGFVPVRKPGKLPGAVIGVDYALEYGTDRLEIQSDALTGNPRVLVVDDLLATGGTAAATGSLVRAAGGELVGFAFVIELEPLGGRSALPDEVLAESLIRY

SEQ ID NO: 20901 - protein, 273 aa, SYNECHOCOCCUS SP. WH 8102
IPVVVAGALGRMGAEVIKAVVGSADCMLVGAIDNTPGKEGSDIGLELGLGELEVAVTADFEGCLCAVSQSVRDAEAGAVLVDFTHPSVVYEHTRAAIAYGVHPVIGTTGLSPEQLSDLCQFAAKASIGGAVIPNFSVGMVLLQQAAAAAARFYDHAELTELHHNCKADAPSGTCIKTAELMEELGKSFNPAEVDEHESLAGSRGGRRESGLRLHSLRLPGLVAHQEVMFGAPGETYTLRHDTIDRSAYMPGVLLTVRKVRSLQTLVYGLERLI

SEQ ID NO: 20902 - protein, 1349 aa, SYNECHOCOCCUS SP. WH 8102
QAATRRKVLHIAQDAQMFTQVRSADRRVAPVEGQSHKSVMKAVYVVLEPQYQNALTQAATALNASGSELGIELSGYLIEELRDEENYAGFCEDVAQADVFVASLIFIEDLAQKVVDAVAPHRDRLKAAVVFPSMPEVMRLNKLGSFSMAQLGQSKSAIAGFMKKRKEAGGAGFQDAMLKLLNTLPTVLKYLPVEKAQDARSFMLSFQYWLGGTPDNLKNFLLMLADKYVFPPAEGEERPAMEVAEPEVFPDLGIWHPLAPMMFEDLKEYLNWTASRTDLSEEARKGPVIGLVLQRSHIVTGDDAHYVATIQELEFRGARVIPIFCGGLDFSKPVNAFFYDPLNPEQPLVDGIVSLTGFALVGGPARQDHPKAIESLKKLNRPYMVALPLVFQTTQEWEDSDLGLHPVQVALQIAIPELDGAIEPIVLSGRDDATGKAHTLQDRVDAIAERAIRWSSLRIKPRIDKKLAITVFSFPPDKGNVGTAAYLDVFGSIHRVMEEMKAKGYDVQGLPSTPRALLEAVINDADAMQGAPELSIAHRMSVEEYERLTPYSERLEENWGKPPGNLNSDGQNLLVFGRHFGNVFVGVQPTFGYEGDPMRLLYSRSASPHHGFAAYYTYLQKIWKADAVLHFGTHGSLEFMPGKQMGMSETCYPDSLIGALPNLYYYAANNPSEATIAKRRGYASTISYLTPPAENAGLYRGLKELGELVGSYQQLREGGRGIQIVNTIIETARQCNLDKDVDLPEDDASTLELDGRDALVGAVYRQLMEIESRLLPCGLHTIGKPPTAEEAVATLVNIAALEREEDGLRSLPGLLAEAMGRSIEDIYKGNDYGVLADVELNRTITETSRAAIGAMVRSLTGLDGRVSMRNSFGWFYDLLAKFGLKLPSPWLRACCGAGFVQIDATELDKLFAYLRFCLEQVCADMEMESLLKALDGDYILPGPGGDPIRNPGVLPSGKNIHALDPQAIPTRAAVAAAKSVVDKLIERQREEQGTWPETIACVLWGTDNIKTYGESLAQILWFVGVKPMPDSVGRVNKLELIPLEELGRPRVDVVVNCSGVFRDLFINQMALIDQAVKMAAEADEPLELNFVRKHALEQAEKEGTSLRDAACRVFSNASGSYSSNVNLAVENSTWEEEGELQEMYLSRKTFAFNADNPGEMNQKREVFENVMKTADVTFQNLDSAEISLTDVSHYFDSDPTKLIAGLRDDGKAPTSYIADTTTANAQVRSLSETIRLDSRTKLLNPKWYEGMLDSGYEGVREVAKRLNFTLGWSATSGAVDNFVYEEANDTFINDPEMRKRLLELNPNSFRQIVGTLLEVHGRGYWETSDENIEQLQELYQEVEDRIEGV

SEQ ID NO: 20903 - protein, 241 aa, SYNECHOCOCCUS SP. WH 8102
VRRPVIAGNWKMHMTCAQARDYMAAFLPQIERAPQDREIVLAPPFTALSTMAAAAEHSVVGLASQNVHWQDHGAFTAEISAEMLLEHGVAYTIVGHSEPRKYFSESDEQINHRARCSQAKGLIPIVCVGESDEQRERGEAERVIRRQIEQGLEGLDANKLVVAYEPIWAIGTGKTCEAAEANRICGLIRSWVGATDLIIQYGGSVKPTNIDELMAMSDIDGVLVGGASLKPDSFARIANYQ

SEQ ID NO: 20904 - protein, 567 aa, SYNECHOCOCCUS SP. WH 8102
RLLPLLRPHLRQLMTGGLCMVVYVGSFPVLVSLAGELFPALGSKDLSRVLQLIAQAVLIFAVQKLAQFGQDSLLAEPALLVSQRLRRELFSTLQRVELGALEKLSAGDLTYRLTEDADRVSEVLYKTIHDTVPSVLQLLVVLGTMLWLDWKLTIAILLLAPVIVWLISLFGAQVMRATERSQKKVSELAGLLGEAIEGLPLVRAFAAEPWLQDRFEQEISQHRQARQRTYLLVALQHPVVGIIEVIGLFAVLGLAAWRIESGDLTIPGLSSYLTGLIVLIDPIAHVTNNFNEFQQGQASLRRLREIEQEPLEPSDPADSVSLGDVKGALSLESLSFHYVKGQTVLDRLDLQVPAGSVLAVVGPSGAGKSTLFSLLLRFNTAQQGSILLDGVDISSMRSRELRQRVALVPQRTTVFSGSIAEAIRFGRRATHEQMVSAARLANADDFIQALPDGYNTKLEERGSNLSGGQLQRIAIARAVLGDPAILLLDEATSALDAEAEAAVQLGLNRAMADRTVIVIAHRLATVQEADKIVVLEHGRIVELGSHAELMNAYGRYRDLCERQIIRG

SEQ ID NO: 20905 - protein, 1106 aa, SYNECHOCOCCUS SP. WH 8102
LPMPRRTDLRRILLLGSGPIVIGQACEFDYSGTQACKALRSEGYEVILVNSNPASIMTDPEMADRTYIEPLTPDVVTRVIERERPDALLPTMGGQTALNLAVTLAENGTLERYGVELIGADLQAIQKAEDRLLFKQAMERIGVQVCPSGIASTLEEAEAVGAAIGSFPRIIRPAFTLGGSGGGIAYNPEEYAAICKSGLEASPVSQILIEQSLLGWKEFELEVMRDQADNVVILCSIENLDPMGVHTGDSITVAPAQTLTDREYQRLRDQSIAIIREIGVATGGSNIQFAINPDNGDVVVIEMNPRVSRSSALASKATGFPIAKIAARLAIGFTLDEILNDITGKTPACFEPTIDYVVTKIPRFAFEKFRGSPAVLTTSMKSVGEAMAIGRSFEESFQKAMRSLETGYSGWGGDRPEPELSEADIDRLLRTPSPERILCVRSAMLRGRSDAEIHRISSIDPWFLAKLRSIVDAEQQLLRGRQLGDLSAPKLLELKQLGFSDRQIAWQTDSDELSVRRHRHDHGIRAVFKTVDTCAAEFASTTPYHYSTYERSIQQLNSDGSLTTLSPASEVSNSSSGRKVMILGGGPNRIGQGIEFDYCCCHASFAAQDAGITSVMVNSNPETVSTDYDTSDSLYFEPLTLEDVLNVIEVEQPDGVVVQFGGQTPLKLAIPLLNWLNSEEGRATGTQIWGTSPESIDRAEDREQFEAILSQLEIRQPRHGLARSETEARDVATRVGYPVVVRPSYVLGGRAMEVVFDEQELNRYMLEAVQVEPDHPVLIDQYLENAVEVDVDALCDHEGNVVIGGLMEHIEPAGIHSGDSACCLPAVSLGEGALGTIREWSRGLALALKVQGLINLQFAVQRNAEGEEVVYIIEANPRASRTVPFVAKATGQPLARIATRLMAGETLQQVGLTTEPQPPLQTIKEAVLPFRRFPGADTVLGPEMRSTGEVMGSADSFGMAYAKAELGAGEALPTTGTVFLSTHNRDKPALVPVAERLAKLGFDLIATSGTADVLTKAGLTVNAVLKVHEGRPNIEDMIRSNQVQLVINTPIGRQAAHDDKYLRRAALDYAVPTVTTLAGARAAVEAIATLQSQPTLSINALQDVHG
